United States Patent 9,487,797 (GENOMIC PLANT SEQUENCES AND USES THEREOF) - sequence listing, part 77

SEQ ID NO: 76252 - DNA, 7233 bp, Oryza sativa
tggtccgcatgtcatttactcggatggtcccacgtgtcagtgtcacgaatggcaatataataaaagtgacgacatgatagtagcaaatctcaccatttttttctacgctaggaaggatgagaagatactgatgatgtgggaagaaaagctagaagcaagaggagtaatcaattgtgtgaaggtggctgtgtggacgtggattcatgtttccatcctcgggagatgtgagacatgtgccctcgtcgctacatcagcacaacagcccataccactggccctagctactgtacatagcagcaaataactggaaatgggttttggcagcgtttggttcttgtagctaggtttaattcctttgtttagataaaaaatagacactactgcaacagattaaattagtttatggtgttagcattaccctttttgatcaatgaatgtatacctctccagcaagtagtaaatgtgtcatggacacacatatatatagatagttgatatccaatgcaatatgcgaaaagcataaatggcatggtttatttgattccggcggtagtataatctttcagtgtgtgtgacacacatatatctcacatagtaaaaatggtatatatgaagaaagaaaaaatgttaactatccatatcctatacatatgcaagacatatatatatatatatagataggaaatatagcggaataactataagtctataatattatcaaagaacaaataaaaacaaaacagtctacccgcaaaataaaagtaaaaacaaaacaggaaagtagatgaattaacatcatatatatgcatcgatctttcctgccattttctctaagaatttttgttcgctaagaattaatgttgattctcagtcgatttaaaaagggaaaactacgcatgattcaaaaagagaaaaaatgataatagacacaaaataggggatcgatccatatataaggaccaaagcgcatttcttattcttactgctattaatttgtcaagcaactcttcacggagttttcggattaatccatttggcattgatcatctctctcctgagtatatatgtcactactgtttgtggtttcatgcatgaacaaaatttacaccagcagtttgattaaatgcgttttactcttagttacttgagaaacactgaggggtcttccggctagctccaaaaggtggtgagctaaatgacctgagtttaaagcctcactctttctaattatttgatattaggaccttgcctaatatttacatttttttactcaattttacctttcacaattaagcgcctttaatttgtgtaaaattttggcatgcgcatgccgtcagtcgtctgcaaatttatctccaggtcattttgtaaattattttcatcatcttgctcatgagtagtgatcacttttctattgatgaaattcccagctcgggatataatttatggagatcgatacactttatatattttgaaccccttttttcagcctgttaattaacgttcatatataggtgtactagcaggaattaatcgtatctttcgtgacgatctcagctgtcgatagtctacaacttctggatatattatacttatcgtccttatacagattacctgcagcaacgtatcttttgatcaacttcatcgcttctagaattctcaattaacctgcaggacagtgtctataatttctgacaaaaggcacacgttaatttctgagcagtgcgtacgtttttgtttctgttcctttcttctgctcgtttgcgttctttttccagttagtttcttcacatggcctcaattatataattaattagctagctagcttagttcacatttgcatcggatcgatctttggacaaatatatatttgcagtgattagcaataaggaatctcttcagttttcccccttttttcatcttcgtttagtttacggattacttcgtaaattaagtttgaactgcatgagtgtgttgatctgtaccacttcttttgtttgatctatattaggtaaattaagctgcaaccttccaagcaatactggaagtatatttgctgtctgtcacatgtctcacatcatattattgtaggccaaattaaacccgggcaattaaatacaaggaatcgcaacaacattaacttaggttacgagcatttttacgggatgtatacgtatgtctactgcatgtcatatataccttttgtggatgcatgcgtggataatatatatatctgccttcgatctgtaatacctttcatgcaagaagttaatttgaagctgcatttttgcacactctttgaaggaattgatcattatatatacatcctagcatttgtgagcataaggcacaaaataattcaattaattactgagtagagaattttcttttcaagagagagactagcaaatacaataataaaacacacagcataacgtaatctacaccatgtctaactacatatatacacctgcgataagctaattggctatgcttgcaaacgccaattaatgtgtagttaaaaacccgactaaaacacttttgtaatttggatacggtgatttgtacgtaataaacattcaaatgaacccgtaaaaaaatatgcatatgccttttactagaaaatatatgtaactaataactattatagaatttttaagcgtttcgtgctttatcttatcatgcaaaacatgcatagtataggtccttcttttgacaactgaagttctcgatcagtatttgcagtacattttgcaaaatagtgggccagctagtaggatttttttatacacagcacatacatcttgttaaaaaaaaatagtgcgtctagtgtgagtggttttacaaaatagaggacatgttcattccaatatttaaaaacaaaccatgaaataaatccgttggattacatatcatggccaccaattgtataaacataagcgttcaaaaattacttccaaaatttagatggtagtgatttgggaccatacatatgccaaaagtagattttctaaataacaagattaatttaatcagtaaaagccactaggaaatgttacgattatttactatgattttattttactttagaaaacatatatatgccctgttttggaattgagcaggtttatttatgtcaatatacaattttgcctgagacgacgtgtccttttcctctgaaccacttaccaattcaaaattcttacatttatgtacttgcacattctattatgtctagtactaaacaaaggtataatttgttaaatctaagcaatttaaggtatactaagactgcccctaatttgccataacttataaaacaaagtacttaaaattaaattccttcttgtataaaaaaagatttccttctcgaatttaaaacaacattagtacgttcatttcattcacaaggtcactttcaagaaataagggcaaccgatgggtttctccccaatctcatcagtcatgcagcagaggcagctgcagggaggggttgcagaagcatctgtgcacagagaatccaggatctgaaatgggtgagggtgagagatcgaatcagatgccaacaccacccgatccatccatccatccatccacaacagcatagagacccccactagcttttgctccactcacgcaaacctatgcagagggccagccaaaaggaaaccctaaccctaaccctaaccacaggtggcttaaccctaacccaaccctaaccggggtgcaggcaattaaataatggtgacaataaaataatgagaaaatgggtgtgtggggctaggaggagtagtagtaccagtagcttggtgggggaaagcaatcaaagcattcaaggagggggactgtgtgaagcaaaaggacaaaataatggtggtggtttgctgctgctgctgtgatgccttttcattttggtgaggcaatgtgcacaccaaatagtgcacctcagaaagcaacatctctctctctctcgtggtggagtatacactgcaatatattaattgcatgagtttaaggggggaatggatgtttaggggctgatttggtcagggtttggtgggtcatatacagggggtttgtttggattgatgcttattaatttgttttatagaaatatgaggatatctgatatactctgaaatttgactgttcatatgttcagaaataaaaaattgtatcattaaacatatctgtaataattttatgattatatcttttaaaaagtatatatagtcaaaattacaactcgaaaaccatgaaaagtcaaaacgtcaagtaaaatagaacaataacaaattatgttgaatcagccattttatcatctttctagtcaatagctgttaattagctttgtgtgtttaactcaacaaaacaaatacggagtagtatggtaacacagttaaacacttaaactacgtatataattttataaattatttcctatcattaaaaacctatctgttacgtgttagctagtgttgttttatttttttaaccccttagtttacagaaaattctctatatccaaatctctattagtaatttgttttttcttccctataattcgtgagcgcatgtgcatacacacacacacacacatatatatatatatatatatatatatatatatgcatgcaaaccttttaatttgtgtgattgtgtcccatcctctcttttcaggctgatatgcatctcccctttacccccacctaccactccttgccgcttagtttccttgtatgtgttcattgtgcgctccatccacaccaaactcactcatgtttccctctttttcccacttttgagcaacatgactatgttatgacaaagatagatcggtgctcttgctgctaataagggcccgtttgaaactctatatattgaagtagcatgcatattaccactgattaattaagtactaattattataagtttgaaaaattatttgattttagaaaaaaattatatattgaaaatatttgcacgaaacgtgttgtttatagttcgggaagcgtgctaaaggaaaatggaaaagttgtagtttggaggtgaagtttaacactcaaatgtccttgatttttatctaccattgtgcgctccaatccacccggccacaccaattttttaaaacatattttggttaatgtatagtagaagcattccaaaaaagaggtgcagacagaaaataatccaattaattagacagtacaattttcatactttcaagcagaggaggtgcaagacaaaagaagattaacaagagggtattatacttgcgagggcaattttgcacttactggcctaaactacaatgggaaggtagatcggagagaaacggaaatatttgctacgcgtgtgtgtgagagagagagagagctagatcagggcaaaatggagaaaaccaaaaatatcaatctagcaaagagaaatttaagaattaaaacaatggaataggtagattgaatcaaacataaggaagaaaaaaaaaggggagaaaatgaaagcgcaagctaaaaaaagaacataattaattacgatgatgaactcagcccgttcatggagataaatagcatgactgtcgttagatgtaccacacgccaacgcctactagagggggagagggtgtgttaggggcggggggtgttccagactatacgtctttcattcatataatctgattaatatgtatggtgaatttaggtaaaacagcgaatccaaaatataaagaaattatcacacattattcagatccaacaaagagaatagaaggattaaaacaaggatccagtaaataaaatcatacggagaataaggaaaaagaaaagggagatcacaaaaaaaaatacattaaatggtctacaatatcaaaggtaaatccacaacgcaaacaaaattatcaaacattttgtaaatgatctgaatttttcaccatttccaagcatgaggaggaatctcacggtcgaaagtttggaagtgaaaatgggccggcatagaccatgcacacattttgcactagaatagtagctattgtggaagaagataaaacgctatatatatgttttggtcgtgaaacagtacatattgtaccatagtagaaaaaatgttacagatctaaaagggaaatgctaacgacatcgtacagacaaattaagataggaaaacaagagaattcacatgatattgcataattacaatactccacatctctacaagctgtgtcctttgggacaaatagggaattctatataaagactccaagtacgtacagttttctcgaactttcttattgagtttcttttgtgacatcacgaaccaaaaaaaccatggcactaattgacaccgtatcttttacaaattcatgcactatcgaaacgtaccccagattatattatattagaaatataaattaattaaccctctgaattgtcgtttatatataggaagctaattactaagagagatctggtatgcatatatagaagaaaaaagagaaaatcccctatgtacccatgaaagttcacctaatcccttctatacctctgaattttgctcaatcccttacatacccctgaattttagtttgaatcccttccatgccctttccgctagttgacagttagttgaccgttaaattcttttgaaaaagttcattttgccctttgctatgaagaaacataataaattaatgaagtatattgttggaatataaaaatttattggatgagactattatatttatgagtatgtgatgcaccatattatttgtgacaaatttacttttacatatgatataaaaagttgatacttatttattagttattaaaagttcttttatgtagcataggtgttttcatagtaatacaacaaatttgtttatcacttcagaacacatatgctaaaaaaatcttttaatagccaataaataagtattaatgttttatgtcatatctaaaagtatatttatcgcgaatagtatggtgcataactatctcatatacataatagtctcatataacaaatttctatgctccaacaatatactctattaatttatatgcttctttataccaaagggcaaaatggactttttcataataatttaacggtcaactagtggaaagggtatggaaggaatccaaactaaaattcaggggtatgtaagggattgagcaaaattcaggggtacacaagggattaggtgaactttcaagggtacacaggggattttctcaa

SEQ ID NO: 76253 - DNA, 8142 bp, Oryza sativa
acttgtttatattttggaatcgatgcactagatggtcattttagatatattgtatacatagttagagtagcaagtatgctgtgtgtactttatctagaaaacgtaaataattcttctatatcaagacttcaacggagaacacacagctgtcgtaatatctagcgaagcaaccattgaaaaccttactaggaaagtaattaactactacccccatctctaaataagtacatttttagcatgtgaagcacaaattaatagggaatataaataaataactatgcctccaaataaaataggaaaatgctatacatactaattttttcttactaaattcttactaatagtactgatgtatcatgctataagtacatctagatcttttataactttcatctacctaaatcaaatgattgagatgattgttagtaaaaacttagtacgtgtaacagagctcaattaaataagagatggttgaaagtgctgaaagtgtagagatggttgggggtaagatgtgtagaaattttaaataagaaacgatttatgaaacatgtactagcaccttagaagtacacttattttgagaaaaaaaaactagagccatagaaacaattagggtgtgtttagttcgcgaaaagaaaatttttgggtgtcacatcggacatttgatcggatgtctaaaggtattttcggacacgaatgaaaaaactaatttcataactcgcctagaaaccgtaagacgaatttattaagcctaattatttcgtcattagcacatgcgggttactgtagcacttatggttaatcatgaactaattaggctcaaaagattcgtctcgcgatttccatgcaaactgtacaattggttttttttctttttatctatatttaatattttatgcatgtgtccaaagattcaatgcgacattcgtgggaaaaaaattttgggaagtaagggcccctttgattcgcagaataggaaaaacacaggaattgaaattgaagtagtaggtttctcaaatcctataggaatcagcaaacataggaaagacaataaaagtcctttgatagtgctatgggaaaaacaaaggaaagtttacaaagaggtcacacctcttactatttttcatatgaaatatgaagtataggaatacgatcctatgaaaagttttctttctttcctatgaatcaaagggatatgtagaaaaaaattataggaatttaaatcctatgaaaatcctttgccaatcctataaatcaaagaggccttagacaaggccttagcacaagggacggagggagtaggtacaatacctggtacgtaaagcatgttgctccccgggtggaaaaacctaggaagcaattaactaggacgtcccatccataagatcaaggaatagcttagctataggattctcacatcatcagagtttttcgtagatctaaagattgccaaggatgggagagatatctctagtcttctggatagtgcgtagtactccatactccctcggtaaaaaaaaaaaagacaaaccctgatttccgtgtgtaatatttgatcgtccgtcttatttaaaaaaattatgaaaaaaattaaaaagataagtcgcgcacaaagtattaatcatattttatcatctaacatcaataaaaatatgaattataaaaaaatttcatataagacggacagtcaaaattggacacggaaatccagggtttgtcttttttttggacggacggagtattcttttactataatatagagaaaaaatattattatatgtagcaccatcaggtaggagtattagctagctagtactacactcgatgactaaatactagctagtactccagtgtctcaagagtagatcagcacacgtcgatcagaaatccactgtactttgctaggagtagtactatacctatctcgtacaaacgggattaaattaatatagattgtatcattaaactactaattaagtaattaagaaacgtacaggtcgattaatttgatgtgtaatgacttgatcgaactaccggctatagctagctagctagtcaaggaagaaattatgatggatgcacgcactactccagtattaatatattgatgtgtattttttttgccagttcacgaaaacgacttaagtatatatatggagtaggccacagagatcaaaaagatactgggtgcggaattttttttattttatagacctttttatgttttaattttattaatagaccgttaaaaaaatattttcaaatttgaaccttttgattgtgtcagcccacctgtaatggccaaatagctctgtcacgccacaatactggccttccatgccattatggcattatgactagcgtggccaaacagccctgcctcagctggcgtggcaagaaggttcatttcttgaaattttttttgaaaatgtctattaataaaactaaaacataaaaaagtctaaaaaataaaaaaaattattgggtgcgtgacagatatatattaacccatattttaagtaattaattaagaaacgtacacatgcagaatgcatgaattactggccggtcatatatgcaagaggctcatgcagttctggcctggtgtttgtggggttcataattggtctggtccatgtccagagcgttttcagtggtgatggatggaatattggaatctagcttatgtcagtccagaaagtatatgatcaacccctccatatagcaagaaaagagatctcagtgtgatatatatgttcagaaaaaacaaggaaaagagatcagtgataatttcgcagacatctgttgatggtgcactaattaatccatctgctgctcataagtacacaccagacagatcatgtgctagatgagtgagatgtaaatttatatatgctttaatttaataataatcatgtgctagatgccttttttagcaggggctactagatgcatgtgtaattgtgtatactgttggtacgaagatggcttaattaattggtggttaggaaattgagaactatatatatacatgaatttaccaaaaaaattgaatcttattaatttggttcaacgtgacaaactagtggtaatgtatgatgaaataacttaattatatagcgaactcgtgggggtcatgccgtcatgacaaaacacaaaggggagtagaatgtatacgctcatctatgatagtaatatataagttcataagttctttaaaaaatatataagttcataattaaagtctttttttcacttctgtacagtacagttatattttcttgctgtgtaatatgcacaaatatgtgtgcaaagttgaaaacagatcgtgcagagtaccatatcagacgatgttttttcatcttgagaattatactcgatcctatttattatcagttcttttccaatcgatcgagaaggaatatccagtagttagtactattagttaatcataattaatagctaaaattaagaaaatataaccttatatattactgcatggtcacacacacgaatgctgacacgcatcccagagcatatggtatagaaagaggaaataagctgttgcagaacatatataggaatggaaattaaagttgaaaacaaatcaatactacaattaacttggagtacataaattaaaaatgatataaacaattcaagtttatatataaatgtgtgtgtgtatatatatatatatcactgatcgaggcatgggccaacttagttgggtcccattggtcattaaataaattggccgggtcacatcggccattagctagacaactggactgctctataaattgtccatatcccagtatcatcatctttcttatctcgtccctttccccatcactctcatccctgccccaacaccctactagtagtagagtattctaacaatctcaccacaacaattaaccattagtttttctttatcttacgtatatactactcctacaaagcaattaaattaataattaaacgacgaaacgatcgaagctagctacccctccgtcaaaaaaaaaagtctaatcctaacaatgaatctggacacgcatcgttgctagctatgactggattttttatcgggaaggagtagtatgcgtagctagctaagtactactccctccgtttctaattgtttgacaccgctaactttttagcatatgtttgaccattcgtcttataaaaaaattatgaaatatgtaaaaatatatgtatacataaaagtatatttaacaatgaatcaaataataggaaaagaattaataattatttaattttttaataagacgaatgattaaacatatttaaaaaagttaaaggcataaaatatttaaaaacggagggattatatagttacgcgcgcggcggcagcgactggccggccgcccgccggcggcgagaggattgtgtatgcaacaggtcagttgttgtagctagttgtgcttatttgagggcaaaagctagttatactagctaggtatgcagctgcggttattgcagctcatcacctggatcgatcgcggcctcgccggcgacatctctactccctcaaaaaaaaaaaaaactaagatgaaatacaattcaagacaatgaattaccctatcccatctttatctaggagtaggttagattttttttagacgaaagaaatatgttgtcacgatacgaggttacgatggataaacactgtcagaaggagtaatgaaaatgtagatttacaccgaagagaaaaaacatttatgcatctgattcattgctttggtctgacccaatgcctgcgacatttatgcatgcatgtgtatatatgtacagttaattagtcagtgctagctagctagacatatatgaccgagtttagttccaaaatttttcttcaaactttaaattttttcatcacatcaaaactttcctacacacgtaaacttccaacatttccatcacatcattctaattttaaccaaacttttaattttgacgtgaactaaacacaccctatatgtagaaaagccggaaaatgaaaggagaataaagaagcatggtcgtcttaggggcctaagtcggttgtgtgaccgtctagggcccaagttggtatgggacccatcaccaaccaaggtggtcacaccttacgttcaattcccacgtggtcacaccttatttcatcgtggctaagacttgtgatgttttcgtcttctcattgcatctaattagtctgaaaattgggctagtattttgttttgttcctgttaattaatttacacaatatttttaggtgtttataatatctgttagcatcatttttgattatatatgatttataacagtatatattacaaattatttaatcttgagggtgtatgttactaggtttgcctaaaaccctctaaaatatagagctggggctgtgaggaaagaagcatgtaatgaggtccgtttgtttatacgtgttggatgattttgaatttctgataattattaattgatgtatacgaatgtattaaattttgtaagttaaaatattgttttaaaatgttttttctaaaaatataatgatgaaaaaggttccaaagaaatcttacttcctccatttcataatataagactttctagcattgcctacattcatttagatgttaatgaatctagacatatgtatgtgtttacattcactagcatctatatgtatgtgagcaatgctagaaagtcttatattgtgaaacggatggagtgctatttagcagcttaatgtatcactgatcatctctaccaccaattagccacgtgtccacgcggtaataataagcaattgagttaattattacctctagctatatatagtcatcttttcgcttatacttatacttatcagccaaaatttaaatttttaaccttaattttggaactaattttgaggtttttttcatcaaagtttatttttcagcctttactgttagatagctaaaaacacgtgtataaaagttttatttacaaattacttttcgcttattccataagcgaaacgatagctagtatctgcatgcctagctcgcttgtcatgcatactggaaagtggatatacatgccaagggatatatatatatacatatgctacgtacgtaacgtacttatgtactgcgtacacgcgatgtacactagcaatggcgcatggaattaactaattttgtacgtgcaagctatagctagctagcgcgtgtaattgaagcaaagctcaaatagtctatacggctgcttgtacgcgtgcgaggaatgacgtcctgtacagcatgagagtttgagcttttttcgctcacgcctatatatatgtgtgtgaagaaaaaccgattctagagaaataaatttgaacatatataatgttgcccaaattcatccagaacttttttttgacagaagtagcttgccacgtcacgtcttttactgagttcttcttatcagtttataagataagctattttcttgtttatcttgaacatgtttcgatcctagctagactgctaacaatacatttcgtgaaagaaaaagttatatataaaagtttccttaaaatcaaataaatttgtttttaaatttataatagttaatacttaattattcggcgctaataacctctaaactaactagctcagccgaactaactgctatttcaaacgcatccttagctagataaaccataacttttttatgtggtttgctgtagtttcttagtttttttctacagcttaccatacataatttcttagggcttgtttggtttggagtaaatttttaccctacagtagtgtcaaaacattggtaaattttggcactatcaaattgggtagtattcaatttaaactattgtggataaaatttggtagcaaaccaaacatacacttgctactattgaagttaccaaaattttggtacggtaataaattgatatcaaaacaaacaagcccttagcaccttacgtgttctatgtatgtgtcatagactcggtggctgttcagattgatgacattttcaactataccattttggtaaagttactaaaaaactatttatgtttagtttgttggcaaatttaataaatacataataaatcctaccaaaattttagcaatattaccctcttaccaattgccaaaatttggtaaggtttattttggttataatttggacaggccctcaattcctagccaacctctaacatatagtatatcaacaggggcggagttaggattatatcaagatcactagagtatgaatttcttgaacaaattttaatagaaaaattagtaaattccttggtattttttctgcctgatcgtaacagttattttccacattatgcaagcttgtgacgacacgagcagcgcatgcaatgcaacgcgggggcagtgcgtcgcggcgcggggggacgggtagctaaggtttaatttgctaccgatcagggcgcggcaaactgaagccgggaagcgaccgatcgagatcatgagcgatgcgtggagccgtgtggacgcatgcatatgcagttatgcaagcagagtacagacatggcaggagtactagctagtaggatatcacacgcccggtgtgctgctgcacaaaattaatactacgtgcatgctccagttgcaagttcctatcgtggatgtatggataaaaaggtcgtaaatagtcttgctacgtaatccctctgtcctaaaaaaaagacaaaccctgggttttcgtgtccaacgtttgaccctccgtcttatttaaaaaaaattaaaaagataagacatgcataaagtattaatcatgttttatcatctaacaacaatgaaaatactaattataaaaaaaattatataagacaaacagtcaaacgttggacacggaaacctagggtttattttttgggacggagagagtactccccaaaaaaaaacttagaagatgatgttactcctagtataatgactctggacaaatggatgcccagatttgttatattatgaggggttgtccagattcattatattagccattaggaggagacacattctctcctaggtttttttttatggatggagtatctctatatataacacggctgattttattcagttattgtcaataatattttttttgaat

SEQ ID NO: 76254 - DNA, 41290 bp, Oryza sativa
gtaactacaaagaaataaaatttcgcccatatgattatgtgttttcaaactaaatagttcgagatgtattgataatcaaagttttaaaactttcacggaataatgttgactgtcagagagagtattaattgtggagctcctagttaattgaacagtaaaaaatgtttttaagactgggaatattgttagataataataatctgaaacgtcataacaatgtccaaagatgtgaaagaaggttggtgatgacagtatataacacgtcgtgtagtagcctttaatttaccctctcttctcttggcagccgggcagtaataaatatgtactagtgacgctgacctgcactccttcacgcaaatacatatatatggacagtagactagctgttgcgtaccatcaataaagatatccatatcatatctagattgggtggcgttcatcgaagatgcctcttttagcaggtaggagtagggtacagcagagactgccaccaaggcaagtacggacacagtcctgctatattaaagacagtagtatatcagaggggggaaaaatacatgcttattatactagatcatcaattaatttaccagcgtatcctctcagcggccgtgatcagtacacacggtactgtatgtataacgaatcaaatgaaatcaatcggggccgggcatcgtacaaaaccggaacaagattatacattcaaatgctacaacagcgtatgatcaagccacgtggggaaaaaaatgtgtaacaattacacaagagatattagacctcttcacactttttttttaatactccatttgattgtttctcattaagccttgttctgctttgttttggcaatgctaagaagatctccaaacagcttgtcctcaggcttcgatggttgccccatggaagatgatgatgaaggtgttgtagagtagggcgagctgttcatccccatgtaagagctgtcttgcatggagaggccatacattttctgggagaggtcattcataccagcgtagtatgttggcctcccttggctgttgctgtagtattgtgccgcttgctgctgcacaagccggtactgggacatctgggggccatacattcgtggttgcggcatggctgcaaactgcatacccggcatcatcatcggttgcgcatacatcatgactggctgcgctcctggcatcggcgaaggttgcatcccggggaattgcattcctggcatggagtgtggtggcatcgaaccgaattggttcgcaaagcctgattgcatctgggttacagcaggttggctgggttgcatggctcccggttgttggttgttgtacatttggtgggcttgtggacctcccatctggttcatctgcgggtgcaagggctgcatcccacccatctggtttgatggtgttgggagagatggcatacctccaaattggccgtttgacaccgggtgagactgcataccgccatttgacatgtcgccgcttggcgctgactgagcttcccaaggaggtgggggaagggctccactttgctcatctacaaaattcaggagacccatcagaatttcttcaaagctcaaacagaacacaagcatggacatgcgtggttctgacatccaatgatagggatgatggtgtaggaaaaaggttgagaaatgtaaatgtataaataaattgcaataccataattcactgtttgctgcgctggaggcgtcgcattgttcgcaatttgaccattccacccagaacttgtggggtatgatgttccagggttcacagctcccccattaggatagaggcccacctgctgaggctgctgctgtgcttgcagaggatgctgggttggagcattgtatggctgtgatccaggaagagtagagctagaattaacaccaaagggatccgcaggtttggcaatgttattggttgtgttgttttgagagaatatgtcaacgatagctagtgcattttgacttggagtagaatcaactactggatcagtaactgggacaagcgctagtgaattttctgttgtagatgggttgtcatcccagctaagaagatcgacgccaagatcggattttggtgctggggttgctgagccatttgacaccggaggtgctggaagcgctagttgctcaaatggtgactgcacactggcactgttacaaaggcaggtcacatgcaaacagatgttattaaagaagccaggtaaaacatgataaataatcaaaaaaaaaaagttacgaatatagatcatcactatggtctagtgatactatgaaagccaagagaaacaaacaaatcaacactaaatgcagtttggatcataaaatttggctaggttcaagaaatgcacatttatctttattttagagagagaaggttctacctacgtgctttctctcaacaactatctttttagttctacaataccttacagagctgagagccacagtttgctctgtttgctaccaaaacaccctctaccataagttacagaaaacggatattcaacaaatttgtaaaagacagcactacgatttccaataccaccaattcaagtaaaataagaacagtcggattgtagatttagtgtagaaaacaaaaactgataccacaccaggtagcagttaagggccccaatcagtagtcacagtgattaccatgaggagtcagtagtcacaggccaaggctcctcatatgcaaacagtggctaccatgtataagatgtacatatgcaaataggctggcatatggacctaccctccaacatgtcctaataattttgatatactagtactgtgcagaaagggagccatgggtgtgattgttcagtggtttgggtcactagcatttgtagatgccattgggcttccatatagccactgaccttttatgattaaacaagagaaagtagtgagaagatgagaaaaatttagccccagggtataatttgatgataaaatggattgcaggggtgttgataaaaacaaaaaaaaagtactatctccgtttcaggttataaaactttctagcattgcgcacattcatatagatgttaatgaatctaggcacacatatatgtctagattcattaacatatatgaatgtgagcaatgctagaaagtcttataatatgtaacggaggaagtacttgtcaagggtataaatgcattgactatcagacttgtaggggtgttcataaacaaaaaatatatgtacatatgtggaggtaagcagcaatggtgatgactttttggattttaatcggtgtttatgatactggctttatcaggaacataaataggaaattttatacacatgacaacatgttgtctggaagtgcatatgttcacaagcctaaacagctacactacactgggcaaattgctgccaatagcagaaactgtattgatcaattacaatgtacaaacttgtttgttctttagaccaagtataattagcagtttagaagaatagaactctgcaatggaaaaggagaagcctgaaatacccacagaaacatggtggatggtacaattgtacatcaccaaaactgaagaactatattacagtgtttaagcacttgttaataaagaataatggctaattactaataaaaaaattgtttccagcatttatgcacaaaaatcgcacgcacatgggctgatatcattcaatattacctagaaataagaaatatgcaaatgtgacaggagaagattataacctttggcttggttctttattagtctcttgggttgtaggatcctcaatatctacaagtgcctgctctttcttagagtcttggttcatagaatcctcagtgtctacaagtgcctgcagagacttaggtttcttctccactcgaactgcaatgcctgcagcaattgcatcgtgttttgcgagaacacgttgcaagtcatcattcagtgcaagcccttgtgacataagttcctcatccctgtaaatggccaaaccagaattttagtatatatgttgcaataaatagttaaatgagataatacagatgccagccaagggctacttttgccagcttttcatgagtgaatattttatatttggatccaaatgctttataagatgataagataattcttatgatcagctcttcttgagcataacattatatctcacacaggaggaaatgttatagagattaattcacaaaaatgacaaagaccatcctttttaccatcctctactcagacacatgcccataatccagggttgtcaaggaagttcagtcagtcaacttcatccatatcttagaagtaaaaactatattcaccaaatattagatttactcacgcggtagcattaactagtagtaccactctctgcttgtaagtgcgacactgatcaacaagctccacaattacctcctgccttagtccctgtgtacagagtagtcagacaaacaaaatcagtaaacctaacacaaaaggaggttgttaagtaactaagtatggaacatataagtacagatttgaacctcgaattaaaattccatttagacttctgtttattcttccacaataaatggattttaaaatataatggagtactcctttattctaagatttttaaatatgggtgtccaaacccacatacgaatgttatcaaaagcatgaaaacaatggtataccatgttcatgcttcgataccttagttaccataccaaatagatttcataacaatatagggtacacggcaaccaggcaaatggtatttcaagtaatgctgcttggaatcaatgaacatttgatagactacaggctgacgtgtcatatactcaaatgtttatagaacataagcaagtaagggcaaaaacacgctccacagcatagtaagttttatgtggttagaacaagaccatttctcaaattaaaagatcaggagttatttctcaaaataaaacaagatggattgttttctttaacaggtatttgtgacactaacatttagatgtgctttttttttgtgcagcttgagtttaaaagcaaggtaagtgttatcggtacctctctgtttccagggtctaaagcatttagcatctcggctagcacatccattataccacgagcattctgaatctctgacatgctgaaaatataagcatacattcagttttacttcaaatgacagaaaaagaatataaggttagagaaacagcaggcaaagcaaggtgaagtagatgagttattcaaaggttctcactggagacggaaaaaaaaaaaactttactccaaaggaattagtgacttggtggttgtgatgaagttcttcatctatcccccttctttcaaggattcttttgtggatgggtttacacaaacattttcaaattatttgtaatatcttctataaaggattacatcctctgcacagcacatgtgcgtataaggtgtcaattgatgtgatgtgaattctgtatgcaattcttttagggcgtatttatttgttttaagtttagaatttatagtatatttatttgagatccattgaaattcacaggtagttaggtactacgctagtattgtcatagcactttacacacaactttgctaaacagatcagcaggaggtaccgactagtgaatagtgatcttctaatagttatagttttccacatgttcatgtgataatctcaaaccagtaaagagaacatataggaaaagatattatcaaatcagaaaatgaaaagtatgaaagcacacctcaaagcaggaaaatcatttccagcagacgattcagcttcatcctgctgatcaggactacgcatatttctgcctgctggagactggccattaaacaatggtgcaggtcgatcagatctctttggaaatgcagctccagcacgctgcaatagtgaaataggaggatagctatgtcaaacagcaaggtgaattcccccttaattctaacaaatatagatagatcagtaaccaattaatcacatgatcaaacaatgcaacgacttctgaatatggaaaattcagtgtgggaaaaaacttcagagcttgataaaccaatctgggattcaaaaccataccaccaagtcatggtacgctgcatagtactgtggatatcttgcacgtggtcccccgaatgcttcttgccatgtatctatcatagttaataccttctctttgacattctgatcagactgtaataggacaagaacatatgccatcatattcaggacattaaaacaaaacagcttgagatcaaaactatggagcatatcaaacctttttcttcactatcttcaccatctcatgcaacacatctctttctgcaacatgcatgtggaatatatccccacagttcttgattgcagtttccaagagctgaaacagagctcccccaaaaaaaatcaggatattattcattttagatcctgtgcaagttgtcctaaacaagatacatctccaaaataataatgaagcataagtaaaataagttgtatcctcatcaaatctccctcccaccttcgtggactggacaaggaattaatacacacatgtttattatgaaatgatgttcctttgtgctaatgatgcttcaggttgcatggttgcaactgatcattacattaacacatgttcatgaaatattggacaataatattaatacagactggaacagtagtgcttagtgaacaaaataaacacacaaatatagctgagcaatagacatatatgcttgatgttaaaacacacagagaagagattcttcccattgcttgtaccattagcaccactcttaaaaaggatgtaaagttatgataaactcacagtcagcgcaagaatttggacttttggatttttgtgcccaatccttttcttgagtgccttaacaacatcttttgattgcctgtacatgacaaatgtttgctcatcaataattgacgaaccaaaacgaaagaaattatttacaatacaataaatattcatcttcagagtcaacctcaaccatttggtttccaatcacaataaccgaccatgaatcaaggcaaactataaaacctctagacaggaacagaatcattgcctcatcaaaaccagcagacacattaaacagcccaactgcatcaaacttttggtggcctccaccactaacttagttgtaagttgtaacaactaatgactaccgttagtagctgtatgctaagtattcaactaataaagatcatacgttgcagcagcagtacagaaatactagtttaaaagcatgcaggtgaatcatgaagcagcactcaagtagctgccttacgataaggaattaaaggtactctaatatgcaattaatgcttcacagtttatcctaaagctgtgcttgttaggttttaaggttaataaatggggtagccgtttaaacaaccaaataatcttggagacacttaactaaccccctgagttctattttctctccagctaacctcctcctcctctatctaatcactaattttgattaatgttgttagctgccaagcacaaaaattgggctaaactaatcttagtaggattaatgtaagctaacctaatttttacagcagctgacaaactgcatcccgagtcaaatgggctagttgtcatttgtttgaagaaaacagtcaagttgcagtggcgagcaaacattcatcatttctatttttcaaccttctcacaataatatctactaccttgctatattgtgggatggagggagtacgaaccatcctaggttgctatattatctgcagtttctttttttttctctctctactagtatgtgtgtcactaggaacacctcgtaagttatgaaactcacaggttactgaaaattgtttatgaaagcaatattattccatatggtagctcgtattttctcctcggttacggttggttccactagcaatttgccagtgaatccatgaataccaccacgctcttgcgatctaactgcagcgtatcatcttgtcacctcaccaaataagccaattgaacggcaaagcaagcaccaatccccagcaattctatctagccatttccaaaacttcctcctcacaatcaaagacctcatggcgaaccaggatgcgagcggagccagatccaccgccaccgcaaatcctgatctcctcctcccatctagcactagcattcattcacccaccaccccccaatcgcattctaattttcagaatagaaggatccaattcccgcgccgctgtgccccatcatcccaacgagaaaccacaccaccaccaccaccaccaccgctcgccgcggatcaagatcaggcagcccgccaccgccacgggatcaagaggagcacacgtacccggggtcgcggttgcagatgtcgcagatctccatgttcttggcccagtcgggcccgatgagcatgtcgctggtcgcccggtccaccatggagcccgccatgcttcccctcctcccaccggccgccgccgctgcccacgctccggcggcgcggaggaaggtggtgcggccaaccacccacccaccctagctccggccagccgccccccctcctggccggattcgggtcgccggcgagcgagcgagcgagcggattggcctccacctccagatgcgatgcccccccacccgccttgtctaacgatttcctcctattttcttttcttggaaatttctccccgccaaattagctctcccaaaaaaaataaaaatgaataaataaatcattttttttattttttttaggaaagttaacgagttcgtttggtaggtggcggcttgtcggatggatctgagctgtcccccacatcataactgtcacttttccctcaacgtgggcctccactaccaggcccattttggcccatactctacgtgggccgaaacactgaggcccattaaaaacgaaaacctggagcggggaggcgtcttcgtcttcctccctccgcacgcgccgccggaagcgcgaaaccctagcaatggcggcggcggcggcggagggtggcggcggcggaggtggggcggtgtacgacccgagctacgtgccggactcggtgaagacgttcgtggcgcacatgtacaggcacgtcagggacaagaacgtgtacgagatccaccagatgtacgagggcgggttccagcggctctccgaccgcctcttccgcgacgcgccgtggccggcggcggaggccgtctcgccctactgcgacggcgaccacgtcttcctcctcctctaccgggagctctggtaccgccacgcctacgcgcgggcctcctcgtcgtcgtcgtcgtccgcgccgctcaccgccggccagcgcgccgagtcgtgggcgaactactgcgacctcttcagcgtcgtcctccacggcgtcgtcaacatgcagctccccaaccagtggctctgggacatggtcgacgagttcgtctaccagttccagagcttctgccagtaccgcgccaagctcaagaacaagtccgacgacgagctccaccagctcaagcagttcgacaaggtgacacacccagctcaccaccaatgcttcttgattatgcattattactactattctttcttagctgcagcctaatctaatatgtaattcagtttctttcttatctgcggcgcataatataatcggcaatccggtttgctgaattgttcttagctgtggggtacaatctaatatgattttctgatttgttcttatccgtggtgtacaatctaatgtggtttgctgaattgctgcaggcgtggaatgtgtacggggttctcaattacctgcaagcgctggtggagaagtccatgatcgcgcagattctggagagggagaaggaagggctcgagcagttcactgccaccgacggctacgactaccagggtggcagcaatgtgctcaagatgctcggttattacagcatgattgggctgctcaggatacactgcctccttggggattaccgcactggcctcaagtgcttggcaccaatcgaccttaaccagcagggggtctacaccattgtgattgggagtcacatctctgctatctaccactatggctttgcaaatcttatgatgcgcaggtactaaagttcattgactgccttggaatcaatggatacttcaatctacagtgccatgttagacgcagagttttttgctcttctatgttcaaattgtacttaaatcacatgaaatgcgtcctaggatataaacattatttccagtaaaattagattgagtcatgttgtacagccacacctaggatataagcattcttttcagtaaaaccccattttatgaatttattttttaattcactttcttgaaattgcccaagatggttgttttagctaatgctatattcttctggtagatatgctgaagccatacgtgaattcaacaaaatcttgctgtacattctgaaatataagcagtaccatcagaagtccccgcagtatgaccagatcttgaagaaaaatgaacagatgtatgccttcttggcagtttgcctttccttatgcccgcagcacaacctcattgatgagaatgttagcacccagctgaaagaaaagtataatgacaaaatgacaaagatgcagaggtttgatgaggaaacctatgctgcgtatgatgaactgttttcatacgcatgccccaagtttattactccatcacctccagccctggatcagccacttacaaattataaccaggtaatgcttttggtgttaaataataatgtatttttctgattcatagatacgtcctatctagttgttactgcagtcaatctagaaatttgtctcctggtgtttggttcacgactgcagctactggatgttgtcactccttgagcccttttgccttctcttcatggactttattgtgtttgccaaagttctgacagctaatttactctttcccaaaaacaaattaataaaatcaaatagccctttagttacttttccttgtttcagactattgcacattcaattttagggtgaaattgttcttccctgttaaacaaagtaaattctcctgcagtaaaacattccggtggtttaaattccatttaaagctcctaaaggggtcataagaaataggcatgttatcttgtcacatggaaatgatagaatgtaggctaaatttacacgtttgttgattacacaaaatggtgtgtttctgattattgtggatgtctaattctataggatttgactttcttgtttactacattttgtttattgttttactattttgtaacaggatgcataccgccttcaattgaagttgttcctttatgaagtgaagcaacaacagttgctttcagggatcagaagctatctaaaattgtattcaacaataactattgccaaacttgcgcaatatatggaagtggatgaggcaacgcttaggtctgtatgataattaacttttcttggtaatatttcaaagggccatgaagaacttaagtcaatatttgtacaggtctatcctgatgacgtacaagcacaaaatgcatgcagttgacaataatggaaagattgtttccagcgcagactttgatttctacattaaggaggtaatgtgccataataatacccttctctgaggcccagaatatttttgtaaccatttcttgtgttgatatacaattcctcttttcagctgtcttgataccttccagctagtaaatagaactgcatagctgtaaaacttctttaacgttgcaaattctccaatttcaagttgatatttagttcttgaatatttgggtttggcttttatgtgtgatcctctaatccttttgcttactcagaggtagctgtagttaaggcactattggcatatgccattatgcatctagtttgacactataattaactgccaataatctatgtgcaaccatgcaggatgttattcatgtcatggagtccaaaccaatcaagcgccatggtgattactttttgagacagattttaaaggtatccataccaccgcttggcataaccttgctgtgaaccactactaccatttgcatttcactatttcttctgaaaataatgtgtatgttgctataccttcaaatctttactattatcctgcagtttgaggaaatgattggtgaactggagaaagtacagtttgactgagcctggtaggaatcatggaggagcggggtacatccccacttagtttagctgttgcaagaggcactcatgatagttattgtgtacttattaatatatgtgccttttgtactcctttttgacttcagagatgaaccggtaaattctttttgaaaattgtaggaacttcagagtctgaagtttgaattctcactactgtgccatcatggcgttttctgtgatgattctatacagtagttgagctattatctcttctagctgttcgatatagtccttgtgatccaattgctcgtgaaattgggtaaatggtaagaaaatattttgcgacattacttctgtttttttaacgtgacccgataaggggaaaaaaacgctaaggcatctttggagcacgggggattagttcaattcttataaaaatcatccaaacatccttcaaattccaaaggaagcataaggtcgctgcagctggctgcgttacaatgttgtctgtcttgaagatgctctgcacagatctgttccagcatacgaaccccaaaattaacgtcaaagaaccttgctcacatccacattcaggtaggggtgaaaacggtacggaaaccatctttatcgttttcgttttcatatttttttttcggaatcgaaatcggtaactccggatacgaaaacggaatcgaatattatcgaaaccgaaaatggagcgaaaacgaaccggcacaaatacggtaacgaaaatttatcggataaaaaaaccctcaaactgataaattcaattctcaagtctcaacggtcaacgattcatcatgaaacacaatcatataagtccaattgttaagtattaacaatacatcacaaaacacaatctatgtaataaattatctatgttttagagagtaacgcagttgataaatctgaatgcaggaaaaaaatattcttatgtaattttatatttgcataaaaaatattttttaaaaaaaaaataacaggaaaacaccatggtattcactattaagtgcttaaaaaaataaacctagagtatttaagttacaaaatttctagaaattctgaaaaaaaatccgaattccaagaaaatttccagaaagtttccgaccgattccgagttccgacggaaactgccctttatcattttcgattccgtttctgagaaaatatttccgaattcgtttctgtttctgaaaaatttcgaaaaaattccgactaacagattccgtttttgaaaataggtccggaatccggaaagttttcagccctacattcaggccatggcaccacattttactgggaccatgactggctggctacatgctttcagctatggcacagtccaaacctccaaagttgaagacttgaagtttagcaccataccatgctgaaatctagctattacactccacaaaagcataattatcgacctggcttttcgcaaacggtggactcgaaatttcaactactgcttatctacccgacttttctggtgaaaagcctggagaaatcttcaccttcaccatgcataaatgcggattatgaatatgtgacacattaaacaggaatgaattaaaattaaatataacagtttgaacagcccatggatcctgttgccttttggaagctatggtttagcttcaacattttatagctgaaaatgaaaatctaggtgtaggatttgagtataacaggcataaacttgaagaatttctaatagccaggtaaacttataccattatcagatattctagtactaccagaagtgtgatcatagagcggaataatgtagcttctgggctgaaattgtaaggtcgagagcaagtcacaagaagcatctttttttacggtaatgaacaagatcgttcgcataatgattgttacagcaagtctgaggtgtattcctcacatggtatatcaagctatctaaaacttttcagaagatgggacgaaggaataggtgagctcagatatcttcccagattgctgccagcatttttgtctgatgatctttcaggtgtggtacactcgaaatccaggactctaccctctgcctgaaaaatatggataaaaattacgatcaatagtgataatacaaccaaacaatgacattactgaggatgttaatttatgctcaaaagtgaccaattacagaaaaaaaaaacaactgctatccttttatttccttttctatttttcaacaaattgctaccattttggcactcacaaaccaagattttgcaagagctacaagctaagaatattaacgcaaaggcagttcactgccgcgtaccatgatttttgtttgcaatttggttgtccctggttccttcttggcatctggattccccgtgttttccttatcagagcttatgttgtcacattggccgccgcttgccagtacctcacgggcttccaccaaagcagcagcagtctgcacatttatctgcttcatcaatcctagtgcgtcgtaactatcagctgggctggtgaagtatgaaccctgggaggaacgtatggacagaagttaaccaaagaaaataacagtaaacaaagtaccaaatgcgtgacagcatgaaggattaatgaaaaactattatcaggcacaacccagtagtccaatatatttccatccacttaacttaacccagtagtccatgctttttccaaacactggatttctatatgacacaatatgaacatgagaaataaaattaaaaaaagaggtaaatgtacctgaaaatgcatatcgacgaaccaaggggacttccatgctgaaggagattctagtcctcttttgatacctggggtatcagccaatctaacaagagcaacagtttagaatttcagaacgacaaattaactgaaggaacaaggatcataaaacaatctcttcagacttcagtagtgggtttaattccctgatgtattatcctaaatgtatcatcctaaatgcattagggaattaaacccacatttcagatgaaataacgtgccaattacagtaagatggtggctaaaaggcttatgataattcatttgatacaaaaatatttttcagtttctgtctaaagatggaagctcttgaagggatattctgattgcatagacaaggatgagcatcaacttcataaatcttgtactggtttaagtatctaagtagatatcaggaaagtgaaatatgccacaccactgaactaagttcaacatgaaaaccctgcaagacccagtttaagtttaggtttagcagacttcacaacagtggcgtagctagctaggtggcactgtggtccacctacaaatttgatcaagattaaaactatagtatatgtactggttaatataataaaaattgtatagtggaccacccttttaattgacctagtacatatagatggaccacctactttaaatcctagctacgccactgcttcacaactattcagaagcatgcaggagtatgggttcaatgcattgatgcttgctaatatcaagaaaaggaggaactcatcattcactagagatcagtttccaaaaaaaactttgattttcacataatctgagaagataaccaaacaaaagaatctgatggaaaacaacaaaggaacatgtgagtggtgtgaagtcttacatgttcacatattcataatccacatttatacatggtgaagatttctccacgatgagttcagtgggctttgatttagcacacactccctccttacagactgataaagatttcacatttgtgttcagcttctgattcatggtatttttgccataatctggggaaatgggatcatcgccgctgtgttcaataagaatacctgcaggttgctgcatcaaacaacaatatagataagaacaagatcatcagcaaaactcatttgctattttgcccgggtctgcccagcccccatatttcatactactaacatggttaaaaagcacttgctacactcagtcattcagggcattaacttggtccacctcctcaaagaaataaggtactactgacaagctaaatatcatcagaaactggaagtacttactaaattgcctgacaggtcatcattagtagctacatttgttgcagaactgcgttcccctgttgtctgctcgtccatgtgttcgtcatttccagcactctgtccatcttttgtctgttcagttgtgtagcccaaattttccttgttttcatcagagaaaacaagtttcttttccagagatttagaagaagcagatcgctcaatacgcaaaactgtagttataagtgcatcatctttagtggcattgatacaacttgtttgaatgccggtggaggatgtgtctgataccccacgatccttttcagtcccatatttcttctcgattcttttatctggaataggagacaagagatctctgtgacgtttcttcagtattgatggcgtgcatatgaagcttttggcagcactcttcagcaaaacgcccgtgctttcatcatgagtaggggagccccacaatctcattggcgtgcagacattcatggttgaatgcattaactgccgaatgccaaggggactaaactcttggagatcaccagaggttacaagatcgcaactgacaaatggaacatccaggcttggaaaacgaggaggttcgtagaagagggctcccttgtcctgttcatctggtgcagtcacactctgtgtaagcgatggttctttctctagactggcttcaggttcttccgcattagtaacctgttggtccccacattcaggtatgctttccatcgttgaagaaggaacatgtctgtcattgctacaaccagggttagcaaacatttcagcatcaccagaagaactggaagattgggtaaccacttctgcctgagaaagtggcatttccttccgccctggtctattatcgaaaggtgcatcatcagtcatagcatttgaacaaataagagatggaggtactgacatctgtggactctggtcatcagcaagccccatcacacttgaagaatttgatgtctgtggcatgtagggtggtgctaaaaaatgggtatctgcttcagaggaatatacatccgattggtgatttgatcttgaaattgaatcagcttcaactgcatcaggtccagaaagaaggccctgtaaggaaatatcctgccagagttcagatttcagacagttaggactgttgaagtcagcctcagacatgaaatgtagtttttgctcagctccagaatcacttgataacatagagagaggcacctccattgctacatcatatggctccagagatctttcatgattttctatactacaaacagtctggttgtctgcaaaactaggaacagttggcatttcatctatagtcatgtccaaattcagtccttgagcaaagtcctcttgcaagtgttgatctggatccaagttagaggaagaaacatggcaatgcacagcaggcaaagcagatgcaacagcctccgcagaagtatagcatgcttggggacccatggaagattgagaatcatgtgcttcattcttgtcaaaattcgcgtttacttgcaaatcacagcccaatggcacagtagtatcatgcacttgggagcaagaaaccttggcaagtgatgattgactacaccctgatgaattttcaacctctcggacagcaaaacaaccactatcttcactgttttgttgggtcatcgctggtgaggaattacaatttgcagaatattcatttagagggagacacgaaacttgggtaagtaaacctgatgacatgtatgaattgactttcttctttactgaactgttccagtgatttttaattgaattgtccgtcctgataggggaaacagaattttaaaaattcaatgacttcaatagtctaaaagaggtttttttaaaaaaattaacaagaagaattaattgcacaaaagtactagatcattgtgcattactccctccgtcccaaaaaaagtgaatctaggactggatgtgacacattctagtacaatgaatctggacaaatgtatgttcatattcattgtattaggatatgtcacatccggtactaggtttttttatgggacggagggagtaggtcataaacagctagagaaggcaagaatgctaaacttgaatagatgtgtcaaaatggccgtaaaacaaaaattttgcatgcatcatttcatggaaaagaacatagattaatttcaagcagctcttaggtaaggaagaaacattaccttcctggtaaaaattttgtcagctcggcccatttatttccatacattcgatgagcatgtatgagggtaatttcctcttcttgtgtccatgcctccttgtttatgccagggttaagatggttgtaccacctaaatgcagattagatgatacatctgtaaggcatccaatacattgtaatgatactcaaattaaaaataatgctaccatgcatattaagaaacaaagttaggatagtttacaaaatactgcattgttaaaataaattgtacagcatatatggattgtttaaatccaccacatggtttggcagccttcattgtacaacatatatggtctatggaagaactatgtcaaaagaaaacctgcattcatctgcagaacaaaggactagaagaaagcagtagttgctagcacaaagaagctaccctgttgagacccacaaaatatattgttctatctttttttttacttggtgcaagctaaatggaataagtaattttcatggcattaccgttctcgacattgctttcctatacgtccaggcaaagcttgagcaatggttgaccatttctttggtccaagtttgtttaccatctgaacaatgatttcatcttcctgaaaaaaggagcatgccattgtgagcgtaagatgagtaaccaatacagtattatttaagagatgaaaataaatcaaatagcatgcttacttctttggaccatggccctttgactaattcagggtttagaaccttttgccacctgtgcaagcattgtacatcggttctatccggaaagcattccgctggaaaattagaatgttctctgtcaaaacttggatttttaacaatatactggaaatctcatcaacagggtaagcatgtctagggtgtgagttaatgaaacagcagaatgctttcctgtacatgagttagcataacatcgaaaataaaatataaaatatgctgattggtttatgatatcctagtgcactaaagtacaaatataaacaatggttagaaaaaggaagccttgagaacaatatggtaaaaatgcattagatgttatgtataatattgtgaaatataaatattattcctgttagaacctgacatgaattgccatacaacagtatgtaatcataaaccaaatgcgcaaaaaaaaaataaaagaaaaaatccaagggagtctaacatatgcgtgataagctataaaatgcagtgttatgtagataccaaatggattttagaaggctattttattttgtttatatattccaacataaaaaaaaacaaccataaagaattcaagaaaaagaaaagtatgtcagctaaaagatacaatacaaatacaatgataaagagtaaggactaaggaaatagccaaagaatcattgcatgattttccatatcattgcagcaatcgaaagagcatacctatttttttccagttcttcccgttgtatgtctgaacagctctggacaatatggcatcctacatttgaatatcacatatgtgcaatgttaaaccatgtaagcaagaaaatttatgtataagacacatggaaattttaaatgttgcatgagaggctgataagatgggtccaggctcacatatcagtgaggcattaaaaggcatatacaaaatagaaccaaaatgctgctggttacaatttacaaagcatagaatcagaatataattgcacacatgagtatatgacaaaaacagaatagcaggaaaccccaaggtagaagagtgaagtttatgatttgcctcagagtacatgcaatccactcgttgacctaaagttgcccatggctcccttggattttagcaattagtaaattatcatattcaacttggtttgtaggaataaagcgccaaattaagcaactcaagcctccacacaagagtcgggatttaaattgaaatgttttttcatattaaaaaattataggtctttgccattaaacacattagatgtctacagtcaatcattctcaacaatacataaaataggattttcagtcaccatttaataattcgtacaggaaaaggactctttgtcaacagaaacacaagatgacattcatgtggtatacctcttcaggggtccaatttcctttggtggaacgccgtgtcggaccggtggtcctcctaaatttgcatggacaaagaaacaaaacaaaatttagtacaatatacattacgatagtcaaaagagcttttagccttttacccattgagaggtcgtcgcctttttggttcattgctgatttctccttcttgaggagccgacggaggtccagaaggctctccatccttatctggagcctttccgttatcgcttgtcatcatgagtgaagacaatcaatcctcactttgcagtagaaacctccaagggatataaaaatcattatactgtcaagcctcagtgaggccttcagggagttgctccaagggagaagcaatcataagctgcaaaagaattggacgaatgaagatattgtcacaagatgtaacaatagaagcattcagggatgcatagaggacaggacattgactaccctcataagaacatgaattctcatttcaaaggagttggggtagaattcatgtcattttcgttttattatagagatggattgtataatattttatctaaaaaaagagttggggtgataatgtgtctacaccccctcgttgtacatctttatgaaaactaaaaaatgcatcattcaccctgatgtatatgtagatggttgattgatatgcagtcaagtggataacttgcaaatggggaaaaactcctctttgcttccgtaaactattctgcaaatctacttattagctcattctaccctccgaagtccgaactactgaagtagctaatttcacatttagggggagtaaaccttaagctttctgcaatatataaaatagttttagggtagtaaaatgttttttctccttttagatttgaggattgtattttctgcaaaatgtgaattatctcctggtttatccataatctaaaaatatggacctcctctgtctgggtttcaggtttatttggtgctaaaagcgtctgactttcgctgtggaatttaccagacaaaaaatatataacacagatcttagtgatacgaattatctgggctcgtaagtcggtttatatcgtatagcatagcacctcctccatattcaaactcaaatcagcacaacacttcaacccaatcaccaacgaagcaacatcccaaagcaacaattaatcaagcagagagatggagagatatataccagatcaccaatcgccttgctgacgggcgagcctggacgcgagacgcctctgccgtgccgccgcctcgtccgccgggagcgcgtcccttccgcggcttctgctgctgccgctgcctgcctggatctgggtggcccgaaatccttaccagacgccctcaactcaaccaccgcggcggctgctgctgcggacgccgcccggcccgagcgatgacggcgcgatttgcggaggtgggagaacggagggaggcgcctgcggggaggtcgatggaagaaggcggcggcggcgcgcataggaggaggggggcttcgccggcggcggccgcgacgcgcatcggcggcgcgcggcggaatttcggaagagaggggaagatgagaagaggagtggatggctatttggcgatttttccagggtggtttctgcaaaaaggacggggacgcgagggggcgcgggggtgtgaaatggacggcggggagatggcccgcgtgggatccgcgcgatctgggccgtccgtttccacgtcggccgcctttgtgtcccgcttcggcaatttttgaatgccaacggctggattgcggctagtcgttggttgttgttttgttaccttttttttctttcccttttgtttcgatggtttttaatttgggaatggggtaaaacaaaattcgttttgaaaggatggggaaagcatttgttttgtgtgtgatgcaactggaacagaataattgtttgcgtgtgtggtgaaaatgtagaaacaattgagatttggttttcactgtttcttacgtttgaagaaaatttgaaattattggtggcaataaatgttccatacacgttgttatcatgttatggccaacaatagtcacatttcacccatggtatttttctctttcccgtgaataaatatttcatttgcaattacttcttgtgaaagtacatataaattatttcaaattctctagctagtattgctatttattggcatacactcataggatacaaacaggaattcgtaaaataaaagtaattcatagttatatttttcatgttgcaaggctttatactaccgggttaaactcaaaaccacattttgtagctaaaaaagctaataaattcgacgtgacctaggaaagcccaaggctcgagcctgagttttaagtcattgtcgagctcggctcattttatttggctttgatttgttgtagcctaatctgaccagggtttggagatctcactataccacaatacacatatcagggttatggataccacatacctaatagtagttgactaaatcttggcaagacccaccacataccatgtcctatacggaaacaacctgcggatataggggagttccggataaggaaagacaaccagagttctacatgaaaacgacaaggactactcggattgtatccatattggttccctagttctacttggacaaggggacacctatgggtataaatacaagtccccctaggaggagagggacagaatccacacacccaacacaatggacatggaagccacaacatagaagcctacatacgccaagacacgccgccggatatcgacttcagggataagcacggctagtaccctacggtgtctccggatactgtcaggagagacgaaagcgctatctctgatctcgccgggcacggattcgaggaggaaggctatcctgttgtcgactacgagtcagatcgtcagaccgtcatgtcgacaacagttagataggctaccccaaatattgtactggtgtgattatcatgaataagagcaataccggcttcggccaacaggatgtagggttattacctgacaattcaggggcccgaacctgtataaaaatcctcgtctccatctcttttacctcagtctcgcgtataccctagtaccaacgatccctatgccatgcaaataccgtaatcgagacatcaaacgtcgacaacacatgttccataagataagcggcttcatcttttcgcttatatttatgcttatcagccaaaatttgaattttcaaccttatttttgagctgattttgggttttctcattgaagtttacttttcagccattgtttttaaatcgctaaaaatacgtatataaaaattttattcaaaaattacttttcgtttgcaaatatattatttggcttatttcatgaataagtgaaacaatagggccggaaatcttccaagttggacatatccttgtttacacagcgggatagtcattgtctcattgagcaatgagcatatgatgcctattattagcatcctctttagcgacaccagtgattgcgtcaagtttaccgtgacttcacttataaaggttaaaatcatgatgctcataattaaataatcatgtccatctataattggtgcataacctaaaagttatttccactgtataacaattgtgcttcagtgcacctggtagtcgaccacaacatcacactcgttcccttaggcgtggcctgtcgttttgatcaagcagtactaaacctaattttattcaaggttgagatatatttaagcacgtggtcttccacaggcattaccgcttttgggaatttgctggaacctaattttattaatgttgggatatattcaagcatgtggtcttccacaggcattgccacttttggggtttgctcggagcgtagtgtagctccgcctcggcgcctcctccctctcgttgtttggagtaaccattttttcgcaatagttttcccttcttttactttttggttttttttctttcttcctcctggtataggcttgtctggcagattatgttgtataaaaaaactcttttacttctaatatattgacgtgcaatctttttgcgcgttcgaaaaaaaatatattcaagcctacatgtaaaacgaaatggttcattagcacattattaattgagaattagctataaaaactttaaaatgtattgatataaatttataaagcaacttttctatagaattattttttaaaaaaaattatcgtctagtagtttagaaagtgtgtccttaaaaaacaagtgtgtagaagttgaaaaatggtagtgtcgaacacaactttaatcatccgtctagcccattataatttactacaacatatagacacatgctacttttttttagaatattttttttcaagaattatagacatgctacttagtatatattcgtgctcggacacaacttggcaatggtaattgccgcacagcctcatattttttgtttatgcctaattgcatatacttattagctaaaattgaaattttcaaccttaaatttagagttgattttaggattttgtttttcaacgtagtttattttttagcctttatttttatatcatttaaaaacatatatatatataagctttatttataaattattttttatatactgtttcgctttttttttcttcaatatgccaaacgaaaaggatgctagactcgtggaggtgggttgtccgatctgggctcatgctcatccaagtcaacaaactcaaatatataaatatgcgaacgggcacgtttaagatttgccttgtcccaggatctcactggaaaccatttacactggtgtacctctgctcctcctcctctcccataataaggccatacccataatcaatactaccagtacggcagcactactccaccactaccgcaccaccattacacccaagaaattaatcccacaactcaaggccggatttagttatcaattttttctttaaacttttaatttttccatcacatcaaaacttttctatacacaaactttcaacttttctatcatatcattctaattttaacgtgaagtaaacacacttcgaatgtacaaaactccaagcacggcaccactactactactcagcgcaccgtgtcgcagcctgcgcgcatgtgctcccccctgcaaccgcacgtctgcgccgcgccgcacgccgcgcgtccgtccaccgcgtccgtccgcgcggcgcggcctccgtcctcctccgtcgcctgctgctgcaccgacgcacgacatgcggccaccgcccggaagctacctaccgctaggagcatgtgtaggcagaacctactccgctccaaaaataaatcaatctcctacgcgatctagatgtaacacatactaatactataaatctgagcatacgtatgttcatatttatagtactggaatgtgttatatctcgtaagagattgatttattttgagacgaagggagcgacttcatctcttttaaagctagaactcaaccaaacaatattagcttcaccttaaaaaaagaaagctaaaactcaaccaaataattttagcttcacctaagaaaatagaatagcgtaaatgctatcacaaaataaactaacgaggttgagttgagtttatactattttataatttcattgcagacctagtttttaagttaaatttaggaattgaaacgctgttaaacgggctagctctagtactagcaaatcctcgtagcagtatgtaacacatgcgctgtggcagtgtgacactgacacgatcacacggcaagggccaattttgaagaaagaaaagttggaatctaaacagacccttgcgattggttagttggggaattggagatctctccggtcaggggtgatgacagagctccgatccggactcggtgttgccggcacatgcgccatggcccatggggcctcttgcctgatcaccctctccccacagctgaaggactacgaggacacattctcactgaccggcaagattcaaaacttcagagagttgttgtattattcagatggtctgaactctgaagaaaaacgtggttcacgatggttgggcaccgccgctaatgatgtgtctctgtctgatttttcccctgctgctacgacaaactctcctctgatcatgctctggtccctagcaaaccttgttaggttgggattggtggccccttggatctcaaagtagtcccaaaatctgaagataagggatcttttcaatggaaggattttcttgggaattttacagaatttaaatcctataagaaaaaaaaattcctataaatacctttgaaacaagaaatgagagtctcatcggttcccatattccctaataagccaaaatggcttatcagagaataaaaattaatttatatttaaaacatttatatatttgttcgcatcgacttaaaagccaacgctaagatatcttaaattcaacttcaaaattaagttcaaacatttaaattttgacttttgctttaccttattaggccaatcaataggctctgagatgcgtaaattcctatgaattggcctcctactacctcctaatgtcctataccgtcaggaaaataaatataagctctaacatcatgtttttattctcctttgagaagtccaatgcattctttctccatctctctaccacatgtaaattcatttttacttcccgtgaaccatccaaagacggtgaaaaatatactatttctgtattttaggatcgtatgtgattctatataatactttttctctattcctacgtattttataatcatgtttttttaaaaaaataagccctaattcagtaacttgtgtaggactagtaatgtactacctactcggtagtattttgttctgctccctattgtaaaaacaatacttcacccccgggatcattattgttattgtcctgctacccgcatctacaattaaagattgtgtggtcactttatctgcccatgagcacggatgcttactcttaaaagtgtcatgataaattgcagcaccaggaaaccttggacaagaaaaccgggtaaaattaaatgcttactacgtcaaatctaaatactacctccgtcctaaaataagtgcagccgtggatatctgtgcccaacgtttgaccgtccgtcttatttaaaaaatttgtgaaaaatttaaagatatttagtcacacatagagtactattcatgttttatcatctaatagcaataaaaatttttcaaataaggcaaacggtcaaacattgaacatgaatagtgtaaaactgtatttattttggaacggagtgagtatcagacaaccaacttactcctacccaacggtccaagagaaatcctgagaaacaggcaacatgcaacatcctctccttttgctgtaacctgtactaccggactgttccttttagattattcactggtttattaaaacaacatactgttagtatttgctccacgctaaaaaaatattttttggggtaaaatacttcttatactatattattttaaacgcttattctaagtatttttaaagcttatttcttaaatatttaatttattcttataataatcaagcagataattcatgataataatgttcccttgataataattaaacaccttaggtggtatttgtttatactgtagaagataaagttaaagaaaaaagaaaagccagtagcatataattaattgagttttattttattgtaaatttgatttaatagtttaaaacaacttgtatatactccctctgtcccataacgtagcaacttaagatgagatgagacccattcgagacatgtccagatttgtagtcaacccatcctaggttactatattatgagacagagggagtagaaagcttttcatataaaatacaccgtttaacagtttaataagcattcaaacaaaaaaacgagataggatatgtatctcagcccaaaaagaacagaataaatcaaactgggcataaggttcagatttaagggggaaaaaaagcttcagaaatgggacctgcctgagtatgacacagtggccctactgcacagacacacataccctccctgaccctgagtgtgagtgacatcatcaaccatcatcagagaagagaagaagagagggcatggtcaaagtaaacgagcccaccaccggtggcaacctgtcccctaactccctttgctcatcaaaagacagagcttgagctctctcctcatggccaccaccactagcactgtgccgtggtagtggcagcagtaggaggtcactgcactagcccacatgccgctgcagtagctagtcgtcgtagcagcagcagtatactactagtagtagccttcttggccttcttcttcttcttcttgcacagatcttgggggcgcaatcagccagttgcaggcttgcagcagacgaacctcggagagagaggcctgcgttcttgcgaaagaggagctagaggtgggtgccatttattcccgtcttcgttcttggcttttgtttttggttgtaaactgacaatttgggggttggggattgagttgataatcggagatagtcatatagatggtttctgaaaaaaagcttctgtgagttcatttgcttggccactctggtttttttgattgtttacttgggggaggtaacaacaagaagaatgcaggggacttcttgtttattggtcatcttgtttagctagttaatttgggggttttttttttggcgctctacagtaaaatttggaggattccatgtctttggggagataaaataaactgtccagtgttgatacatgattcattacactgttgtaataggcagtctgggatttttggtttaggatttgcatgtttgattttacagtatgggagtcatgtacagagttaatgagagcgaatgacctctaactacaaactactaccttccagcttccatcaccttgattcactttccccctttcccttttcacctttctataagagaaaagtgtagtgtactgcttgtgagctatcagttctttattcttgacatgatccatatgaaattcgagcactggtgaatcgagagaagaggccaggtaggtagctggtcaatgcatggatattccgtgggcagatagagaaccctcgtagtagctttctttcttgtaaccacttcttccactgcttctccttgacattcaatttctctgcattatttcttgcaaaagataaaccttggtatatgatatcctaattttctatatttccctctgtaagagtagctttcttgtgatttgcagcttcaggataaagcagacaccaattcctcaaggaaacaagttcttaaattgacacctccttcataaactattttataaagattcaaagataatgtaacctttcctccctcctcagtctgacctgtgggataatttgttcacttgaatttgtttatcatctgttgctattttctgaccatttcggtttgtcaatttgcctttcttatgttgctccagagaatagagaaaatgcatcaagacagtttcaggtcggtggtttgcagatccctttcaaagagtctttcctccaaaaccaaagagagcagctaccctgaaatagctcaatgtgctgtcccttgtgttgtcacattgcaacctacggtttgtcgaggctgccaaggccgggattggagcccatcacaaagcaacagggaggatatgtccatgatgttgcagaaagattacctgatggcatcctcgctctcgaggcgcttcgcggaggacctcctaagaggagccatggacctccaggattcgctcacgatgctcgagaagttccaaactgcgtcgcggagcatgagagtgtcaaacaagaagagaaggccagagggttgtgagagatcaccggacacaagtggattccgtggagccctgtcggaagcgtcaaacgccaagaagatggtgggtagaagcgccagcagtggattggatggggaattaacgaattctactgatgagctgaaaagagtgatcaaggatagcttttacaggaagaacatcttgtcggtatatcccaatgatgaacaggcttccatgagccagtcattacattacatgccaaacaagaattcgttatccaagcctaatgagcagaagaaggcagcaccaagatcattgccatcttgtgcaccagggcagtctgagaagtccaaatccccaagcttggtagcaaagctcatgggccttgatggattgcctacacacaatagcaataccttcaaaaaagacgagtcaatgaagacagtaagttcaccaagggcactttttgatattgagatgcctaaggtccagcaaaatgatgctcatatgagttctccttattcccgaaaaagtaatgtttctctgtatgattctactgtggttaatgagattggctcaatgaaaacaattaggagggaaaaaggcatagagcaacctcaaacccgagcagccaaggatatcaaggttgtatctcacacaagtcgaaagcaacaaataaaagagaccactgaaatgggcaggagaagtagtgacaaacaaagacctcattcgacttataggaacagagaagggaggaaggataccaagtctaaaacaggatcagcatctcggtctagtgctaatacagtgaaaaggcctgataagaaatcaatgattgcatcaagtagcagctcttcaacatgtcgcacaaggaagccggtcgcacgtaaagcacctagtaattcgagggagaaggcagtgtccagtagaagtcgcaagaactcaactattgatgacattgtggtatgcatcttctattatagcatagcctggaaatattttattcatctgaaatattaaactattttggaacattgtaccctcagatttaaaaacaacatttatcttatttttccctttagaagtttcagttaaatcattcagaccttgaattggaacagttcgttgaaataatttatttcgcttaaatcacgggatctttttttgctcctaacgtaggcatatgagctgcacagagagttcatacaagttgatggtccatccactgaacatagcgcaacacctagtgatgaaagctgccaaagtgttgttgattgggacacagagcctagcattgatggtaaggaacgctgaatttcttttcattcttctaaacatgttttcatttttatttgtcactaatacaatttgaagcctgtgaagtaagaaaatttcaaatattgaacttcaatcgaatgttgaaatttggaataaaccatttagtgaggaatttgctgcttatttgcaagtggaatgtgacagttttggaattcacatgcagcgggtgtgacagttttgtcccgccaagccagcgagggtggcgtggccaaataacgctgccacgccagtcgccagctagaccagcgtgaccaaaaaacgttgccacaccagctagaccggcgtgacagtattgttttgccacgctagtttagctggcgtagccaaaagattcagatcatgtaaataagttttgatagggtttatttttaaaattaaaaattaaaaaaaaatcattccgctttaactattgtagacattaattccacttctatttacaggtttgtatctaataacagtccaagatgattaatttcaccacttaaaaacctaaatgttctctcttgcaatgaaaataggtgtttccacactaaacagaaatcttttcatgacaggcattcgggaagatttgagtgaatcctatgaagcttcagtgactaccagctctgcggaaagaaccgattcagctaacggagatccttttcacccatcgacacacttagtatcaaaaaatgaagttgaaataaaagacgagatgagtctgcttctcctaagtgatcaaccattccttacccgggcagcagaactcattggcatcggcgaaccggggcatctgatcaaccgatataaaggtatccgcaaggcccagatgggtaaccatgagcttttcgtggacaccgcaacagagcagctggagcggaagcatcgtcagcgaaacagcttgtgttacacaggaatttggagccagaaatgcagaacagcaccatacttctcactggaggcattgctgacagatattcgcgatgcgactcgaaagctgagcatctataccgaagacgacgatggctgcactacaaaagacacactatacatgaaactggagaaggatctgagatgcacagatgcgtcgatcaacagcgtgtgggatatgggctgggaagattggattttcatggaggaaacacaatgcttcataagagatgttggggagagcattttatcagggcttatcgaagaagctgctctggacatgtgggtacattgatctgggaaaatgaagcctaggtggttcttgcgttcttggagaatttctagctttgttctccacttggctggcacttctcatgatttccagtttccagtttgtatctatctttgttacatttcacctgtgtaaaaaatgaaaaatgtgcaatgatttagagagttgcctaaagaagtgatggagttgtcttcaccaagaaacaattgtaatttgtgcacaaggtatgaaggcatgatgaatagacaaagagcaatgtttcgtttcactttttcctttcgatgaatgaacaatgccgaggaatctcaaatagcaatgagcaaggacagttcttgttttcatttcttttttttttaaaaaaaaagctagttgtatgcccgtatgttataaagggtcacgctcatataattagggacggattagacgggtgattgatgatacaatattggatctggtggttactttttacaaacgagaacacacgtacattgagaggaggaaataaaaggagaagggccccatttttaaagtagtaactagcattgagagtaggaaataaaatgaggacagttgtgtttgctaggggaggatgggaacctgcacactacgcacggaaaacgatgtagtctattagcgcgtgattaattaagtattagttatttttttaaaaaaaaaatggatcaatatgattttttaaaaaactttcgtatagaaactttttgcaaaaaacgtaccgtttagcagtttgaaaaacgtgcgcgcgaaaaacgaggagagtgttggtttggtctaaaagagcgtatttttttaattaatcattttttatcttgagattttttttatacagtgcagtgggcgaggggaagatggacaataaacaggagagaaacgtaacaatattatgaaatctgtgaatcaaaaagagtaaagcacttactgatggagatagcttccaggcaagttgggtggcctccctccgtttctgccttcttcattgtcaacaaccatcgatgcctataaaatattactgaaaaacgctattaatcgttcgagctcgatggcgatgctagctctgccactgcaagcacttgtttttttcatttcttaaccagcacttgatggtgtggttggttcgatatttaagaccttttaatccaaagtgagcaactcatcaaatcccttttacaaacaaaaagtattacacccgtcccaacaagttttagagttagacacaattattaagaagatactatctctatttttaaaatatagttatttctagcacattgacttgttccaaatgaagctatttctccacctaccatctactctcaaccaatcacaactattctctttacctactttatcttttcgaccaatcacaatcctccttcaattatctctatctattttttaaatatccgtgcctacctaaaaaagtatttatgatttgtaggtagataagattatgatttgtcgagaagtgaaaataagtagaaaaattaaatggtgaagggttatgattgggaagagaatgccgacgaagaagttgctatattttgagataaatttcgaacactaaggtggtgtttgagaggggagggacatattttaatccatctcacaaaaacataaatcactcccctagagacttatacttatataagaggtactaaacacccaaacaccacctaaaaaatgttttatcttccgatgaggaattagttagctctcgaacagtagtacgagatttgtgcaagttgtggtcctgtcgtcatcctgtggagttgtggtgagtgtttgacgaattttttttttttttggcggctcgattgcaacccgcggcccgcaacaaatccgacgccaaatcggacacggccggcgactccggcgacccaccaccacacaccaatcctcctcctcctcatcgccgcctgcgacggcgaggcggcgagcgatggattccctgggcgtgctgctggtggcgccgatgaacgcctacctggagcaggagctggaccggcggtgccgcctcttccgcctctgggagtcccccgccgaccgccgcgacgactacctccgcgcccacgcctcctccatccgcgccgtcgtcccctacgccctccagggcgtcgacgccgccatgatcgacgccctcccctccctcgagatcgtctcctccttctccgtcggcatcgaccgcgtcgacctcgacgcgtgcctccgccgcggggtccgcgtcaccaacacccccgacgtcctcaccgacgacgtcgccgacctcgccgtggggctcgccatcgccgcgctccgcaagatcccccaggccgaccgctacgtccgcgccggcaagtggaagtccaagggcgacttcacgctcaccactcgggtcggtttcttttttccgaattccttagcttccgttctactagtattatccatttacgattttgcttaatctttctccaaaaataaaaagttcttaggtttgatccgtagtttatttacagtttggtttagtcgaagcaaatatagcacaaaaactgattgtacagcacgaactgtttggttgggtactattgggtacagtggaaaatacgattgaatggaaggaaaataagtcagaaagggagagctggaagtgagaaattgttggtcctgatcagatgtggctctagtttttgtttcacatcattagatatcttccttagatagtctaatcttaatttgatcattcaaacatcgttcttttataccatgtgaactatttaactaaggaaggaagcacgggaaatggtttcagagctctggtggatgcgtttttgtgagttggaaatgcatcttatttggctgaaatttaaacttgtttcgagcaggttgttgctgattgtagttgcagtgattttctatgggtctaaagagaatcatcgtgttcagaagttactcatctgataatgctgggtgctaattttgggttgcagatggttcttactgagtggcgcactgatagcagtcatatattaggatgttagtctatttaccggagtttatccatccattttattatgcatatgctgctgttattgtgcctggagaatttttcctttcaattaaaattgcattacagtaaactttatgttcagatgcagtatctgaaggacaatatagctagaagaaagattaatctgctaacgttcaattgattatgcataaattggtgtgttcgtggaaatgtaatgcttggtattcttatttttctgcagttcagtggtaaaagagttggtattctggggcttggcaggataggcttagccgtagcaaaaagagctgaggcatttgattgcccaatcagctatcattcaagatcagagaaaccatttccaaagtacaaattttatccaaatgttgttgacctggcagccaactgtgatgtgctagtcgtagcatgctcacttaatccagagacccgtcacattgtaaaccgtaaggtcattgatgcactaggaccagagggagtgctcataaacattgctcgtggagcacatgtggatgaacctgagcttatatccgcgcttcttgagaaacgcttgggaggagcaggccttgatgtgtttgaggatgaaccctttgctccagagcagctttttgagttagataatgttgtcttagtgcctcatgtggggagtgacacagaagaaacatgctgggcaatggctgatctagttctacaaaatttagaggcacatgcattgaatcagcctttactcactccagtcatctgattgtttctgttagaagtctgggatgattgtgccaccactactacattctgtaatcccaattagttttctatcttctgtttattagttcttcattttacccatcattagggacatatgccactcttttgtaagacatcattttatcggccttatggctgtcattcaatcaaccatgacaaataagatgatcagttccagaagttgaatcttcctgtctttggatgatatattcacatattctcagtttctccttcttacaattttccattctgtcagagcctattctacccttcccagttttgtcatcaccctattatctttctcatcatcttgtaacaaatatcatctttctttgttcaacatgatatgatcttctgatgagagttttttgtttatcctttttgcagttcagtggcaagagagtcggcatcatcggtttgggcaggatcgggctcgccgtcgcgaagcgagtggaggccttcgactgcccggtgaactactaccagaggacgaagcaggatcaccccggctacacctactacccgtcggtggtggagctggcggcgagcagcgacgtgctggtggtggcgtgcccgctgaacgagcacacccggcacatcgtgaaccgggaggtgatggaggcgctggggcccaggggcgtgctgatcaacatcggccgggggccgcacgtcgacgaggcggcgatggtggcggcgctggccgacggccggctcggcggcgccgggctggacgtgttcgaggacgagccgaacgtgcccgaggcgctgctcgggatggacaacgtcgtgctggtgccgcatgtgggcagcgcgacgcacgagacgcgcacggccatggccgacctggtgctcggcaacctggaggcgcatgtcgccggcaagccgctgctgacgcaggtggtgtgagctaattgagtgactggatgattctgatttgattgattccaaagcaggtgcaattcgacaaaatgtagtatgtactgtttcaggatgtgaaaaatctgttttccctttttgtaaacacggtcggtctgggacgatccagtaataacgatttaatatttgtcattggaaatgtgaaaagtgtgttgggttgaaacggaactgcattgccactgctatttcaggtagagtaatagagtattattttttttctgaaaggaaaacggcaagagtattgccgaatatattagagggaaatagaaattcagggattacagaggagcgattacattaagaagcggtaagcaactacttagagaccaaagcctctttgcgaagtgtctagcacagatgctactttcacgaatatcttgaatgatttggtgtgatgtccttcgcgtgtctggttcttctccccctaaaatttatgcgtttctttgaagccagatatgccactgcgtcttaaccggggcttcagctcttggcttccatcttgctttcattttgcacaatgcatgtcatccattcagcaatggagcaataagattggttattttttataccctgggcagcagtgacaaggccccacgtttccttgaagaactcacactgttgaaacaaataatcagtgtcttgaaaagccccctgcataggggcaaatccagtcgcactctagcgtcggattagcatcggattagcatgttttcggccgagtaatagagtattatataggagtactagtatatactccttccatccctaaaaaaactaatctacagtggtgttcttttgtggcgtagacgaagatgaaaataaagatttagtgttttacgcaaaataaggtgatatttacgtatgattaattgagttttaattattacaaacttgaaaatatatttatctgatattttagaacaatttacatataaaaagttttcgcatgaaagacactgtttagcagtttgaaaagtgtgtcacgaagatgaaaattttcatccaattcctataggagaaacggacgggaccatatataatgaatatgaatatgaacatattcacatccatattaattgtattatctctaatattataaaaatcaaagacgtttttgccggtattttgatacgtcatgcatctatgcgtcggtttttaagttcttttagaaatacatatccgtatctgagtcagtttttaagtttgttcgcttttaaaaatacagaagtagtcatataagaaatcactttagaaaaactcacatgttaacttgagacgatcggactcctaattgcagcttatgattttctaaagaaaatgtatatatccaagcaaattctcacagtgcatttcaccttaactaaaccgtataacaacaataaaattaaaatagcatcgcataggtttttttttatattctaatgctagtttgatttttttttgacggaaggactattaccgtccgaagagattaaccgacaggtgggggccacgcgttgcatggtcaaaaggtagggtccgggagacagccacacgagttcctctcccgtgtctctctcgctcactcggcttggctagctcctgtctgttcccctcgccgccgcttccgagtggtagggtttggctgctaccggcgctggtgaagaataagaagaagaagaagaggcaaaagcgtcgtcttcttccccggcctttcttcctctctggctctccgctcgtgttcctctcgcgcggcggagatcgagggggcacaaccgcacaaatcccattcgtttcgatccgtacgtttcggccttcccaaaatccccacttccatcatcacagcggtgcgggggggggggggggggggaggaaagtgatggtttctgcccgacaactcccaaatcttctcttcctcttccttctcaatccgattgttttctgaaactaggttggttatctttcttcttttgtcccttttgatttgatcaccgtattcaactcgatgtgctttattatgtgatcaggttgcgaatgcggatcaaactttttgtatttttgttcacccatttcccactaaattttcaactaggaaaaaaatgaaaaaaaaaaacgcgccctgtttcttctgtacaaacagaattgccggggaggaaggtccggtggtggtgacacttggcgagatctgctgcatcggtggtagcagtgccacctttttctgtccgctgttgagcttgtgctacacgtggcatggtcctcccttcgctttgcagacagcattttcaacgcaaaagttcacccttttttctgcttcctttttctgtttgcgaaattcgatgtagattagatttagattagtcctatgtgtctcttgccgggttcttcttctcgggactcatgcttgcattgcacctctttgttccagcgaaaatgtgagattttgaagagatctgccattgcaaggtggtactgtacgctccatagcttttccttccggttttggatttatttattcttgttctttttctcgaaaatttccaaacacaaaccttaggctacgttctccatgtgcctttcgtcttcatggacaaaaatgtgtatgcttgcagtttcttttcttatgggttttctctcttcctctaataaatctttctaggatgaactgctcttaggatagagatgtacagttggttcttttctttttttttttcagttgagtcttgtacacgactgtttcatacattcaaacaaaagtaggtttgatcgaaactgaatatggtctacagctcatgctgaagaagatattggctttttcttcttcagataggttcaacaggttgtcatcttcagatgcttctggtaaaattgcaggttcagtttcagcaagagctaaactcgatcggattcagaccgcgaagctaagctttgcgaaggaggatgaagccggcgacgtcggagtccgacatgacgagcctcgcgacgtcgtcgccgtcgcggtcgcccaaggcggcggcggcggcgtactacgtccagatcagcccgtcgcgcgactcccacgacgacgacggcgacaagtcgccgtcgacgcaggccacgccggtgtacaacaacagcccgctcgactcgccgtcgcaccactcctcctccttcggccgccactccagggtctcctccgccagccgcttctccggcaacctccggtcggcgtccgggaggagcaggcttggtggcggcggcggccggaggcggttgggcgccaaggggtggcgcgacgtcgacgccatcatcgacgaggaggaggaaggcgcgtacgacgagtttgacgacgacgacgatggcggctatgagccatccagatgctgcgtcctcgccttccgattctcgcttcttgctctagccttcaccctcgtctgcctcatcgtctggggaatcgctcgccattacaaacctggagttcttgtcaaggtatattatcactgaattcgtatccaaatcacacaggttcataatgagtttgtgatggttttttgaacttgttaaattattactgatcttttgtctgattctagtagcattgtactaagtgtttgtttttgtgtttcttcaagaacgcaaattcataatgagtttgtgatggtttttgaacttgttaaattattactgatcttttgtctgattctagtggcattgtact

SEQ ID NO: 76255 - DNA, 3798 bp, Oryza sativa
ggggcgtgggcgacgacgtcttctcttgctagttgctactgatccgtgctcgtaatcgtacgtactgcccgtttggtcgggtacatgtacatgtactagtacgtgacatcttgcaatccctaaaagacttttttttttggaagaaccaaaagatagtgaactgcatgagtggaatcctataggatagttaacttgaatctgcaaacatcttaccaccaatcgggagattcagagtttcattatatgcagatgttgttgccctttctgtcacccctacatacttaaatcttttcgcttctgtaagtgggatgcacatttatttgcaacactcaaaagtttctgtaatttgctgatggatataatatcactattataggacatcctttaaaattaataatttgcctgagaacattttcggttcgattggagagaaaaattctttaaaaagacaagaatgcccctatgaccaaaatcttttaacctatagtgctggagtgaagatgaaatatgatgcatattctaatctatttgaaaattttatctctctaacagatcgaaagtgtcctataacatattactatttgtttatgtcttttagccatcacacgtttttacaatattcactagtaaattacataatctttgagtgacctatagcaaaaattgtctttaaaaaaaagagagatatacccaatctcctgcaatgaactaaatgtagaggcacgctttacaaattttcctggaaaggtatcaacattgtcatgcaaatatctagtacattatcaaccactgactataaaggtatcaacattgtcattgcctctgactataaaaagctgaaaaaacgattatcaaccactttttgacaagtttggcttcaaattagctggatggttaggtcgcttcttcacatcgtctagcagaaagacgctagtaaaatcagttcttaatgtcccgcctctctgataccgggtccacttacatctggcagcttttataggttataaactgctctcacaaactaacacaaatcttttctgcacactttgtcctcactcgtgcgcacttgggaagaatttcctgatcggtcgcccatcccaaatctgctccaagctaagcatgcttaaccttagagttctttcgagatcggcttccggaaaagaagttgcaacttgttgatatgagtattctattaatcctattaatccctgggccgggatgtcacagcaagagaataggctggattagaggatcctttctttggagaagtgatgacccacaaaatgtcagtggaggccacttcttgattaattggttccaatggaaagatcccgaaaaaccatgagtttatgaatattccctgtgataaaatagacaaaactttttaatgcctgcaccttgatcaccgcaagagatggagagaaaattaaattatggaatgattactggctgcagaacaaaagaccaaatgaaatagctccatctcttttcaagatctcaaaaagaaaaaaacaggagacaaacaatgtttggctctccacactcacagtcacatccagcattgaggagataaaccaacttgtgactaggaggcctcctacaacaagttaccttggatccaaatattcaagatgacaaatgtggaaagggactaccaatggagaatattcagcaaagagttcttacaaaatgcaattccaagaattgattactcacaataattgcaatgcctttcggaggcaaaagctcaatccaagcacaagttctttagacggctcataatacatcaaagagacactcacgaccgataacttattaggaaggcattggccctgcgcatggatctgtcgcctttgcaacgaagctttttaatcgacggatcacttgctcaaagaatgtgaattcatggtaaatgtatggggggaaatgccaatgagcaatggtttgacacaacacataagcctcaatgagcaatggtttgctctaaccaaactcaagccatagaacatgagaaaggagtggttgggggtccaaattacaacttggtggttcatctagctagagaggaacataataactttcgaggacactagccaaagtgaagagcagattgcttttacaatcatgcatgaattaaacgctcacagtcaagcacatagaaacaactaattctagcacaacttttgtttatggcttctttttacgggacaccagggggagaattgctcacttgaatatattacgtcaaacggtcttacatatggcaaagcttttagctatgcaaacacaggagccctggaagataagagaaaatacacaaggaaaaacaaggaagcgaaacatgacaagaacacaaccaacccggagggcactacatgtaacagttatgtaaaactattaaacttattttccccttctacctataaaacggcaaaattcctacttttcacctcaaaaaaaatatttaacacgaatcagctcacttcttgtgaaaatagtaatttaaccttttccttgatgtgcaacagttttcccgtcacagtacaacttcaattcaaattggagatttttaatttgcggctatacacgcttcactgagttgctttttttcgtagatagtgttatctttttcgtaactactgtacttttcctcgacatgtgagttatttttccatatgtcattgtcacaggagtgataatatcatcaaaatggcaatcttgcgtacttgacaaatcatcaaatttctctaaatcaattcaaaggaggcatgtatgatttgcacctttttctcattgtgacattgcttcccaacactaggccattcacattgtgggtttgtgcgaggctcttcattttggagccacgacaacggctcaaccaaacccgtgctctcaggaggcttctcgtgtccaatagagagcacaattgcctcgtcaatgcaaggccacttgtgcttgatgccatggctcatgagccacattgggcgaggttgtgcccaccctcctacatacatgtggttacaagcggttgggaaaaggtaggagcttgtcgacaccttcaatccatgttgcacggagctcatcgaaggcaaatcccaataacatcgggtggtgtggggagagattgcggcgaccatagaaggggcagccaattaggagtccatagaggggttatagggagtagggatgtaaactaggaggaacataccaagagggtacaaaccaagactataatattgattgtgttgttggatcaacatagagcttgcacagtctgagttggcacctatccatctcatcacagagctcattggtccacactatctcgattttcgctgcttaaggattgctcaacccacgccaccgaggagcatttagcccacattgttgtttccgatcagtcgttgtcaacgctttaattagatcaaccactgagtctgttctcatcacccgatctacgctaccaccaagcccttgtctaatctataccactaccaattcatcatcgtcatctaagagggagaggcagtgacaatgaaggtcgtcaccaaagatgtgagaggtggcaggaatggccgaagaaggggacaagcggtggttaaagggaataagtaagggagtgaacaagtgaggagagtctaagtattatattaatttgtaaaaaaacaaaaaaaaagtgaggactagaatagaaatgtgaggagtcgatatgaaaaattgaagctatcacttaaagtcggcatcatgagagagaaatgttcagatgtgtagcctcatactacggagatattttaacta

SEQ ID NO: 76256 - DNA, 7627 bp, Oryza sativa
caaatgtataagatataaatcacacttgaagtactatgagtgataaaacaactcataacaaaataaattataattacgtaaattttttgaataagtcgaatggtcaaacatttgagaaaaagtcaacggcgtcatctattaaaaaacggaggtagtatatactttatgtatatacgtataattttctatacatatatacagagtttgtagagtttgtatgtatgtatataaagtatacatacgtgtgtgtatgtatgtatgtatatttttttaagtatgtatacatttttttatgtataaaaagtttaaatatataaactttgtatacatacatatacaactttatatatgtacatattaaaaaaatacaaaagaataacgtatacaaattttgtatacatatgtatgtaaaatttgtataatatattcaaaactttgcatacatatgtatacaaagtttgtatatgtatatattaaaaataaaaaatccagaaaaaaactgaaaaacaaaaaaaccgatagaaaaatacaaactaaaaaaccggtcacgcgtcgccacagggaggtccccccctctctctctccgcgcgctacgtgacgcgccacgcgggggacggtgtgcgatcatccgctttttttcgttaatgtcttaaaagtagcaaaaagttaaatacccccgctctttgaggtcatccctttttgaatattttaaaatgcgtttgtacatatatgcttcttttaactcattgctcgccatcgagagatgaagggagctctgtcatcacctacctcaaaagggacctgcgtggttcgagcttcaagcattgatgctgttgcaatctttatcttgtccctcccaaatttcaggagaacaatcgagtatcgacatgtatgcttaacaagacgaagtcaaccccctctatcacacaataaatacatgtacatgtaaacgaatgatactagaacactgatgttacgcggctagttaccaagtcaaggtgtttttattatctcctacactcgaagtttcgtagtacgaacttgcaatcaagtggaactacgcaatcttatccgctattcgcgatgtaaaagaacaaagtcagaagttaacaaagattagtactacaatttctaatgtaccatcccgtgtatgagctcctgaatcttcggaaatgttcaaaatgttaccgatcactgctcgatctgtactcgagtagctgcacgtacgctgggttaatttgacggcgaattcgtgaagaaaccacacaaaacgcgggcgagtgaatctcgataatcagaggaaataaaatgacaggaagaatatggtgagcacactgcgttatcatttcattttgacaaatcttaagatgtcaaccggcgcaaattccacggcgtgatggatatatacagcagcgtggcctccattgacaacggggcatttaaattttgatgtgagaccaccatgacctgtaataaggctagctgtaggagtaatataataatgcttcagacctataataaacataagaataaacaaaaaataaggctgtagttgttttctgatcagaggagatgccatgccgcacggcctctgttgacacaacgtctctgctggtacatgctggtgtaaacaagggtgtgtttagttcacgctaaaattataagtttggttaaaattagaacgatgtaacggaaaagttgaaagtttatgtgtgtaggaaagttttgatgcgatggaaaagttgaaagtttaaagaaaaagttgggaactaaacaagggccaagtagccttgtactggctgtactatctatatctatttatctgtctatgagaaatattcattaagaagtattaaataaggaaaaaacacgcatatttaaaagttctataaatttgtcgataccaaatctgaagtccaacataatttcatttaagagaaaaaaatcaatttcatatgaatagttccctcttactattcactataaatttatcattttgttgctcttaaataaagttgactttgaatttaagattttaagatttgatgaaaatatatttcaagcttatacatatctctagtaaagattttttttctccatctatctatttatctatccttcttccattttaaaatataaaaatttataggatttaaatcatgattcacaatataaggaattttagcactattcatattactacttgtctcatcaaccattttgcatttaattctttttccatgttacccctacccaccctcccatctccatccatttcatatttattaaggagcattaaagtcttctctctttaaacatggtactccctccattccaaattgatctacatctagtttttttttgaggttattcttaaatgatctacatatttgtgttcatttattagagtctattcgttatttgtgcattggagtaaatggacattgatgcatgcatccatgcacacaagtatttataacccacatgcaatatcttgatttgctattggctagaaaatattggggatggtgcatgcattgagtttgttgctagagtaaatatagtatgagagagttattagcttttcttggtcttggtgtagctatgaaatatgtagatcaatttggaatggagggagtatgtgctaaaaacccttatgcacgatcttagagcaggtataatagtaggctattagctagctgtaaacatattttaatgagataaaagataagagagaagagcagcaggctataaatctgtagccagctgcaacacggactccaagacgcaatgtgtgtatgacaggtgggaccatatattaatagtatagtaagcaactattatatgaattggctattagattggctatagataaattagagctaataatgggctatactattaaactttgtcttatgcgcgttcatgaaaaaacagtgcaacagatggattacctcatgcaaaagaaggctactttcatgcatgtttaacaaacagtcacgtggattcaaaagctttaacgcatgcacaatacaaatacactcaactcatcttggaaaaaaaagcaaatagtaaaatagtaaaagacttttggatggagaaagtataaaattgaaaacctgatcatgatcaaattcgatattttttttcaaaaaatactaagacaacgagattactatttaataaaattcaaataaatttacgtgtaaaataatttagataatttcgtattggtactccctccatctacttttgatagtcatatttttaaatctaaaaaaattatttttgataggcatatttcaatccaacaatctatcattttaatgattttcttaaatttaatgcgtgactctctatttctccacacaagattggctacatggtatcgagaaatgtaaatattaatgaatcgtttgtttacgaggaatgactattagcatgtttaaatggatgataaatggaattacttatctttgatctatgtgccaatataaaatatgactatcaaaagtaaatggagggataattagctgaggcaattatacgtgccaccttaccagttgtaataatttgtacgagccaccggtgttggttcttgggcgtcgtcgctcactcgctctcgtccgggacgggtactgaaccttcatctcgcggaatcagtttcgcgaccgagacatggcccccctctcgttgacccatttaaaggcatcgttaacttgcaaaaccgaccgaagacattgtggcccatgaatgcctagttgccaacatggcccctcacaacacagggatgccgagtcaaaacctgcgtcgtcgatcgagtccagttgagaccgggagagagatggattatgcctacctcttgcgttttgaatgttcgttaaatgtatgggaataaaatttgaaaatatactgttcattgatctttctttcagaaatatactggatgttgtttgattagcataaatataccatcgaaatcgcggttagaaaacgcgataccgaggttcgctacgggaaagcgcgatatcgccacggtatcgcattaccaatgcgcgagagcgtgacggtctcgtgcgttgaatgggcgaggagatttgagctggcggtgtcgcttgttggttatgcgatatcgacgcggtatcgcgtttccactgagcgagagcgccacgtcataccgatttgggagcaacagctggagtggtgctatcggtctcgcttattggcagcgcgagaatgggatcgctaccaggtttagacgcgcgagagcgcgggcccgcggtctcacacggccaaatcgcgagagcacaatcggtatcgctctttcagagcgcaatagcggctgtggagtgggtcccactggatttttttagttgggagatcgggcagccgcggtatcgcactgtgggagcgcgatatcgctcggagggggggcgcggtctcgcgcgttggttttgcgagaccgaagctgatgtgacactgacaccctcccgtcaagcatgcactcacgcattatcaatacgcacgcatgcaatcacactagcaaaataatggaacaagtcaatagtaaactgcatccgaaaaagtttttcaattaagcggtgtacgaagattatcatgaaataagctgtacaccccttaattactaattgctcacgcgtgattaatttatttttatacgaagttttctatgtaattaacttaaccttaacaccattaaggcaagtactatagtctcccatatgttacccctaagagtgccacattagattgagtgatgaggtggaggagagaagtgaggagagagaagataagctacctctaaattaagaggcaacatccacacaaatttcaagaaatatgtgagagtattagagaaattggtatttgtgtattagaggtgatacattgtatgagttgcctcttagttcatgagtaaataaaatagataaatttgaaggtggtagtcacatctaccatagcacttgcccttaggcgcgcagtggggctcacctgaccgctctcgcgttcctctagcgcgagaccgcgccatcgcagtcagggggcccaccgctctcgtgttcctgtagcgtgagaccacgtgggtcgcagtcgcaacatttgcgggggcccaccggctcgctctcgcacttttagagtgcgacaccgtgcgctctcgctattcggcaaagcgatatcatagcaccgcctaggccaccgcgtgcgctccgtcctcgctgactgaacgagcgatactgctctcgttctcgcgcctcaatcgtgtaagaccgcggtctcgctcaacgaaaccgcgacggcggtatatttttgcaaatcttcacgcgttcggtattttcttgcaaattctacagaaaatacgtatatttctaaatttttttcaaatgtatggagcattgaagacatgaatgtactcactccgtcccaaaaaaaatcaatctaatattagatgtgatgtgttctagtataatgaatcgtgatagaggatgtctgaattcattgtatcataaaatatttcatctaatacttaattcttttattttggaactgagagtgtacacatttaataccgttaattttcaataataagtaatgtagtcatcgacaccatagtgatttccttaaagttatgttggtcggatttttcatatgctcataaagataaagtgtgtatgtgtgtgttcgtccaaataaagtgtacatttctaaacatgaatacacatatctagtaccgcaatcttctctctgatattcttttttctgggagaagaagtctattgctatctcatgtgcgactggggcatgccatgcatacgcaggtaaacgcatcacaccggccggcagtatcattccctacaagcgatcatggtggcccatgtgggctttggggcgctgcagcatgggtgggtggggtgccatcccatgcgaggttacgcaggaagctaaaggcggtaggcacccactgctgcatccgtagtctgacgcggaccgacggatcaagtcgacggccaccaccacacgccgtagtttgataaactcagatcgcaagcgccgcgccgccgcggtgctttgaatgcgagagaatttgtcgtaccgcgcgcgtaaatgcggcgaccgctcgcacgtcgatcggccagaagccgtcaatgtccagattcataattatacgatgagtctgatagaaaacgataggtaaataaatgataaaaaataatagattaataatagaagacacgagatttaatatggaatatttttcttaagtaagagagaaaaaaccacgggcatcagccagcaaatatcttcattatatcaggtgagattacaacaccgaatgacagcttacgtgtgcgattgaatttgaatcacaaactcaacagagtcttaatccattttagattaaagtaatacgtattttagaatggagagagtacttggacacccaacgtgcagtgctgcatcctccggggctgcgccggggggcgggggggggggggggtggcggctgccctatccatcgccggccggccgggagaggcagcgagggaacacggggggtttcgccgtgttccgcgggggcgtgcagggtggtgtacccggccgcgcgcgcgtatactctggacaggctcaggtgacgggttcccctactccctgcacgtccttgtgtatgctttgtcttgcgcccccgcgccgcgcacgtcgcgatttagggctgttattagtactactacgagcaatcgagctcgatgagaattcgttcttctcctggtgcgtaatgcgtgattttgctgtttctctgtcgccgtcgcgtgattttctcttgcggcgatactatggtagagaaaatgaagtgaaggccccggcccatgggtgctatgggcctatggggccacgacagttcgattcattcctgaggtgtaaagcccagtagccccagcttgtttcgatttagcagttttcagttctagagagacaagttgcacacgtagcacgcacatagacccatcgcggtatttacatactacatttgtcccaaaatatatcaatttttatctatatataaatatagacacatagttctccagatttataaccaaaaatgtttatattttaagacggagggagtatgttgcaattttcggttaatgagatttatttgtttatttttttaatcaaaccctaactttcattactcattagcttgggaaaatatacagtggaaacctgaaaacgattgttagataaaaaatagacgcatgataaaaaaattactacatgagtatatctgcgagtaaaatttttagtcgggataacgtggaagaatctcagacgtccatttttcgatccgacggtagttttcaggtttccactgcatatgttgtttccatcgcatattttccccattagccgagatatcctcaacaatccattagccgaggtgtcctccacaaccaagtatgtaatacatgatggtatagagacgagcactgttcagaatctgccaagcacaaggaccccaactcagcgagtctatggactatcatatttccttctattggcttatactccctcgatcccccgtctctaaaaataaaggattttggtgaga

SEQ ID NO: 76257 - DNA, 9564 bp, Oryza sativa
tttttcctgggatttaaaattgcccttaagtgatttttaattggttaaaattatttccaaggctctaaaatttccactaaaaatcctgttaatgcattggagcatggggaactcaagaaaaattccaccacactatttccgattattaagtgcatttattaactagggatttagctctaggttaattaagataatttcttcaagcaatttatttaaccaatttttaaagcaagcaaaagggggaaaacttcagggtgtgacaacaacccttgtccacaagccttgccttgtacttttcaattgtaccatcaggcataagctttttcttgaaaactcatttgcatcctacaggcttgcaccgatatgaatgctcgatgacttcccaagtaccattagacataattgagtccatctcacttcataccgcttccttccaatagtcagtgtcaggagatgaatatgcctcttcaatggttcttggagtatcatccacaagatatacaacgtagtcatctccaaaagactttgcagtcctttgtctcttactcttttgagttgctacaatgttatcctcctcagaattttcctcaagcatttgatcaatgtgttctatcggcacaaagtgctcaggggataaaataggttcttgactagaagtgctaggtgcatttttcataggaaattcattctcaaaaaatgtggcatctctggactcagtaattataccaacacgcatgtcgggtactccagaatttactgttaagaacctatatcccacactatggatagcataaccaaggaacacacaatctacggtctttggtccaagtttacgctttttggctatagatacatttaccttggccaaacagccccatgtgcgcaggtgagggagatttaatttcttcctttcccattcctcgaatggtgttagttctttatgcatagtaggaattctattcaggacatgacacgcagtcaatattgcctcaccccaccattccttggaaagtcttgcagtgtctaacatggcattcaccattcagttagagtgcggttcttcttttcggctaccccgtttgactggggtgaatagggaggcgtcctctcatgaataattccatactcttcgcataaagaagtaaactcattggaaaaatactctccacccctaccagacctcaaccgtttgattttcctttctagttggttttctacctcagccttatagatcttaaagtaatgtaatgcttcgtcctttgttttcaataggtacacatagcagaatctagtgcaatcatatatcagtgtcatgaaatatttctttcccccttagtcaacacgttgttcatttcgcacagatcggaatgaacaagttctagtggtaccaaattcctcacctcagatgccttgtgaggcttgcgaggttgtttcgattgaacacaagtatggcacttagagcctttgactaaagtgaattttggaattaaactcatgttggctaagcgtgtcatacaaccaaagttcacatgacaaagtcgcgaatgccacacattggactcatcatcatcatcgcttacatggttcacaactttattacacatatcatccaagataaagcggaacaagcctccgctgtcataaccttttccaataaacgtgccatatttagatacgacacatttattggattcaaacacaagtctaaaaccatctctacacagtagagagccgctaactagattcttctttattgaagggacatgctgcacgttcttcagctgcacgatctttcccgaagtaaacttcagatcgatcgtacctacaccatgaacaaccgcaaacgatccgtttcccatcaacaaggaggaacctctcccgacctgataagaagaaaacagggaaatgtcagcacacacatgaatattagcaccagtatcaacccaccaatcaggggagtgacagacagagagaactgtagataaaatttaccataccccgatgttcctccgccctcactaataaccatgtttgcagacttcttgtccatgcactcaggacagtccttggcccaatgcctaggcttgccacacacaaagcaatctccttttgcctttcccttgtctttattcttaaaattgattgtagccttgggtttgacgtcaggtttgactttcttgttcttgttgtgggatgcgtgagggttcttcttctgtaccaaattagcgctagaacctccctcgatctttttgtcccggttgtcctttgccctcgtcttctcctcaacacccaaagagccaatgagatcagtaacgctgaactcttgcctcttgtgttttagagaagtaccaaagtctgaccaagaaggtggcaatttggcaataatgccacccgccacaaacttgtccggcaactcgcagttgttgttctcaagttcctttgccagcatctgaatttcatgagcatgttccactacagaacggtcatcgaccatgttgtagtcatagaactgctccatgacatacagctcgctgtcggcgtcggaaaccccgaacttggcctcaagagaatcccacatgtccttccctgaaggcatgtgcatataaacgtccacaatactgtcggcgtgcacactgatcaatgctccacggaacaagcaatccgcagcctcgaacttagcctcctcctcagggagagaggcggttcactcggtttgcctcgtgaagcaaagaaacattgcatcgccgtcaaccacaaaagtgcacgtgctttccatcttttataatttgaaccatcgaaagcatgtggttttagtgatgcagcaaagccaactaccgaaaaagacctatcaagtttttggattgttggaaatttggtcataattcgacatattttaatccaaaatattaagacaataaacatgacatttgcaatatgagtagatctagtgacagtgctagatgtatacaacttgagtgtgcttaatatagaataagcatcaacatagacaagagaacgcaataatattgcgaccgacagttgtaggaaacgaagaacgaacggtaagagtgaaacgttataccccgaaaatggccctccgctggagtttgagacagtattgcctccgttggtgttgacgggaggctcctccttgtctctagtgttgttgttgtcgccggttgtcgacatgttggtgaagatgatgcagagtagtcgcgcttgaagcgctactcaaaaacttgatcgcccgcctacccgtgcaggttctcaagcggacggagtttcggaggcacctgctcgttccaatcacccatgtgcgcgggatgaacagaaccggggaaacagagagacagcgcaggaacagaaggagagtatcgccaaggaacaatgcaggaggaagacacacactttgagagcctctgccttgcgttatatatacgtaaaatctaaactgagaggcttctcgctttagtcgtatcacgcgacgcatctcatagccgatcgatcgcgcctatcgtccatccacgtggccgcgctgtaatggcacaatgagaaggattgacacagtgtgtgccttgtttctcaatagacatgtatatctttttcctattcaaataaagttttctcttaaattacttatccgatctataatccgattacaccattgtgttcgttacaattaaatcttcacaacaagatcttacatgattatattacgatgaaaaaatatttatatttataaattacttttattatatatgtaagttacttttatcatatatatataagttacttttagatatgactaaattatttcttagtcatataaaagtaaattcaataaggtctaaaagtaatttacatatattataaaagtaacttaaaacaaaatggaagtaactttgtcacgacattagaagtaatatgtgatctaaaagatataagcttttttttgaaatgaatactaccagacatttgcccacagtgtaccttttttaaaagatataagttattaaagagattaaaaaaggatacatactattgcatttttcaagttcaaaggagagactagatggagtacaaaccagctaccactagctgtgtagtcacgtccaatgaaaaaagacatacattaaagttacactcttttttgttataagttacttctataatatatgcaaattaattttaggttttattgaatttatttttatatgtctaagaagtaatttagtgaaatttaaaagtaatttagatatactataaaagtaatttatgttttttcatcaaaatataatcatgtgagatcttgttataaagatttaattgttacgaacacaacggtgtaatcggatcgtagatcggataagtagtttaagataaatttttatttgaagcataggtggatagggtctcagctggtttagacaatacagctaccactagctgtgtagtcacatccttatatatatagagagagagatctccattaccacacaaataaatctcatttgttgtggatgttacaacacaatgaatctctcatttgttgtggaggttacaacacaatgaatctctcatttgttgtggaggctacaacacaatgaatttcatttgttaatggtgactttattctcatctgttacaaaaccgaaaagcagcaggcaggctcggctcggtcggccgcctcgcctcgctacgcctacggccgaggccgactcggcgcgcgcgcatgtgtgtggcagtccaaccatcacctcaaccggtcaacagggaatctccaatatcaccatatttaagttgaggttctttcacctaatttttcaaggtagtattattctctctaacattacttgtgggttcttgagattttaattgaattaaattgggcttagcccatttattccaacaggtggtataccaaaatgaactatcattttagacaaagagaccaacaggcacatgaatcatgcatgtagattacctcgtagtgtggaatcctatgtactcctcactcctaccagccatgagcaacggattcggccaagactccccttgatactctcacattagctggttccataaaagcatgagatattcccctgtagttgttcgtctacaagcagtcgaagacaatatggaaaatgtaaagttttaatggaaaaagagccatagtttaagaatgttcgaagaatccaaattccatccaaccaaatctaaaactgcatggataagcctccaacttctagaattttagcatctaaaatggctagttcaaccatacttaacaacgataaggtaagctacacagaaactatgtaaataaagtagtaacaaaagcaaaattggaaatttcagaatcaagacctcctaataccatggtgaatcatgatgatttgtgttttcaccaaagacagggattaaatcgtcttcgaagttcaaaccccactgttgccttgggcttggcctgtgatgccggtttcatcaacatatgtttggatccttgaacagcaaagcgagaaaaaagaatggtcaattccgtcaatagcacaatagcagccaagcacccaaatgcttgattggggcataagttttttttgtgtatgtatcctgagttagcagcagctcgatcttctacagacaatccaacaaatcaaataaaaatagaatcaattacctggaggatgacagggatgatggaagtcgacagcatgcctgctgaggttgccgttgccaccgcctatgcgctcttctcttccctccccttccgatcttaggttctcttccctcccttcggatcttagggtttgagcagtgacagcggtagggagagatgaagtaggaataggatatggggatggaagaggcggtgcaccggacggaggagaaagccgtagggttggaggaggagaggggctatgaggcaatggagtaggcgccggggttcacgacggaggtggcagcagcgcggcggatgaggcgccggggttcacgaccgaggtggcggcagtgcggcggaggagctgccggggtcgcgactgatgtggcggcagcgcggcggaggagccgccgagggcgcgacggcggcgctgggaaagcggcgaaggcggtacgaaggaggagtgacgggggcgtgcgatggagggggcagtgtgaggacagtgcgatacgaaggtgggggtggtgcgggacagcaggaggttatttgatcccttcgatctgtgggaggatcctgcgaggaatatcggcccttggattatacaggactcaccaacaccaccacgtattttttaagtagtaaagatactatgatctatgagacatgatcatcaattaatatatgtgctgatcatttaaccatatttgttccatatatgatgtttgatcagggatcttttagaaatagtaacaaacaacataaagagtctcatgaaagaatcacatattcattaactaataatgagttatctatttcaaggaacaaagttggataaatatgtaaacatagtatgtaatacaatcatctctatgattgcccctagggcatatcactaacacaacccttgcgcctgattgcatgcagtgaattttggtgaaggcgttctggaaatgatgtagtgttgcaagcgcctgagaaaaaaaaacaaaccacctcagagttcagagcgagctgacggctgcaccaccaccagtccatgcacccatcaatacaaagttcttgcttaacccaaaaagagattaaattgacctattaggacgtttgtgcccataaatcgagcctctctatgtatatataattgtagaaaatattttaattttgctcttagtatataaaccaataattcctgtgcataaaacaggacaagcttgtccacatcggcataacaagcaaatatggcaacccctcattctaaaaataaaatgacacatttttcagagaaacaacaggttcagggtcaaaaccagcccagcagaagggagtcaggcagctccatctcatgaaccaactgaagtttctcatgtcactggtactgcaaaagaatcccctccataattttctgttaaagtgtcagtggcaaatcaccataattttctcttaatcacaagagactaatcacaaaatgtgtacatcttcaaacttaatagctgatttgcaagcaacataatagaagagcctgacagccgcaccaccaccagtccatgcacccattaatacaaagcaagacaaatcatctggtaggggaggaggatttttgtaccttctatcggtggcggaggggatcggcttggtgaggacgagcccggcgactccggccgacggtgatatgggggcgtggaggcgggcgccctggcgtacatcgggggcggcgagggcaaactggcctggcagcgcggatcggtgcgatgggcggaggggcggtgcggacgagatcgtcatcggtggcggcacggataggtgcaatgggtggagggacggcggggatcgatgcgatgggcagaggctcgggggtggcgactgcgactccggtgcggatcagtgtgatgggcggaggggcacgagcagcaggatggcgaggcaaagggaatgctattggaaaggaaggggtggcgacggcggcgtgatttgtggggcgatgcgttggggggatgcggcagttgtagaagggagagggaggtgcgcgagagagggagggatctgggagggagggcgcgatctgggagacgttggatgtaactcagatgattttaggctgttggatgtgtgacatgatgaatgtgtaatgagtaaaaccatttgttcaactatagggtagatgttaaactatagcttagcttcgtgtcactgtgcccgtatattaaacttaacccctgcttagactttgataaatacaagtaatatatgtataaagagtattagcatagtctactcatattatcttcccttgggatcaaaaatacgataccttggaatatttttgggtgaaatactacaatggtatatcggtgcgcttgtggataacatctgtaaccagaaaatataccaggaccatttctgcgtcattgctaggaatgaatatttctagtaatgtcgttaagaaataccaataataccaaagggcaaaatgaactttatgataggaatttaatggtcaactaacaaaaggggtatagaagggattcaaactgaaatttaggggtatgaaagagaatgagcaaatctcagaggcatagaagggattgggcgaactttcaggggtacacagggaattttctgtgcaaaataagttaacacacctacattaacttattttagcatggagggagtacacggataaatcttatgtgacagtatcccttcttcacccctaacccgtcggccttcattaggtctccaacactatcctcatttaattagctagtaacagaaaaagtgttaaaacaacaagaaacaaaaaccgagctgattgccaaacactgatctacaccttccatcctataaaaaaaaacttaatcctaactaccgacctagatacgcatgcattcggattgatagataggattaatatttttcttggacggagaaagtaatacccaaaagataacccgagcttactgcgtgcaggcgaacaccgaaaagaatcactactagagaactgattgttgacggtcgttatcgaccaatttcgaccatcaatattactcaattaataaagactagctatgcttgcaatgcataatttgcaaataaaatatcaacttccactatatactatactactaacatagatgtaggagaagcacatataaatggagaagaatcgacagaaagtaaatggtcaatcaatcatacgctgtcgagatccagacttatggatgaatgcgcaaagaacacagaattcacacgatccactaggccttctggactgacgagacaacagggagacggcctgccgaaaattgggctgtttgggccagcctccccatctccgccgttgatcccaggttttggggtgtggatgtccaggatgcctccctcaacgacagttggagggcagaatgaacattttgcatcacctaaccgtcataactgccctatgtaaggacctcacatcctcactctctgcacacactcaagaagaagagctctctccctctctcaagtttagtagtatcctagtgctagtggagtagaaattataaaagtattcttagtcctcgggtcttcaggagaattttggtatgtctctagtagctttcctctcttcttttgtaagacttatggaattaatagaatattcttctttatacatcttcggtattttattccatttatattatctgagtgccggcttcattttatacttgtatcaatatagttgtgtagctagcctaccagagaggtgcaatggtgtgggtttagtgtccgattactcagttgatctatgtcatctcgggggatatatagtagtatttaataatgtagatgtggtgtctaaattattaagtatcactatctgggcatatatgctgcgggacagtagaggtgggccgctgatggtgaca

SEQ ID NO: 76258 - DNA, 7426 bp, Oryza sativa
ccaaaatcccttaattttagagacgaatagagtaactattaactataactataactatagtattacgaatctggacatacctctgtttagattcattgtattagaatatgtcacatccagttctagattcgttttttgggggacggagggagtatgcttcaattcccatatcacgctgctgctgttggagagatcataattagatgataaaatagccacactgaagtatggaataagaaactggatggatagaatgaacagataaaacgacccatatatgttaaaatgggcctccaagatgataatgcatcaccgcagtccatggcccattaaataggcggctgcattgtatttggattcacgtttgagctgcagtgaaacttgggaagttaagtgataaaatagttaagcatgtgtttgtttgaaaagatatttttagatgggaacaaggttagatgagagagccagagaaggaatattccaaaaaaaaaaaggctggatgagttcatccacaaaattagccggatgaagcatctcctttgctagtcttaatcattagtaattagtttgtgatgattaatatattttgttactcattagtttatggttgtttcttgttgtggcctagcctattttcaattacacaatgtctactgtccaccttaaagaccttaaggaggttacttttttgcaacattgtggttgcccttcaacttgttaagattagtgttgatagagaaaattagtccattttattgttaatttgtgtattatagacatattaataataattaatattttgtattataatttaaaatttttattgttttctatccattttcattcatccaaccaaataagaagaaactggatcgtccgatctactcaatcaaacaaaaatttaaaccactatctaaagaaaatgtggacatatcgtgagatatcttgacgataaacaaaagcaccctaacattccagtgagagtcaaatgaagtgataaaatagttacgttgtgacaaagaatgtggaagcaaatgctatagcttgcctaagtagctaataggtccttcatcgagaatttatatttcactattatttacaaaaggacggttaattttaagtggggacagatatattattggagtttgcaaaaacataaggaatggctaaaagcaagtactataaacctttaatcacttacctcaaaattccacataagcccatatgataaaatggagaaaagaagaaatgagaggcggtagaagacaccccttatgtaacgggcagtttccacatatgtaacgggcagtttccacatagacttcaagtaagaaaaaaaatgatttgacaaacaaaattattagaattagtgtactagagttagtgtgcatgtgatatattgagtacatactacctcttagtttgtatgaataaaattagaagtagcaactatctcttctataaaacttgatctaaggatttaattaagcactagtcccaatatcatatgatgagtaggaggatagaagagaggggaaaaagacacccctcataaaaaatgtaatatctatacaaacattaagacaaaaggagggagaggaaccgcagtacattggaaaaataaatattagaactagtgtattagacttatggatataatatattaaatatgctatgtctaaatttataagtatgcgatatggaaaaaaaatataggtaataacaaccatcttactaatccctttgttccataatataaaggattttggaagaattagacacatattgtccatattcgtagtactagaatatgtcacatctctccaaaatctcttatattttgggacggatggaattctatataaaacttgctttaaggcaccgtttgaatgtgaggttgggttgagttgtggcacggaaaacgtaatggaccattagcacgtgataattaaaattaaccagtccctccatcacacaaagccttcattttttgccttcttcatttatccgataatttgagccaatcaatgtatttgagtttgagaaatttgagaacggatgcaatggagttttcttaaaagaaggggtcaaatgtgttgaggtttaataaagtaggagttaaatacatcggagtttgaaaaagtgaagaacattttagccttttgactttatattaatatgcgtgagataggaaaaataaaatattttagacagagatagtgttataagtatgaagaatatatttatttgttttttttaaacaaataaacttctgtctactaccttcttcaataaaaatcatttttatatttttcccgttccaaaatataagcatttatagctatgaatctgaacatctgcccgtctagattcatatataaaagttgttatattttcatatagaggtagtacatgaatatggataggtactcttgtatgaatctagataaatggttgtccagattcatttataaatgttaacattttgctaacatagttgaaaatatttgcatgaaacacaacatttaacagcttgagaaacatgctcatgaaaaattaaaaaagaagcataagttgataaaatgatgacataaaaatagagcctctttggatggagggagtaaaagtgtaagacaattaacatgacgattttggtgggattatatgtttctggcacacgagtaagagtatcgtttaacagtttgagaaacatgctcatgaaaacaaataaaaaaaagtagagtaagctgataagaacgatgactagaaataaagtctttttagatgaatagagtaagacaattgacatgacggctgttgtggggctacgcttctagatacgactgatagagttgtgtgcatgtctagattcatgtataaaagtaaattatttttatacgaagatgatataaagtatttgcatgaaacatgccatttaacagtttaataagcgtactcacgtaaaataaaacaaagtagcataagttgataagaatgatgataaaaaataatgttttttggcggtagggagtaagacaattgacatgatgttttctgtgagactagatgcttctggagacgtctcatagagccgtatagctattcagatttatatatataagtgaattattttttaacgaagacaatagaaagtatttataagaaagactatttaacggtttgagaaacctgcttacaaaaataaaaaaatagcttaaactgataagaaagatgacaaaaaaataaagtacttctgtcgtatgaagtaagacaattaacatgatgattttgatggtgctagatgtttctagacatgaccgaaagagttgtatacattcatgtctaaaagtgaactatttttcttttacaaaaaaataatagaaagtatttgcacaaaccgttgaaccatttaagaagcgtgctcgctcacgaaaaataaaataaaaagtagcgtaagctgataagaacaacgataggaaaataaagggtttttagacagagagtaagacaattgacatgatggtttcagtcctactagatgcttctggacatgacggatagagctgaatacctgtccaaattcatatataataatttaaaatttttgctcaaaacataacatttaaccagttgaaaagcgtgttaaaacataacatttaacctgttaaaaagtgtgttcacgagaaataaaaaaaagtagcgtaacctgataagaacgatgacgtaatttttttttcgaccgatacagttggtatagtaatggtttgggtccgactagatgcttctagacacgacgccgtatcctctaggaggattgccgtcctcgaaaacccgtgctgagggtgtagcgcgcgtaggcctcgagcccatctcactatcaaaacgatctatcggatttcccaagtagaaacacacgtctcctgaaccaaccaggtgcacgatgcacctccccgcggtgccacacaccctctacgcctggatggtcaccaccaacaacgggggccccatctgccatgtctgcagtagaagcgaaaccccacgagaattcgaaaccatttcaaacctcccccgccagcgcaacgccgaaaacgcgaaaataagacagttcccacgtaaaaacttttcacgctatcatattaaatattaaatatgtaatattaaatatagaaaaaaagcaattacatagattttgtgtaaattacaagacaaatcttttaagcctaattacgccacgatttaacaatacagtgctacagtaaacatttgctaatagattaattagacttgataaattcgtctcacagtttacagacggaatatgtaatttattttgttattagactacgtttaatattttaaacatgtgttcgtatattcaatgtgacacgcaagatcaatatttttttttttgccaactaaacagggcctaaaccccgtttcccgctgatttcgcctcgttttgcccccaaactcgattcgaaaccatttcaaacctccccgcggcgcaacgcctaaaacgcgaaaaataaaccccgtttcccgctgatttcgcctcgttttgccccccaaactcgcgtccaccacccgccccgcccaaaaatcgcccaaaacgaaccgacgctacgcgagccaagccacccctcgcgcggcaggtcgcgaaaagttggggcaaatacacggaaagaaaccctccatagtacgcgcgcgaggggaagccgaaaaggcaaaccaaatcaccaacaaaaatagtaggccgcccccgtttctccctcgcgccgcctcgccgcggccgaaatctcaaacgcacccccccccccccgcccccccaaaattttcgctgccgcgccttctcgcctcccttaagaacgcgcctccccgagttctcctttgtctctccccgcgccattgccaatctccgacgcgttgtggaggtagttgttgtcggtggtccggctatgccgtcggccgtggtcgtccgccgcgcgcgcgtgcgcgcccggtcgcagtcgccgccgggggagttcgattcggcgcggcgcacgcggccgcggatggagggggaggaggagatgcgcggtcgcggcgggaaggcatcggcgcgggcccggtctcagtcgccgccaggtgggtccggttccgcggcgcgggtggaggtggaggggatgggggcgtcggcagtgcccgacgacatgctgctcgaggtgttcaagaggctgtcgccgctggcggacatcgtccgcgccgcggcggtgtgccgccgttggcggctgctcgtctccggcgccggcgggctccccgcgccgcctccgtacttcgggttcttccgcaactacgcgccgtccgcgcttccccctttcgtccctgcagccggcgtcggcctcggcctcgaccacggggcgctctcggtgtcgcccgcgtgcggcgccctcctcgtcgactgccgtggccggcgcctcctgctccgcgagctcggcgccgggtcggcgagagagctcaagctcctcgtctgcgacccgctgaggaagacgtccgtgtccctcccctcccgcttcgtcgccggacacaaggtcgcctgctgcgcgctcctacctggcgccggcgcggcgttccgcgtcgccgtcgtcctcttcggcgctgctgcccacttcgacattctagtgtactcttccgccgcctccgcatgggaggcggccaccggagcgctcaagaagtccatgaacccacaccaaggcccgacggtcgtcatcggcgacgtggtctacaagctccagagcgaagaagacaaatacgtaatggcagtcgacgcgaccaagatgacgctctcggcggtgccattgccgaacaccgggatgctcctgtacgccgggaaccactggatcggcaagacacacgacggccgtctctgcttcttcgcgctgcgggagcagctcgttcttgcgaagtgggttctcgagtcgccggggaaatgggtggagcagccggcggtggacctgcgcgcgctgatgaacccggccaccgtcggtgacctctcccgaatcaagctctcggcgaaaatctcggaccagctgcgcggctgcaagctcgtgagcttcggtggattctgcgagggcaccggcgcgctgttcttcgtcatggccgactgggtcgtatccctcgacctcgcgacgtggaggtttgagaggatgtggcgcaacaccgatgagtcgaggccgctcggcgacatcttccccgtcgagatgatggtttggccaccggtgcgccgcggcgatcttggcgagaaggaatgaggtgcaaggtgttcgacaaatggcaggctacttgaattgaaggtgtttttttgctgtaggcctgtagcgatgaaaagaataacaaattaagaatgcagtttgcgaatttgtcgtcaatttccattgttactcaaaaatgtgattaacaatgtgatacaattcactgaatcatactggaatggtgaaactttttcttttttttttttgcgggggaatggtgaaacttttgggtggttttatctttgtgatatctctttcatgaacatatacttagtaagagcattcccttgcatgttgccgttactcataacgaatcgcttcgaatgtcactttgacctttgaaaggattggttcattatgttgagtaaatcttgtgaatgctaggagtaaagccgaccgtttctgccatttttttttcatttaccaggacgcattatttgactgcattcatcactgatagccataatgtaaaactcgaatattaaaaaaagaatgacgaaaattgcccccttttttcattcaaaagaacattgtctttgttgctaaaagttacttccctgttatagaataactttatttgttatccatttcataatactaatattgacggagcgtggggctcctcaccgggagaccgcgcaggcccccctttgccagttcggccgggggccctgtgtgaggttctaagctcttggtctgtggaaagttcgcgagaatggaaacacacaagacacgggcgatgtatacaggttcgggccgctgagaagcgtaataccctactcctgtgttttggtggatctgtgtatgaagaagctacaaagtccgagccagcccccctctcgttctaggatcgttctcctcttttttccccctttttctaagtgggcaaggtcctccttttatatctcaaggggataccacatgcaccatctctccctctctttcttacttgacttctcttcattaatggacggagatttgtatggctgccgtccgaatgaccttctgatgggacggcccatacctacctccacttccgccggaagcagacgcgacgtgggaacatggctgtctgctgacatgaccattgtcagaccgatcacaaatcggtcattcttgtccaccacgtgtcagtttaa

SEQ ID NO: 76259 - DNA, 4476 bp, Oryza sativa
tcccttgggattaaacaaatatgatacttggaatactccggggtgaaatgctaaaatggtatatccgtgcgcttacggatcatatttgtgaccataaatataccatgaatatttcttcgtcattgctgggaattatatttctagtaatgccgtttaagaaatatcaacactaatctttgcttggacggcaaaaatcacagttgcccaagttcgaataggatccgagactaaagaatatctttagccacgacaaaaatcacagttatcccggttcgaacactaactgggatttaagatcatttttagccacggttcaataattgtcaggccgtgtcaggcccccaacaaggactaaagatcatcactttagtcccagttgctgttaccaacccagactaaaataggaggatctttcatcctggctggtaacaccaatccggactaaacattgatcattagtcccggttcataaaccaacccagactaaagatatttttagctccacttggtgttaccaacccggagtaaagatgcctccagggttagtttaaaaataaagcatctctatccaagtcagatgtgtatactagagatgaaaacggtcggaaacggtatcattattttattatttttcgaaaacgaacggaaacggtcgaaaaatttccatatttatgaattcatctatttagaccctgtttgattcagcttaggattattataatctagattattaggagtaagctgaaacaaacaagtagattattatgctagattattataatctataagccggattactataatccattaatctcctctagagaagcttttttcagattattgagtggctaaagacctactacccttagatgcctctaataatccagagaaataaacaactcgtagcttattttatgtcattattataattcagcttagagtaatctaatttaataatctagattacaataatctttaagctgaaacaaacaaggccttagtgtcaacttcaatgccatgctgacagaaattaaaaaaaactaaattttgaaaacggtaaccatcggtaaaaatagtattattatattagttttgtggaaacggtatcaataccgtcgggaaattttcataccgttttcgtaacacgcgtgagggttgaggtgagagatcttgagtttgaatcccacatccgacgcgtttttttgacgtggtatgcatctttagtcccgcttatttcaactaggactacgaagggttggcaaccgggagtaaagctcccttccccaggagtgaatgcttgtttggttctatggctgatttttggggaaatttgtgcccaacccctactcgtcacgtgtgaaggaatcaggccgcatgtatggtgtggggccactctcttttggattgagacgacggttatgcaactttttaccaaccatggatggaggtttaaaaatagacttgaataattgtgtattccttatcttggtctggtcacttttataatgtttaggtgtgtttaattctatttgaactacactcttgttcgagtgttagattgtaataattggctgcagctctgtttagcaaaggccgggatgttatctattccattatctaaaaaataagtgaaggaatcatgccgcgtgcatggtctggggccactctcttttggattgagatcctcttccttaagtcagatgacattaaattctttgacatgtggacccatagaactagaaaaaaaacgggtaatttagaaccatgccattataattttgcaaagtttgagatatgccatcggtatctcaataacatgtaggacccacatgagtcaatgacatgtgggtcaggatggcatatctcaaattttgcaaaattataatggcatagttccaattttcccaaaaaaaaaaggatcccatagtaggcagaggctttggccatagccttgtgggctgtggtgcaaattctgtggaggcggccggtcaaaggcgaccttgtctacctgcgtgtggagtcgtggagctagacgacgtcacctcgcctcgtggtttggagtcaaacatcgaccggggtggatggtgcgcgccgcaaatagaagaggtggtgtggagtttacaaactctggaggaggctactccgccgcagcgcagctaacaagcaaccaagacgacatcaagcttcgccgctacaacaggcaatcgcggctacaccgctgcaacaattgaggaaaagaaagcagagcagcgctggtatccttttgtcgagaaacctagaaaccttttaagttgggcgggagcttatcgggcagcatttgcctggtggacgccgttttgctacgtctatacccagacgctgctcgtaacagtgaccacacctggacgatcttccaaatagcgtccttactattttgctaaataatgccaatgaattactaatgatttaatttcatggttattaattattatatataggaaacaatttcatggttatctatatacctaattaaaaaatacggaaggcttcctccctccgctttagtccgtccccccaccccccctgcccccacgccgccagccctcccatgcatctccgcttccgcctctctcccttccttccgacgcccccatctcttcgttgctgcacgctcccccaccctcgcggccctcttctcccttgcgcctctcctctcccgcctccctctctccctcatggcactgatgaaccctgagttccactcgacactcaagactgttgttggcccaatctttcgatgagtttagataactacgatttagaagaaacgttgatgacccgactacaaccgtacaagacgttacgttgtaccttagcgaccaatacacatctccatctttcattctttccgcgagttcaaggaaaacagaatcctctcgttcaggaatgtgttttgacgcacttatccggtcgtgttcgccaccagagctcgtcattatcgtttctccctctaccaagaccatgacattgcttgcccaattcctgctgttttggttttcttcattgccgaccaccaccatctatggacgagtcacatcgtgagacacatcctaccatcttcctcgccactgtttggtcataggagcaccgacacccatttcccctcctcttttgtttctcgtcttcagctagggaaggcaatgaacaatgtttttttttgacacaattccttcttggtctagcccaaagatgctcatggaacactcacagaccataggactatgaatagaacaataaaattctaatttatgtcaatgaaacatgcaccgttttagaattaatgtattggatttttcatttgtgggctaaaataagttttttcaatttctaactaatttaagttgttttttcacagtattagttttagcactatttgatccattaaaaattatcataatttatatttttctttgtattgaattctttataggtaaatgaaaaaatagggattaagttatgtaattttcatgatattgaattatcgttccggacaaaagttatttgtatgtttgtatttccttcgtcgtttatcccaactataatatatgattttggattttaatttatgtcaataaatattatttagaaaccgttgcaacccacaggcattatgctagttaattactcctcgtcccaaaatataacaatttttagcacttagagcaattttaatagtatagcccaccgttagctcaaaatcatctatagccaatgtaacagccaattcatacaatagttgcttactatactattaatacctggtcccacctgtcatacacacattatgtcttgtagtccgtgctgcagctggctacagatctgtagcccgctacttttctctctcttcctttatctctttaaaatatgtttatagttgacttatagcctgctattgtacatgctcttaggatttgtcccaaaatataacttcttcatcagcatttccttcctaaccaatcacaacccttcacttttcccacctacctccactgctcaaccaatcacaatctctttctatttaatgctatctatttttttaataaccgtgtccaactctaaaactgtctatattctgtgacggagggactattatatataaaaaaattcagcaacccctctcgggtcatttggttgggggagtttttaggagagattgagagtttagagggatgatgctattaattattctgtttggttgtgttaacaaccaaatttggtaatatcacactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatcggttcgaatgctgtcaggacctgtcaggcccccccgggatctttagt

SEQ ID NO: 76260 - DNA, 16195 bp, Oryza sativa
ccgcctgtcgccacctaacccacgatctgaccggtctgtgaccggtcacagcacgaataaacgagcgcgctgcactgcgttacatgcggcgtgacgcgctcgtccaaaccgtaataaatgtggttaggtgagccccgctatgctcacctaccccatatacgcggcgcaaaacccacaaggggtcggggcgcctcggccctcggggccgaggcggtagcggtccgacccctcggggagacaaagagaagggcggccgtatcaccctcgggcccgacccccccgagggggttaggccacgtgggcgatcgtgtctgcctcaagtctctaagtcatgatactcctggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatgatgatggcgcttcggtcggcgagcgtaattaacgcgcgcacgagatgttccatctagactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcactattattccccttgtcttcgccgcttgcgccctaactccttgtttcctgtgccctaccttcgccacacgcgctcgctctcaaacatctcttcttccggcgtcatggcacggggctccgctccgcttgatggtagcgtgctgccgccttcccgcatcgtgagcgagagacaggccgagctgccgcgccgcttcatgccggaatctgccaccggccgggagatagtctcgctgggcgagggatgcccggcgccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgtttcggtggttcttcactgtacagccggtgtcgccgccgtcggtggttggtggttgctacttccagccgcgggggccggtgctgaaccactacattccctgcgtcctccgcaagaagtgggatgactggaagagcgactggttctatacccccctcgccgacgaagcgcgcctccgacttccgagccagcctccagcgcaggcctccaactggcgggcgccggtagatctgggagatggctacgacgccgtcctcgaccgcctggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccagggggtcagatgggactgggctcctgaggacttcaagatagtggtccaacgggtgctgaatctcagctccgtggaggcatccctcatttctcaaggagtcctccccctctgcagcgatccagaccgtgcctccatcctgaccatcatgcaggcggtcagggcgtcggaggagcgggctcctcgaggccacgatggcgcgggcgggagccgcaggggggaacgatctaccccgggagggggtcgtgcttctgggccccgcgacgggggcccggggagcggccgccctgccgacgcccgggggaagaggaagcaggaaggaacccctcccccatctcctccccgagggggcggggcggcgcgtgccagcagcaggcgcccggagggggccacgccgacgtcgcagcccgaggggagcggaagaagaaacggccccgcaagatgggggggacagaaccatcccggggaaaccttatttcccctccaaggtggtcgtttaaccgaccccctcgcaggttcgtcccacgcccatcgtggccgtattcattccctcaacgcgagttttcactcatccatcttgtttgtcttctggtctttcttctgtttcagcgagatcccgtcgcgtccctcccgccattccaagtccggccagtctgaggccgaggacccggcgaccacaaaggctcggaggcgggaatctgaccggcgagaagccgcggatcgcctacggtaagccgaggaggccgcccaggtggccgtccgagctcgccaagctgaagaagccgctcgggaggaggccagacttcgccaggccgaggcgacgacatcctccgaggcgacccgtgaaactgaccggcaagaggccgcggatcgccttcgagaagccgaggaagctgctcaggtggccgtccgagctcgccaagctgaagaagccgctcgggaggaggccagacttcgccaggccgaggcgacgacatcctccgaggcgacccgtgaaactgaccggcaagaggccgcggattgccttcgagaagccgaggaagctgctcaggtggccgtccgagctcgccaagctgaagaagccgctcgggaggaggccagacttcgccaggccgaggcgacgacgacttccgaagcagctcgcgacgaggccgcgggcgcatcgcttgggcccactcactcgtgcgacgctcaggacaaaccaggtccgggggacatccccgagtccggcacgtccatcggcgggccaagccgcgcggcatcctcttcgaggcggctcttccccacgccttccgttgctccactgagcgcagaacctcttctgcaggccttggccgtcgctaacaccacggtgttggacgggttaagtgcccagatggaggccttgcaagcagagcgggtggagctcgacgccgcatgggcacgtgtcaaagaggggcgtcgctcggtggaggccatggtggaggtgggccgcaaggcacaccgccggcacgtctcagagctcgaagcccgtcggaaggtgctgggggagatcgccaaggaggtggaggaggagcggggggctgccctcatcgccaccactgtgatgaacgaggcgcaggacaccctccgccttcaatacgggagctgggaggcggagctagggaaaaagctcgacgccgcccggggggtccttgatgctgccactgcccgagaacggcgggcggcggagaccgaggcggcgtctcggcggcgcgaagaggccctcgaggctcgtgccatggcgctggaagagcgcgccggcgtcgtggagagggacctggtggaccgcgaggccgccgttgccatccgggaggcaacgctggcggcgcacgaggccgcctgcgccgaagaggagtccgcgctccgcctccgcgaggacgcgctcaccgagcgggagcgagctctcgaggaggccgaggccgcggcgcaacgtctggcggacagcctgtccctccgtgaggcagtgcgggaggagcaggcgcgccgtaatctggaaggtgcccgcgccgagagggccgcgctgaaccagcgggccgctgagctcgaggcgcgggagaaggagctggacgcgagggcgcgcagcggcggggcggccgcgggcgaaagcgacttaaccgcccgcctcgcagctgccgaacacaccatcgccgatctgcagggcgcgctagactcgtccgccggggaggtcgaggccctccgcttggcaggcgaggtagggcccggcatgcttcgggacgccgtctcccgtctagtccgcgccgggcggcaggcgggtctctggggcgggcggactgtgaagtacgccgccaaccaggggggcctcgcccagcgcttctcggagatggccgggactctccagcggctccccgaggagctcgaggggacgattaagtcatcctcgagggacctcgcccgaggagcggtggagctcgtactggcgagttaccaggccagggaccccgacttctccccatggacggcgctggacgagttccctcccgggaccgaggacggcgcgcgcgcgcaggtccgggatgccgccgaccatatcgtccacagcttcgagggttcggcccctcggctcgcgttcgccctcaactccgacgaggagggcgatgacggcggtgtgggcgacagtggcgacgaggctggcgacccgggtgcatcggagtgagcccccaggcccccgccaatctttaaatagtttcttcttttcttcttccgaggccttcgggcccccttcttgtatagactaatttaatctgcaatcaaataaagaggaaattttttgtgtcaattctatttgttgtgtgtatgacacgaggatgtctgtgccgcggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcactacgccccggggcacggctcggttctgggccccgtttggcgattttagccgacccgagcccccgagggcaggattgaacacgagtgacttatttcaagtcaagatccttcaaaaggaaacaacagcacagatacagcctttaggaaattgaaaatgtttttattgaaatacagatacaagagatataagaatatgcatatgtggtagcccccggccaaccctgcacgcccgaggggggtgcggggttggcctgagcccgaaacctgacacccgatccccctttaggggtagaagcgatgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgtggctcggagggccgcgcgccgccttcgctcttccaagtagtcgaggtcatctctgcgaagctgatcttgatcagcctcgcagtacatggtggcccgaggggaccttagggtgagctcggatgggagaaccgcttccgcgccgtagacgaggaagaaaggcgtttccccggttgctcggcttggcgtggttcggttcgaccagagcaccgttggcaactcctcgatccacgaatcgccgtgcttctttaggatgttgaaggtcttggttttaaggcctctgaggatttccgcattggcgcgctccacttggccgttgcttctggggtgggcaggtgaggcgaagcagagcttgatgcccatgtcttcgaagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcctgcctaaacggtcccaggatatcgagcccccagacagcaaatggccatgaaagtggtatgatctgcagggcctgggccggctgatggatttgcttggcgtggaattgacacgccctgcatcgccggaccaggtcgaccgcatcattgagagctgtcggccaatagaaaccttgtcgaaaggcggagtgggatccgcattcgccttcatggatatcggcaagaaactcgacgccttgttcccgaggaatgcacttcaggaggattccgttagccgcgcgccgatagagggtcccttctaccagcacgtagcgtttggagatgcgctggacgcgttcactcccttcgcggtactcgggtagagtcttatctgtgaggtatgcttggatctcaacgatccaagcaatcaatctaagggagctgggagcgctcccctcgggtcccgaggcctggactccgacaggcctcgggggcctgtcaggcgcgtccgtctcccctgaggggtcgggtcgcgccgaaggctgggcaagcctttcttcaaaggcgcccggtggggtctgggctcgcgaggaagcgagccgtgagagctcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccccagtccagctgccaccctgagtcccgcaaggagtccttcgtactctgccatattattggtggcccgaaagtcaaggcgaaccaaatatctgaggacgtctccgctcggcgaggtcaacgtgacccccgcaccggcgccctgaagagacagggaaccgtcgaactgcatcacccagtgggcggtgtgaggcagctgcgaggggcccgagctggcctcggggactgagacgggctcgggggctggggtccactctgccacaaaatcggcgagggcctggctcttgatagcgtggcgtagttcaaagtgcaaatcaaactcagaaagttcgattgcccatttcaccacccgtccagtaccctctcgattatgcaagatttggccgagggggtaagacgtaaccaccgtgacccgatgcgcctggaaataatgacgcagtttgctcgaagccatcagaatagcgtaaagcatcttctgggcctgagggtatcgggtcttggcgtcccggagggcctcactaacaaagtagacgggccgctgcacctttcggtggggccgatcctcttcgctaggggccacgtccctggggcgctctttgtccaagcggcctcgcggggtgcactcgtcttctgtgccgacgacctcggggtcggaggacgacaggggcggccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggccttgggccaccgttcggctcgggggcctctcctccctgctctctcccgagccaagccagcacagggtgggggtgcgcggaatgaggactgtcctcatcgcgctccacaaccaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctaagcttgctggggggcgcatctgctctatagctcgtatcttctcggggttggcctcgatgcctcgggcagagactaaaaacccgaggagcttgcccgcaggtacaccgaacacgcatttatcggggttcagtcttatgcgggcggagcggagactctcaaaagtttccgctagatccgagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgcagttttttcctcatcctccctagccatgcgaatctgatggtaacccgagtatgcatctagaaaacacaaaaggtcgcaccccgctgtggagtcgacaatctgatctatgcgaggcagggggtaagtgtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccagaccggccttgcgcccgaccgcacggcgagacggtgctcaatcacctccctggggaccccgggcatatccgccggtctccatgcgaagacgtcagcgtttgcccgcaggaaggagacgagcgcgtcttcctatttgccgtccagaagaccaccgatccgtgtggtcttggacgggccgtcgcccagggcaacctccttgaccgggacctcgtcacatgtgactatccgctgcctcggggcggcgggggcggaggtgccaagcctctcgtcgccaccctcgggcttggacgcggcggcgaggtggtccgcgcgctgctccatacaagcaagcgcgactttgaggtcgccatggacagagatggggccaccggggcccggcatcttcatctggaggtaggcgtagtggactgccgccatgaacttcaccaacgcgggcctccctaggaccgcgttgtagggcagactgaggtccgccacatcaaagttcacccgctccgtgcggaagttggcggatccaccgaaggtgaccgggaggtcgatatgacctagcggccaagtgtgacccggcgtcacaccgataatcggctgggacggccggagcaccatccccggggccttgatggcgtcaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgtttggcctcacttcgccgattgccggaaggaaccgccggggacttgccctctcggcgctcctgcctcctctcctcctcccacttcctcgtccgcttagccaaacttttgactgcgcggcagtccgcgaggtcgtgaagggaagtgttgtggacgatgcaccacttgccggttgggcgctccctgctgggagcgccggcctccttctttttgtcgcccgcaggcctcccttttcgggtggcccgcgaagcgccctcgacggcgaggacatgaccctcgtcgtcggtatgggctgacctcttcttcctcctcctgtcacgccgccctgtctgagcagcggatccgggggcggccgaagctgccacaccggaaccggaggggttccaggtccatgcctcctccttacgagccactcagtccgcaagctgaaaaagctccgcggtagtctggggctctttggaggcgatcttttcgagcatgcggttgtgccgcacacccccccctgaacgcgtagatcaccgcgtgtgcagggatgcatggtatggtgttatggacttgacagaaccgctgaatgtacgagcgaagtgactcatcatccattcgctgtactgcatgtaagtccgcttcttcacctgggcacggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggagaaactcggcggggttgacgctcccgtcatatatttcggcgatgttggcccgaaccttgggggccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatatcgatgtgggcatccggccccccacgcagatcttcctgggtcggaggcgctgacgaaggagtggcggccgaatggcgagcaacagccgccgctcgccgcgccctccgccttgacgatacggagccggtggtagcagcgccagaggtcttggtggcggaggaccgcccaccagcacctaggcgctgccgtgccgtcatgaccaagttggccacgtcgtccagccaacgttgggctggagactccgggtcaaggacaatgggcgggtgacgtaggagtgcgcccgcagcttggagcgcgccctggggcgtgctgccgtcgccgtagacgaggaggcgacgctccccatctcgccgcccttccccatcacccgtggatgtcgaagtcgcggatccttcgaccctctcgagcgcctcctcccgcctaggactttggcgtggagggggcggtggagtacgagctcgacggcgtgggtttggctccccatcgtcgccgctaacgctcggagagaggttgtgcgcctttgcttgttcggccattgggctgaacaggaaaagcttggcgcacacgaaagagtgcgagagcttagaagaacacacgcagaaccccctacttggcgcgccagatgacggagcgtggggctcctcaccgggagaccgcgcaggcccccctttgccagttcggccgggggccctgtgtgaggttctaagctcttggtctgtggaaagttcgcgagaatggaaacacacaagacacgggcgatgtatacaggttcgggccgctgagaagcgtaataccctactcctgtgttttggtggatctgtgtatgaagaagctacaaagtccgagccagcccccctctcgttctaggatcgttctcctcttttttccccctttttctaagtgggcaaggtcctccttttatatctcaaggggataccacatgcaccatctctccctctctttcttacttgacttctcttcattaatggacggagatttgtatggctgccgtccgaatgaccttctgatgggacggcccatacctacctccacttccgccggaagcaggcgcgacgtgggaacatggctgtctgctgacgacatgaccattgtcagaccgatcacaaatcggtcattcttgtccaccacgtgtcagtttaacaatctgcatgttcacccttcttcatacaatatcttgcctgtaatggttaggataaagcctggcatatatctgaccggaaccaacgtgccatctccaggagctaacacgccggttccggctagggacgagtgcttggaggctctcgtcctgacgggatggggcgaggcgtgcgtcagaccgcctatcgccacctaacccacgatctgaccggtctgtgaccggtcacagaccggataaacgagcgcgttgcactgcgttccatgcggcgtgacgcgctcgtccaaaccgcaataaatgtggttaggtgagccccgctatgctcacctaccccatatacgcggcgcaaaacccacaaggggtcggggcgcctcggccctcagggccgaggcggtagcggtccgacccctcggggagacaaagagaagggcggccgtatcaccctcgggcccgacccccccgagggggttaggccacgtgggcgatcgtgtctgcctcaagtctctaagtcatgatactcccggtcccatgtcactgacaaatataaaagaaaaataaattatcccaatatcctatactttatcaaattctaatacaattactcttaattttatctagtcctaataaatttatcccctatttctgaaagttctaatataaatatctcttaaaagttgaagtagtaatatctactattctgtaaaaaaaaaacgaattcctagctacgaatgtaggtaggattggcctttttttttttggcacaaagggagtatttatgtaaattttggatcagaaaccactcttttttacaatagaaggaatcaaaattttcagttaggaaaggtaatgtgatggtaaaggagaagttgctagtataaggcttcgtttgataggagagattgctgtgagattgagtagaaaacacctcgttttctgcgcgcacgcttcccaaactactaaatgatatttattttgcaaaaaaaattatatagaaaagttgctttaaaaacatattaatctatttttgaaatttaaaatagttaatactcaactaatcataagataatagctcaccgcgttttgcgtatcttctcaatctcctcttttcctatcatctcaaacttagccttagtagcatcgcagtccgaacaaccaggtgcactcattacatccagcagggaagtaatgaagttattcacttaggctgtgtttaaattccaaaaaattttagccaaaaacgtcacatcaaatgtttggagacatgcatggagcattaaatgtggatgaaaaaaaactaattgcccagtttgcatgtaaattgcgagacaaatcttttgagcctaattgcgtcatgatatagacaatgtggtgctacagtaaaaaattgctaatgacggattaattagacttaataaattcatctcgcagtttacaggcagaatctgtaatttgttttgttattactctatgtttaatactttaaatatgtgtccgtatacgtcaaaaaaaaatttggccaactaactaaacacagccttattctacaaagtacaacgaaagcttttatgttgggtgtacttgtttgtttaaatgttaccacctctgtcgcaaatcacttctgaagttattaaaaaaataaaaggagagtaaaaattaaattaaagatgatcgttattgattgagaaaagaaagtatgtgaaaaaaataaatgaaagatggttatgattggcacaaaaaacacttcattaattaagtatgatgtggggagatgatggccgacacgtcgacgacttaccagagttccgcgtgtgggccattgatcatctcaatggtcgaccggtattggagcattggtacgatggccacacgtcgaaggtgttcggatggtggcaaccgtcacatatgactggggcacgacagcatgcgagggaaggatgtttttgggcgacatcctggtctgcttccaggttgacagcggcgatgcttttccatttccattttctaccaatctcttatgcagacgatttgtcctcttgcggcgacgcttctgaccgccacaaaatgaccatgttggtgggttcatgtgagggagaatggatccatttctctatcgccctctccctctacaacaaaaggacgtggatggcgttgagtgtagataaaacacgacgcttttgtttgtttccttagaggggttcgctttgttgtaggcgtgtgatatggcttgttgttttatttttcctgattatagtcatgatctcccatagctatgatcttgtaacttttttatcctatatcaatatgaacctcacactatcttgtgtgatttgattgaaaaagtaaaccattgtaaatttgaaaatggatttattcatcttttcaataaacttttatactatatccgtcccaaaatacttgtcgatttgagttgttgtctgtaacgtttgaccattcgtcttattcaaaaaattatgaaattattatttattttgtttgtaacttgctttattatcaaaagtactttaagtataacttatccttttttttatatttgcactaatttattaaataagacaaatggtcaaacgtagcaagcaaaaagtcaaaaggatcactaatttgggatgaaggtggtatataaagttttttttaataaaatcaaatgatgccattaattttggaagcaggaacatacatgtgtttggtagggagtacgtgtttgtccatgggttggtgcatttaagaatgtttaagtcaatgcacaaaatatgtgcttctctattttttttatatacgacgccgttattttttttacacacattcgactatttatcttatttaaaaaattttatgtaaatgcataagatataaatcatacttaaaatatgccccaaaaaaatttttagtgacaacaacttacagcagaataaataataattatgtaaattttttaataaaataaatgttaaatatgtgttaacaatcaaagtcatcatctatttaaaaaactgaggtagaattaggaccagcagagttcaaatgtggtatgtgctgactacgtggagtgaaaatacgtaaggtgaatctttagcatatggttaattgagtattaattattttgaactagaaaagatgatttgtataattttttaacgcaacttttatataatttgttttataaaaccgtttagtagttcgggaagcatgcgcgtggaaaatgaggcaaatcttctctcaatgttcttttttttaatcaatctctcactgttcttcaaaagtacattggggagttatgattgcatattactcaatccaacaagatcatattctatttactaatactccctccattccaaaatactccctccatctacttttgatagtcatattttcaaatctgaaaaatctatttttgataggcatatttcaatccaacaacctatcatcttaatgactttctcagatttaatgcatgattctccattcttccacacaagatttgttgcatggacatcgagaaatgtaaatattaatgaatcgcttgtttacgaggaatgactagtagcatgtttaaatggatgataagtagaatcacttatcattggtctgtgtgtcaagatgaaatatgactatcaaaagtagatggagggagtataaggcacaaccacccttaacccaaagaataagaaataattattatcacttatagtttgaattaccctaataaatagaatgcatacacccaataaaattagagatcttgatggtggaagctttaaataataatatttgagtggaaaatatgtgctagttaatgacatgcatgcatgcacgccttatattatgaaacaactttaaaaagtagttgtgacttatattattgaatggaggaagtatcatgtactgataatatattgaaccaaacaaatcctaaatttgtcaacttaagcctcctctgaaatactccctccgtttaacaatgtaagtcattctggcatttcccatattcatattaatgttaatggatctatatatatatatatatatatatatatatatatatatatatatatatatgacactcatatggggcaccatggtgcccgggcaccatgatatcaaatacacaaaatcactcaaatttttcaaaattttcaaattgtgagtatatacctagttataataactcgattcatacctatacctatcaacaaaacaactcagatttaactttatttcacaatccatgattacatacctaactaattatatgtatggatgctatatacctagaatcaaaatctaacaaaaacaagttcaaattcagttcaaacttgctttgaactagttagtaaagtagctaatgttaatatctaagtaattgaaaaagtttcatactcatttgaattaggtatatactcaatttcaacaatggtgcccgggcaccatggagcaccaaacaaatttactatatatatatatatatatatatatatatatatatatatatatatatatatatatatatatatatatatatat

SEQ ID NO: 76261 - DNA, 4703 bp, Oryza sativa
ctcatttgtgtggtatggtaaccattcaatctgcaaaagttgaagagatgtcgttggttagtatctcaattaaagaagtaaatgtctaactagaagtgatattggaagtacttacatgttgagactgtaagcagtccatctcattgacataatgcttgtatgccacatcccggtgagcatgtgcagtggcagtactctcaaaaaggtaggccactgtcttctccatgtctggctcattgtagggccaaggagtgaagctttgcctccacttaggccttccaaccggtagtcttaaccacatccacagctgaatcaatagcacacaaccactcatgttggatgatggtgcctgacgacaacaggcctcacagagctgtctatatgtccacgccaacactgctgagccccaactgaaacggcctagatcaccaaggttggcgaccaaaggaatccatatcgccgaagcaatgtcatccccagcatcaggaaacagaacccctcccaacaagtgcaagatgtatgcacgggcataacactcaacacgccatggctcagcgtcgtcgtcaagatgtgagaagttctgactcagccaagacaggggtattccattctgcttcttcttccccccttgcccctgctcaatgttcagtggaatgccaaacagctgctccacttgtgcacgccatccaggagtctctgtcctgcccgtcacggcatgcccccgtaatgggagggccaagatcatagccacatcctgtagagtgatggtcatctcaccattagggaggtggaagctgtgtgtctcaggcctccatctgtccacaagtgctgtcaacgcaggagcgttgaacactggcattcctctgctcacgaccaaggccaccccgagcaacccggccgcccttaggtacgggatgtacctatcgtcgaacagtgggggggcatgagctctgactcggagcggttgaagtacctgcattagcaattgtaaatcaattagttaatataatgtcaaatacacgctacagatacttatgcacaagtgaatcaatgccgattcataccctccccgcctcgatcgcagccccgcgatgatgggcctcgtagtacgcctccaaggctgggtaagtcggcggttgtctctcctcggccatactacatgaaaaagtaataaattcaccgttagttaccaatgtgacatatattaacagaaaatgaatgcgagaacatgagtaggaaaacaaattatttacctccctaacacatatattttttttggacttcttcttttttggacgcttaagacacttagttttcttgtgactctcctggtgacacaacgagcatctattttgcaccggcgcagcatcaagttgaacgcatgaaggtggtttccttccaaaaccacccagacccgaggtcatttcgttcttgaatcgtttcgatctcctcttccctcttgtttaaatcttcaactttcggtcagcaacaaattcttcaccatcgtacggtggccactgtgtggggtcgaggtatggctcaaagcgacttgcccatgtgttcacaacggctcttgaagagaattgatacggcattcggttggaagatttctcatcaattgcatgaatcagataaacgtgtataagatgtgagcaaggcatatggtagagcaatggcctttggcaagaacatgagttcccctcaccttcaactttgaaggctcttgcgccgaatctaacaccaccacgcgttatactacccctctctgtgacctcgtatgtctttttctgcttatcgaaacaccttgcagtgtgtttgttcgccttacttttttgcaccttcatcttactatcaaccttggtggaccaacgctgccctaactggactcgcttcaaagcttcatcacgtctgttcacaaagtagtcattgcacttcatgaacgtaaatgatactatggccgtcactgaaagcttacgaacaccaactagcacgctattgaactgttcggccatgttggttgtcatgtaaccccaccggcggccatttctatcgtatgcacgagaccacttatctttatccaacaactcatcttcaagccatttacgaggaccttcgggaatacgctgccttagtgcctcaacatccctctcaaatatccacttctcgtcaatctgacatatccttaggagctcttttgtctggtgcttgtccgcaccgcccttgtggaaattagcattgaagtgcctcatgcaccatcggtggtgaaccggtggcaatcctggaacaggagtcgtcatggcattcattataccagcatgtcgatctaagataatacaaacctccctatgcggcccaaccacaacccgtcagacaagatcgataaccagcaccagtctcgtgaattctctttctccaccaaggcaaaagctaaaggtacaagttggtcctccgcatcagctgataatgcagtcatcaaggcaccaccgtatttctcagttagaaaggttgcatctatagctagtactggcctacaatgcttaaaagcctcaatggaaggaccaaagcaccagaatgcacgcataaaaattttcttggtcactccatcaacgttgacaaccctatcagaatgagtatcgatgtggtagaccatactgggattcctctgcttaatggcttgcagcaaagtgggcaaacggacatacgcttcaccccattcaccgtaaatgagcttcatagcctcctctcgtgccctccaagccttgccatacttcaccctatactggaaaacctcaaatatatacaaagctaacgcagaagcagagagtgtacgttgcagttttatggcattgcataaactatttactatgaactttgatgtcagctgccggtggctccctgaaccttcggtagtagcacaactatgttccttacctacccgtgatatcctccacgttccactagactttttagttgcatggaccttccatttgcaccgtgggttttcacatttaacagtgtacctcctatttgcggcagaattgacaactcggtatggacgatggtgcacgatgacgtaatcctgaacccatagcttcaatgcgaccatgtatggaacttttaaaccctttttaagaccatccacttaaaatggttctgacaactgatctaggttgatgcggccatctagtagtgccccatgggcatgtgttaggtccctaaactcagaaatgtccggcttcctcacaaacaccttctcaaacgcacgacattcctctaatgctaacttgtcattattagtaagtggagggaatggacggtcatcatcagagtcttcagcaaattcaacatcatattgctcaacacttgcctcctcgtcaacatcatctctattgacttctactgagacagaatcgtgaccactactcaattcgacatcaaagtaatcatctggattcacatattggcctgctacttctgtcgggtattcagggttgactccgtacgatgaccaatgaacactcgccgacaaatgttcacttagatcaagcccctcttgtactaactcccttttcatctccctcgctgcatccacatcatgactaccacaatgtctctttgatggtcctgcctcccataaatcatttccaagcaaaggtctcttcttctctccttccccctccaagtcttctcgtaccaactcagtcttacttgcaccccctccacgacgagaataatatgtcacaaaattcttctcaacgcaatgataagaaggagatttgtttagatccaaattttctacggtacgaactaactttgatgcaaacacctctagagatctaaactgagactcttttaccaaatcaaagtaaacttcccattccaactgacctatcacatttaatatatacttatgcccttgaccaacatcgtatctcccataaaaacgaatctccacattatcctcggtccatccaagaacttctttcactcgtgaccttagttcatctagagttgggtgggtgggaaacaaaatggtcttcaataacatatcctcaaactcaacatgtgtaccaacataaggttccaccactctaccaccgtagtaaacacgaacaagtcaatccatctacaccaaaaaatcaaatgtaactttgcaacaaaaattaaatcttcattcctaaacgtagtccaaaccgacatattataaccaatgcataacttaaattatcccaaagctactactccaaaaaaatatttaattcacctacaactatcaacaagtttactagtgcattacacatcgaaatattaaaaatactccgtcatacaacccaacctagttctagttaactataatcaatttatataatgcaaccaaaattttctcaccttcatataattaatggttaaaagtttaacctatagactatagcatcaagtccatcaaattaaaattactttcatgcctcaaccataatttttatatccatccatccaatcaaaccatttaaaaattaacattaccacatatatggttaaaaaaatcgtgacaccaatgagttcattgcaaacatatagcactacaacaagccaatcctaagaacaaatgctaaaaatcacacatttgggtaaaaaaggggttctagggttgcccaccgatctacaaattcaccactaaaaacgaaaaaaaagaggggtgaatg

SEQ ID NO: 76262 - DNA, 7172 bp, Oryza sativa
ccgacaaagctggtgacaatgaactgctctctgcagataaatgttcacaacccttccacgatgttcggcattcatgtctcttcgacatcgattcagatcttgttctcgcaaatcgcgatcgccaacggtcaggtagcagctagcaccttcagcaccagaatttctgtactgcaatttcctcttccatattgaactacaaccacattcttaagctcaattcatcctgctgctctgcagttggagaagttctaccagccaaggtcaagccatcatgtcgcctcggcgatcgttcatggcgagaagatccctctctatggagctggagaaacattcgccttgtcgaatgctggaggtgctgtgccactgactctagacttggtggtaagagctagagggtatgtgattggtaagcttgtgagggtgacacacacaaagcgtgtgaaatgcccggtggttatcgattccggtagctccaagccgattaggtttatccagagtgcttgtagttacacctgatgcagtgccttggccttctataatctcaataagggctgtgatcatgtactccctccgtatcataatataagggattttaagtttttgcttgtaacgtttgaccactcgtcttattcaaatttttttgaaattattaattattttatttgtgacttactttattatctaaaatactttaagcataacttttcattttttatatttgcaaaaaaaatttgaataagactagtgatcaaacgttacatgtaaaaaatcaaaataccttatattgtgggacagagggagtagatatttaggtccttcatgacatgagcaaacaagaaaataagcagtagttttatcttccaattttgccatgttgatatctcttgctaacatattgtgatgtcgttttatcagtgttacatgtcattgcgctttgcgacaagtttttatacactaatttagaagttggttttaaacaatatcctctgttagtttcatagatcgatgaaatggttcagaaagaaattgaaggtggaaaaaaagaagttatctcctgaacagagtttcattctaattctacatcttcaaatttttcacagaatcattcaacaatttgagttctcttcctgtcctcagcaatgacaacctgattcattgaactagacataccatatatcatcagtgttttggaaaacaagctgtccatgatcaacatacatttgctatcttacataaacatatttcccagtcttccttccaaaatttttgagacatctgaagcgagttcttggcacagcagaaatcatccaatgtgtgttgagaaatagtaagaattgtaattgacaggttcttgccagtgtacatttttcttttttactgagcaacaacacaagatggcctcctctaactgaggaacaccatcttcagtgagctgatgctctggccatacactccacactgcatctgaagctgcttcctgcaaagccacgtggatctcaccggaagccggcacgatcgccggagcagcgacagcgacggcgacgacgacctcgccgtcttcaagctcatggaagctcttgtcacctgcatggatcgtgacgcgtcactcttggcatggccattggttctctcgaagctctgcagcttgtcgtcgccatggttgtccgggaagtagggctcctcgtcgtcgtcggcgtcgaggaggtcgccggaggaggaggaggagccgagcgcgcggttggcgttctcgacgaggccgacggccttccacgcgtcggcgacgaggcagtaggtggtctgcttggggcggacgccggcgtcctgcatcatctggagcacctcctcggccttccatggctgcttcagctcgctgtagccccagatgagggtctcgaacgtcctgaggttcgggcgcacgccggcgtcgcgcatggcggcgtagaccctcacggcgttgcccatgtcggcgacgctgcaccacccgctgatgacggtggtgaaggtgacgacgttggggcggacgccgaggcggcccatctggcgcaggagctcctccgccttctccggctgctgcgcgcgcacgtagcccttggcgaggatgctgtacacctgcgggtccggctcgatcccggcctcgatcattttgtcgaacaccttcatgcacttggccatgtgccccatggagctcagcgcgttcagctggtggctgtaggtcacgatgtccggcttgatcccgaactgctccatcagcccaagaacctgcaagaacacaagatcgcagatgaaaactcgatttcgtttagtgttcttggttattgttttgtgatgatagctcacgtcgtcgacggcggccatgtcgttggcgtcgaggaagcccttgagcagggtgttgaagacgatgacgttggggagcacgccggagtccttcatctggcggacgcagcggagcgcctcgccgaggcggccctcgcggcagtagccgccgacgatgatgccccaggtgcgctcgctggtgcggagccctgcctgctgcgccatctccacgacgagctcctcggcgcgccacgtctcgtcgttcttggcgtacgcgctggcgagggtgttgtacgtgacgacgtccgggtcggcgcccgacgcgcgcatcctcgccaccacccgccacgcctcctccagcctcccggcgtcgcaccacgccttgacgaggatgttgtacgtcgtcaggttcggcctgaccgccgcctcgccgccggcgccgccggaggccatcatgtcgaacacccgctgcgactcctcggggcggccggctatgccgtagcccttgatcagcgtgttgaacgtgctcgccgtggggcggcagccggagtggcccatcctgaggaaggtgttcgtcgcctcgcccatccgccgggcctcgacgagggcgttgatgagcgcgttgaagaagatggagtccgggcggaggccggcgtcctccacctcggcgagcagccacgggatggtgtcgaacgcccgctggctcgtcagcgccgcgagcagcgtggtgtacgtcaccagcgacgggcggtggccgtcgtcgacgaggtggcggaacgccgagtgcgcctggtgcggcctcctcgcgtcgatcatggcgcgcatctgccgcgtccgggcgatcaccgcctggcacgtgtgccccttgccgcacgtcgtgcagagcagcttctgcttctgcttctgcggcggcgacggcggctgctttgcttgcccgtttgatgggtgcagggcgccattgctgccagcttcgtgcttctcctgaacacacacaaagacagaaatcaatcgaggtgttcttcgttttctcaggtagacagtcacaaagatgaaacaaacgaggtgcaattataagataaaagaatactttgaggtgtgatccgtttagcacttctccattgattcttatcttgccattggtcttgacagtggaggtcaatgtgagctgcacaccgttctctaccatggtactatgcttctgtcagccagctccttaacctgaaccataatttcagaatttcagaactgtgctcattttcatcaagtccccaacatatgtactgcactaatgcagtcagtgggcaagaaacacatgcacacattcggagtgtatagatgaaattgatgttcctactcttgtctgtttttaaaaccaaaagaattgcatattcctgggaagctgttaagagcaaaatgtgatatttctctgatccatttccacagtgaaggacgcatttcataggggcatcctggattcctaacaatgaaaacatcatttacagaattttagtggtcatgataatcaacatcatcttcagatttcatggaacacgtgttgtattaacaaatccaatgaccaaagcagttgatggacaaactaccagaattaaagaaaaaaaaacaaaacagaaacaaaatcaactcaggatctgaaatacaaaaccggccttatcctgaagcctagaccaattcaaatgtagaaattccattattttcacatattatatcagcagaattattttatacaagcagaaaaacaagcagttgcagagcgtcggtcgacaagaaactgcctacgagagagacaagagaagctaattcaggacgaatcccggtagaacacgagcgagcgagagggcgcgttcacctgagaatcaacgagctactggcagcaacgagcgttcattggccaaggagagcgagctgcgctgcagctgcagctggtggccagcgtgtgcctccgtcccccccgcgctctacgcacgcacacgccgcgcgtggccagccgtcgctgtggctcgcaagcaaggcgggcggagcggcggagcgacgtggaggaacacgaggcgcaggcggcgtccgcttttttttttttttttttttgcccccggtggagctttttttgggtttcgaagtgggggggagcgctttatccgcggtgaggagcgaaacgggtggcgggggaagcgcggccgctttggcggttgccggggtgaactggaccggacgccgagggagcgtcgcgtcgcgtcgccggttgggtgaggctccggagcggccgcgtggcgcggtttgcagggaggcgtccgatcccgcgaggccccggacgtgggcgttggatcgggacgggacaccgtgtggtcgctctcctgacgcagcgttggatctgatcgagccaaagctaatactctccccgttttaaaatgtcggacatcgttgtttttttcaagtatgtgtttgatcattcgtcttatttaaaaaatttaaataattattttttttcatataatttgattcattcttaaacatactttcaagtacgcaatttttttaataaaacgaacgttcagacatgcgctaaaaaatcaacggtgtcaaatatttttttttgaaacggagggagcagctcttttcacttcaacgtgcaggcgggcgcggtataaaaacgacgcaaagctaacaaaaaatcacatggtagtgtagtaaccaatcttgtcattgtacttgtcaattggaattttattgtattacatgacatgcacgcgcgtacatacccaacaccacacttatacatccacaaatacaactcctaacatacttgtgaagtgctataaattttgactaccatttgttttaacttgcgggctcctttggattgatggtttttcaaagtacttatggaggattgaaaatctcaagaaagttttcatacgaggctctttgtaccaaaggaatatgaatgtcaaatttcctatggattgacttcttttcttctatctaaaataaaataatacctccattcaaatcgaaaataaacatgagtcatacctcatgttttattttggattaatttaattcatgccattacacacatgttatttcaaataagtatcattacaattcatctatttatatccatgtcacataaatttttaaaaattagaatcgttctgtcgtcatattttccatcttcttcctcatttatttgcaatcgcatggatcgaatacccttttattttcctctaagaagtataatgcaccctctttctttctctctagcacaaagaatttactctaatattcctatttttgtttctgtgaaccatccaaacacctactctgttagaacatggatcctatttctacatttttactggtactgtgcttttagatctcgcgtcccaaaagagttttgatcaacatatcagcctaccagtcatagccaaaatttaaattaataaacaaatttttagagttgattttatttttttttcatcgtagtttgtttttttatattgtcttttatgtcgctaaacacacacgcaaacgcttgagcgcgcacacactgtgcgcgtgcgtgcgcgcacgtgtgttttaaagtcagtaataagcgttagagtttatgaattatagttagagtgacataccatgtgtgtagtttcagagctttgagttagctggtagtattttctcttgaaggtttaaaattggagttaaaaagttactacgaagatcatagctttctttccaactaggtgaaaccctgcgcattgctgcgggaatttagtatgataataataataataataataaataacgtgtaaaatagctagataacatcagattaagtaaattaatgtggtttatgataatttaaatttaaatagtatgtagaatggtgattcaaacgtaaaaagtagggagatagtttggaccgtagattaatcatctaaaggctaaaaacaatttatgtgatatgacttaattagaggaaaaaaaagagaaagataatttggaccatagattaatcatttaagcactaactaagtgaggatgaactatataagtatataggatatcataaaacataataaagatatacattgaaacattatgtgaattatgttggatgataatttaacatgtttgtatttgaaaagctcttaaattataaaaactataaagatataacatgtttgcatgatgtttaaatgtgatgattgttagtggatgatgatgtgacatcttattaattagtgaataatgatgtgacatctttgcattttaagcttaaggagttagtgggagataactttatagtaagataggatatgagagtattggatcgtatacacttatagcttataattaaggcaatagtcataatttttggtcaagtatttttttctcttactataaaggggttcattattattttacgactgccaatcatatatatagtttatacttattcaaaacaaccgttaaaaacttttatatgctatcgcagatttacgagtacttataggactctttgactaaactttttaagatatgatggtgactattggattgcttgctgcatctcacattctataatttcctgataacatgtcctaatcaagttttgtgaaagctcagggtttttactactttagatatgatttccatatttttaagtgataaggaaaactacatcacccaaaattattggaggtacactaaattaattttcatatagaatcttgaaatgttcaatattccatccacatgtgcattaaaactgtattctttgacctgaactcttgcactcctatctcggaaaccccctaatatgactgacttgacgcacctaaaaa

SEQ ID NO: 76263 - DNA, 9984 bp, Oryza sativa
gagcttggaggtggaggataacctagcaaaggtgggattatagggcgtaggggttgtctaatcgattgatggtgtgtaggtgaatcgaaatagtatctcaaaaacttatgcaagttatcaactcctgtatgttgggaatggccggatttgtgctttgttctctggccggtgagcttccctgtaaaggactgggaatattttgggtggagaacggccgtgataacgatggtttggtgacataaatggtgcaattttgggctgatgttctcctgcttggagccctaggatctactttgcggaaccgtggtgtcgtcggggtggtttgagaacaatcgagtcgtctgctggtagggagacatgattttttttctgttgctaaaaatggcctggtatgtttggtttgtcttaggtaacagtgtcatactcaaatcctgtagctttagatgtattttctatttcagcatcgagatcagataggcggtgagcttgatttggtcactgcctctactacataggaagttcagtggttaatccctaaatagctgaccggttaatattttgatttcagtgaatgaaatattcttttggtaatcgttaaaccactgtttagatgggatcatgtatcaaagccaaccacggttctatcctatggtagcagggtcagaagtacttttctggttaccttttttggtaaacggaattgatgtggtggcagctaaagagttggttatgttgctatgaacaggaaaagttagttgaaacaagatatttattgctgttcatggtgcctttgttcagctaagagattgggaaatctaaggaattcggacatggattttgtttgaactatgggacaccttacaagtggtccaggggcactttcaaccttatattatttcttaccatcccttccaagaggtttcctcattctacaatttgaatatttgtcacttttcaggataaagataaagagttcaaaattgattggaagagggtgggcatcacaagctcatttggatttgcttttgttggaccagttggacattactggttagttccatccttttcatattgagcatgaacagatggtgttagggtcaattttgtttgtggattcctttcttatggtcataaattggcaagaagtttttggaggttttacccattaacaactgaaaatctgctagcagactttatctctcccagtcccaaccagcaacatggtgtagattaaggaaaagagaaaaataggtgacatggaagacataatctccatcctgcactgagcttttccatttaggttgtcatatctagagaatgatatgaatgttgctttatcgtattagtatcaatgggttccaactatgaaaaactgaagatagttaaatatcagatgctttgcttgaatatatctaggtccttttagttcttttaagtttcgatattcactgtggtgggtatcgaatggtgggttagattggatgcagtgggtgctatctttatagaactgctgtgcttttttttagatgaactgatgcatctttttctaacataatataagaaagccatcacactatagtcatccattatgagtgcgctgtgtgctaccagtggcttcttttactgaatcttgtgtcacgcaaggggcatacattatcttttggagttaagtagatattgatgcactctgcagctgcgcttcatgtttatgttcatttgtgtgcttaccaatccacttcaacatagacttgtttttcaccatgtcacaatttcttgccttttcatgcttaccattcattacgtatgtgtagttaaactgtaaaatattcttctcttgagagcatttcgtgattgatctgctccgctttgtggttagtgttctacattttaattgaccacaaggttttcaactgggaagattttggtatttgagaccacttaacagtgcatttctttctatagtacgccatactatacaaaacttcaaattaataacatgatcatatgcatccttttttgtgaaataagctaataattgaatataaataatacttgttgatggacttctactgccctgccctacatttttgtgtttgtttttgttatgaatggtgattctatggtttcctctcacttatttgttgcagtctactcatatgcaaaacctgggatattgtgaaatccatgcttccaacaaatatgcttttgcttaaaaatgagaatcctgttctgaagcaattttatacaacaggctggcatataacttgcgcttgtttctgtcacctaggtatgaatacttggatcgcttcatcctgaggagataccagcctaagaccttcaaatttgttgcgtcaaaagttgctgcggatggtctcctatttggaccagtagatcttctcttgttcttctcatatgttggtcttgcatcaggaaggagtgtagagcaggtgaaggatgatgtgaagagggacttcattcctgctctagttctagggggaaccatctggccagccgtgcaaatcgcaaatttccgcttcattcctgtgcgatatcagctcctttacgtgaacctgttctgcctcttagacagttgcttcttgtcgtggatcgatcaacaaggagatgcaccttggaagcaatggttcacatcattccagaaaatcgaaggccagaagggcaaggtttgatgtggatcaggcacggtccttttgacatggtcctggatccagtaacatcacccggcaaaacaccgggcatcccagaaaatttgtcttctgtcatttggatcaacctttgtatgctttggctgatccatgaaaaaaacactggaaaagagaaacacttgctgctatggtagcaattgttttaagcgcaattgcagtaccaagcagagctgagcatcaatatctgtgtagagatttgtttcatgtttaatgccaaggaaaatattgctcaagttgttctacttgtgtctgtatctctgaatgtttgtacaagcgattctgtaacttcatgtggttgaaatatgtgcttccaaagcagctgaacgcactgaattcaacaactaacatgcataaaaagtcgatgagatttaaagaagagtaggcaaaaatgctgtataaatcctctgccgctgacgctattcttctatagcataagcaaacaaaaccataatatcaataacaccaaccaatcattggctacaactctgcacggcagctaatctaatgtcaatttttttcttcataatcctttctaatcttcttcagtgtcaccacaacaccggccattgacatcctctggtcaggcaagtcacttgagcagagcaagccaacctcaaatattggcaaaagaaggtgattcaggtcttggatagaagactcatctagctgtagcttgtcgtccagaacatgaacaagcttcgccggaaatgcttgattgacccactgcctaatggtcacttctccaacgaacaaacgatccgtgggtcgctttccagtaaagacttcaaggagcatgattccgaagctgaacacgtcgctattgcgcgacgcctttccgagtgatccgtactctgctcaggaaattcagaaacaaaattttttaagaatgattgataatctaactaaagtaatctccatgatgatatattccggtcagtcaatgggtttatggaaattaaaatttactccctccatattttaatgcatgacgctgttaacttttttttatcaacgtttgatccgtcgtcgtattaaaaaaatgtaattatcacttattttattgtgacttgatttatcatcaaatgttctttaagcatgacacaagtatttttatatttgcataaaaattttgaataagacgaatgatcatacatttgttaaaaaagttaatgtcatcatacattaaaatacggatggagtattatattagtacctggtgccatgtacccaaatgttccaggcatgcttgccgtgatctttgacgtgtcatcacccagtagcaactttgcgatgccgaagtccgccacatgcgccgtcatttcctcatcaaataacacattgctaggcttcaggtcacagtgtaggacaacctcataatgctcatggtgaagatattccatcgccatcgacacatctagcatgatgtccaacctcttcaacaaccccaaagaacttgtgccttgagagtgcaggagcatgtctaagctgccattgggcatgtagtgaagcaccagtgctctgaactccatgttggagcaggtgttcagtacctttatcaggttccggtgccgagccatgcgaagcacacggcattcggcatcgaagcttctaatggccacttcttccaggtgcatatctagaacttttatcgcaaccaccaaaccgctgctcagttggcccttgaaaacttttccgaagctcccactccccaataagttgtcatcgctaaatttatcggtggcacgagcgagctcatggtaggtgactatcaaatgattcatgtcatcgcctggagtgtgacttgaatcctctttcttgttcttacttttccttctgatcattaggaaaatgcaaataaccatacagccaaatgctacggtgacaactggaagtagaaatcttaggaagtgtctactgtttgagtgagacttctgaagacatggtgaaaatcctagacgtggagcaccgcataatgcagcattcccgatcaaggactgtagcgtaatgtttgagaaaacaccaccatctggtatctggccttctagcctattgaaggacagattcaaggctgtcaagtatgtgaaatttgcaaggaattttggtatggtaccagagaggttgttggaggagaggtccaatgttgccaagttagcaagctcttgaaatgagtacggtattgagtctccaaatgagttgtgcgatagatttaggtaggtcagcatcctgatttgtccaaatgattctgggatacttccaagcaaagaattggacgataaatcaattgtatcaccttgttttagcctgctaagatcatttggtagtgcaccagtgaaggagttgtgagaaagatttagtcgcaccagtttgccaaggttgaagaagcttgcaggtattgttgagttcagttggttatgggacaacatgatgtgttctaattcactcaggttgccgatgctatctggtatggagccaaataatctgtttctctggagatccaatctctgtaagctgctgagcatgccaatctgagtcgggatagggcctgagatatcattgctagacacatctagccttacgagatttggcatcatggtgatggattctgggattggcccagtgagctggtttccaggaagttgtagctgttcaagactgctcaaatttgacagtgacgatgggagcccacctgttagcttattttcgctcgcggaaaatatactcaattgcgcagacaggttgccggtatgatcgggaagatccccggtgaaagaatttgaatccaaggtaatgatccaaatttgtcggcaattagaaagggaagacaagaagccaaggttcccctctagattattcagtgacagagtgagccagttgagagctgggatattgcctagtgttgctggcactgccccagtcaattgattcatctgcaaatctaggaaagataattgcgataaattcccaagagaagttgggattggacctgtcagctggttgtatgtgagacgcagagttgagagacttctcataaggcctaactctgaaggaatttcaccggtcaggttgcagaaggagaggtccagcgaggtaacaccggtgaggttgccgagaccaggagggatagagccagtgagctgatttccacccaagaaaagctcagtgaggtatggcagctgagccaaccatgccggcacgacatccacgaagctattcgacgaaatggacagggtttgcaggtatcggcatgccgcgagccctgccggaatccggccggcgaagccgttggagctgatggagaacgtgcgcagcatcggcaggtgaaagctcccgttgctcgtcgtcgggatccaccctgtcaggttgttgtgcgagagcaccaaccctcgcagcctcgacatgttgtagacggccggcggcaccgcgccggcgaggcggttgccgcgcaggttgaggtactcgagcatcggcagcgacgacggcgacgacgccacgccgtgcggtacgccgcccgtcaggctgttgttcccgaggttgacgaacgtcagcgagggcgtgccgttgaacagaagcggcggcaggtctccggtcagctggttcatgtgcagagcgatcctcgagaggcggcgcatgccgtgcagcaggtcgggcgggatctccccggagaggttgttgttgcccaggtgaaggagctcgagcatcgtgaggttggctatggcgggtgggatggcagccgatagcaggttgtcgccgaggaggagactccgtagccggcgtagcctgccgaggtcggcggggacggggccgacgaggctggtgttggtgaggtcgagggtgtagaggaatgagaggttaccgaggtgggcggtgagctcccctccgagcggcgcgtccggcagcgacaggccggtgacgcgctccggccggcggcggcggctgcaggagacgccgacccagttgcagaaggagacgttggtcgtccagctgccggcgaggacgccgagaggatcggcgagctgggccttgaaagccagcagcgccgcgaggtcggctgcggcgccgccgccgctgctgctgttgatggatggagatggagaagaagaggcacctgctgcaagggctgtcactgtcagcgagatgatcaacaactccgccgtgtgcaggactgctggtaaacagccttcattggctgtatcaaaccaacgcggtccatcaacgccaaccaatgattgcctacaactctgcacggcagctaatctaatgtcaatttcttttttcataatcctttctaatcttcttcagtgtcaccacaacatcggccattgacaatttgacatcctctaatataatgccaatttttttcataatcctttctaatcttcttcggtgtcaccaccacatcggccattgacatcctctggtcaggcgagtcacttgagcagagcaaaccaacctcaaatattggcaaaagaaggtgattcaggtcttcgatagaggactcatctagctgtagcttgtcgtccagaacatgaacaagcttcgccgaaaatgcttgattgacccactgcctaatggtcacttctccaacgaacaaacgatcgatccgtaggtcgctttccagtgaagacttcaaggagcatgattccgaagctgaacacgtcgctcttgcacgacgcctttccgagtgatccgtactttgctcaggagattcagaaacaaaatttttcgggtaattgtgtacttacccctactttgtattctaattatgattttactccttttttagggtgtatttttgcccttacttttctcaaacgaagcttcagtttacccctattctgttatcatcagttaacagtgtcaattcactcgtaaaaagacatgtatacccttgaacatttgtccaattcttttagaattttgatagcatttccacacaattcgcacggttgcagaactttagcacaaagattcatcacaaattcgtcgcaagtgatgagatggggaaaaaaataaaaggaaaatcaagcagcaaacgacatggcattgtttgtctttgtggacgagctgctcgccgtgcgtcgctattgccggcttgccgcaccatgctgctcgctgctcgcttgcccgtgcgttgtacaggagctgcctcgccgcagccttcgccgccgccttcccgtggcgctgcgccagattcgccgccttcccatacgctgcgccatcctgccgccaagcttccctgctcgctgcttgctggctcgctggctcactggccgacggagccgccgctcctctccgccgcgcgctggccgcggggccgccggccaccgcgcctccctacgcatgcacccgcggggccgccgcgcgctggcccgcaccgccgcttgtcgcgtgcgccgccgccgccgcttgcaacccagctagggttttggattggaaatcggaaatactacgtcccataatagttgtcactttgacttttttctttcgatgtttcaccattcgtcttatttaaaaaattagtgcaaatataaaaaatgataagtcatacttaaagtaatattgataataaagcaagtcaaaaaaataaataataattccataatattttgaataagacgaatgatcaaactttacaaacaaaaacttaaagcaacaagtattctagaacgggacggaggtagtagtaagggattgggggatttggctcttcattgaaccaagggtagcatagtcattcacaaattataataacattttctttttttgtttaattcgaaaattccggcccaccagacttctgtcaaacctagtagcagaaggctgtttcatttaaaaaaataggtgtaaaaatcacaaaccctaaaatacatgataaaatcacaattgaatcgtaaagcaagggcagaaacacaattaccccaaattttttatgcatgattgataatctaacaaaagtaatatccatgatgatatattccagtcagtcaatttgtttatggaaattaaaatgtattatgttagtacctggtgggcatgcttgccgtgattggtgatcttggaggtgtcatcacccagcagcagctttgcgatgccaaagtccgccacatgcaccgtcgtttcctcgtcaaatagcacattactaggcttctggtcacagtgctggacaatctcataatgctcatggtgaagatactccatcgccatcgacacatctagcatgatgtctgacctttataagagcaggtttaatagtatagccggcaaccggctataaaagatctaactcagcaaaaattatatccaatactaacaaatagttagctagtactaaattattatacacgggtttctaaaaattatttatactccttagagcacccgcaatggtaaagtaaggtgctatctataaaacatgtacatctcagcaataaatagtaaaccatctcaatagtatgtctacatgggtatctatagctctctaatatattgcctcatttttctctatagactatctccaggttagtagatagctttgctctctcttctttaatctctttcaagtagaaaaatatgctgacatggatcttttatagagagcctatagataaccattgtgggtaccttacagtacttcccacctctcacaatatctattctctgtctcatcgaggcaattgggaagcgtgcaaatggtgggaaaagcttacagttgcagcatgcatggatgacgattggtcatgctgctttttactatcgctgtagccgggtgatagattaagtgctggttactctctctcctattttcttactcttccatctaggatttatcttagatgaatagtactaccgcccgctgattatatctactatatttgctctaacaaccccaaataacttgtgccttgagagtgtaggagcttgtctaagctgccattgagcatgtactggagcaccaatgctctgaactatatgttggaacaagtgtttagtacctttatcaggttccggtgtttagtatctattttccgtttagatgtagagaccgatttaatctattaaaaagaattgcgaggaatcatggcacggctcgccgggaaaaaaaacccttctatatgacaggggtagctttttcatcccaagggagattccactggtggagaaatgctttttagtcccggttcgtaacccccttgtagtcccggttttccaaccgggactacgaatccgggactaaagatcgttatctttagtcccggttaaa

SEQ ID NO: 76264 - DNA, 602 bp, Oryza sativa
tcacagtacagacagggaaacaaagaaagcaactagcacgttaaaagagtcatgctatgaattcagaaagtcgaacattgactcttaaaactctttgggccatcagataggccttttagatagatctatttggtctatatttttcctttactaaaaaggccacctgattttcattccgcgagctttgctgaaaaattcttcgattgcgctcaagccgaacgttccactaacttgatggttcccgaggatcttcttcttcatggtccctgacgaaatgtggcaatcccaatagggaacttagttgatggccttctgggtgatgacgaacctaagaagcctaggagatgaaataactcaattttatagatgtttcgtaattaaaaaaatcaacgtaaaatggtgagggaagaacctacacgaggtgaccatcgtacaaagatccaatgttgacggtgaccagttacatgtactctctcccaaaaatctcatatatcattctttggtttttccaaaaatctaagtcctatttgtagtcactttgtgctaaataaaattgttaatcggaaaccaagaagtcattctaatacttattggttgcatgt

SEQ ID NO: 76265 - DNA, 4160 bp, Oryza sativa
gtttttgcacaagtatgaataggtcggatgagtgaaggctaccaatcactaccaactctagttctctcattgtctgcttttgggctatcaatggcaaataaaatttaacttttgaagcttaattggagttgattttgaggttttcaacggaagaaaaaattatgcaagagatcacatggatgcaaaagtctggactacagcgtgaaaacaggcttccaacagcaaagttttacctggtggagcagactgattactgaatctctttaaaagcacaatctccttcacgatgcgaataggccaaatacaagcacaagaattagtcatgccgaattaaaggctgtcgagtaatgcattgggttaaacttctatcctgagaattttcaagctaccgatgattgctttgaatatcatacatacacgacagctttattacttccgcatcatccaactaaactctccagcaaactgactgagtataaacacctgtaatgtactaatgtaaggagaaagtcctcttcgggacgtactagtagaacgattttcacgaggatcacttcaattcctgtaggcataaacaaaaattccagcattccaaactgcgccaactttctgcaaaaacttttttctcgaatttgccaaccaagtcatcgggcattgccttgatgggacgactcaggtggcaattttcgggcctgaaatgtcaggcacatggagcgagaagatacaagcagccgatgtgcctcgaaccactccttggctctttgccacatgaatcaaatgctgaaaatattagtatgcgaatttcatatagcagtagaacataaaagaaatatgacaaaatacattgaaaactaaaaaaattaactgtgctgagggaggcaaaactaaatgtcatttaatgtaaaccatcgttagggttgtactatacacagctttagtttcaggaggtaactgtttttactgtggcaaagggctctatagctatatgcagaacatatgtaaactttagcaaggactctgggtcaatgcatgtgactttaatcttcactggtccacgtagtagttcataacagaattaagaaaatcgatatttttttagtacaccacagtttttttcccctcatatctctgcctcatactaatccacaagttaaataaaacctggttatgctatgcctgaaggcttcccccccatagtcaagactcaaaaccacaaaccttatttactggtggattgtagaaggccaaagattatgtagaactaacatctaaacatttcttaatctgtttaacctgaactataaagaagacatcatgcaaagttgcatattcattgcatataaagccagaaatgggtggacatatttagaaaaaaggcaataacatacctactgttctgcggccttttcaccaaccacagaagaagatgggctccattttctatcaaaaggcccatagcttctctccacaatagtttgccgctcggttagtttcttatctattagctccagtaactcttgcaatcctgtccctgtcactgcagaagttttcacatgacaagtggacattggttgtgttgaactgcagctatctgtactaatagtttctggaccacaaagctctccaaaacaatcttttgatgatgatgatactgagttcattgctctcatctcactaggctcaagtgaggatgatatttcaccattgttgccttccaaattttcctctgataaatattcggagtctgttccatcatccaaggactcaaatgatgattcttctgcaggcacatcgttttcagaaaataattcttcctccttatcctcctcaccttcggtcaggaaaatctcatcttcaatatcatcagttacatcattatcattgttgtccacaatatcaatctgaagaaacaccataaaaaagtcaagttacatgaaaacccatgctaccaacaattcaccatgcaagtgtgacagtcacagccaaattaaatttcactactaaccttattccaaacttcgatcatactgttgattttatcctgtgaaacaccaatctgttgcaatacttgcagaacagtagaacgatgttcctcgatattaggagcactagaatctaatacatgctgcaccaatgcaaataaagagacatacaatcaactctatttctcttttttttattaagtaatttatcttaaaacaatttctgaaaagaaaatgtacatggctgaagaactatttgttattaaactagcaatggaaagattttagaagctgtcggagatatgggccgggggtatgcaaagtgaggggaagttaccttcccatccagccacgtggctctacagtctggccctaccccgcacctcgcgagtcgcagaagcggccggggcgcctcggggcgccacgtcatgcccctcgggctctcgcgttgccttgccccgaggccctcccccggctgccatgtggcgggggagcgagaggggaggaaacccaggctgaacagccatcaatgcgcggcgccccaactgtccctcactgcgtttaatgtggtaaggacggacgtgcggtgccgcaccactgacccacgtcaatcgggtctgaccagtctgtgatcggcctgtcgccggtcacgttcgactgaatgggcggccgtgcccccacgtcgcctctgtatccggcggagtggaggtaggtatgtcccgtcccatcgaaaagtcattcggagttccctccgtgagaggaggaccgccacaagtcttcactcatttatgagggaatgacagggctgtcccccgtgtcaggctggggggggacgttgggtcccgctcaaggacggactgctgcttagcttccgggcgaaggtacgggtcgcagtccggtcaaggtagtgggtccccctcccgtagaagagtaggcagaggcggtgcatgcggtatccccttaaactatacaaggatgaccttgcccaccgagaaaagggacgactctcagtaagcctgaactctaggagaagagaagtgggagcgctctccggagtttaggaacccttgtaacactccataatctcacacacaggagtagggtattacgctccatagcggcccgaacctatataatcttagtgcccacacgcgttttagtagcattgagggcggattcacgatctccccacgcgagccttttcccccggccgaactcactaaagggggatctcacgatctcccgctagagaggatcactcctcgacagctggcgcgccaggtagaaggaattcgcgcgcttcaaagggaagtcgtttccttccgccccaagttctcctctaccttcgacgatcatggtcgaggtcttggaggaagaggtggtggtgcacacccccattccctccgggagtgaggatgctagcgggagtcgcggcccccgtcaccgtcgccgcaactggcgaactccgccccgtcgcgaccccccgcggagggaggatcccacccggtcgggtggctcggccctctccccgcctcccggcggggggaggccacggcgcgtcggagcacgtcgccgcctgacatacggcgacggtgactcgccccgaggcgcgcttcaggcggcgggagcccttctacggcatcctccggtgaacgcggagcatcctcaggttggtgacgtcgccaacctggtcaccactgcccagcgacagctgaccgcgggtggccgttccaccgccactggtacgtcacgtacccccaccaccctctcctcatcagcaaggaggagggcccgtcggtcggccacggccttgaggcgatccacggccccaacgtcgtcgggggcctcgggaagtcggaggcatcacgatgacctctacgaggagcaggacgctcgaatcaacatcgagcaacaccgggacgagcgccgcgctgcccgcatgggagaaggcgcctcctcgtctggagtgccgcgttcctcctcgcgaggcggcccgccccccacgttcacccctggagggactgcttgtagggccttcgttgtgagtctccggaatgtccggtgacccccgaagttttgccccaacctcacggagaagtatgatggcagcatcaatccctccgagttcctccagatctataccacgatcatcgtggcggcggggggggggggggggag

SEQ ID NO: 76266 - DNA, 9267 bp, Oryza sativa
acacatcatctggatcatattgaatcccagtttataaaattatgtggattaaaataatggcattatcgcttaatttaaattcccgcgttatcactgttttatttagccatgcctatttacctttgttatgaccatattattattgttattgttattattattaccttgttcaccctagacaaacaaaacctcaactagtgggcactctactcatagtaccactaggataattttaggtagatgcttcgcaatttaattaggtaacattaggtggttttacaactatagactttgggaaatattcatatcacctggatactttggaatggttggctattgtggaattggtttcacaccgctccttcctttcaaaacccctaaaatggttttgggctgggctaggggtgcatggttttgatggtagcacctcggccgtataaggaccggtcttcgggcctctgttgcaaagcactaccgtactttcacatgtctagtgggtaaggcttagtttgtggctcagtctagtcataaacaaaagtacacggattggagatggatgaagtcgggggtcgatggacattctccagggcaaatgaaggctacacgagctgcgggcccgtagtcaagatgtcattgcagagggttggtgccctgctgctaggggctcagtcctgcctgcctgtcccgggggttccggccgtaggcgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgttttaatccttaaaacctgcttatcaactaaaatgtggaatggttggcctgggttggcttgggacgagctgggacccagggtcgggttgccagttcggtctgaatcatcataggccttgggttaaggcaggttcgtgtgggttcacggccttgattaataacattgtatagttctaggatcgcgtttgcaaaatagctttgtgcaactaaattttctttaaatgctgattactgcaaccctaaccctttatagtataattcccttgtactcccttgcatttattctgcatttgtgggtgtgtcttgttgagtacggtggttgtactcagtcttgctcaatttttcccaaccccagaagaggagttccttgaagatgaaggctttggtgtctagctcgtgcctgccgtcaagcgcctgtggtcgtcgccctagtcttccgctgtttcccgtttgtctttgtgtgctgggccttcgctgcccgtgtaataaatatatttacgcttccgcttgttaaactctgatttgtatcaactgttggtgtaccttgcctcctgggacaaggattaatgcacgcacgtaaggaactcccgttgggttatttccggtcgtggcaaggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctatcacggcctctttccgatatgtcgtggtggcatgtcggcgcacggaaacgtgttgtgcggctgtgtcttgtgggtacagttgtacacctctgatcagagtaaaactattcgaatagccgtgcccgcggttatgggcggtcaaccagattcaccgtgattagtctcaccttagtgtaatcttttaatttggatagtttaggtggatggttgggcctgtcgcaacgtgggttagcgttggacagtggatgtttaatattaattaattgttacaacggtttaatctttcaatctctgtttataaatgctcgctttatgcaaatgaaccactttagctcttctttgataactccctgcatcatacccctattccggtatgacttgctgagtacagtgggtagtactcagccttgctctatttccccccgatcccagagctcgagtatgtgtccgatggcgggttctccgaggagtaggcttcgtccgtgccgtcgaggatgcctgtggagtggtgttcccgctgcagttcaagtcaaggcttagctccagttttcttttgttttccgctgcatttctgtaagacttttatgatgtttgtaagacgtggatctgaatgtcaacatagtcgtttgtgtaccccggccggtcctggacgggggttttaatgcacattctgcttggaatcctattcgggaatttctgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcaggggaaaaatcttggtcgctcgtttaaagtgagatttttcaaaacgagtcagtctagggttttagtaaagctattgggattcattcgttagtcagttgggatttgatgggtgaaatgcattaggtcctagctcaggaatttgggttgcaaggtatttatgctttatttgttattattagtatgtatctaatttctcattattttatcgttatgtgagtctgtcttatttattcgctctcatgcaaaatgatctatgcataaaatttcgctcttattcgattcccttatttgagtcttttattgctttatttacatttggatttgagcatgcattgatcctactcctttgtattctctagatggccggtcacccacccaaccaccgtggagaaggcatgattgacttcgtggcagagttggcacgcatgacactggtggtgggctaccccaatgcgccagaatacacgacgattcccccgctcagtggcgaacttcctcaccgtgtccgcttggaggtccacggctacgtggggacttgcctcgctaatatggcggttgaggcgtcaggaggcacagcggatcacgcttgtcaggaggcagcctacttgatgatggccagactgcgggagcgccacaactacatcttccacgacacggcgtaccgcttccaccctcgtcgagcccacggtgacgacgtcagttccttccgtccgacagctggcgagaacgacaccacctttggtcacatgtgtactgtgatgaggggattggacaggatgcactcggacctgcacaaggcgaccaaggccttgaatgatgggaagctcatgaggatcgtcgctctgaaggatgagatagcgcgcctgaagaaggagaatgctcagttgaagggtcttccagcaccaggaggagtccggatccgcactacgcctcgtaagaggacgactgcacccgtgcgcatccagctcgcgcccaggaacccagttccgaccgcagctcctgcagcacctccagttccgcccgcagctccggcagttcctgcagctccagctccagctcccgcgttcgatctctccttcgccctagcatcagccgccaggggtccagccagtggtaccggaggttggttgtctgctactcccagtggcagccgcgaccgcagcagcagcagctccaggggctgagagtcgggcagcggcgagacttatctgccaggctccaggagtcgttcagagggacctggtgatgagcaggaggacgccttcgactccaccgaccgcaggagccgttccgagcattaggctcgttttccattagtttaccgactgtctagcttctgcttgttagtttgtgtgtttaggttgcttgtttggggtcagtcgacggtcgatatcatgtgcctatgatatggctgtcttaataaggatttttgtttgctcttttaagtgttttaattcagatcagaacaattgcagttttaattcctttgtaataaagcttagttcctgagcatctgtttttcttcttttccccgtctgcttttccctccagatggtctacaccaggactggcaaccgcacgacaggcgagggcagcaacggcgaagaacgcgttgatggtgtgcaccccaacagcgattccggcaatggtccgccaccacttcccgagaatccgacccttgcccaagttatggcacatcagactcagatgatggcagccatgatgcagcagatgcagcagcagcaccagcagatgcaccaaaggatgatgcagcacgccgaacagcagcaccagcagtttggtccccctccccctcagtccaagttgccagagtttctacgcgtcaggccacccaccttctccagcaccaccaaccctatggaggcgaacgactggctccatgcaatagagaagaagctgaatctcctgtagtgcaatgatcaggagaaggtcgcttttgccacacaccagcttcagggtcccgcgtcagcttggtgggacaaccacatggccacccgcccaccgggtactgaagtcacatgggcagagttctgccgtagcttcaggaaggcacaggtgccagatggggtcgtggcacaaaagaagagggaatttcgtgcactccaccagggcaacaggactgtgacagagtacctccacgagttcaatcgcctcgcgcgatatgcaccagaggatgtccgcaccgatgccgagaagcaggagaagttcatggcgggtctggatgatgagctgaccaaccaactgatatccggggattacgctgactttgagaggctggttgacaaggcaattcgtcaggaggaccaacgcaacaagatggacaggaagaggaaggccgcacagttcagggcacctcagggaagtcaccagaggccgcgcttcactcccggacagcagggtggacctaccaccatgatcgtccgtcagcaccgcccgttcaactccagcaactttcaccagggctctagtggcagtcagaaccaccatggaggtcagcccaaccgcggtgcagctccacgcccaccaatggcaccggcacagtcaggcccgcccgcgcaagccaagaaggagactggagcaaaaccagggtcctgcttcaactgtggcgagcttggccacttcgccgacaaatgcccgaagcccaggcgtgccgggccaaggtttatccaggctcgtgtcaaccacgcatctgcagaggaggcacaaacagcaccggaggtcgtactgggtacgttccctgttaactcaatccctgcaacagtactttttgattctggtgcaacgcattctttcatttcaaagaaatttgtggggaggtatgggttaaggaaagaagagcttagcacaccaatgagagttcataccccgagaaatagttcaacctcagtcagttttagcccttcagtgctaatagaaatccaaagatcaccatttctagccaacctcattcttctcgaatccaaagacctagatgtcattcttgggatggattggctgaccaagtttaagggggtcattgattgtgcgaatcgcacagtcaccttgaccaacgagaagggagaaaccgtggtgtacaaatcaccagactcaccaaagcaaggagtctccttgaatcagattgaagcggaaatcccagtggacaccgtggagaagaacttgagaaaattggaagatatacccatagtctgcgagtatccggaagtgttccccgaagacctcactaccatgccacccaagagagagattgaattccggattgacttggcaccgggaactgctccaatctataagagaccgtacagaatggcggccaacgaattagcagaggtcaagaagcaagttgatgagcagctgcagaaagggtacattcgaccaagcacttcaccttggggcgctccggtcatttttgtggagaaaaaggataagacgaagaggatgtgcgtcgattatcgcgcacttaacgaggtcacaatcaagaataaatatcctttaccgcggatcgatgatttgtttgatcaactgaaaggagctagagtgttttctaagatagacctgcgatcaggctaccaccagttgagaatccgggaagaggatattccgaagacggccttcaccactcggtacgggctatatgagtgcacggttatgtctttcggacttaccaacgcacccgcattcttcatgaatctgatgaacaaagtgttcatggaatttctggacaagtttattgtggtgttcatcgacgacattcttatctattcaaagtctgaagaagaacatgaacaacatctccgtctagtactcgagaagttgaaggagcaccagctatacgccaagttcagcaagtgtgacttctggttgacggaagtcaaatttctgggccatgtcattacagctcagggtgtggcagttgatccatcgaacgtggagtcagttaccaaatggaccccaccgaagaccgtgtcgcagattcggagttttcttggacttgcgggttattaccgtcgattcatcgaaaatttctccagaatcgcccgacccatgactcagttgcttaagaaagatgagaagtttaaatggacagccgagtgcgataagagcttcgaggagctcaagaagaaattagtatccgcaccagttttgattctgcccgacccgacgaaagacttccaagtctattgtgatgcatcccgtcacggacttggatgcgtcctaatgcaagagggcagagtggttgcgtatgcctcgcggcagttgcgtccacacgaagggaattatccaactcatgacttggaattggcagcagtggttcatgctttgaagatctggaggcactatctgattggcaaccgctgcgaagtatatacggaccataagagtctgaaatacattttcacccaaccggatctaaatcttcgacaacgaagatggttgtaactaatcaaagactatgacatgagcattcactaccacccgggaaaggccaatgtagtggcagacgcattaagccggaaaagttactgcactgccctatgcaccgagggcatgtgtgaggaattgcggcaggagtttgagcatctcaacgtgggtattgttgaacacgggttcgtagccgctctggaagcacggcctacgctcgtggatcaagtcagagcagctcaagtaaatgattctgaaatagtagagctgaaaaagaatatgagagtcggaaaagcccgggatttccacgaggatgaacacggcacaatcaggatgggagaaagattgtgtgtacccgacgacaaggaactgaaggatctgatactcaccgaggctcatcagacccagtactccattcatccaggcagcactaaaatgtatcaagacctcaaagaaaagttttggtgggtcagcatgaggagagaaatagctgaattcgtcgcactctgcgatgtttgccagcgagtgaaggcagagcaccaaagaccagcaggtttactccaacctcttcaaatcccggaatggaaatgggaggagattggaatggactttataacgggactgccccggacatcatcgggacatgattcaatctgggtagtcgtggatcgactcaccaaggtggctcactttataccagtacataccacctatacgggaaagagattggcagaattgtacctcgcaaggatcatgtgtttgcatggggtacccaagaagatagtatccaaccgaggtagtcagttcacctcaaagttttggcagatactgcaggaagaattggggacccgtttaaatttcagcacggcctatcacccgcaaactgatggtcagaccgagcgagtcaatcaaatcttggaagatatgttgagagcttgcgctcttgattttggtggagcttgggacaaaagcttaccatatgcggaattctcgtacaacaacagctaccaggccagtctacagatggcaccgtttgaagctttatacggccggaagtgccgcacacctctcttctgggatcagacaggcgaacgtcaactgttcggaatagaagtattagcggaagcagaacagaaagtcagaatcatcagggaaagattgaggattgctcagtctcgacagaagagctacgcggataaccgtcgaagggagctcacttttgaggcaggagattacgtgtatcttcgtgtcactccgctccgaggagtacaccgttttcagacgaaaggcaagctggcaccacgcttcgtgggaccatacaaaattttggaacgaaggggagaagttgcttatcagctagaacttccatccaacatgatcggcatccatgacgtgttccatgtgtcccaattaaagaaatgcttaagggtacctgaagaacaggctgattcggaacacattgatatccaagaggacctaacatatgtggagaagccggttcgtatacttgataccagtgaaaggagaaccagaaacaaggtcaccaggttttgctgagtgcagtggagtcaccattcagaagaggaagcaacctgggaaagggaagatgatttgaaagccgcccatccgcacctcttcaccagctcctccgaatctcagggccgagcttccgtttaaggggggtaggtttgtcacaccccgaagttttccccccaagccaaaattgtaatttataaatgaccccaagaaaatgcaggtgaaatcaggagaaaaccctaagaaagtaatgcaaataataatcggatttgacatgtggaatttttcttgagttctatatgtcgaaattcattaacaggatttttagtagaattttcagagctctagaaataattttaaccaattaaaattgagcaagcaatatttttaattccagggaaaatcctttttctttttctttttctttttcctctctttttcctttttttttcgaatgggccgccggcccattccctcctttctttctccccctccctgctgggccggccgcaggccgaggcccagccaggccgccccgctgcgtcctctctcggggtcgccgacaggtggggcccaccagtcgggcccgtctccctcctccagccctggttaatattgcgcaataaatgatttaaggttttttcttttatagtaataaacacagtgaatcttctaaaaatcataactaattcatccgagctccgtttaatcccattcatgtctcagtaaatcaagaaaaatgtgtagaatccattaaaaatggttttgtt

SEQ ID NO: 76267 - DNA, 21591 bp, Oryza sativa
cgtttatacgtttcggaacggcgtgcggcacaatcgcatgctagagaagatcgcctccaaggagcccaagaccaccgccgagctcttcaagctggcggacaaggtggctcggaaggaggaggcgtgggcctggaactcccctagcaccggcgcggcagctgcggctgcccccgaatccgttacccgctctaagcggcgagatacgaggggcaaaaggaagccagcccgctccgacgacgagggccacgtccttgcggccgatgggccctcacgggccccgcgcaaggaaaaagccaccggcgataagccgagctccaccgctccctccggagagggtcggtcggcagacaagtggtgctcggtgcacaacacttatcagcacagcctcgccgactgccgctcggtcaagaacttggtcgagcggtttcggaaagccgatgagaagcggcagaatcgacgggagggcaaagcccccgcgacccccgccaatgactggcgaggggaggccaagaagaaggcccccgccgatgacggcgatgatagcgaggatctggaattccagatacctcagggaaccgtcgccactctcgacagggaggcttgcgctcacacctcccgccgcggtttcaaggtcacgaggtgtgagcttctggccgccgtcccaactcacaaggcggcacggaaggcgcgctggtcggaggtgaagctcaccttcgaccagagcgaccatccaacaatgctcgctcggggagggaagttggccctcgtggtctccccaaccatccacaacgtcaagatgaagcgtgtcctggttgacggggaggctagcctgagcatcatctccccggctgcttttgacgcgctcaaagccccggggatgaagctccagccgtcactgccgatcatcggcgtgacctcgggacacgtggcctctgggtcacgtttagctcccggtgaccttcggcgactccaccaacttctgtaccgagcggattgacttcgatgtggcggacctcaatctgccctacaacgtggtcctgggcaggcccgcgttggtgaagttcatggccgccacccactacgcctacctccagatgaagatgccgggccccagcggccccatcaccgtctttggcgatgtcaaggtcgccctcgcctgcgcagagtagcgtgccgacaacctggcggcagccacggagccgcaggtcccgaaggcctccacgtcccgcgcctccaagaagcgcctcgcctcggccgacgaggtgcccgtcaaggagattccccttggcgatgatccatccaagaccgccaagattaacggtaccttggacgccaaataggaaagcgcgctcgtctccttcctgcgggcgaactccgacgtctttgcgtggaagccgtcggatatgcccggggtccctagggaggtgatcgagcaccgcctcgccgtgcggccggatgcgcgacccatccggcagaaagtacggcgccaagccccggagcggcaagccttcatccgagaggaggtgacgtggctcctggaggccggcttcatccgagaagtcatccacccagagtggttggcaaatccagtggtcgtcccgaaggccaacggcaagctccggatgtgcatcgactgcacggacctcaacaaggcatgccctaaggatcccttccctttaccgcgcatagatcagatagtcgactccactgcggggtgcgaccttttgtcgttcttagatgcctactccgggtatcaccagatccgcatggctagggaagatgaggaaaaaactgctttcaatactcctgtagaaacctttattatacaactatgccttttggtctcaagaacgcaggtcctacttttcagcgcatgactcgcattactttgagtaatcaaatagggcgcaataggcgcaatgtagaggcgtatgtcgatgacctggtggtaaagacacgccaccaggacacgttgttgcaggatggctgagactttcgacagtcttaggtccacgcgcatgaaactgaaccccgaaaagtgtgttcagtgtgccggcgggcaaactcggttttctagtctcctcccgaggcataacccccgcacatccttcggcttgtgcaggcttggccgagggctaccactgttaattatgttgtatcttttcccttccccagcaataaatttttccgctcaagcggaggctattgcgcgccctttcttactccttcctatggctcgtcctgcttcaaaggatgattcgcgcttatcccggaccctaagtggcgttgggcgacctgaaaaccgccgaaagggagcctaaacgcgggccgcgccccgggctgcggcgaaccctgggggctcggaagggcctacacacggccatccccgacccccggtcgtcgtagcctcggtctggccagacctgctaggcagctccctcggggcgacggcattgcccctcgccacctaggtgccacgggccgagcgtgagtttcccttttcaccggaacaagcccgaggagggacataaagagggtaagaacggcaacttaatcataagaaagtcaattgaatacgttcgctttggtttcttcttctttctttgccgcagacattcaaaggagaaagcaagaatgtaaaggcgcgaaggagaagctttgtttacaaacagtatggcacgatgacctaaagtttgaagcgttcaccgcgagcacataacaaaataaaagaagaaaagcggggatagtcacggagtgcccgggaccccgagtccggcgccgctgaccacctcgtcccagtcctcgccgccgtcatcgccaccactgtcctcgctcccctcccctcgtctgaagcaagcgcaaggttgaaccgaggggccgacccctcgaagctggagacgatcgcgtcggccgcctcctggacttgctcccgagccctcgcctcggtccccggggggaagtcctcgagcgcgcgccacaggacgaagtcggggtcgcgagcttgatgacttgcgaggaccagttccaccgcagcccgcgccaaagaagccgacaacgacttcacgacctcgccgacctcctcctccagcctctccaaatccgcagccatcccgtccagccggagcgcgagtgccggctgtgtgggcgggagcttcctgtcccgacgcacggagatgcctacccggcgccccgcgcactccagccgttcgacggcgtcggagagttggccaggtccgatctcgttggtgaggcggagggccgcaatctctccagcttggtcctgcaccaggagccgcaggtcggcgagggtgctttgaaccgcggtgagttggctcatcaactccgcgccgccgggctgcccgcctgccgccagctccttctcccaggcctccagctcggaagccctcgccgccatcgccgcgcgctcagcgcgggcaccttctaaatgccgggcctcgcgcccggcaacggcctcctcgcgtttcgcgagttgctcgcccagccgacgcgccgccacctcgcggcgattcacctcggcctcgcgtgcggcaagcgcggtgtcccgttctcggcacgcctcctcccgaagccgcaaccccttcgcgcgatgagccaccgaagcctctgcggcaagggtggtctggttgcgctcggctgcggcctcctggcggaggcgaagggaggactccgcctcggccgccgttctctcgggcggccaaagtggtctcgcgctggtctagcatgcgcgcccgctcctccagcacccgagcatgctcctccagctcccgggctcactgcgcctgttcccgactgcgcccgtcctgttcgcactggttacggtcgaggacctcaatccgtcgatggatcgtggcctcgaactcctgcgcggagcgggcgcactcgtctaaggccttgcgattggcctcgagcgccgccaaccgagcccgcagcgaggcgtcgacctccgacgcccgccgctcttaggcagcagccgcgtcgaggactccgcgggcgtcttcgaccctcttcgccagatcctcggcgtgggcctcgtactgcaagcgaatgtcgcccagcgcctcatccagtacgctcgaagagataagcaccgcctgccgctcctcctccgtctcccgcataaccgagtccagcgtctcttcgcgcgcctagttctccgccagttgggcttggcgcattttgcgccccacctccaccatgtcgtccacggcgcggcgcccctcatcgactcgcgcgcggtccgccgcgagctgcgcccactccacctccagggccgcctgctcgtccgctagggcttgaacttgggcattgagcccctccaggacggtggagtcggcagcggcgagcacctgcaggagtggctccatgctcacgggagtcggagaagaaaaagacggtccgcccccgagatgacggagtgctgctggaccccccgcgagactgggggctgctctcggcccctcttccgcgcggccagccccgaggacgccccaaatgcagaggggaacggttgcccccgtcaccccccgcctcggcccctcgggcagactcggcctcggcctcgagttcgggcccgcccccggcctcagcctccaggccgtgccccgcctcggcccccggagcgtgttccacctcggactccgagccacgacctgctttggcctccgcccccgagtggcgctcctcgtaggtcgcgccctcgggatcgcccccggggggacgccgtcgccgttgctatcacccgcggatggttgcacctcggctgtggcgggctcggaaccagacccggcgtgtggcccgggggccccaccagggtactgcgaaggccccgtgacaccgggttggccgggtcccggtcgatcccaccgctcggattttgacccctacaagggatcggacgccgagaccccctgggaaggaatcccgctacaggagaaccccaatcacgttaaaaaaaaaagaagaggaaggaacaggaggccgagatggatagagagcaccgagtcggatgctggcgatcattcctgcgaggagggcgtttgaaggtccacttccggggctcgatgaagctcccccggcacggctccgtttgccctatcttccggagccgcttcttccgtccagcctcggacgcggcggggcgtttgtggcccgccggtggtcggtccgccgttcgctcggcgccccctccacgcgggggagaaggcagccgagattcgaacgccttccgcttccctttcgggtcgccggccgagtcccccccgggtccatggctcggaccgggcgcccaggagccgacgcccccgccggagccgccggcccggctgccgcctacggtcgcgccgctgctacccgcgccgtcgccgccaccaccggcgccgctccggcgggaccgacccctgccagcaccgactgccgacatcacagccaggatactctcccggtcgcggtcgctgcagagggggaggatcccgtccggaatcagcgtttgcttgatagtgtccaggcccagcactcgccggatcaccgtcttcgcgtcctcctcgccccagtcccagcgctcacccacgtgggtgcgcatgggatcgttgtgcccagtatactcccacgcgccgcgggaccgctcctggagaggcgcgatgcgacggcggtagtcgccgaacaccatcgcccccgttaagccttagcttcgcaggcccctgaggcgatcccgcacggcgtcgtactcctcgcccagttccgaaactgccaaccacgcggcggatcgttcaggagggccgacggggagccgaagtcgcggatgatccggtagcgcggtgtagaaccaatccttcttccaatcctcccacttcttgcagaggtggctctcgatgtactaccccgccattcccggccggggctggaggtagcatcctcccaccgccgcgccttgctgcagctgcgggatgaagaaggactggaacagccgcatcgtcggccgcaccccgacaaacatctcgcacaagtgcgcgaagatgaccagcgtcatcacggcgttgggtgcgagatgcaaggcttgaatctcgtagaaatccaaaacctcatggaagaacctggaaaatggcgggatcaaccccaccatggcgaaggacaggaggtgcacggatcgctctggataccacggccgcggccgtgactcccccaccctcacggcggcgtcctccggcatgatcttgcggacgaggctaagatgcatctctgccgtgatgcgcgacgccgggagcacagcgtcaccagcgtcatgggccatggtgaccggcggggaaacgacgaggagcttggtgtacagaatggcgtggagcgagagaagcgatggggcttgaagaacgagtgagcgggcgagcagtcggcgagaagaaggggacgaactcgcccccttatccttttatccccgcctcgcccgcgctcgtctcctcgtttcacgcccccgcggttgtctcctcgattcatgcgcctcatcgtttctcgcgtccactcatcacgtcgcccactgaatccgcgccccgcgttcagtgaacctgtcagcggcacactcagcgcggggcgtgcgatgttcgtgggcgcggattaggcgggcccgccgtcggtcccgtcgcgtgcctggcaggcgagggagtcgaggcggcgtggctgacgattctgggcgtggtctggtcgaccccccgattttcgcgccttaggcgcccccatcatcagcgcggttaatggcggtcaaatcgccattatggctaatgcgccagcctggccgcgcggcggcaaccgtcaggattccccgtcgggcccacaacctcggcacgggaagacgtgaggcgccacgtcagactgccctcacaaggccgatgtccgacgtggtgccgggggctactgtcggagatatgggcccgggggtatgcaaagtgaggggaagttaccttcccatccagccacatggctctacagcctggccctacccccgcacctcgtgagtcgcaggtcgcagaagcggctggggggcctcggggtgccacgtcatgcccctcgagctctcgcgttgccttgccccgaggccctcccccagctgctatgtggcggggggagcgaggggaggaagcccaggctgaacagccatcaatgcgcggcaccccaactatccctcaccgcgtttaatgcggtaaggacggacgtgcggtgccgcaccactgatccacgtcaatcgggtctgactagtctgtgaccggcctgtcgccggtcacgttcgactgaacgggcggcagtgcccccacgtcgcctctgtatccggcgaagtggaggtaggtatgtcccgtcccatcgaaacgtcattcggagttccctccgtgagaggaggatcgccacaagtcttcacccatttatgagggaatgacagggctgtcccccgtgtcaggcggggggggtgcgttgggtcccgctcaaggacggactgctgcttagcttccgggcgaaggcacaggtcgcagtccggtcaaggtagagtgggtccccctctcgtagaagagtaggtagaggcggtgcatgcggtatccccttgaactatagaaggaggaccttgcccaccgagaaaaggagcgactctcagtaagcctgaactctaggagaagagaagtgggagcgctctccggagtttaggaacccttgtaacactcagccataatctcacacacaggagtagggtatcgcgctccatagcagcccgaacctgtataatcttagtgcccacacgcgttttagtagcattgagggcggattcgcgatctccccacgcgagccttttcccccggccgaactcactaaaggggatctcacgatctcccgctagagaggatcactcctcgacagaagccatcttcaacctatgaatgccaataaaaaatgaattggagataagttaattatacataccactaacatatctgcttcaacaacttcttccaaagtagcatgaaatgcttccactagctgcacaagaaaggttactatattattactgtcaccacagtagttgaaaaaggctttcatgcatcattaaggttcccctggaggcctagaccaaagtggcatgatagtgctgtgattggcagcaacaccacaagggcagggagagatagagtaaggaatttcaggtcactcttgcttagcacttcatgagctaagacctcatgttaaaaagagcattcctaagataattcaatctaagagataagataatagagaaactaggaagtaatgaatatgtgaacttcaaaccacatacttgcaactaacttgcagtgccagctcttttctctcttttactatcaactctgcacagttctaacctagtagcacaatgtaatacaagcctctctgcagcattttcttaaaaaaatgtattaaccaaatctttatagtaaggtgaatgttggggtttagcagaggtcggcataacagatggtttcgctttaaatcgtgccagcagtgctgttggcagagtacaaaactatgcaaaataaactaataacttgtatgcaaaatggtagacgctaaatccacgattgtgtcaaaacaatctgcaaggtcaaaattaaatcaagaaagctacctgcacaggcaagtctgagatgaagccaacagtatcgctaagaagtgcttttctcctgaatagcatttgacaaaaaaaaaagattatatactgaacatgcactaatcacaaatcaaatctactgacatacaatagatgaatgaaaaatctattaaggtaccctgatgggaggatcacactgcgtaagcggggatccactgtagcaaatagcctgcatggaaacagtaaaatgatttggctacacagtgcacatttaaaatagtaagctatacagggaaaagttctcatcatacctgtcatcactgtatagatcagtttcagaaagtgcactcactagagtggattttccctgtaaaagatagcatcaaaggaaggagtttgtagaaagctcagatatatttcgctgtatttctggaagagcatagaaaatggttgtccaatattaagggagagaactgcaatggcagatcaacgtactgcattagtgtagccaacaacagcaacagttacaagctcttgaccaaatgagttgccatgccgttttcgatttgagcgttgtatcgctctagttcgacgtacatcttcaatttgagctaacaatctgacacggcattcctggattctacacgagatgcagtaaaaggaaaaacgatgagaaatttctgataaaaatcaggttcaaacaagattctatcaatcaactgttaggcacctcctccgctgtagttgaagttctgtttcaccagcaccacttatgaagccacgtcccccacttcctctcctaaaagccacaacagtgaattagtcaagatcaggacactagacacaataagaaataagatttcaacaaaaatgtgtttaagatggccacaaattcttagcaactacaacatcagcacagtgatgacaaaaggaaatgtatgtcaacttccttttttatactagcttcaattatttccatgcacatttaaaactgtgtatagtaaatacaaacaaaacaagtaataacaatgaagattgacaagtggatctatgcccattttgaatttgaatacttcatgttatcaaatgcataacaaatttacgtattcaactagcaaatcacacgaggcacataccaaaatgaacatgcaacagccacataataatgtttctctgaaggacctgtgcagctatgttagaactataccagcaagtacatcgtacttgaactaattgataaggaaacaatggcagcaccacttttacattagcatgctaaatctatgccctaatgtatccacaacataaagaaaaaaaaagacataacactctagttcttgcaccaaaaatagttaaaaaccagtgtgaccatagtgatcattttcttatagtgggaatttcatcttctgcagttacaaccgtaccaggaatatgcatgattatccagttgtgcatgataaaaatgagttcataattctaaacgatataaacaaagagcaatgttgatgtcactacataagtgtataagtacaatttaaatgttgaaatcttgcaggttgaaatcaactacaagaacatgcaagtttaccatgtttcaaaatgtggaccagcacaggttaaagttcatccttgacattacaatatcattgtaccaaagatggcatccacattaaattttgctcatcattcatcaaacaatattttaccaccgctgactatgattaagagcagacataccctcgagcacttacaacttcagcttcaccactcgaaccaaaagttaatcgtccacctggaccacggacacggacaagtctagtcttcatgtacatgagagctgctaactctgactgtgccaagcaaaacaatagagcaattaaacaaatatccaaatgtcacagcatatttccatgaatattatgcatcaaagagaaccatatacatgcactcaaaagatctgacaagagtgacattttggtcagatatcaaaatggaatggacctgtaattttgcttcttttgtttcagcgtgagcattaaatatctcaattataagcccaacacgatctaaaaccggcttaccccaggcaacctgcaaaataagatatcatcatgaacaaaaaggacaggaggctcagaaattcagaatgcggcacaataattgaaacttcgacaaaatctaacaaaaaataagcaggagcacttgcctccaagttcctttgttggattccagtgagaattgcattaacaaaaactgcatctactccttcctgttagattcaaaggaataccagataaatggcgcttaaggcatactggaatattttccttcatatatcatacatgtcggaattgaccgtgcaatagaaaagaaagcataagcaagtgcgatcacaacacaaatggaatatataatggatcatccggggtgtaaaactacaaatgaagttacaccgtagtcatgtttatgtacaagaaacaaataaagagtgcacctctgattccgatgtcctcaggtagcacttaacattatccacagttccaggtccaaaaaatttatctgtatgacaagttgtcacataaggttaaatcctataatccaagaaaagccgacgaaagactctcctaggtgaacagaagtatagaactatacaaatgctggcaaaaagttctaacaaataaagttacttgatagcacagctggaagtgtcaaccagtgaagctcaagacttcacctatttgcttattgatcgaactctagaaaattcagtctgggttatgaagttcaaacattgcaaacaaaaaactacgcatatttagcaagaaagtggttagcacctcaggagaaaataattttgacattttgaaaggattaaagactcaaaggtacaaatcaacttcaccactaagaaaatgtactacaaccacatcttcagagcaacatagaaatgccaatgagggtcttccaaagaaacatgacttattttataccatttccagtaaaaataactggcagatctatagaatgtattgcatcactaagcataccctaaccttaacagatgcaattagaaataacctcaagccaatctagccagccttatttcccgttttctcaagacagaagaataggtagagtaatgcgcctatatgagtactcatgagcaaatctcacccaactctgtatgcacagccctctagtatgtgccatccaaaaagctcagtctataagtaaaattcaaacaatcagattaaagccttacaattcgctcttcattcatacaatgctaaaagtgctaacctaataatcttataagtaaaattcaaacaatcagattcaagccttacaattcgcccttcattcataaaatgctaaaagtgctaatctaataatcttataagtaaaattcaaacaatcagattcaagccttacaattcgcccttcattcatacaatgctaaaagtgctcgtctaataatcttatcacaacaaaccccaggtgtgccagaatttaaataaaaatcgctgcatatcgcatgccggcatgcagaaaagacctaaaccttcgaaatacaattacgattaaatacactcccgcttgagttaaccgctggaaatgaacaaaagattgccacataccgacatgggagcggccgcgggatgaggggttctgggcgacgaggtggggcggggcgcccttggcggcgagaccttccttgtagaagccgtcgcgcggctcctcgagggagttggcgaggttgagggcctcggcgagcttggagtcgaggagcgagcccgggcggaggcgcggctgcaccaccagcagccgcggcgggcgctcagggtcgcgggggagcagggagaggccgcgcggggagccctcgtcgtcggagtcggcgggcggcgacgcggtcggggaggagcgcttgccccagcgggtggagagggagcggagcggagcgggcgtcacggagggtaggccgtggtggtggtgggcgtgagggtgggggtggaggtgcgcgcgcaggcgggagacggcggcgcggagcatcgcgaatggcggcgcggcggcggcggccggtggtgtggcgttgggtcccaccggtctagcactcgggcactgatggaggagagcggttggatcgagtccacgagggatcgtgggacgaaccgcgacggtgcgactgcgcgaccgtgcgacacgagtcggtatggcgagagcggcagcaaaaggtggaggatagaattgctatcttgccatctttcaacaagggtttcctcatagttgtgccgtctattgttatatatcgttaaattatcattttaaacattgtctatacgaatactattataaacaaaagttcacttgaacatcacttctcctttcctttaaacacgtcaatgtgtttgtcggcagcaccaccgaatgccatgaccaccatcactctcaccgacgatgcactgcgctccacttcatcagctcaacccacatcacttcctagttgtgccgcctaatcaaagccatctccataatacatctgtcgtcatcctgcgaactccccgcacatgtctctctttggcactccgtgcgtcatggcggccttcacgtcgtgctgatagaaaagccggactgcacagcttggcggtgcacaattaaacgatggggtgccagcggtgggctggctaggtgtagtgtactcgtccatgtcccttttcagcagcacgtgacgatgacggttcaagccagtgtagcaaggccatcggagttgaaagagaaacagagaacgaggacatttcagtctatttatatggcaaatggcactctaacgtgcaatgtctatttgaaattggtaatttagcaaaatcaaaatgcaagacaacattccggtgaaacccatatttgaagatggcacactaacaattttctccatgtagagaggccaacggtagaaatattttaggaatgatcttttatgcagaggtgttcacgtacaacctgggtatcccaatgaaccaaaccgcttgactagctagtttttacgcgctggattgggttaggctataaacccatctaaatcatttgtatatatgtaagcacaattttttttccgtccccaatttcatctcgtctgtccgtaaggaataagcagcaagttagaaaaaagcatcattttttcgttattgttgccgccgccattgtcattctccttgtcgtccttgttgatcgaaacaaagagcatcatgtcaggccaggtgccacaaccaccatcgtcatcgtccttctcattgtgcttgtcgcacgagaaatggagcgctatagtgataatcgatggtaattgtgaatgtattcgacgtttttttttacttgtgagcaatatgatacattagaggagtagaagacggatgcaacaaggaagggctcaccatttgcttcatgttttacctgcttgtcatttgtcagtcacaacgttctccttgtttttttcgatgaatccgaacgagaaagacgacagcttaaactgactaaaacaaatcatataaaatagttattagtggttgggttatagagtgaactcatcgtaaacccaataagattctactttccaaacaaaatatattgtgaagagaaattcttgtgtttgaaagtaccgtttaacttggacggccataaattaatagagctaggaagtttctaaaagctatcaaatggtgaatatggtctatttaaaatcatgttttcttgaagtacagtgatgtcaggatatatatttacttatgatatctaaaaattaatataatcatctaaaaccaggtgggctttcttaagtagaagatctggaagatcttactcaaaatacaatgattacaaaaaagtttttattgctgtccctctactactccctccgctccaaaatataaacatttgtttatcgatatggtttttttatgctactttgactaacagtatctacaaatctacaaaagtaagatgttttaaataaaaagagttatatattatgatggttcgtttaatgatacatgattaatctttttaaattttttgctattagtactccctccgtccgtttcacaatataagactttctagcattgcccaaatttatttagatgttaatgctaaaaagttttatattgtgaaatggatgaagtagttaaaatttagaaagtttgacttgacactattctaaaaatacttatattttgaaacagacaaagtaagatttagttacatctagagcttatctacgaatagtacttgcgtttccatattgtataagtgatgaggtagaattcatacacgcgaccttcgagcacattttgaatagaaactagtttcgcttacggcttcgctatcacgacacatatccgtccgatctctatgctacagtctacagaatagatatcccgacgtcgtcaccgtgccgccgatcgaaccttaccgaagaaacgccacgattttttcaccccgtgccacgccacggccacggccacggtcggccactcggttggcgcctccccgacgcacgacgacccgcggttccctcccgtccccggccgcctcctgcctccacgcgcggctccacctccacctcccctcccctcctcgccgcgccgcgccgcccagcaatccaactccgaatcatcctcctcaccccgcgcggcgccgctccgaccgaccaaccaaccaaccgcagcggacgccacgcgaggggaatcgaagcggagacgtaggggcggggggaattcggccgaggggaagcatgagcttggcctcccacgcgcctagccgtcgagctcgaatcgcgtgagataaggggccgcgagcaccgtggtgggagagggagatggcctcgcgggaggacgaccgcgccggccgcggtggcggcggagggcggacggagcaggagcggcggccgtccaaggcgtgggggatcctcatcttcggcctcatcggcgccaccaccgccaccttcgcggtgagcagagcatcccctcttctctgttagtctgttacttttgtgttgattgatagtcgatgacctggttgattgattcaatacgaatacagtcctgtttcaagtgcccagcttactagctttcttgtttagtttcacgccttccgtgatgacatgactgtttccatttagttgttgctttgatgaaatttgctcctgtatctgcaattcggcgtcaaatgctccaattaggctgtttgcatcgtttcatgcccaaggtagtggcaccttcagtgcttctttttaaagataatgcaagtttttattgaacccggtcaattatatcaaggtgatacaactgcactgagaacattcctagcctctgcaaggatttagtggttcttatgcagctccttgtggcaacgaagcatgtggctctttaaacctgttattagtagtaatgctcttggcttcatatgtctctttgctgaccaaagccccaaggtcctaaatgctatcttaagattgcacgagcactgcagatgggtaaaccttgtgctaggcaggtacttactcccatcctcatgtttgcgaggtgggttgctaaggattgttgctattattggaaatcctttcgcatctccgttcaactgtgatatacggttattgtttttgctggaaacaaacccttgttgtaagctattgttacgacttacaagttgcaaagatcacctgtgcttgacctttctgtttcttcttaccatgtaattttcaggttgctcaagttcgcagaagtgttgattgggtctacagtcaggtatccaagttagcatctatctgtttgttgattggtcaaatgcaaactgttgcttttctttgaactaataatatgtccatgcggacattgattcattggcccatatgattggcaatgggtttggattgtggctgcgttacgcgcgtggagggggtgggggggggggtatgtatggggcacgctcctctcggtgggggtgcggaggggaggagatgggcatctccactttttaagtagtagagaaatgtagacatcccaaactaaatgtcctgttccagctccttatctaatcaggattgttctattcaagcagaatgaattgaagcgaagcccccaaaactttatggtttgagccttgtacagtatagagacatgatctgtgttgtggggtggaacattctttttaggttaaaacaccatatagggttttttttacatctaatagtcggtagttactccctcagtcccaaaatgagagttcgaccattaatacatggaaaaatatataggttagctttaataaatagtattgaatttgtcttgccaaatgctttcataatagtattgaatatgacttacatttttggatgtttgggagtaatagattgtttgctcaaatgtagtacagttcggcaataacaaatttaatgtgtctaccccatagacgagcattattatgatagaccagtagggtaagattcctgtcaatcctctctccctcgtcagttctactccaacaatggatttgcgtaggaacaaactcttttcttgctattgcattcaattattatttgattatttctcagtctccctgctatatgtcggaatccctttggttatattgttatcccaacaaaaatgctgtgtagtcaggaagctagccaataacagatgactgatttatcatcctatgtctccgctgtatgcttatacttgtctgtattttgattctttccatcatttacttatatgttccttttatgtctccctttcaaaagttcaataagatgcagacaacatcttggaggaatgcaagtaacagctctaaccgtggaagtttcagtgaggatgctaggagaagatattaccaacgtatgcaacaggaatatgaggaggaacaagagagagttgtaagttttaaataatgcataatccttttaacttctttatattccaagacattcatttatctttggactttgaatttggaagtcggacattatatgaatgctgcctatacattgtaactgctgctgttaaggtttagaaattatcgtgagctatgttttaattaaagttatacacattcacgaggaacaaatgattcctatttcatcccttaaatgtctcaattcaacatcttctcaggtccttttcccatttcccttcagtatgttcactttttatttgcttttttgcagcaaagaataagacacatgcaaagtgttttcaacagagagaggaacaagtttaggagaagttatgaagcttggagggagaatggccctccaggtggatataattatgtcccacgggacgactggtactggcagacagatacatcacactcggaacataaaaataggcggacatatactcctgcaggacctagggtgtattctatgtcacatcactatacagtccttggtctcaataggtatttgtttaagtctctagctgcatacttctgttcatctgttaatatactcatttcatggtacagatatattttactgccatactcagtattaagtgatctgtggtttatggtactctgaagtttctcaaatcaatctaaattgctaagagcctcagacacatgttgtaatatagtggagctgaaggtttagtattttggattagaaggctctgttaaacatttcatgtagtattgacccatggacttccttgtgtatggtataatctggctaatacactagtcagatggtcattcctttttttgcactgagttcttgtgtttttgtttgaatctggctattacgtcttctaaaaatagaacaagcctgctttgcttcaatactaccattttatgaacccagctctatattacctgaaatccctaaagtggtcctttggtagtaggaagctttcattagcatcttgcagtcatctggcatgcgagaggttctattatgggaccagtttctcattgctattttttgctatataatcaaggtcaaattggcattgctatattgttctgtatattcatgttagtttcatagtttttttaccaattctggttatctggtgaaacatttctgctattgataataaaacaagttgtcaattagttggtatccaaagtagtacactagaagcctttataagaagtgacggaagcacacgtagcacactataatcagtagtgaaatgaggattgttgatccttaaagaaaaggataatcctttgtcaggacagacatcaaggctatctgagctcagtgaactaggatattttgatgtacagacaagtctattatgagtttaaaagataatcttggaaatcttatatgctgtatactggtgctgcgatgtttatcccttttctttacgcattcagtagtacataagaaatttcctattgcatttctaaaagtttttttttgcaatctaactgttgatactcatagttcttgatggaaaggaacaaataaactatgatgtcgatttcatttgattaaacacaatgatgcttttatccccatttttttcccttccctcaactgcctttgtttgagaataaccttcacaatagtaggatgtgctacagatataccaatttgtcctaacaagccatgtcctcctttgtaggtcacggacaacaccatacaccgacgcagaagtcaaggtattgtattcgaatatctgtctgtcatgctattgttcctccagacttgtactgtagtatgttttaacttgtctcagctgacatgatagtggcatttcctctgatggtttaattacctcctttctgatcctggatggaagcctaccgcctgttccagctttctttatgctttcaactacctcttttttacatcccctttgttgtgctaaactcttttgctctttctgattcaagagttttcatgccttttcttactagcaaagaaatggaaacattatgtttgtgattatttatttttgttttaccatatcacttatcaaatatccaagctaactaaaaatccttcagctagctatccagaaatcataccctgttaatttgtatggatgttgaggattttgcattgtgccgtccccaattttcctacgatggaacaactctctaaccgtgtttttcaataattcttacgtgatctttgattccaccaatcaaatatttcatattttatgttctttcctattgtatatgaatgtattaagtggctttttgggaatatctggttataaagggaatggccaaagaccatccggttcatgaaagaaattgaaatttttctcatttcctttttcaagagaagatagccccaaaaatctagtagggatttgttgttctagatctgcagaccgaatttgttgtttggtatatttaccatgtttgctgtgtgtgatatgtagctgagtatctaacgtcaggaatttacttgctgcagaatgcttttagaacaaaagcaatggaggttcaccctgatcaaaatcaagataatagaggtggctaacaactccatgctttttttttcttgattcgtcatatatatgtatcgtgttgttatgtatccacgaataccatgaacatcttatgttgtgcagaggctgcagaagagaggtttaaggaggttgtcaaatcatacgaagcaataaaactggagagaaaaaatgatgcaagttgaatgtgaatatgtagcttcactggagctcattgggaagattgaaaggatcaatgaagacagtatcagcaggccttgcaatcaagtggatgatctgttaggttcggctgtatctgttgatagcctgtaagcacaagtttttatttgcgagtttttttttttgggagcacacggccctgatgtagactaggatattgtcgacaaaggtgcaaaaggaaattgctcatttgtgcttagccactaatttggggtgcaaaatctggactgcgggtgagcatttttgttgtgtacacctgctggtttattttttattagtagaaagtagagtgaagatctgatagaaaataataagtagcccataatattatagcagaaaaacaatgtttattacgacttactcagttactctgttgtgcattagagctgtggttagctcaaaccggtgctgcctatcatctatatgcgttaaatgatgcatggatatgaattcggtttgttacagctgaccctgttgattctgcacagcagatcgcagtatcagactgaaattgtgagtgcaatctagccataaaccaacatgtcactttcgaaatgacaccgtatgatcatactctgatacgtggagagtactccctccgtcctataaaaaatgaatcttcccataaaaaatgaatctgatttatagtaatagaatatattaaatctggtactaagttgttcctataatcatgttgccacgaaaaagaaaaataaaaaatgaaccaaaaagaaaagaaaaatgaaccgggcaagcattctgggcttgcgcagttgcgccacactgccacagtccagcccaccatgcggcgcctcctctccgctccgctgcgccgccgcctatgcacggcggccgtggccgcggcggcgcccgacccggccctcgcctcctccgcggagctcgcgtaccgcctcctccgccgccaccactccgaccccaagaggctcaccgccgcgctctccggctcgggcctcgacccgacctcgccgcgcctcctcgacgccgtcctccgccgctgcggcgccgcctccgcgctcgcgctccacttcttccactggtgctccccgtcgctgccgccgccggggccgctcccttcctccctcgcgctcctcgccaagtccttctcccgcgcctcctccgcgccgtccccttccctcctcgcgccgctccccgcccagctcctctccccgtccctcctctcccccgtcctccgccgcctcccgcccccgcgccttctccccttcgcgctct

SEQ ID NO: 76268 - DNA, 23713 bp, Oryza sativa
  unsure (1)..(23713): unsure at all n locations
gtccctcgccaagaccggccatgtcgccgtctccgagcagctcgtcgaggagctccagcccaggctcccgctctcgctccgccactacaccgcgctgctctacgggtggtgccgcatgggcaagctcgacgaggccaagcacgtgctcgcccgcatgaaggccgcggaggtcgccccggacgtcgtcgtcttcaacaccctcctcgccggcttcgtcgccgacgggcggttcgaggacgcgttcgagctggcccgggagatggagcggcgtggctgcccgccgaacgccgtgtcgtacaccaccctgatgcaggggcttggcgccagggggagggttgatgaggcaatgcgggtgtttgtggaaatgcgcaggaaggggtgtgcaccggattccgtcacctatggcactctggttactgcgttctgcaaggctggtaggatatcacagggatatgagttcttggacgtcatggcaagggagggtctgcgggtggacgccggcgtgtacctcgggttcttcgtcgcgcacgagaagaaggagcagcttgaggagtgcttggagttgatggagaggatgagggagtgcaggtgcccgccagacctcagcatctacaatgtggtgatcaggttggcctgcaaactcggggagacgaagcaggctgtggcattgtggaacgagatggagaccaacgagcttagtcccggggttgacacatttgctatcatggtgactggcctcgttggccaaggcgtgctggttgaggcctgcggttatttcaaggacatggttgggaggggactctttgttgcaccccagtatggggtgctgaaggacctcctcaattcattggtcagagatcagaaacttgagcttgcaaaggatgtttggggatgcattatgaccaaaggctgtgagctcaattttggcgcatggacaatctggattcatgcactgtacgcaaagaaacacgtcaaggaggcctgcatgtattgcttggacatgcttgacgctggtctgatgccgcagcccgacacatttgcaaagctgatgaagggactgaagaagctctacaacaggcagattgctgctgagatcactgagaaggtgaggaagatggcggaggagagacatgttagcttcaagatgtataagaggcgtggggtgagggatcttgaagagaagcctaaggcaaagagaaagaaagggcagaaaaggagtcgcttgaggcaggctggtcagaatcaatccaataggcatgctgacaaaactgacctttttgatgattttgatgatgaataatttcatgcaaggactagtttttgccttctgatagttgctctatatagtttcgacttattactctagatcattctgtgtgaggtttaatattttttttcttggggaatcactggatctagattgtaaagttgctaatccaaacaagtcaataaacatgtcacaaaaaaatatattgttttttttttcatatgcaactagagcgaactgtaaaatcttacacgtgcagagaaataggtagtctgtaatgatctactttatgtctcttaagttgttgcatgcagtatgattgtgatcataagtatatctcattgtaatttcaatttgtgataactggtaggttgatgtatacgtagcagtatttcttttcccaagtttgatgggcattgaatttctctggtttcattatatattgtagtttaaagtatcacgaatagtattactttaagttacatttgtttaagtatttcttaattgaattcctcccttaagaaatacggagtactgcactaaagtaatgttctttgttctagggtggtgaggagccgaagaaacatggtttggttttctattgttcgtttggttaagccaacaaaaaccagatcgggtgttttgactatgtgtacctgcggaaaacgttggctagaagaagaaaatgactgtttgcctgaaaattgggatgaatacatacatttgtcgtgtagtaagaccccccttaaaacgcacgatagaaaaacacaataggttcccggcgaaaaaaaaacacaataggaaaaaaacgtaataattgaagtattatgtttttccaatcctatgaaaattgagaaaaaaatatatataaaaagatgagtaaattacacccgcggtacatgaacttgtgtggtgggtgcaaatagatacaacaacttacaaattgctcactttgatacaataacttggctagttggtgtgaaccgggccaaaatgatcacacaagtaaaattgctctaaattagtgcacactaatgacataacaacatatacatataactgtgatttggagatcttatttcgaatccaaataaaaatgtgcaaaagtttatttttcatgtccatggtacaatatttgtttcattttttggaaaaatttgatcatctatataactcgtctaatgtttatttatctgttcaagaccaagacaatttttatatgtactattaactactaaaagaaaattttaattttcatgttcatgttctgacactttcatcgaaagtgtattttacaatcaggtatttttaattattttgctttttcgttggtctagatcttaaaagtatcatgcgactaataatatgtgtcagtaaaaaattttgatgtgtaacaataattacacactagtacgtatcatattacatcaattttacttgtgtggattagtttggcccatctttgtatgaactagccaagttattgtaccggaataagcaatttacaagttattgtacctaattgcacccaccatacaagtttgtgtatcgtgaacgcaatttactctaaaaagatggactctttgattgcatcacaggaaacattcaacaatcaacgaagaaaagtttcacaagagatctaacctcttatttattttcatatggaattgaccataggaatggaatcctatggaatcaaaggactctagaaaaaaatccttcaaaatttctttgctaatcctccatttcaaagggtccctaaattaccatttggacaagattttttaacaaagtttcactttgaagtctttgcgctattctaaattctatattttatataataaagctaaaagtatttacatattttactttgaaccactctctaatgagcggattacctttgtaagtaacgtgtgggccaaaagattatcaggcccacatggtagtaagaaaggcaatccctaacgactaagagtaagtataatagtgggctataagaaggctgaatgctgaggtggatgggagaaaagaggagagagatgagaagcaggctgtaagtttgtggagattatgggtaccccatacccacacggcatggttatccgactagttataggggataacttatatatatgaaatatgtaacagattatgacttgggtattacgtttccctgtatattatggaacggcctaaagtcctggtttgataagattgtaaagtagatttaggaaaccgataccgtgttggttaaggtttctatcttgtaatcctgcccccatcctatataaggtgggcaggaggccctctagggggcatgagacaacttgatcgtcagatctatactacacccggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacagttggcgcgccaggtaggggctgcgtcgagttttccgtcgagaagtgcgatggaactttgtgccggcatcatcggtgctactcttgtctttggccgtgatcctctcaacaaaagggcagggtcttcgtcgccaaaaattctatctggatctggtcaatcaaccaggagattaatcaccgatcgaatcgatctacaaccagcttgttaccgtcaattttacctccgtcagtgagatcaaatccgtcgctacaatgctgccatatctgttggtccgtcggtttcgtcaccagggcatgatttgaagcaatcagcaagcagccgccgccaaaatcatgcgaagatcaccgttggttgagcctgtacatcaccaagtcaatactactcggatacgtacggcaagacacaaagtccaggatacaaattaaatatacctggtcaaatctgtggtcaaggaaattaatccatacacaaatcagctattacatgcacaaagtggtctccaaactaatccgtgcatgtgctaccgacgattacatgtctacacggctgcatgacacggctgcatgctacggttcatccattgacaggcctcgaatcaaagttggatcacaaaccaggtttatcgttctaaattttcttatataaattagaattaattcacagatcactaattattatttgatctattattttatacatgtaccgccggccgccttcgtcgctgccgattggtttcatcgcctccacggttggtgtgcgccgctgccgttgcnnnnnnnnnnnnnnnnnnnnnnnccggcctgcctccgtcgccgccgactggtgtcctcgcctatacggtcggttggtcacaccaccgttgatgggcatcgtcatctacaccgccggcctacctccgtcgccgccgactggtgtccccgcctatacggtcggttggtcacaccaccgttgatgggcatcgtcatctacaccgccggcctgcctccgtcgccgccgactggtgtccccgcctatacggtcggttggtcacaccaccgttcatgggcgtccacgtcttcaccgaccggctggccttcgccgactggtgtttccgcctgcacggctggcctattatgccgccgctgttgggcgtctacgacttcaccaccggcctgcctccgtcgccgccgactggtgtcctcgcctatacggttggttggtcataccaccgttcatgggcgtccacgtcttcgccgaccggctggccttcgccgccgccgactggtgtttctgcctacacggctagcctattatgccgccgctgttgggcgtctacgacttcaccgccggcctgcctccgtcgccgccgactggtgtccccgcctatacggtcggttggtcacaccaccgttgatgggcatcgtcaacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgttgttggacgtctacgtcctcaccgccggcctgcctccgtcgccgccgagtggtgcctccgcctacacggctggcctattatgccgccgttgttggacgtcttcgctttcaccgtcgaccgccttcgtcgccgccgactggtgtcttcattgttattgatggacgactttgttcccacattggccacttctgccatcaccaaggggaatattataaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagaaaattctgatccgtgaaactttgttccattaatgacgaactcatgtcactcatatgcatgtttgggaagtgcctaggccgactcccggtgcttgatggttatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacgtcaccaccggctcgcctcgaccgccgccgactggtgtttccgcctgcacggctggcctattatgctgccgttgttgggcgtctacgtcttcaccgaccggccgcctcgtccgctgccgactggtgtttccgcctgcacggctggcctttatgccgccgttgttgggtgtatacgtcttcaccgaccggccgcctcgaccgccgccgactggtgtttccgcctgcacggctggcctttatgctgccgttgttgggcgtctacgtcttcaccgaccggccgcctcgtcgctgccgactggtgtttccgcctgcacggctggcctttatgctgccgttgttgggcgtctacgtcttcaccgaccggccgcctcgtccgctgccgactggtgtttccgcctgcacggctggcctttatgccgccgttgttgggcgtctacgtcttcaccgaccggccgcctcgaccgccgccgactggtgtttccgcctgcacggctggccctattatgctgccgttattgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgtcatggctgccgactggtttcttcacttccatggctgcatgattctgccagtgttgattggccttaccatcttcatcgctggtcgtctcgtctgctgctgactagtgccctcgcctctacgtctggtttatacagctaccactactgatggacatcatcatcttccgtcgccgactgattatgccgccgccgactggtgcttttatcttcacaactgcgcgtcttcactaccggtttgcttctgttgccgccgacttgtgttcacttcattacggcaatacaactttgtcatcatggtggagcgacttcatctttattatcttcggcaccggcaaactctattgttgctacttcgcaagttttactacttcaccacccacgacgtctttgtgaacctcgacatctcggcatgcaatgccatgttattttactacaacaagtggctctccaatattcaggatttctacttggacatcttcaacacatatcttcaatcaagtgatgactactcgacaacaagaagctataattctcgactctatgttcagttgtttcccaactaatcaaagagtcgggggctacacaaatacatggctcaaaatttgacaagctttatgtcaagatgaagcaatcaattaatcagccaacaagtcaactctgggagtcatcaattttgtcttcgcttcagagcagtaggtcaagattaaatttacatgtctgggagtttggagtcatcaaccaatcaactcatatcagattcaatgagttgaacaacagcatatactttcctccaagtgaagcatctacaacagtttgatggattattgtcactgacatcatcaccagcacatctgcttcatcagctctgacattccgccgttgctaatggatgactaagactttgccaacttgctattccgccttcacggttgacctactatgcaaacgctgatgagcgtcttcgtcattatcatcggctattacaccgctattgactggatcaccgacatcgtcatcttcatcaacatcctgtcaaacctctttatcatagcttactctactgctattgataggcaacttcgtcatcatgtttgatcatctctgttgatgcttatcatcattactgtcggttacgtttgtcgtcgccgactattttcctcatcttcatgattggtggatttcgtcatcgcctttgatctgcctcgtctgtcaccgactgattatttcgctgccatggctacacaactttatcgctgggcgccttcatcttcattgatggctgacctgactgttgccgactggtttcttcgcctccacggctgtgcaacttcatcacttttgattggtatcactatcttcactaccaccaatatttttgccacctctgttgggcaatattatctctatattggtcgtcttgtctctatgccaactgcgtcagctaccatcaatgaacaattgtgactacgtgctcaggggcttactagctcaaatacaagtattatatcttcaatttggacttgctccggatatatgcaacatgaattcatgatcatgggtctattttatatgctcaaagactggactatttattattccccgtaagggttatcaactgaatacttgcgccagtcgggattcaattgttatatctattttggagtatcccataagggataatcactcagatcacatggtctatatcacccgggagcatgttacatgtgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctggcttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttgaaaatttctttattcacaacatacaagcttctttatagctattttgctatgtgaattttcaatgatgtagccaactttaggttacactcatcatattttacaaagcagtcggtatatcacttggatcatattattcagggattcacaccgcatatgctacatattaatattaagtcgcttggttgactacaattatcgaaaccactcggtgcatctagtcgatgcacctgactttatttttcagccctccacagtcttcagatttggtaaaaatactcgggagaccatggcaaagatgattgaagtactcggttttggagtaatctagttcgagagaagattatcttttcgactgtgaaggtctcaggggctactgtggagattatgggtaccccatacccacacggcatggttatccgactagttataggggataacttatatatatgaaatatgtaacagattatgacttgggtattacgtttccctgtatattatggaacggcctaaagtcctggtttgataagattgtaaagtagatttaggaaaccgataccgtgttggttaaggtttctatcttgtaatcctgcccccatcctatataaggtgggcaggaggccctctagggggcatgagacaacttgatcgtcagatctatactacacccggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacaaagtttacagccggcttagacataggaaccaagaaaatctgtaagacagacatgtggatcatatatttatagtgaatagttaaccactatatgagtgagctgatagatagactataactaagcagctggatgtattattatcttgctctaacgagcaccggctgctgggctcctctccccgtcgctcaacggtctattggcccggtctaatagtagggtccgatcttttttggtccaaccgatcgaccgaaccgggtctgctacgataggtggaagtgtgcccatatccactcctcggcaatttcgcattccccccgaaaaatttgaaatccttttcgcatccctctcctctccgcgattccccactcccggctgcagggcggtgcggcgatggccgacgctccgccgccggtgctgacgctgcaggtgaagaagggccgccgcggcggggagacccggcagtggcgggcgggcgccgtgctccgcgtcggccgcgtcgccaccggcaacgacatcgccgtgcgcgacgccggggcgtcgcagcgccacctctccatcgagttcctcccgccgccggcctcgcggtgggccgtctccgacgtgggatcctccaacggcaccctcctcaacggctcccccctcgtgcccaccgtcccctccccgctctccgacggcgatgtcatcaagatcggggagtccagcatgctcgtggtctccatcgcgcccgattcggatcccaaccctggccctaggcgctcctcgcgccaatccgccgcagtggtgggggagcaggagaaaccccctgcggtcacccgccgtggcggacggaagaacgctgcagcggcggcggtggcggttgagccgcccattgcggagaaggaagagccagagccggaggaggctccagtggtgactcgccgcggtgctcggaagaaggccgcgcaaccccccaaagcggaggagcacgaggagggcgaggaggaggtggtcgcggcggtggtgacgcgccgctgtgggcggaagaaggccgcagagccccctaaaccggatgaggaggaggagcaagagaaggggaaggatgaggaacaagaggagaaggaggaggaggaggtcccggtggtgacgcgccgcggcaggtcgaggaaggcggcgccggaggcagccgttgcgccaccgccgccgagggcaaggtcgacgagagctgctgctaggagaggcaaggcagtggacacaagcctggatgagagggagagcgagatggccggaaagggacggggaagggctacaaggtctaatgcaaggaagtgtaggatggccgttcctgaggacgatgacgatgatggggaacagcaagagggggctactgctgtggcagaagagcagataaaggatcaaccgagggcaatggcggtgactgacggtgaggaggaagatgataaggtggaagccatggatggagaagttgaacagaatgacaaggcatcagaggaggaggaggtgccagtggcgcggagaggacgggcacgaagagctccaaaggggaaggctactgcaagtagtaatgctcatgctgcttcggacaacgcggttgaggaggaagacggcggtagaggagagggagcggctgtggaagtggagggggagagttctgggagcagcagcttggaaaccatgacactgagggagtggtttcagaggatgaatgtgtacctccctaggatgatcaatgaggctgctgaagaggcgctttcagccctgcgggagaggcatcggcgtatagatgagtacatttcaacgcttgaggattagcgtgattcatggtatgttcatctctcaagagaaatctttgtccttctgttacttctcttcagcaagttcagttctctttatgaaatttcctactgctgtcagaatgttctattatgttcgaatagctcaatctttcaggtctagcaatgacttttctgcattgcccagtaattgataattcattttaattactagatacagtatatgtataggaactgtacttgaatgcagttggtattggggccgtatctgcataaatttactatgccatgcctaatgccttattgctgactatcaatctggattgcctcaacatttgcttatgttaaagttttctcgcaacaattttgtaggatcatgtttattgagaaagttcttgcataccaaataacttcatcaggtgctcttgtcatatattttatcttcacttcataagtctgatttatgtcctctcccagcaaaaaccagaatgccgagtgcatatctggctaatctccagtgcaaccattacccattattagtctccaacatatgatgggaacaattacgatgtagttgacagttactgtttagatctgaaatgaatgtgtaattgtgaagcaagtgtgatctattcattcttgcatattgaataactgtttactgatcaattctagccattgaggtgtagcaattaacatagacaattactctctccgtttcataatgtaagacattctagcatttcccacattcatattgatgttaatgantntnnatngatntatatntanattnattaacatcaatatgaacgtgggaaatgctagaatgacttacattataaaacggaaggagtagaacatacttatatctgcagtttgttctttgcctgtaatgtttcccttttgcatccataacatatttacatgtaaaagctgcctctgtcaccatatgatgtgcctatttccatactgctagtgctatgacactccacgttcctgatctgctactatgggactgaagtttcatgagtgatctattacacaaccgaacagataattgttcagctgcagttctttgttctgcttgacgttttgccacagccaatgcttgatgccttgaactaaaatgacaatgttgaagaaattttttgcacgactctttcaagatctaaaattgccttttggtgccacaccgtcttattcagcaagctttacaacccagtgacacagaactcgcaaatagtttttcacagtttcagcgtttccgtttgagatgctgaaaaggaagatacatccagtggatcatatttttctgtgtaatccttgctcccatagtctcatgtattgagctgtggcagaagtacggtttattttgctattcatctactaatgcttgtgcttagcttttatccacaatttgcttaacatgccatctgtctgcaggataattaggagctatttggtcaatctgacgtaggggtgatgcctggagataacattaattggaggcaatgctttgctgaagcgccacaaagatttgctgaagcgccacaaagagccattaggtgatatttcactgggatcatctcattatcgattccagttccaccaaatgccgcaaaaatcattgatgcaatacactgtagcactcttcatgtttactctagttatgtagtaccagtactctagtactcatgaagtaggacctgggttcgtaggcctctatgcaaaggcattcaacatgcatcgcagatttcattctgtaaattgcctctctaaggtgatgtttattcatgcctaacctctatctggaatacaacgcgacaatgttttgaatgtatatgtcgtttctaccatggctgctattaggagtcagaactgattattttgcccctcccccgttttttacttttgaataacgtgttcctggatgatcagtatcaactgttgggaatttgttggtgaagatgagttctcatgttttgatactaaatcagaccaccttctagtctcaatgacctctctcatctcacttggaaaatgtacctgatttgttgcagtgatcctcatattgttaaaacccactctttaatgggatccttcgatcctctacatgcaacgctcagtaataatctcaggtgaaaaatgaacgaatgctcaatcttatctttattttcagcgatacgaagcgcacaatgcaatttcacctgcacagcatgaactgttaaatcgaatggcaacacagaagaaaggatcagatgcaattatctaacaaagaacaacacacgcatggcaacatctggtatccatgccattttgtggagaaaaacacacccatcacccccagctcattcagtgccatgtactgatgtacagactcacagcggaagacatttccaaagggtttaacctgctcatcgggagcacgcagtccacattctttttgcagatgcagaagcattgcttaacttcatacaatgaacaatctaagttctaagacctaccatcagtaactcctagctcaactagaacattggcagcaagagtcatcgttttctcttgccatgagtctttgacttgttctcaaggtcatttcctggtggcgccttaagagacttggatgcaactgctgagctccacagcgctctctcaacatcagaagtagtgaaaacttcttctcctgagctcaattcctaccagagaaacaaaaaatatgaaataaatgtcaatcaagcaccgcatgtgttcatcttcagacttcagctaacagtccaaatgttcaacaatctataattttgatatggaatttgcagtttactcggtgttattctagcaatgcggacgttacatgcttgcattttgcaaatataaaagcataacgttcaagtactaatcagcttatcagtatattaccctattgttgcagctgctgtctggaataaaaaggcaagcagctgaaaatttggcatacgatttttgtaatgcatactctgtaaatttatgagcctggcatccttgagcctattggacgttatgatttagagaagcatcagcaaacaagaaaaaggtgttatctttctgcactagttcttgaacagtactataacaaaaaatatgtggtggtatgttctatttcaatttcaaatgtcagctaagatcaattcttctaaaatgactccacacaaccagctaccttttgaagtccctttcagtttatctgcattaaatcaaccacatatttgaagtgtatcaactagaaatctccacacaagggaatacaccgtatttttttcccctttgtctgaactcaagtgatagtcaccgcaaaacaatcctaaagcattaactaggttcagacttgcagctgcctagcaaaccgaaggcttattatacagacacttcgatcagcacaatcaggaaaaacaaatgctatcttaacaacagtttatcacacatcacaaatgcagaagcaataccttcgatttagtttgcaacttttcagcaaaagcaagatactgcttcagagtgtactcctttgcattgcctaaggctgccaccatagcctaaacacagtccatccatgtttacaacatcaaagatgcattcatctcacctggaaatgcagaactgccaaaacaaaattcacaaactcacctcatcagacatgaacggtgcaacatcaggcgcgtaggcagcgagaacagcggatgccgtggcagggccaacgcccttcagcacggtgagctcggtgatggccttgcggaggtcaggcagcgctgcgaacgccttgcacgatgctgattctaccactgcatcctccaagcccttgacgaaatccatcagtctcggcctgcacaaaagaacagagcaacaatatgattattttttcccccaacgagtttgataataacagggtagtgtaggagtatcatcaactaaccaactagggtaatgattgatttgccaagaaaacgagtccctaaatcaatggatcaaatcagtccaagcacccttaagatactagcatcatccaattgatccacacatttcggcacgatttctagggagatttgagcgagaaatactactacaacatcacacgcccctgggaaccagaagttcaagtgctctaaagaggaacaggaaagaaaatctaagagcgggatgagacgacctccacttgccgcgggagagcttccattggaggaggcgcaccagctcgggcttggcgaggaagggctccgggtcgcggcggcgcaggagatcggggaggtcgcggcggtagaaggagtcgacctcgacgaggtcgggcttgcccagggccgcgagccggcggtcgtacgccgccagcgccgctcgccactccgccgcgtcgccgctcgcgaagtccaccgtctcggccatcgtcgttaccggaggcggcggcgcggtggaagaggtcacttcggcgcctcaagagccaggaatttcaaacagactagtatctacccatgtattaatatctctcgataaatacaacttcggcacatatcattggatatctactctattatattatcatcggtcgattggattgattgttcaagttcttctattgtctttatatcattatttatctgagcgttagaatttacctcggacatatagccaattgttcaagaccatatcaaatcggcttattggctgatcggttcttttatcatcaatttatctatcttgtcagttatagtatcaaactgactgacacgtacaaacctgatattttaggacttgcactggagcaaagcacgtatagatgatgtcagcacaagcccatctatagatagatgtttgttcctccttttttttgcaagcgtcctgtgcgttatattcttattagacactctttaggcccattcgtgaatgatcctatgtaaatgtaagcttctctattgcctttatgcgtacaaaaagattattccgtataagccttttctagtcttatttcgataccttagttatcttctagagttaggtataattatgataaataattatttctaaagtgtgaatgatattgtccattcaaatatactccctccgtaaaaaaaaaaagacaaactctaggtttccgtgtccaacatttgaccgtccgtcttatttgaaaaaaatatgaaaaaaattaaaaagacaagtcacgcataaagtattaatcatgttttatcatctaacaacaatgaaaatactaattataaaaaaattcatataagacagacagtcaaacgttggacacggaaacccagggtttgtcattttttgggacagagggagtttgatccaaatgactacaattattctaaaccacaacaaaaataatgatgttggcataatatatatttaatgtggatgttttttattttaccaattttcgtttttcgtgtgctggaacacatcaatttctcccagtggcaacgcacgaacacctacctagtgtaaaaaagaagagagaatctactatatgctactgagtttgtctcagttcaacgatttgctactgataatgtctctttgtgcaatataccgatgggacactgaggagagtacaaagttcaagaagattgcaatatatcgatgggacactgaggagagtacaaagttcaagaagattatttgagccagtgaacatatcattatgatcatgatggtgagcagcgtagtggatatatgtcccacgccataaaagaactagtgtgcttcttggaggagcaactccagcaaccccaaaacacctcagaccacgtatccacccagacatatctacgtaagttcgataagcatatcagtcatggtaactaattattttagtaaacaacaacattgaacaaactctccagattaactcggaataaaaccataaaaaagtgggaacaaactctccaacaaacattaacctgtaggacagaggcttgacataagacatcgggacatagatgataaacattaacctaaaggcaaggatcatcgatgtgatgctcgccacgtgaactacaatcttcaccctcttgatctccatggttttgggttgctcgtcatcgccaatttgaaccaccatacttattttctctaatatctattttgtcatatataagtcaacttaaacgcataccacctatacacgattcttggtagatgagcactacgcgaccatccgcagtagctagtagcgcctcctttatctcactctctcccgcaccgtcgttgcaacagtgcctaagagcgaagtccacgacaggcaataccccacatgcccccctacgctcataaaacaaagggtaccttatagaaatagttgatctccatggttgtgggttgctcgtcgtcaccaatggagcttaagctaaagtggaggggaaacctatagaaataaacatcaatatttgaataaattgatcaaacatttaaaattttaggatgagataatcaatttaccatttattttggttaattacaacactttgagctaacatatatcacttgaaagaaaatagataacaggatgacaaaaacgaatcatccacaataagaattaacagatatcacacctgaaaataaacttacactaataaatataaaaagggtttgttggaaccatgctaaatttgagatatgccacccgcatctcaatgacatgtaggacccacgagtcaatgacatgtgggtcagggtggcatatcacaaattttgcaaaatttgtgtggcatggttcaaattgtcccatataaaaaatgcattatcatttgcagcgtaaggaaatcaaacttaatatgaaatgcattcctcagcacgagacggtagatgtgtacatagtgctaacacaatcagatgtagagtacatatatcatcctaatcctcaagacgaaaaatacgtgtagttttatagatcctcctacttctcggcacgaggaaatcggcatcgaagatccatagcatgcctagtgccttgacaatgctacgatcgtgttgtctagcaagtagggcagtacccaaggctgcaattagccctacctcacgtgcagcacatgagtacctgcatgaacataaatataagttaatcaaattagggggcgtttgagagggaagtgagttgaaagacctcatttacatggcaagcattaaggcccatataaataaaacattaattaactctatccatttccaagatatagttagttttataaataatttctgacactattccaaagccaagtacactcatccactgttgtttaaaaatgtatttgttgtactacaatgatgaggaaagtagtaacattttcaacccaagacaaatttattatgaaaatatattcaattattgatgtgatgaaactaatttagtattataaatattactatatttgcctataaacttagtcaagacatatccgtaaggtcggtaaggataccagtcatggtaactaattattttagtaaacaaaaacactgaacaacaaactctctagattaacttgaacaaaaccacgaaaaagtgggaacaaactctccaatgaacactaacttgtaggacataggcttgacataagacgtcgggatataatgataaacaccctgatgacgaggatcatcgagcacatcctcgccacgtgaacgacaatcttcaccctcttgatctccatggttttgggttgctcgtcgtcgcaattcgaaccatcaaatctcactttctctaatctcgtcatatataagtcagccaaagcgcctaccacctacgcactagataagcatagcgcgaccaaccgtggctaataacacctactttctctaatctcgccatatataagtcagcctaagcgcctaccacctatgcagacaagcatagtgcgaccaaccgtggctaatagcgcctcttctatcttgccctctcttaactagacaagcacaacgcgaccaaccgtggctagtagcacctcctctatcttgccatctccgcaccgtcgttgcaatgttgcaacggagcgaagcccacaaggggccaatgggggcacatgcctttctatgctaatagaacaaagggtaccttatataaatagttgatctccatggttgtgggttgctcgtcgttaccaatggagcttaagctaaaatggaggaggaacctatggaaataaacattaatatttaaataaattgatcaaacatttaaaatattaggatgagataactaatttaccatttattttggttaattacaacactttgagctaacaaatatcacttgaaagaaaatagataataggataacaaaaataaatccaaaataataattaacagatatgacacctgaaaataaacttacacaaataaatataaaaaatatattatcatttgcagtataaggatatcaaacttaatatgaaatgcaatccttagcacgagacgtagatgtgtacatagtcctaacacaatcagatgtagagtacatataccatcctaatcctcaacacgagaaatatgtgtatatataatactgcgtatagttttatagatcatacttcttggcacgaggaaatcaggatccgaggatccataacgtgctagtgccttgacaacgctaagaactccaacaaacaccgctagcacagatccaactaggaaccgtgtgcactcaaccacgctgatgcaaagatcatgctgtctaccaagcagggtagcgctcaagctgcaattcaccctacctcacgtgtaacacatgagcacctacatgaacatagatataacttttactctatataacttaatcaaattagggggcgtttgaggggaagtgagttgtaagacctcatttgcatggccagcattgaggcccatataaacaaaacattaattaactctatccatttccaaaatatagtcagttttataaataatttccatgacactattccaaagccaagtaccatcatccactgtttgtttaaaaatatatttgctcgtactacataacgaggaaagtagaaaaaatgttagtagtgctttactactccattcattgcccagcttattttggtccatcattggggagggatctttcattgcacggcttattttggtccatcattgattggggagggatctgaggaaaagacattgaaagtatttcattttattctcaattttttctaaacaaactattaatacttgtactttgaaactgagagagtagaatttattgattatcgtcatgctctatgcatattaatcatgagattataaagtataaggagattatttgagccagtgaacatatcatattgatcataaccatcatgatgtgcagggtagtggatatgtgtctcacgacacaaaagaactggtgtgctgattggaggagcaactgcaggaacccaaagcacctcaaaccacatatccaccgagacatctccgtaagagcaactccagcaaccccaaagcaccgcaaaccacatattcaccaagacatatctccgtaaggtcggtaagcatatccaccaagacatacctacgcacgattctttgtagacgagcacatcgcaaccaaccgcgaatagtagcgcattttctatcttgccctctccgcaccgtcaatgcaatgatgcaacggagcgaagcccacaaggggcaatggggggcacatgccccttaagctcatagaacaaagggtaccttatagaagaaatagatgatctccatggttatgggttgctcatcgtcactaatagagcttaagctaaagtggagggggaacctacagaaataaacatcaatatttgaagaaatcgatcaaacatttaaaatattaggatgagataagcaatttaccaattattttggttaattacaacactttgagttaacagatatcacttgaaagaaaataggtaacatgatgacaaaagtgaatcatccaaaataagaattaacagatatcacacctgaaaataaacttacactaataaatataaaaaatgcattatcatttgcagtgtaagatatcaaacttagtatgaaatgtaatcctcagcacgagacgtagatgtgtacattgtactaacacaatcagatgtagacgtgcacattacagtacgactgtgtacatataccatcctaatcctcaacatgagaaatacgtgtgtatatatagtactatgtatagttctataaatcctcctactacttgtcacgaggaaatcgggatcagaggatccataacatgtctagtgccttgacaacgctaagaactccaacaaaccccgctagcacagatccaacatgatataaagggcattaagtggaaatcctctatgtttaactttgaaatcaactagttcttgagaggatttacaacatgtagttgaataaatttggaattcttataatgaaaagggttctagtattgacaaatgcgttggagaatgcaaatgataggaaaaaggctaaaaggatagaacatgaactgagatggtgaatacaaatggaaaaaaaggtggcaaatgaagtattcatatcaagattcggatagagatgagccaagagaagtttggagtggagggactgaagtttttgtgtgctcctctttttggcctgatgccgatggatgcaggttttctgccctagcttatttgtagtttttttggtagtcgatttggtcacacctgaaccaacgagaattaggccaacaccttttattttctttcttgaacttaatttctcttaatacaatgatgcataattctttgccgtattccctgaaaatactttcactgaactaaagtatataagaaggagaaatagtgatcaagctaataaatgaaacatggtgtaataaaaaaaaccataaacaaacatgtgagattgtgataaaaagcaattgtaactatatagcagctcatccctcatgcggagagagagataatggggagaggggtgtttataataaggatgagtatgcattcatgataatcttaacaacactaaacaaccttgactaacctggccaacagttcttgtgtgcacaatccagaggaaggcactaaatcactacatgccaatcgatagaagagacaaatacttggatgagcccctacaatatgtccacaggcaaaaaaagttgacagacttgcttaggagcacaccaaaagccagatcaagtaaatacaatcaccaaacatctattttgttttgtattttttatacaaccccctaatgggaataaactaagcatgttcttattgatttagttgattgacatggatgagccattgaaatatttgttaaatataaattactttccattaaaatataataacaaaaacaaggaagaaggtttccgcatgtaaaagtactaaaaagataattcaatatgtattcaaactttagtagtacctcaagaaacatttcatcgagcagttcttgagcaccaaaaacctctaatgcgttcctcctcttccttgttctctttgtatccttctattctctagccatggcagcagtacacggcatcacatacatcatgaggtcagcacagagcagaagcaaatcaacaacaaatcaaaaagagcaatgcggaggcagtaacataatagcagcagcaacaacaacaacaaggataccaagacaacaaggaagaggaggaacgcattagtggtttttggtgctgcagcggaaca

SEQ ID NO: 76269 - DNA, 707 bp, Oryza sativa
cgatcggctttcatgccgatccgagcccggggggctgccgccgccgccgtccgtccgatcggcccgagggcgatccgggccgtcggtcccgtggatcggcggtggatcacccgcgtggtcccggtccacggtggaccgccctccccgtgccgctgaccggtgagcccgcgggccgacgcctcctctttcctccccgtgccgctgaccggtgggccccgcatgtcggcgccgcgccacccgtgctgacgtcagccctggttaatattgcgcaataaatgatttaaggttttttcttttatagtaataaacacagtgaatcttctaaaaatcataactaattcatccgagctccgtttaatcccattcaagtctcagtaaatcaagaaaaatgtgtagaatccattaaaaatggttttgttctctgtttcagtagtcttatagcctgtttgcaatgtttgccttgtatgtcgctagattccggttcctccgacgctccggtgtacttcgagatagtcgccgaggttcctccagcagcagagcaaggcaagtcatgcttgtcacttgatcatattgatcctatattgcaaatgctctattgttttctttcaaataccgcatttgttttgcaatattactatagagatggttacctattgttacggccatactattttgataccatgctcctttgttagcttgggttataa

SEQ ID NO: 76270 - DNA, 1635 bp, Oryza sativa
aacctccggaacaggcaggcaggattaagcccctagcagcagggcaccaaccttctgcaatgacatctcgactaccgggccgcagctcgtgtagccttcatttgccctggagaatgtccatcgacccccgacttcatccatctccaatccgtgtacttttgtttataactagactgagccacaaactaagccttacccactagacatgtgaaagtacggtagtgctttgcaacagaggcccgagcttaatccttatagtggccggggtgctacttcccacaactggcatgcacccaaaccccaccgaaaacaggtttttaggggttttgaaagaggaagagaggtgtatgtcaaattccaccataaaccaacaattccatagtgtccagatgatatgagtattcccaaagtctagagttataaaaccacctaatattgcctaattaatcagcgaagcatctacctaaattcatactagtggaaccatgaatagaatacccactagttggggttttgtttatcctagggtgaacaaggtaataatatcaatagcaataataataaggtcataacaaaggtaaataggcatggctaaataaaacagtgacaacgcgggaattttaaataaagcgataatgcattaatttaaactaaaataattttataaactgggattcaatatgctcaaggatgatgtgacttgccttgctcagagagaacggccttccgaaccttcggcgacgaccacgaaccacgctttgggaacctccggaacgacgaaagctacgcgaagcacacaagcaaagctacaagcctataaagaagcaataacaatacataaaaaacaaagcacagggttctttaggttataacaaacattaagagacttgaacggatcgattcggagttcgtatgaccaagatatgatcatccgaagtttaatgctgtatatatggcgatttgcggattattataattaagctttgcaactataaaaaatgtggaagcgctagcctggaaaagacaggaaggctgcgctgctgacatgcggaccccacatgtcaacctaaaggaccgcggtagaccgggtacacagagacggtccacgggtcgacggaagcggatcccgtgtgtcaaccgaggcgagtggccgacaaacggactccactagacaccacacggcctgcacacgtggaaaccacgcggctaccgagcgggcacactaacgcggacactacacggtcaccacccgcacgcgtgaacgactaccgacaccggtacacgggtaccggggccgacaaccgcacaacgagcacgggcgacaccgaaaggacgaggacggggcagcgagggagagggatccttaccaccacgcgacgaggcgcgggaacgacaacgacgaacgggcgcggcggagacagacgggcacaacggagacgaacggcgaggggacggcttcggcggcgatccttggacgaaggcgagacacggccggcacgaggcttgacgacgcggagccgaggacgaagacgatgacggggctgctgcacacttgacgaaacgcgggcggcggacgagaacggctcgacggagggacgaacgccacgacgaccgggaacgacgagaggacgacga

SEQ ID NO: 76271 - DNA, 9565 bp, Oryza sativa
ttactaaccggaactaaagatcatagggccctgacacggcctgacatgtaatcaaccgggactaaaaatgaactttagtcccggttgaagttaccaaccgggactaaagatgatttttagtcccggttggtaacaacaaccgggattaaagatctttctcttattaaccgggactaaaaattatttttattcctggtttttaatggaaccgggactattatggatttgggttgaccaaccaaagatggtttctctaccagtgttcggtttcacaaccttcatatgactgtgcttattacgcaatccaatcgtgacgtatgaagctaggtatactgcccatcgatcgattctaccgagatggcaacatatattcgtatatatcgatgattaatttcacaaggccatgattctttcgaatttcggacaccgcaatacacttatatatggacagctcggatcatcaacgaaaaggaagcaatgagaggaggcggcggcggcggcggcggcggctgctgcggctcatccgtggcgggtggccgtcgaaaagcttcgggctccacatataccggaggaagttcgccgcccgctcgtctttcctcatcaggaacgactacggcgtgtggtcgcaggcgcaccggcggctcatcaggatgacgcgcctcggctactggatcgtctacgacctcgacgccaaggagctgaggacgtggtacgaggagaggctcctgcgggaccgcggcatggcgcggtggccggagtacggcgccggcgacagggaggaggtccggtcgctgatcgccagggtgagggaggagtactggcgccgcatgcccgagcaccggaggcagaagttcgtggcgagactcgaggaggagcggcggctcaaagaggagagcgatcagcgacagcagctcgcggcggcggccgacgagcgccgcggggcgcagatggccgcggttgacgatggcaagctccgggcatcgtcgcggtcgtcgacgcagcctcctcctcgtcgtcgtcgtcgtcgtcgtcgttgggctccgccgccgccgccgccgccgcctcgcctgcttggtattctactgtggatacttgctgcggaaatcgtgctgctgttcgtttacaaatttatgcttccatcgtttcgcttcttctaactcttataagccaaaatttaaatttaaaaatttattttcgattttatgatttttttatcgtagtttattttactgtatttgtttttaattgatcgttataaacatgtatataaaagttttattcgtaagttattttttctaataacctgtaccgcttttgcttctaaagagcaaacggtcatatgcacctctcgttttagactgaaattgacgatttactttcctattcatcgtcgtgtgaacttgagtctaaacgaacacccatctacattggagtaagttccatttcttttccttgttgtaagccgaaattcgagaggagagaaaccgaactaccggagagtgttctagtacaaggaactttgggtgaaaatgaactttgggcgaaaattaaggagtaggccaaaacctgatcgctagcaaaaagctctgtagatccaggaaaaaataatagtggggctggacaaactatgctagtataaatcaaaacatgtatcacatataaattggctacatatctagttcaaagtacacatacattgaattaatgatatgtagagaattttgtccataccaaactaatgtccaatagataatatgtcacacccaattgcctattattcttcatgagtaataatctatacaaagaaaaaggcaaactaacgaattcaaaaaatttagagacctagggatcactgatagtgttgcttgaactattataatacgtgaaccatgttctttttgacatgctgacaatctataaatgtacagaaacaattataaatttcaatcactacctcacttaacttgaactattgaggcacaattttagactgtctattagtattagaggttagtaggctaccaaatttaacttcaatcaccggttgctgctgcaagttgtgtagttgccggccactgcgccgctgcctgcctaccttgcgccctcgccggctccaggctcggcacctcccgcccggcgtgtcagcgcaggatcgccgcctggtgccctggcccagctcgtgtctcgctacctccccggcactagaccgccgcttggcctgtctcccgtcccaccctccaggcccctagcttgtttggtgctcgcggcttgccacttgcctgcttgctacacgccgcacacccatggggccacgagccacgttgcctcgtgcctaggggtggcaatttccctattgggtccggtgacccggcgggaacccgtccctacggggtcgggaccgggggagaattctcaccagcaggtgagtggggacggggccccgcaaaattccgaggataggggtggggatcagaattaatccgcgggtgacccggaggggccccaaatatatatgagttacttttccaaaattagcccatttcaataatatagacccaataaacccatttaaaattgacatataaaagctcaatatcctagttctcctcaaccgtaatccatttccttccttcaaccaaccctcaccgccggaggctattgaaattttatcacactattattcagtgtattacaataaattttacagagtattaactccatccgggtgatgcggggccctgatcactcgccggttcccctgtgggggcaaggacgggtgatgtttttcactcgacttcctttgtggggccgagggtggggatacctgcaagagggcgggcgggggtattccagcccaacccggccccgccccgccccattgccacccctactcgtaccctcgtcagctggtgttgtcgccgggtgctggcctcctcggcaccttgcgtccttgcctgtccaccgtgcacggccgtctcccgtcgcccatcagccgcccccacacccgtgcctagctaggtccttggagatttggagaggggaggtggggagttggcagtggccaattgaggaagtagccgagtgggccggcttgacctgttggtttggggagtgcgccttgcttcattgcttggagtgtgttgggccaaaattggaagattgagctcatgggttgctcttcttagccagcccaaatcgcgaaatacttcatcttcaacctctagcctcccctccagccgatgttgacgatctgatgaaccttcagcccccacatcccatggatctatggaagaagtttttagtggggggtttatggaggtctccatggttccggggttgatagtggggtctgaagatccctctcctcccctccctccccgcgcctccacagtaaatccatccctgctctcacagcttattcccttagctttatttcactttatttttctttatataataattcttcatgcttgtaaaacttcctttaacttctgctgtactcaatggaattgagatactttaagtgccagttaatgaaatgaaactttaagcacatatgaaaacttacagccatgttgttaataggattagggtgcaaactcccgtttttggtagcactttattggtggccagagtcgtccatcaccatcactcatggactgttgtagttgtgttccacattatcgattcaatctcctcgagtgaggtctacattgataggatatcccatatcctcaaaagttaatcaaccaatacataaccagggtcctattagttgaactgcagatggtaacatcttttctcaagttaaggcatacgtggtttagcgacgacatgtagaccatacttgagatgaacagctatcccattgacctcactcatgtctactggcaacgcccatgcttggctgcccctcctcctgtgatcagttgccgccgcctcccagtcaaaatggtagagcaagctcgcgagtgctatctccatggctgacaccccgaacacgatcccggggcaccccctcctaccggcgccaaatggtagcagctcgaagtcctgtcccttgtagtcaatggtgctgttgaggaatttctccggtgagaactcgtccggttgctgcccccatgctgccgcgtctcggccgatggcccacgcgttgatcaccacccgcgtgtgcgctggtatggtgtaacccaggatctgggtgtccgccggtggctctcgtgggatgaggagcgggagtggtgggtgtagccggagcgtctccttgaaaacagccttgaggtagggcagcttgtccacgtggtccttggtgacatgactagtgttgcccacgactgcccagatctcgttctgcgctttgcgcatggcgcgtgggtggttgatcagctcggccatggtccatgccatcatcgtggtcgtagtgtctgagccccctacaaacatgtcctgctcgtgtccgtgaagcaagaagcatatcagctacggaaatttcacagtaccttaacctcaaggtatctaaattttgcactaaattttttgatacctaattaattagtacctggaggtactaaattttatactaataaatacgatacctcccgacactgttttaatatggtaaaattgccctatcagctatattaatattcagtattcacttttgtcataaatatgtgatatttagaataaaattttgttaatcttttaaaactttgatcattaataattttttattgcctagtttgaaacaagaaacatattttgcatacaattaccttaaaaatcactacaattacacctatttaatattataaaattgttccaagataacatgatgatcagagttttaaaacctttggactaaggagtgctagtattccaactagactatagctcgattcataccatgataatagccttgatttcgacggtgccgagctgaatgccagcgtccttgtccgtctcgttcacgtcgagcaacacgtccacgaaatcccggtgatcgccgccgccgtcgtcgtccatacgccggccgccttcacggcggcgacggtgatcgtcgatcaccctctcgaggatgccgtccagcgcctcaaacgtgcgctgcaccttcccgtctatccccctcaaggcgtccacccaccagaaccatggcaagagctcccccatcggctccgtcccgagcaacctcgcgaagtcgtcgaacaccttcctcagctcgcgccccctgtcgccgccgccgccgccgccgcgcgcgctctcgtcgccgaacgcgatgcgcgtcaagacggtgttggagtaagcgatgaggaggtcggacaggtcgacgacgacgtcggcggcggcggcgcggacgcggccgacgagcgcggcggcctcctcctccctgacgcggcggaacgagaggacgcggcgcgcgctgaggaggtggaccacgcagatgcggcgcgcctggcgccagtactcgccgtagggcgcgaacgcgacgtcgcggccgccgtagagcagcagctcggccatggccatcctgggccggctcgcgaactccatgtcccgcgaccgcatcacctcctcggccgcggccgccgacgacacgaccaccacgggaacgcggccgagccgcagcagcagcaccgggccgtgcgccgcggcgagggaccgcagtgcccggtgcggcagcgcgccgagcaggtggaggtggccgagcagcgggagcccccgcggcgacggcggcagcctccggcggcgccggccatcaccgccgtcgtcctcccacctcgcagcgccatttctcgtcgtgtacttcacggcgggaagcagcacgaggtacaggagcggcgcgacgatggcgaggagtacaaggacggcggggaggagtgagacggccattgttttgcgcgcgtgcgtgcaacggaaagcgtttggttacttggttgtagttgcgcgcggcagcagcatgggactattgataatgttgaggacggaaggaagggtagcaaatcaacaaccagaaactggacgggctgacggtgacggcccctcacgaaaagtatattttctggtggtgaatgggagcaagggacaagtgataatgttgaggaatttttcgtttttaaatataactcatctctcacgatgttgtacacgtactatatatactaccgccatatctctaaagtactataggtcccatactcccatccagaaaattttctctattatacccttcaagtagtgctagtggtagagccataatttttctggaccttaattgaattaataaaattttgcctttatcttctaattttttgaaggtttaaaatgaaatttcaatgaatatttaggatcggctacagctctacctgctctactcctatctccacccgggccttcaagtaccactccaatcctaactatacatcatttataaatgaatggaactattattttttccttaaattttaacctatgctaaaatatatagaatgataagtactccctccattccataatataatgcacaaccactttttttagatgttctataatataaggcatacatgcatgtaggccattaactatgatcacttcttcattaaattattacttttttaaatcctccactctcatgttctctaattctattctcactccctccatacttgtaaaggaagtcgtttaggacagcgacacggtctctaaaacacaactttgacttcttatttctataaaaatatttattaaaaagtaatatatgtaaacttttatgaaagtatttttcaaaacaaatctatacatataatttttacattttcaaaactcaacaacttgagagttattcatgatttatattcccaaggtttgacttaaacattatcttaaacgacttcctttatgagtatggagggagtatttattaggatgatccaaactacaagatgataataattattttcttggtctttgagttaggagtggttatactttatattttggaaagaagggagtattttcgaacggagagagtacatgttttaaatttgtttgtgcaaatatgcatacctcgcgggctagggagcgcgagggacgagggagtcgtcaccctcgaagacgtgagacaaatggaagagatggtggtgcgatgccatcacacgtgaccgctcgtggatcggggacgtggaaccgacgcagtcgcgcaaattggtcacgccgaatggcagacggatcgatggcgattaaatagcgtggtcacttttcgtccagctaattaactagcgtggttgctttcttccatagatttattagggagaaaacttcaaatctggcgctcgattgttctaaataaatcaaatgatccaaatgtttcagttgaccacggtaaaaattaagttacacatggtggaaaacaaataaagtcactgaatcattgaaaacttttgtgaaacataataaaggcacacgttgaaacatgttgctatcacgtatgtgtcgacgggggatacctgtaaactggatgaatagggtattgggatacgttggtacgaggatatacatgatcgacatcaagcaaacaagaagacaaggattatactggttcagacccctcataaggtaatagccctaatccaatttatataagattgatatggaaagaccatagattacaaatagagaaccgacgatcccgagattaccggcgagatcccttgtcgagatggtctcgacgagaagtcccgcaagtaggctatggtggttgtgttggcagtatgattcgatgatctaaacccctcagggggtgtgccttttataccgtgaatcaactaagtctccaagtagaactcggagactatggtccccacatgatataatataaaccttatcttctccaagtaggactctgatattcacttgcctgtgagaataatttccataatctcttgttagttttattatcatatacggaaacatatcatatactcgaaggtataccatatccgtatattccataagtcataggatatgaggtatgtcttatctgtaaccatgacagtatgacacatcgagtgttaacggattgaaatatatgttttttcattagaatttaaacatgcgatacttgttataaatatttaattataacaaatataacgatgtaatcggataagtaatttagaagaaaaatcgttttgaagatcgttaaatacatgcaggatggagtggagggagaataggggtgagttttgtgaaacacagtgaaaatacacatgtaaacatgttactatcacgtaatgaaacatctagttttatcataatatagttatacgatatcttgttgtaaagatttaattacaacgaatataatagtgtgatcagattgtagatcaggtaaataattgaggagaaaagtaattgaagagaggaggagggaaggagaagaaactagcttagtgatcaggttgaataaagtttaattttattcagtgaatggagccaccggtccaaacattcttcatttgttaggtatagattcatatagttaagctcgatcgatgaattcgatgtagatttcttaattaaatcttgatttttatacgtgtcgcatcaattttcttgttcattgcgacaaaattaaataaattgggtgccaccaggccaacacacgaccaatccgcgggaccacgtgtggctatagattgcaggccgcatcacaccggtgcctcgtccgcgacggcgcttgggtaccgcgctcagggttagaaattccagttgaaaatttcgaccatctgatatgatattattttgaccaaaatttttaatattttttaatctaaatatatataaagagaacaacttatttctatggttagggtgaaacttaaccattgtttcgcagcagcttgcgagttatatgtagtcattatcttactcaattcaggaaataacatctccaggatcaatatccgattattttgacgattgaatttcaccacatcagcgtcaatggctgaagtcgaattgaagtgaaagataccgtcagatagttactgagttgtaatttgtaaatcagttgccggcaaatgatcccacttaggcacttaccatcagaacaacttcggtgatgccgtgatggtggatgtcaatgtcagtggtgaaaatacacgacaaataacgtttccttttcctctttctctatttggtaaaatagaaaatatactaccaatgttttttttactaggggtttaatttggccattgacatagtatctaatttataaccatccaccattttatttttatctattttcttaatctttgtacctatttaaaggtagctatatttaaaacacgagagagtaattatagccactggaaataagataaaaattaggaatcgacaaatagcaaaattgtcgattttgaggcatgttgaggtgagatctaattcgatctagccccctagtgcatacaaagttcaaggccgatgatcagcggctaactcaaaaaaagtggcaccatttttttttcactttgtgatttttaattaactcgttctcatataaaaatat

SEQ ID NO: 76272 - DNA, 1551 bp, Oryza sativa
ccaatagtaattttattactatgaattagccgctaaatatgttagaaataattgttttgagttttataaaatccattcataatcataatcattgccaccttatttaattacttattataggagatgccttgattgattgtttaattatctgcccaaacccctccatatctgtactgatagtaatttaattactatgaatcagccgctgcaaaatttccgtatgcatgtacatatgttgcttttttaatctaaagtccttttatattttatatatattacaaataatagtactgagttttataaaaatctatccataatcataatatttgccaccctatttaattattatttatattcaacaaaggccaatgtcgaatccatgagaattattttaatttgtagtaaatatttaaattgctattttttttgtcaataatattctttcgatcctggatggatagcaacgaacgtttcctaaaggcacgtttttttttcttggactaaccagtcaatcggattgattccccatcttccatatcctttctgtttttatcgctccgcaggcggcggcggcggttcccggcgaccgtgggcttgtgacagaggacaccggaggggtgagccgatgacctgattctgcgtcccctgaagggcttgctccgacgacgccggactgatcagcctaccgccggtgacggtggcttcagaatccacggccagccaccattgtttcaaagaatcctgaaaacgtgagatctgcatcccccatccctacatactcatctcatctatctatttaactatcatcaagcatagcttcatcaatccgtgcatttttttttggatagattcaagttgctcatggttcttttaatttcacccatccttctgtagatgaagcggaagggcaagatgccagaaaaagtcaggagtatcaaattcactgaatcacaatccataactacctccctacattcccattttttttttataaaaataacatttaataaaaaccttcgaaattacagcgcacaattcactatcaaagcttccagaaacagtaattttaacgtccagtaaaaattttactaccgactcaattaatatattaaaaaaaccataagtaagggcaaaaatcatcgctgtgcactaattgaatcaatagtaaattgttttctaactgaaaaaatgaggttcttatcgtaagataattactaaatcgcacgtaacttttccctccgtgatgacagtgcgatcgaggatgagattctgcaagcatctatcaacaatagtacattttttgctaacgatatatttatatagtcatagtaaatgagttactaagtcaaaccttcagaggttacaggtgtgacacacgcgttactcggctcgttattgcggaagcaaaccaaataatcctcagtaactccattactgctagaccaaacatcataattaagtaactactttactcacacaaactaaaaaatattactcggttggttagtgcagaagcaaaccaaataatcttcagtaagggctgcaggaatt

SEQ ID NO: 76273 - DNA, 3583 bp, Oryza sativa
attcgcaatgcgatcatgcaacagcagcagtgggagcaatttcaacgggaacataaagattaaacgcatctgaatcatatatatatccatgatggttttcgcgacgaatctgtgggcacggctcctggcatggttgacatatacgatatgggaaactgttaacagctcgaatagacgtccacctatttattacatgtccagtacgatatactattttctcatcattcgcaatgcgatcatgcaacagcagccgtgggagcaatttcaacgggaacgtaaagattaaacgcatctgaatcatatatatatatatatatatatatatatatatatatatatatatatatatatatatatccatgatggttttcatctgtgggcacagctcctggaatggttgacatcaattcgtccatatcaggaattggattttcatttttagaaaggatatcctcttttttttatactacttaaatagtcatagaaaagcttataataatttgataacatatattagcatgaaatatatcactccatgaacatataaaactaaattgaacttctctacaagttacaaaacaaaaaacaaattaaactgaaaatagttaatgcatatacatagttatatttattattattaagtaacgtgaacggagaagttgaattggtatttacatgtttgtaaagtgatatattttatattaatctattttttttaaaaaatttttatatgactatttagatgacttataaatctgcatatagatcatgcttaaattcatatagaaaatttagtttttattttacaaaggaagtaacatggcagctagtgcatccgtgcgagcctccagtttgcagtttatctatctgctctattattactgcataccaagaggagtttatattcttttttggtgtcgctgcatatgcctaccgcacatgatggttgcccaccgaagcacgtacgggttccctcgtgcaccgggtgtgccaagaggagtttatattcgctcttaacactgtgcagaactcttgacacgtacgtttccggtgcatgtacgttttgtacttcatttctggacgatactgcaaattgaatagtgatgatagcctgtatgttgaactcttcttccctcccgtctctctcaaatggataagataagagggatatcgatgtatatatgttcatattcatcttcttatttatttatttatacatcctatagttcaaaaaagttgtttcactcatttttcattctttcattcatcactcaagcgtcaagggtccagatcatctcggtaaaatccaaacggcggagatcgatcccacctcccacctctctcaatcaccgcacgccccctctccctcaatcgcggaatcgccgctctctctctcgctctccaactcgcacctgcgccaccgccaggattccgctcccgcacgcgctgacgccggaaagagctccgccatcagtgctcccctctctatcagccgccgcgccgtcatctgcatcgccgatctgccaccgatccccgccgccggctcgccctacacgatccccatcacccgtcctctgccaggattcacgtcgtcgccgatcaccgtcctggtccaccgatccccgccgcacgaagtcctcccgacgccaggtcgccaccgacgccttccgcggtgatccgatctgccaccgatccccgccgcacgaatcccttcccgtcgccaggtggccgccgacgccttcagcggtgatctgctcctcactgcagacgtcgccaggaatatcttcatcaccctcatgccatgcggcccttcatcgcatcgcctccgccaaggcatatgggaggtatgggcgtctgatcattaagaataactgatgagatttgaaccatttttgagaattgctgtggcaggagttttttgcagttactatacgactcaaacaaaaatgcatgtttgctgccatatttacattgttcatttacacatgtacacctgggatacgcttttcagaagttttttttttcaaattcatatgctcacttgctgttattctcttctagatagacttgttagaatttttgttagaatttatctcgtggtttacttcctccgtttcacaatgtaagactttctagcattgtccacatttatttacatgttaatgaatctagacatatatatgtattcagatttattaatatctatatgtatgtgggtaatgttagaaagtcttacattgtaaaacggagggagctgaatggaaacatcaaacccgtacagataacccattggtaaaaggcatatgcagcggcccattgaggttttgtcacaaactgtacttccaaaaaaacaaaaaaactttggctcattcgttctttaccgcagttcatgtatttgattccattgaactttcaagaacaagtcccaaatgttgcatgagaggccgcacgtctactgtgacagctcttttgatctcatacatacttatctttcatctcatgtcctttcaagcttctgaataaacttataagatctgttcagtgaagtttatgtttctatttgttccgtttgggtatgatttattcatcctaaatgttagatcatttacttttaagcaatattacacaagcagctgcaaacgatggccattctgttaatcttgtgattttaattgttcctttttgttgatttttcagctgcactaactatattttctttagtatgtgttatggcacccacacaggcttttgtttctagagaagagtatcaatgataatttcttctgacatggcaggtaaatctccaattcaagggggctctgcgcctttcctcaacaagaaaaggtgaattttactactgcaactataggttgaatgcaactatcttgagtcgaaagttttcaaatatgagttgaaagttttttaaatctgagttacaagtttttcaatctcgagttgaaagttttcaatcttgagttgaaagtttttaaatctgagttggaagtttttaaaatttatcttacaaatttgaattttgagttaaaaatttccaaaatttgagttaaaagttttcaaattttaaccttaaaatttaaattttaactcgaaagttttcaaatctaacttaaaaattttcaattaaaaaaatcttttcttaatacattcattatccttaactaaccgaattagttacgttaactcattgaaaaaagaatccgaaaaaaaagaatctgcgtggcgtgcgcgttgccggcacgtacgcgccggctaccttttcactttggcaacgcgccggctaccttttcacttttgggtaaaggtgcacgtgtgtatatgggccttgtgttcgcattttcacttttgggtaaaggtgcacgtgtgtatatgggccttgtgttcgcattttcatttttgggtaaaggtgcacgtgtgtatatgggccttgtgttcgcatataattatatgggactacctatacatttgtcgacaaatttttctctaaaaatttgatagatgtaattatagtacaatcgtagtgtaattacactggtacttgtttgtgagtacactgtaactggaatgt

SEQ ID NO: 76274 - DNA, 8120 bp, Oryza sativa
gcgaacgccatgtcgcggcggtagaagagccgctccgacatgcgcacctggggccggctcgcgaacgccaggtcccgggtcctcatcacctcctcagccgcggccgccgacgacgccacgacggcgggcacgcggccgagccgcagcagcatcaccgggccgtgcgcctcggccatcgaccggagcttccggtgcggcaaggtgccaagaagcgggaggtgcccgagtagcgggacacccggcggcgacggtggcagcggcagccgccggccgccatcgccgcagggcggaggaggcctcttcttggtcgacgagacgatcagccatgagaagacgagcaggagcacggcaaggaggaggggtgagtgcaacagagcagcaagcgacgagagctccatgtctgaacgagtgtactcggctcgatccgcttgtgtccaatgacagtgatttaacatcgccgaataatttgtgttgatggaaaagccaaaatgctggttgacgtgattaaaacgaagacaaaaatgtagctctcgcgtatagttgttattgtagaaaataagcgtaaaaggacatgtctagtggttgcagtgatctgagtagtatcctaaggttttgagtttaaattttcatatgagcgaactttatattaggttatttgagggctaagtttctaatttataaaggttgcatatatccggttagatgtagaggccgtgtaaaaaaaataccctttctctaaaataaataaaataaaataaaaaaagtagaaactaagcacaatccttccagagaaattggaaaagtcacgacagtaaattgaagtctacaattctatatacacagacggcccgtttggttggagggagttttcaggagggattgggagtttaaaaggataaggatattaactgctttgtttggttgggatacatgggaattttggtgggatgggggtgaggaattgagggaggaactccctccttttcaatacctgggtagggggtggtaattgggaaggaattcctcctttactttacctaaataaatctcagccatccgttttcattaatgacctaatttccaactaaactccctatcaatttccaccacctctaccaaaaaagatactgggattaaaaatcaaatttctatcttaatctcaccatcaattcccttgtataaactcccaatccccttccctcgcgttgtcaaacaagccgtctagaacctctacaaagtccatatggaatcaccatcatgttctcaaaaaaaaaaagaaatcaccatctttggaccatgcattatatggctggaaataagtctattttggtcactcgtctatttaactccctaatcattggaccaggtcgtgccgggtcggcccatcatgccgaggcaaaggcccaagcacggcctaaagatcgggtcgtgccgtgcttgggtcgggccaaaaccccgtgccatgggtcggccttcaacatccacaaacactgaaagtcagtgtccgagtcggtatatgcatggtagaggcccttccggccatatccgttccctggtgcttcatgtttgatcacgaaagtggaaataaggatgttgtcgtatcatacggggtctgttgtctctgagttctacttggagactaaggtgatctgcggtataaatacatatcatcgaatcttagtgcaagacacccaccacagcaggagcaatccagaggactacttgaaagccaacttgcagataggtctcatcaagtagttctcgacagggatctcattggtagtctcgggatttttgttgttctctattgtagtctgtagttttcttcataatcccatataaactagattagggttattaccttgcgagagacctgaaccaatataatctctgtctcttatgtgcttgatgtcgtatcgtgtagatcctcgtatcaacataccccaatatcctcagaatacggtccgcgagtatccccgtcgacaatagctgaggaggctcgtgacgcggtcgcgccggtcgccgttgagccgcaggggtgaagtgtggtcgagcgggacgagaactggcgggtcaaggacggatcaggaaacgaggtagcggagcttgtccttgaagatgacgagaaggggatgatccggggtggtgggcgcggaagcagaggaggaaaccgtagtcggagacaaggcggcgccaccgcttgtagacgaggaaggcacgagagatagaggacgagtgcgaggggaggcataagaggatctcttggatgaggtcattgtcatccggcggagagccaacctctatatttttctttatctctcttctccatataagattatattagccttggggtagtcccaaccctccacctcaactagtttacataacattaatatactatcacataatcaaaaagctaggtggcaagaggatttactgatgagagaggaaaaaatattaagaaaccatttttcatgaaaaaaattagttttatacaggaataaagaatgaaataagagaatacatggacgaatgcagagagaaaagaggtgattaattggatgataatttattatgaagaaactatctatcgggtatacagtttttatgcatgcttagtgtctatatgacagataaatatggattaaaaccattagataatttctaggttgggactgccccactattatcattgctctaagttcatgtgcactctatctacgtactaagccattaaatgctttactgatattatgaattcatgttataccgagaacataatatatattgtgcttaactaaaatataaaaagtatacactaatgtcaaagcaaatctaacggtgaagcacgtgtaggtgcacatgcacttaccccttaaatatagatgaccctcgctacacaaattatatgttgcaataggcacagatggtagctagcctgcctagcagctttcatactgaacacatcaaacatcggaagaccatggctttgcgactagattcagcgtcgtcttcattcgcatggacagcccaaacagctcacccatgtccagcctcgccgccgtcgccgccgccgctccgtcggcatgtggcggtagctcccagtcgaagtggtacagcaggttggtgagcgccagctcgatgctcggcgcggcgaacccggcgccggggcaccccctcctcccggcgccgaacggcacgaacctgaagtcctgccccagctgcgccgcgtactccacctcctcgccgccgccgtcgagccaccgctccggcacgaactcctccgcgcggtcgccccacgccgccgcgtcgcggccgatagcccacacgttgatgatcacccgcgtccgcgccgggacgcggtagcccagcagctccgtgtcctccaccgtctcgcggggcacgagcagcggcaccggcgcgtgcagccggagcgtctccttgaccacggccctgaggagccggagctcgccgaggtggtcctcggtgacttcggcgccgccggaggcgccggggacgccgacggccgcgcggatctcgcactgcagcttgcgcatgacgggagggtggttgatgagctccgccatggcccattccaaggtcgtgaaggtggtgtctgtggcggccgctatcatgtcctgctttttcattgttcatatgcgtcattcattaataattgaaatgtatcttaaactgtttcaggttacaagactttttgactttgatcaaaatcaaactattttaaatttaactaagtttatagaaaaaaataataatatttttaactcaaaacaaatttattatgaaaatatatttaattattgatttaaagaaactaatttgatattataaatattattatatttgtcattaaacttagtcaaatttgatgtagtttgattttttctaaagttaaaacgtcttatacctgaaacggatggagtaatactgcagtagttgtattgaaaagtgatatgaaaaattgaaaacacggtttaatattggcaattaatatgcatcacgtatcactatgactttgaacatgatactttgaaccagagccaagatagatactggtgtggtgtggatttattgtcatggaaactaggattatactccgtattatttggactttgatgaagtggaatatttagaagatactccatgattttgcaaaattatatgagacggtttcgatcgcaataatcaacgtgtcgtgtcacaacgaaaggactcaccaggataatggccttgatggcgacagtgtcgaacagcagcacttctccggcgccggcgccctcctccacctcgctcacgtccagcagcacgtccacgaagtcccggtgatcaacgttctcatcgccgtcgccgtcgccgtcgccgccgtccggctggctgaggcggcggcgctcgcggtggtccgcgatgacacgctccagcaagccgtcgagctccgccgatatgcgcgccgccttggcgtcgaggcccatcagcttgtccacccacgccagccacggcacgaactcccccaccgtcgccgtcccgagaagcgcctcgaagttggcgaacagctccctcagcttctcgccgccctcgtcgccgtcgaggccatacgcgccgtcgccgaacgcggcgcgcgagatgacgccgttggcgtaggacatgagcaggtcgctcaggttcacggtctcgccgccaccgcgaacgccgcagcggcgccggacgcggtcgaggagcgcggcgacctcctgctccctgacgccgcggaaggaggcgatgcggcgcgggctgaggaggtggagcacgctgacgcggcgcgcctggcgccagaactcgccgtatggcgcgaacaccatgtcacgcccatagatgagccgctccgccatgcgcaccctggcgcggctcgcgaacgccgcgtcgcgggccctcatggcctcctgcgccgaggccgccgacgacgccacgacggtgggcacgcggccgaaccagagcagcatcaccggcccgtgcgcctcggccatcgaccggagcttccggtgcggcaaggagccaagaagcggtaggtgccccagaaacgggacgccccgcggcgacggaggaagcggcagccgccagccgccgccatcgcctggcttcttcgccgacgagaagctcagcaaggtgaacacgggaaggagcaggagcgcggcgaggaggaagagaggtgagtgcaacacggcagcaagcgacgacgagagctccatttctgaacgagtgtactctaactcacctcgatccgttcgtggggaatgggaacaaatctacactgaaagggaaattgtttgtgatgtacaatgtttgtattttttttttctttgaaacgagatttatttcaaaaaaaaaactaaattcagacaataaagacgaaaatgtagctctcgttggggaagcatcggtgatgtgctgacggaattatgggtgtatgacttcacctactgtagtttaaatcctggtggctgtaaatattacgcacatgtaggtgagcttaaatattggtgcccacgactattacgcacatacaggtgaactttcaacaagactttaataatttcagtagtatgtcgttggtttctgtttttagagcatgtgttaggggacgcgtaggttttcaacaggactttaatgaaatcaataatataccgttggtttgagcatgtgttaggggacgcattcacatgtgtgagtgagatgttacgtgtgtgctcacgtttgccatgtaatcaaaagaaaaattgtagctctcgttggtcctggatatggttgaaagctcaggacaaatgcacgatctttccagagaaaaaagggcaatttcacaaccgtattttctattttttgtggccaaaaaacagaacctccaaagtccaaacgagcaatgaattcgatggatcaaaatgtagtacagagcacggacatgaactgtacatcaagcaagacataatggaaggattgtattagcaagtagcaagccatatagatacagatctggcacgctctaccatcaaaatgggcagagaacagaaccagattgataggttgttctgtcaatttacaagctttcacagaacatgttttggtctctccagatatgcactgaagcaatcaaacagaaaagatatgtgcactgcagcaatcaaacagaagggtagaaagactaaaaaggtatcccaactctagcatctagcagatacaaaggtaggagtaaaaacagttacaaatgaatcttctccaattatgttggagcactaaaaaaacaatatgtagcattggacatagatagaggctttcaaactaaagatatcacacagtggaagaggtgaggatgatgatctacaccgatccggtagaatcaactggcgatatcgctggtgccatatcttctagcattcacagcctgacgagcgctgttgccttccagcacctccaacatcaattgtatcaggaagatatctacaaaattatagcaaagtgtcattgaacggcatggtttgcactttgtagttcatctctgcgttagtacttctaaatgctccccttatcaggaaaaagaattgagtttttttaaaattgatgtttctactgggaggctgcaagatacaaattttacctcgatttccattagcaacgcttttcaaactgctaaacagtatatttcatgcgaaatctttttatatagaagttgctctgaatatcaaataaatccaatttttcaagtttaaaataattaaaacttaattaatcatgtgctaatggctttctcgttttacgtgtgcgtacttaaatcttcatcttcatcagattcaaacagggcaataattaacttacatctcctcttccggttcattcttgatagcattccttgctatacactcaaaagcagcctccacgttgaagccttctttagcagatgtctcaaaataagggatgtttcccttagaagcacaccaagctttagctttcttctcagaaacctgggaagaacaactaggttaagaaaagcacaatgcaaatcaggaaatcagaggctaaaggcacttctatgaggacaaatactcacagtccggctattaccaccatcaacatcaattttgtttccaagtacaacaaaagggaaattctctggatctgatgggctagcctgcattgagaataatgattcaactttcaataaacagattgcagtacatttggaattttgggtaatcgataagtaagctacttacttgaattaggaattcctcacgccagctgttgagcctttcaaatgacttggtaacattgacatcatatacaagaacacaccagtcagctccccggtaaaatgccaccccaagactttgaaatggttcttgtcccgctgtgtcccaaatttaagttccaggtaaacacaagtattagcgtaaatgtagacagaattactgtttgacaaatgacaaggtattactttgattgccatacattctagtatttctatgatttataacacttaaaccagcagatattggtaataattatcaggtattgagctataacagcaaacgttggagttactttgctgatttacgagttagatacaaatcgaaaaccacagtctttgttccaataaatgtgggaaagtgaatataatttttggcactgatggactactatcaaagagcattatgggtgtggatattttctccaacttgctgtaaagtgagggtatcattagttccacatagtcaagatgattctctactgcagttgattttgtcttagaaaagcatttgccaattaataatgtaatataatatttactactccctctgtcccaacatatcttcaagcgtttgaaatttgtctcaaaatataaggacttccatagtactacttctcccaccaactaacgctcatttaattttcacccaattttaccccaaaccaccttcccactccccaatcacccaacatttaatgaggagcatcatagtcttttcccttcatcattaatctctctcaagaaaaaatctagaagtccttatattttgggatagagggaatagaacagaatagtactcgcttttcacgaagggaacaacacattg

SEQ ID NO: 76275 - DNA, 2189 bp, Oryza sativa
ccagttacgtacaacaactgtcaggcgactcaagctcgtgctgcccaccggtggtgcttccattttttcccctttgtccgcaggaaaccgccactatggccgttaccatctttcccctttgtccacaaaaaaccatcgctatccccatcctttgcatctgtagtgatacatggatggggataaacggaagacaatggatcattttataagatttcatctcttcctcctcttatggtgacgacgttgcggcctgctacctagtcccgctttgctcgccctagggtcacactcggccctcaacccatgctcactgcgttccttatggcgaagatgcggagtcgaggacgacgacagatcgacagcaccgacagcggtgggcaggcggcgatgtcgagcggagttgatgtgtagcggccacagcgcactgtgttgaggggaggtggcgacatgggacaaggtgacggtgctgggctaaggcgcacggtggcaggcctgttggtgagccggcgacggcattggatgagggatggcagtggcgatgagccacatgggaaggaagaggggtggttcaaggcggcgacgaagtggaggcgtggggtgctcaaagcaaggaggttgtccattggtttcactaatcctactactaatccatctgctaatccaactcacaatgtaggtcgttagatgagaggatccaacggttaggaatgatctgggtatattttgttaattcgttttgactttttccgtagccaaacttaaccaagttttttgataacatatttgttttgtatttaaaatgctatgctaacttgattaaataaagtttgattagtcaaaacaacttataatatgaaacagagagtatatgcctactaattactaattgacttactatactagtaatatgaacgtgctaacgctacggtgatatttcataaaacaatggtgatagacagaaaaatagaatcatgttgagaatcaaacaactaattatacttgttgctcaaagtatattgatttaaaacccattgcatgatcagtttcacttgagcaatcaaagcgtaaggattctttgaaaaataaaatcaaccacatacaacagtagtgggagaccatagtttacagggtcaataatcatgttttctccttttctagcctccaaagataggaacattgattcaattgtttttaaaagagtaaaatacacggccggtccttaaacttgtagggatgtgttatctaggtcctcaaaatacaaatccaggtcctagaacttgtcaaagtgtgtcatgtaggtcccaaatcgtcacagctcctccaggatcttacatggcactgatgtggcaatgacacacagacatgacatggcataatattgaatgacaaatgagacccacttaaaaaattttcatttcccttttttattctcttttttttcctttcttctccttttcttgctctcactgcagctataggccaccgctacacgggttgctcaggtcacagagaaaagagaagagaataaaagaaaaaaaaagagaagaagaaaagaaaaaaaaggaaaaggaaaatttttaaatgccacgtcacgttcgtgtggcacgccacatcagcgccacgtaggattttggaggagttgttgcgatttgggacctatatggcacactttgacaagttctgggagttggatctacattttgagagtttagggacttagatgacacacctctacaagtttaaggaccgcctgtgcactttactctttttctaaactcccaagttactttagaaaggttgattttgaagatcatctgatttctaaccaacattttttaagatgttggagaggtggttgaaaaccaaagacataaaaattacatgatttggtacaagacaatcacttgttaagcatccaaactacccttcatcatgctcagaagtaaaagagagctgaaactcacagattcagaagtttggatcactgaaggctgcaacatggactgttcacttcagaaaagagtcgacacttcaaatttatctacactgatcacacaacctaatagattcaccagacaccaatctaatgacatatattttgacaaaatatgtagcagagaaagtactaatcattcataaattacaccatgaacgttgcttaccacgtagagcaacaatcgacagaaagc

SEQ ID NO: 76276 - DNA, 662 bp, Oryza sativa
atgtgtacttgtctttttttttttgatttttgatttttttttttggctttaaagaattggctcgactcaaatcgagccgatcgggcttttttttttttttttgcaaatcgtatacctcaaaggtgtcggttcctaaaccggcacctttgagtcatctcatcagtgccgccttggtggtgctggttgggaaaattggcacctaaggggatttcccaaccggcaccgaaggctctttctgtggtagtgaccctggttttgttagcacgtttttcaatctgctaggtgtatttcgtgcgaaaactttttatacataatttaagttgctttaaaatatcagataaatctattttttaagtgtataataattaaaagccaattaatcatatactaattaatggatttcttgttttcgtgtcctagctacttcatctttagtaaaaacgagcatcaccaaactatgttccccggactggttggagagtggatatattttaaactttcgagaagacgttcccttgttgtttacatatcactcaaaatagttattaaaaaatttaaaagatatattaatatataatatatcagtatttaaaattcaacttttacaagttgtaaaaaaaaagtacagctagttaatgtatattgatagtcatttttttttt

SEQ ID NO: 76277 - DNA, 1577 bp, Oryza sativa
cgtaacataatcctcattgtagcttatgaaaggagctatgcaatatggcttccaaactgcgtaaatagagtggaataaaaacaattttctagtaaccgctctatcccttctgtcatatttgtgttttacatcttttgtgatctcattaacgtctccaataagcaattacatgatggttgcacaggtatctcacatctcacactaaaataaaacaagagtaccaagcaaaataattacatgaaacctaaactctaactgtcacaagcaaaatattttttcttttgagcaaaacgattttactgttcccccaatattatctgaatccattgttgtctagtagaccaaacctacagtactagtagacggtcaagctaaatcaggtctgcacgatttggcaaaaaagcaattccgaccacaatcagtcaacggtgcatgtgcatcacgccctaatccccaattcccctacttatctgcaaagatctaagcaccccaataatccccccaaaacaaactatcaccgcgcaccaaaatccagctgcgatgaagctgcgaagtgattctgggaaagcagattagaccgaacctgcaatgtgaagagccggtcgtcgatctgcacctccttggtcaggaaatccgcgccgatcgtcgctttgtactgattgctgaacttcttgttcacgtacctgaacaacaaaaacaaaatcacccaaatcattcaacatcgcgaagtcccccttcaaacaacgcctaaaaaaaccctcaaatttgacgaatcggacaacgcaagattgcgcccccttgatcttactggttcatcagagacgtcttcccgaccctgccaacgagaaaaaaaaaagagacgcatcagcgatcagagaaacagaataaatttcgcccagaaagaatatcccccagtagaaattgaacgaaaaggtgggggattttttttgctttttcgcacccgctgtcaccgaggatgatgaccttgaggagcattcgcctgcgcgacgccatgggcgcggatctggaggcggcggacggatcgggcggagcacgaggagggagaagaggaggaggaggagaaggcgagaagcaaagagatgatctttgcgcttctctttgctttgggattggcgtctcttgtgtgctcaagaaaaaaaaaggcgtttttttttggagggatcttttgttcgtttgttgcttggatggtctggctaatttatttatgagatttatttcgtctaaagtgcgttttgaagtagtagatgattagtcacacgtggaatataaaggtaattaaaatatgattaattgagtattaatttagatagttgaaaagtaaattaatttgttttttaaaataataaaatttttccacaaaatacatcgttcagcagtttgaaaaacatgcctatagaaattgggaaaatggtcaaaaccgaaacgtagtgtatacttgtggatgctctatcaccctctaaattttgtggtggttggacaatggagtctgtgtatgtattttggtttctgtaataccctttcgcttacttcttggagaatggagatattgtttgtgg

SEQ ID NO: 76278 - DNA, 32555 bp, Oryza sativa
gtcacatatgcatgcgcccgcgcgcctcggtttagcagttccatgctattttggccggcccccttttttccggtcgaggcacgtactgtactgtactacgcgctcgctctctctctctctctttcccgtccttcctcacatggtcgacccgtcgccctctcactgtgctggtcctgcacgccgttttcgctgctccccggcgaaattttgttttgcgcgtcgtgtacactccatatgcgtgtacggtgtaatggcacgtgaaaaatttctctggagcaccggatatatatatatatccagatgcactggtcgacgggctcgattattattacacagggaataataaaaaaaaacgaggatggatgcatgcatatgaatgcatcgcacgtcgtggcacacgggttttttttgtatcggtccgtgggggctcactcactcacacgctcgatttcttttgcctttgcttgttgtttcttcttcctcctcctcctcactttgagtgtcaaaaaaaaaatactagtacatgagtgagcttaaagtcgaagcaatcacaagggaggcgtgcatcagtacatgcatgctagcaaccgagatacaggcttaccgacacttggtcctccaggatgcaaacaacaaagttcatagctcgatagattgacttttctctctctctctttctttcctttttgcttttagatacgttgaatggagatcgagcatatgctcctgaaaatgactaaacagctcagtccaacggaacaaataaccacataacctcgcactgaggacagtttgcgcatctactacattcaagttacacagatatactactgtatgtcaacttgccaaggcattgattctgaaaataaatgtaaaggaaagttcaacgcgacgagcccgacgcatgcagatgctccacggtgtgtgtgtgtgtcactctctgaacgccaacacagtaactagctggacgcctggagagctaaaaacagtgacctctcagctgcctgcctcacttatctctgtttcagactaacaatggaaccttgcttgtcctgaagacatgaggcccagctttaggtgcacactacactgtggttgtgtttagttttatgtgtgtaaaatttttaaatatatgaatacacatttaaagtattaaacatagactaataataaaacaaattacagatttcgcctgctgcaagacgaatttattaaacccaattaatctgtcattagcaaatatttactgtagcatcatattgttaaatcatgacgtaattagacttaaaagattcgtctcgtaatttacatgcaaactgtgtaattgatgtttttgttaaaaaaattttatctaaacaaggcttataaagctagtacggacgggcagcgaggtgtcagggcacaggcaatcatcgcagaaaattaaagattatgtgtaaacaggcaagcacggtgtttccaagttgagcacttgagcatccggtacgcggaagggagaaagccaataccgggtggattttctcatgaacgtcgcgacctatttattcggcgcgtcaaaagatcaatgttgatatcgatcaatcggccaaggccaaaggagacgaccacgtagccacgtaggagtaaaaagcaacgaggcggcgtcgcggcgatactttcgtctgctcaactgtcggaaagggtgcaaggcaaatactccctctattccaaatttataatgtcgttgattttttacataacatttaatcactcatcttcaaagtgtgaaaacaagctaaatgttaaaacctcgtaaaaatcgtatctgaaagtttcataaataaacgaagttgagtttggagctgggatttggtgagaatgtatttcatatctacacccatctctagtatttttttcatgaatttactaaacttttaagtatgattttcatgagtttccaacacttagctcatttcatcggatatgtccctatttattttattgtgaattattttatcatcaaataaaatacaaacttaacttattctttaaacatatttatattaattttttaataagacgaatgatcaaatattatacgaaaagtaaaccatatcatatattttgaaatgaatattttgaaatgaagatggtatgaacaaatgagtacggaatgtctgaatcactgacccctagtagaacagttgtggtcgggtagctttggctaggtgtatattaaggctgcgttcgcttgggtgtgatatagggtgagaaagcacctcgttttccacgcgcacgcttcccaaactattaaacggtgtattttttataaaaattttctatagaaaagttgctttaaaaaatcatattaattcatttttgaaatttaaaatagttaatactcaattaatcatgcgctaatggctcacctcgttttgcgtatcttcccaatctccccaatctctttcttctcaaacacaccctaaatcagcccggttgctcatctattctcttcgtcccataaaaaataaacatatgaccggatgtgatatattttagtacgataaatatgtacatatgtatatctactatgatgaatctggacatatgtatgtctagattcgtagtattagaatatgtcacatctagtactagattgattttttatgggacggagagattaccttgtactgtgactgtttttagctagcaatgataccctttgtgattgtatataagcagaatgtagggacacccacaccctatgaagctaccagtctactttacaaactttggagtttttccctccgtgtcccacgatatagaaatgtaagcatcagatgagatatttcatagcacaatgaatcaggacattccttgttcagatttattgtactatgaaatgtcatatctggttctagatttttatattatggaatgaagaaaataataaaatgatcactgtccaattcattgtaatataaaatatcatatctggttctagatttttatattatagaacggagggagtaataaaatgaacgtgcatcctctatacggtattgccgatacatttgactgtccgaaactttagcacctgtgagcatatgaacttctaaggaagaaacacaatcaaccgtcacataatctctctctctctctctctctctatatatatatatatatatatatatatatatatatatatatatatatatatatatatatataaactcgagtacgttgcaaggcatcaggaactttaagtacatctttcttgatatgcacaaggcatgaaaccaccacgacgaatttaccttgaaacatgggaggtggtggagagcaaaagactccgggggcagtgtgagtgagtggcgaggccactagaggcggctgcctccttgtgcttcttccccttggacatctaccaccgcacctagcaatgccacatacctaccaggaaaagcagcgcatatgcattgctttgcttgccacatttgcgctattctttccacttgtggcatcacacagaattcgcatcacttgtccttgaaacattttcaactcaacgaagctcctctcttctatgagatgcccgcaaagcaacagtggttatcttttgctatgctccatggaatctagtacatatataccgtatatgcaaacgcatcaaaagaaaaggaacctagaaaggacaagtagacctctaacatggcgtgtttagcaaatgggcagcatctaaaacaataggatccaaccaatatgccccgagtgtgcaatggaatattggaacaatttgtgaggttcttggagctcgcgccgtcgaagaaatcttctccaacattgcacttgaaaagctgcaaagacagagaaaaaaaaaagaagtgggctggttcttccggtaaaggagagggaacgaatgggatccaaatcaaccagttggggcgtagaaaaaaaagaagaaagaattcaggcaatcaaaggatcgaccaggaaaaagacggcatgttacgtcggtggcgcaacttgaatcaggattgtgtggatcgcaattggaagaagggggagatggaaaagtcctggaaaaaacaaaggagatggtacatggttgtatgtggccattgatgtgaggtcacaatcgtcaagtacttctttatggcctctttttggagaattatgcagtgtccaataagcgcaataagcaaaggaacagcgagttccacgtaaatctgacggccgcaagtggccctttccagttctgaactgtcaaacagtttaccctagtcgataagtcattgtaaagcaatatgagtgaacaggaaaacaattatacgagggaacaggctaaatcggaacataggatcctaccatagaaagcaggcagattttggagagcagaaatcgcacatatgacccaactgatggaaactataataacgactttagaatggaggatggcgatggtgatggtgaagaaaccaccatttaggtgtacagtgaaaatggcatctttgatagttttggtggcagcacgtcatacaggatcataagtactgtagcacagctcttgacaaaaaaatatatactcaatagtcgaggtacagaaaaaaaaattaaaaaatgtgccaaaacccaaaaaaagccgacaaactatcctgacaaaactattaaaacatgtgatcttcaaatgacctaacatcatgagtttattgcttgctatccccttgctggatacttgaatcatcaaagtcaagaaggcagatggtttttcagaatctgaatattgttttgtcattttcaagtgacacggcacataatgctttacatcagaaccaagaggattgtttatatagaaagcatccactaatcacatagaaatagtccacaaattattgtcaaagatatcaaaactacattgaaatgctcaaaagtttgacgctatagttcattgaattaccgtttgctaaaaaatatataaaataccaagatggaaagggctgtcaaaacggttaaaaaatcactgtacatgtatagtccacccaatgcttagatcgtaaggtcacaatatgagctttggatatcctccagacaattttataatacagcactttatctctcagtgcttcaccaaatctgccttgatcctacaatggaactttggaagcattaagaatcactaacaatttaagcaagtataccatttggtttttagaagataacttaacattgcagtctgcagatacttttccatgagttgtcaattaaccaaaactgtctttatcttactccgatacatcgaaaaggaacatggacatttgtaagatagaaaacgaggaagcacgtaatttcagaatcaatgcaaagaaaattggtaatacaaaagccaaatacaacaaagttacaattagatgtcccacgatatcagcagactacaaagccccagaagcctaggctatgaaaaaaaaagccacaaacaggctcgagacataaatagtcacaggctaaagaaactatttcgaatttgggccctaaacatggcctgcaagattttaacccagtccataaagcattcctatacaatactatcagattttgcagttcagattgtaaacttagaaggaaacaatatcaactacattcaggggatagtaattagctacaacagtacaagtgatgtttattccctgcattcaatcactgacttggacaaaaaactgttggacacttggaaccatcacatgccaaatcatcataaagaagctttgtgtgttaagaattatgacataaactataaaagaacgtgcaaatcagttaaacccagtaaacatatctcaacaaaagaatacaaacaaagttacagaaattaagctgatagttgtgacttgtgagagaaccagatggcattcatagcatcatcctgaacttaatctgccacttgcatcttcaaccttttaagacttattgtcctttgcaacaaatatggtaactaatatgatatccacataaaaaagctcacactaatcattccaaaacacttgacttttcaaaagtcaaaccaagtacagagtagttagtactgatatcattttttgttctcagaaaagaagggaaaacaaatcactatggacttgtttgcatcaggcctttagtgcactaatcctctggttctaccattgaagtatctttctgcttattaatcttcccagcactattataataataatcatttgttcattttatgtttcattaagggatcattcagaataattcaaaggccattaaggcttgagaactatcccacagagctagtctgtaaaaaaaaaaccatagaatactgttctatgcatgctgatcaatcattaatgtgtgatctttcctctaaaccaaacaatcacacctttcaaactaaatctaagattaagtacttttgatcactgaatatgaattaaaattatcaatagtccctcagattaaactaaaggttcaactgttactaaattccacatgaccacagaagacattaattagaagcagtgaaatgatagatatatgtctagttattatgaattgtctgtacataacataattcatcaggtaaagtgtaagacaaacatgaatacccatgtacggccaagttaaccttaaagaacagtggctacatatttcacatgaaaatacttgaaaataatatgatgtcattaaaacttttcacaacatctaagtttgcaatgctactacaaatcaacccaggcaacaattttgcaatgcagctgcagcatcaagaaagcaaacagccccaggaataatccaatttgacaattcttcacaatagcactatcaccgataaatttgatattgagcaacaagaaaatatccacatatgccattaagatgagtggaaatactcaggcattcaggcttatattgcttcaaacgaaatcttcaaaccttaaattgaggttctttgagcatagcagataacaaaatgattccgcgctattcattgtggcactataattctataattccattgattcacacaaaaaagaatcagtgagacatatttgcagtaacaacaatagatgctataatacaactcagcactatatcctcatggttaagaaactaattttccacaacaagaagaaacaggctatctccacaaggaatcaactgaaagaaccgaacctattaaatgcctggactcctcaatggcgagggctctgtctggtaatgccaactccgccggagaagatgctagcaaaggcctgcaggttctcgtcagaggggcttatgtggatctttcttggtaatggtaggatacaaggcccgcaaaacaccaccccgcccatctctctcaactcctcacgctcctcatcgctccgatcatctgcgccattgttcagcttcaccgcaacgtccagcttgtcagcgcacttcttgttcggcttggctgcaatctgctgcttcttggtcgtaagaaccgtcggagagggtgggggcgtcggaaacgagcggttgaggacgcggagcacgcggcctgctgggatgggcgccgtggagaggccgctgagggagacggcgggggatgagcggagagcgtgggcagctgccggggacggcggcgcggcgacgagactggccgccacgttaaggaggccgtggacgcggccggaggggcggcgcacaccgacggcgaacatcgacggggacccgacgggccgggacaggaggccgtggtcgccgagcaggaaccgggcggagccgaccagggagtcccccccgatgtgccagccgccggcgggcgcggcgtagatctcgacggtgacggcggcgcgggagtcgtcggcgagcgcggcctcgtggacgcggaagaggaggcgctcgtgccactccgggtcgaccccgcccgcgcggtccggccgcgtctggagcctgcgcgccgcgtccacccacgccacggcgtacgcctgcagcagccgccgccgcaggccggagggaggcttcagcccctgcgcggagatgagggtgacctccagaatccgctcgccctcggggagcgccagcccggcctcctcgtccggcgccgcctccatcatcgccgcccaagcggcgtagggtttcttggtcggcgcctccgcgctccgatttggggggtgggggttttccgcgcctctcccgtttcgtccgtttcccagagagggatttgaacggacggatggattgctactggccattgaccgatcgagggtcacaaataaaccccgccagattgaaagcgtttgacagctgcacgaaaaattctcaaataaaaaggagggtattccaaaaaattcaatcacattgcatctcacacacgccacaagccaatggctgtgttcagttccacgctaaaattagaagtttgaagaaattagaacgatgtgacggaaaagttgaaagtttgtgtgtgtaagaaaattcgatacgacagaaaagtttaaaatttgaagaaaaaaaagttagaatctaaacaaggccaataagaagatggtactcggatctaaatgggggagttcacaactatgggggtgtttaggagagaggggctaaaccccctatatatgctctactctatctatctaacgtgagttctaatataagtatagtatttctagttagtggcagaatcagccaattaggacctggcaatcctatgcagctgcataaacaccatggtttgaatcaatagtgtagttgctttgctccgtaagtctgtgttctttgctcaatgttcctgtcggtgatatgggaccgggagtatcatgaccagaggcttgaggtagacgcaatcgcccgcgtggcctggcaccttcggggacgtcgggcccgagggtgaggtgtccgccctcctcctgatttcccccgagggggggtcgggttacgcttgccccggccccgagggccgaggcaccccgaccccttaaagaagtctgcgccacatatatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcacgccttgccccatcccgtcaagacgaaagcctctaggcaactcgtctcaagccggagctagcgtgttatctcttagagatggcacgttagccctggttagatttataccaggctttatcctaaccattacaggcaaggtgttacacgaagaagggcaaacatgcatcttgttaaactgacacatggtggacaagaatgaccagtctgacactggtcgcgtcagcaacgggcagccacgatcccacgttgcgcccgtctccgccgggagtggaggtaggtgtgggctgtcccatcgaagtgtcattcggatggaaaccgtaccgatctccgcccattaaagagaaaaagaacagtccagtttggaaagagaaaggtgcatgtggtatccccttgagatataaaaggaggaccttgcccatttagaggggggatttttttcccggattgaaagctgagaacgggggagaagtcagcggacactttgtagctcgttcatacacagatccaccaaaacacaggagtagggtattacgcttcgcggcggcccgaacctgtatacatcgtcgtgtctcgtgtgtcttgccgacgagtaatctgaccacatacagagagagtgagagcttgagatttcaccctaagcccccggccgaactggcaaaggggggcctgcgcggtctcccggtgaggagccacgagctccgtcatctggcgcgccaggtagggggctcagcgtgtgctttcagagctctcagactcttccgtgtgccccaagtttttcttgttcagcctaatggccgagcaaggaaaaacgcacgacctctcgccgagtgtgagcggcgacgacggggagccgaatccacgccgtcgagctcgtactcctccacctcctccgcgccaaagccctaagcagggggaggcgcttgagagggtcgacaagtccgcagcgtcaccggccgcaggtgatgcaggagaacggcgagacggggagcgtcgcctcctcgtctacggcgacggcagcacgcctcagggtgcgcttcaagctgctggcgcgctcctacgacacccgcctgtcgtccatgacccggagtctccagcccaacgatggctggaagacgtggccaacttggtcatgacggcacagcagcgcctgggtgctggtggacggtccgccaccaccaccaagacctccggcgccgctaccaccggctccgtatcatcaaggcggagggcgcggcgagtggcggcggctgcacgtcattcggctgccactccctcgtctacaccgtcgactcgggaggatcagcatggggagccggatgcccgcctcaacatcgggcgccggtgtaatagccggcgtactccccgtgcaacggagggagcctcctcgtccagagtgtcacctcgacatggacgtgaagatcagccctccgtgcccccggccggtggtgttggctgtagagcctttgtggcgagtcttcggaacgtccgttggcccccaaggttccggcccaccatcaccgagaagtacgacgggagcgtcaaccccaccgagtttctccaggtctatacgaccgggattgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacgtatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacctggaactcctccggttccggagtggcagcttcggccgcccccggatccgccgctcagacagggcggcgtgataggaggaggaagaagaggacggaccgttccggcgacgagggtcatgtcctcgccgtcgagggcgctccgcgggccacccgaaaggggaggcctgcgagcgacaaaaagaaagaggccggaactcccggcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagtccccggtggttccatccggcaaacggcgaggtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaaacgagagcttctggccatggcccctacccatgaggcgatgcgtcgggcgcggtggtcggaggtcgctctcactttcgaccagactgaccacccaccgtgcattgcccggggagggcaggttgcgatggtggtttcccccaccatctgcaacgtgaagttgggacgtgtcctcatagatggaggagcggctctcaacatcctttcccccgcggcctttgatgctatcaaggccccggggatggtgctccagccgtctcaaccgatcatcggtgtgacgccggggcacacgtggccattaggtcacattgacctaccggtcaccttcggtggacccgccaacttccgcacggagcgggtgagcttcgatgtggcggacctcagtctgccctacaacgcggtcctagggagacccgcgttggtgaagttcatggcggcggtccactacgcctacctccagatgaagatgccgggccctggtggccccatctctgtccgtggcgaccttaaagtcgcgcttgcttgcattgagcagcgcgcggaccgcctcgctgctgcgtccaagcccgagggtggtgacgagaggcttggcccttctgcccccaccgccccgaggcagcggatggccacttgcgacgaggtcccggtcaaggaggttgccttgggcgacggcccatccaagaccacacggatcggtggttttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaagccccggaacgtcaagctttcatccgcgaggaggtggctagacttttggaggccgggttcattcgtgaggtcatccacccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagtcaaataggacgtaatgttgaggcgtatgtcgatgacttggttgtaaaaacacgcaaccaagagaccttactttcagatctagcggaaacttttgagaatctccgctccgcccgcataaaactgaaccccgataagtgtgtgtttggtgtacctgcgggtaagcttctcgggttcttggtctctgcccgaggcattgaggccaaccccgagaagattcgagctatcgagcggatgcgcccccccagcaaacttagggacgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgcccagttgaaggcgtatcttagctctcctccggttctagtcgccccggagccaaatgagtccctgctactttacttagcggcgaccccccaagtagttagtgcagcgttggttgtggagcgcgatgaggacaatcctcattctgcgcacccccgctctgtgccgacttggcccgggagcaggcagggaggagaggcccccgagtcgaacggtggcctaaggcccccgacgaccggaggcggccctccacccgcttgtcaaacggtgctgggtgcccccgaccctcaggaaggccccgaggccactgagggaaggctgcacttaaagccctttggccccgaggctaaccctgtgctgactcgacccgggaaagagcagggagaagaggcccccgagccgaacggaggccagaggcccctgacgaccggagttggccctttgcccgcttgtccgacgatgccaggagtccccgacccccaggacggccccgaggccactgtgggagggccgctcctgtcatcctccgaccccgaggtcatcagcgcagaagacgagtgcgccccgaggggccacttggacgaagaacgccccgggggtacggcccctaacgaggaggatcggccccgccgaaaggtgcagcggcctgtctactttgttagtgaggccctccgggacgccaagacccgatacccacaggcccagaagatgctttacgctattctgatggcctcaaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatgcccgaggccagcacgaacccctcacagctgcctcacgccgcccactgggtgatgcaattcgacggttctctgtctcttcagggcgccggtgcaggggtcacgttgacctctccgaacggagacgtcctcagatatttggtccgtctcgactttcgagcgactaacaatatggcagagtacgagggactccttgccggactcagagtggcggctggactagggatccgccgcctcttggtattaggcgactcccagctagtcgttaaccaggtctgtaaggagtaccggtgctctgacccacagatggacgcctacgtacgccaagtgcggcgtatggagcgccattttgacgggatagagcttcggcatgtgcccagacgggataatatgattgccgatgaactctcaaggctcgcgtcctcgcgagcccagaccccaccaggcgcctttgaagaaaggcttacccagccgtcggcgcaacccgaccccttaggggagacggatgcgcctaaccggcacccgaggcccgtcggagtccaggcctcgggacccgaagagagcgttccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaatggaatcctcctgaagtgcattcctcaggaacaaggcgttgagcttcttgctgacatccatgagggcgagtgcggagcccattctgcctcgcgcaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaatttattaagggcatcacggcccgttttggagtgcctaaccgtattattacggataatggcacccaattcactagtgagctcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgccaaacccatggaacatcgaacaccttcgtcgcttctacccctgaaggggggggtcgggtgtcaggttttggctcgggctaaccccgcaccccccctcgggtgtgcagggttagccgggggctaccacacatgcatatatattcctttcagcatttcaatagaagcagtttcaatttcctaaaggttgtgtctgtgccgttttttccttttgaagaatcttgacttgaaataatgtcactcgtgctcaaccttgccctcgggggctcggttcggtcggctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgcggatctccccaggcactagccccgacccgagccattcgaggaccgggacttgggcgcgagcccttattccaagctaagtcgcaaaaggaccatggcacagatcatcctcaactcatatatatagcaaaataaaactaacacaaaaatttttcatcatttctcattgcagattaagttaaaattgtacaaaaaagaggcatgaaggccttagaagaaagaacaagaaaaaagataagagtggcgggggcctgggggctcattcatatgcgcccgggtcgccggcctcgtcgccgccgtcatcctcatcgctggcgtcgccctcctcgtcggagctgggggcgaacgcgagcaaaggggccgacccctcgaagccgtcgacgatatggtcggcagcatcccggacgcgcgcgcgcgcgtcatcctcggtcccgggagggaactcctccagcgccatccagggagagaaatcggggtcccgggcctggtaactcgctagcacgagttcgaccgccccccgggcgaggtccctcgaggatgacttgatggtcttctcgagctcctcggggagtcgttcgaggacccaggccatcctgttgaggtgcggagcgaggccttccaggttgctagggcgcgtcctcgtctggcctttccagaggcccgcttgccgaccggcgcgatccatgcgggagaccgagtcccaaagcatgtcgggccctatctcgcccgccaagcggagggcctcggcctccccgatggaagaatccagcgcgcgctgcatgtcagcgacggtgtgttcggcagccgcgaggcgagcggctaagtcgctttcgcccgcagctgccccgccgataggcgccctcgcggccagctctttctcccgtgcctcgaggttggcagcccgctgctccagcgcggctctctcggcacggacgcattcaaggttgcggcgcgcctgctcctcttgcgccgcctcgcggagggagaggctgttcgccagccgttgcgtcgtggcctcggcctcctcgagagctcgctcccgctcagcgagtgcatcctcgcgaaggcggagcgcggactcctcctcggcgcaggcggcctcatgcgccaccagcgtcgcctctcggagaccagcggcggcctcgcggcccgtcaagcccctctccacggcgccggcgtgttcttccagcgccatggcacgggcctcaagggcctcttcgcgccgccgcaacgccgcttcagcctctgttgctcgctgctctcgggcggcggcggcgtcgaggaccccctgggcggcgtcgagcttgttcttcagctccgcctcccagctcccgtgttgaaggcggagggagtcctgcgcctcgatcatcgcggtggtggcgacgagggcggcctctcgctcctcctccacctctcgggcgatctccgccagcgccgccttgcgggcttcgagctccgagatgtggcggcggtgggccttacggcccacctccaccatggcgtccaccgagcgccgcccctcctcgacgcgcgcccatgcggcctcgagctccgctcgttccgctcgcaaggcctccacctgggcgctaaatccatctagcaccacggtgtttgcggcggctaaggcctgcataatgggctcggcgctcaccggggcaacggaagacgaggagaaaagtcgccttggagaaaaggcgacgcggcttggccccccgaaagatgcgctgggctcggggatgtcccccgggcccgtttgatcctgggcgtcgcccggtgaggtaggcccaggcgatgcgcccgcggcctcgtcgcgagccgcctcggaggatgtcacctgaggaccgcccgagggagtgggcccaagtgacgcgccagcagcagctgtcgcctcagcctggcgagcccgggcggcctcctcccgggcagcttcttcggcttggcgagcccgggcggcctcctcccgagcagcttcctccgcttggcgaacccgggcggcctcccgggcggcatcttcagcttcccgaaggcgggctgcggcttcacgccggtcagactctcgcctccgctcctctgcggccgccggatcttcggcctcggactggccagatttggggcggcgggaggaatgcgacgggacatcgctgaagcagaagaaaaaaccgaaagacgaacaaaatgagtaagaaaaaacttcttttttgggaggaaaatggttgcaatgagagtgagacgaacctgcgagggggtcggttgaatgaccaccttggaggggaaatcaggtttccccggcatggttccgtctcccccgtcttgcggagccgcttcttcttgcgcaccccctcgggctgcgacgtcggcgcggccccctccgggcgccgactgctggcacgcgccgccccgccccctcggggaggagatgtgggaggtgttcctcccagcttcctcttcccctgggcgtcggcagggcggctgctccccgagcccccgacgcggggcccagaagcgcgaccccctcctggggcagattgttccccccggcggcgctcgctcgcgccgtcgtggtccttaggggctctctcctctgaggccccgacccccatcataatggttagaatggaggcgcggtcgggatcgctgcagagggggaggatctcctgaggaatgcgagacgcctccgcggagctaagattcagcaccctttgaaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtactcttcccccagatctaccggcgcccgccagctggagacctgcgccgggggctggctcggaagtcggaggcgcgcttcgtcggcgaggggggtgtagaaccagtcgctcttccagtcgtcccacttcttgcggaggacgcaggggatgtagcggttcaacaccggcccccgcggctggaagtagcagccgccgaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcactatctcccgaccggtggcggactcaggcatgaagcggcgcggcagtccggcgtgcctctcgttcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacgacgcatgaagtggatatgcggttgaggcgatcgaaacggattgtatcgtgcgcgcgttaattacgctcgccgaccgaagcggcgttgccgtatctccgggcgagacgaatctgctcgcccagattcgcgcgctgctcaagtggtgtggcagtcttgaatagaccgcccattatggacaaccaaagttaccaataccaatgtgcatggattgagaccgttgggtattttgcccaactacggagaccggtcccacccgtcaccaggctttaggggtggcgtcacacctgaccgcttcccttgggaagggaaattgctctggcataacgccgggggctactgtcggtgatatgggaccgggagtatcatgaccagaggcttgaggtagacgcaatcgcccgcgtggcctggcaccttcggggacgtcgggcccgagggtgaggtgtccgccctcctcctgatttcccccgagggggggtcgggttacgcttgccccggccccgagggccgaggcaccccgaccccttaaagaagtctgcgccacatatatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcacgccttgccccatcccgtcaagacgaaagcctctaggcaactcgtctcaagccggagctagcgtgttatctcttagagatggcacgttagccctggttagatttataccaggctttatcctaaccattacaggcaaggtgttacacgaagaagggcaaacatgcatcttgttaaactgacacatggtggacaagaatgaccagtctgacactggtcgcgtcagcaacgggcagccacgatcccacgttgcgcccgtctccgccgggagtggaggtaggtgtgggctgtcccatcgaagtgtcattcggatggaaaccgtaccgatctccgcccattaaagagaaaaagaacagtccagtttggaaagagaaaggtgcatgtggtatccccttgagatataaaaggaggaccttgcccatttagaggggggatttttttcccggattgaaagctgagaacgggggagaagtcagcggacactttgtagctcgttcatacacagatccaccaaaacacaggagtagggtattacgcttcgcggcggcccgaacctgtatacatcgtcgtgtctcgtgtgtcttgccgacgagtaatctgaccacatacagagagagtgagagcttgagatttcaccctaagcccccggccgaactggcaaaggggggcctgcgcggtctcccggtgaggagccacgagctccgtcagttcccaacttcaccctactcgttttccacgcgcatgctttctaaaccgcaaaacaatgtattttttacaaaaagaaactttaggaaaattgctttaaaaaatcatattaatttatttttcaaacaaagctaatagttaattaatcatgtacgaataagtcactccgttttacgtgcgtgacgaatgatttccaactcagtttgtcaaactcatcctaagagtaagtttaacagtatagcccactactaactccaattcatctatagccgatctaatagccaattcatacaatagttgctttctatactattaatatatggtcccacctctcatacacacattgcgtcttgaagtccgtgctacagctagctacagatctgtagctcgctgctcttctctctcatcttttatctcattaaaatatgtttatagttagctaatagtctgctattgtatctgctctaagtgatgtgggtaaatccacaatctttcatggcaacgaggtgttcttttatacttttgatgcttatggattgttgtcagagatttttctttcttaccttatggttatgttgactctttcatgatcaggatattcatgtaaattgaacatcgttttacattaaatttgttctaggcagccaccatgaataatcattgtatacgctctgattagttgtcatcattgttagacatgcccagacttaggagtctatcagatttatttgacagatgaaaaacatttctaaaacctaagaaatatacatattgattggtatagttcatgacttcatgtgattaaaatttggtgatgttatgtacctattgtattgcagtggtttggtagactaatagttctcatgagtcgtgagaccatcgagccttagttccgtcaacatgcaaatccacgtgtgcaatcatagcgagagtaaatctccctcctagagagccatcacagtggtggtgagcatcccaacggaacggccaaattaggctctttaaatatctatatagccagctctccaactaatttggacagtcaaacttgttacttactcaaacagcctctccatatacccttagtattttgagcctctgacattaggacctatatgtcagtctctactatcccttcttcctcctcttcctccccctcttcatcttctgattttatccaccccttcctcttctgatcttcgcccttcaacggtggtggcggcgcatactacagtggcggcagctgccgcagcagatggtgacgatgacggtagatggcaactgcagccccacgcgaaggtgacaaaaatcgcgcggaagcagcagaggtcgcaccctccccgaatccacgtctcgctggccgaatccggtgggggcggaggccgcgtgcctccctgaatccacaccgcgtaggcctaatccaacaaggacgaaggtagtggagaccgaccggatggcacatatgacggctggtgatgacgacctcggcaacgatggcagtggctggcgacgatgacctcgacgacaatgacagcggatgacgatggttggcgacagagcaaacaacgacagtgtcagctggcgacgaagatcttggcagtagtggcggatggcgatggcaatctcgacaatgcaggcgcaacggctggcgacgctgcaacgacttcagccggcggtgggcacgggcggagatggggacgacgacggcgagctctgcgcagatccagcgtgatggcgctgcagaggggaggcggcatgtcccggcggcatcggacaaggagggaggttgagcgtgagagaggagagagatggtggggcaatgtttagcatgtcttttttggttggccaaatttggctagtgagggaggagtttggctagtcatttaacttggccatccgagtagaaaggctattggagtgcgattttatgctaaacttgtcaaatttaacttggatagtctgttggagacgctctaaatatagtgtctgtgagtctctgagagagagggtagtaaatgtttgtctagacctgaccatcacaacgttgtatagtttctttaggcagttttcataaagggagcaaataataaatatttacattgagaccggtaaacaaaaaatcactggcttgctctattgcattttgttgggtctaacaattttggtcttatcgcccatgatagctcttgcatgagacctaatttcttcaaatttccctctcttttctccctcctctaagtaagtatcaggctaaaatttttttatgtgatagtgcaattaattatataaagatatattaattgtgatattagaacaactctaagatcacttgaaagagaatgagaattaaatttgaaaatatattgttcattcaattttttctcagaaatatttgggatacaatttattttgaaaatataccgtcgattttatacaaccgttggacgtaacgtcgagggcgcggtatcgcgaggtataagcgcgagaccgcggtctcgcgcagcaatgacgcaagaccgtgcggtcttgcggaatggaagagcgagaccgaacgatcccgccaaatcaaacagcgacactgtccaatggcttcattttattagtgattaattactcaattaacaattaattaataataattaatgactaattatcttgattagcgattaattaatccagaataattgatcgctaattaaatcggcatgccacggtatcgctcattgcttcagcgagaccaaatggtctcagtctttctttccacgagaccgcgcactctcacactgttcatgcgtggtctcgccttttcaccgcgcgatatcgccctcgacgtcactcccacatcattttcgcgcaacggttgtgcgagaccgacaatatatttctataaaaaaaaattgtatccctaatatttttttaaaaaaaataaatgaacagtatattttcaaatttaattcaagagggtgattcggtagtttagaacaaataagttggccaggcgtcgctaatgatcttgtctataaccgagtgccagatattatacgtagatggatttaaaaagaacaacaaaacaatgtcactggcatgtttaaaaatatggatgcgagtgggacggataagagcatcaccaacagatgctaaaaatctaccctcgcaattttgtttttaagattcctaatcatattttgagatatgaatagattcataaatatcttaaaaatctgattctagaaaataaaagtgggtccacactaaactaccaatagagatcactctcccctccgatgtacgtgtgtgttactggtagccgatgtgctcccttgttggtggagagcaagaaggacggagaaagagattccaattttaagaaggtactttggaaaattagaaaaaaaaattgaaatcatcttttaagaaaaaactaaaatgttgagattaggagttaaattaggcatgtgttagcgggtttctttttcctgtttattacaataatggttattgttttcttctaaattatgtattggcgaatagaaaatgatatcaaagccggggttttttcaggtaacggattttcttacttgcatccctatttaaagaacttggtacgatcatactgtatcggggaaaaaaacacaaagaattcagcatacagaacgtggtaaaatatgcacgctgagggcggattgcggaggacatatggactttgggggtaccgtttaattgggaagtcaaggccccttggttgcaacggtgagcccatcgcatccttcttgggccaaaataccaggcttaccaggttgcacgcgctagttctgggctatcaaccaatgggaaggacagaggcaccgttgcctagcaaggaaaattgccttgcaatggtagctttagcccctttgatttggaggaaaaacatagtaattttagaggattttaatcctatagaaaaatttcctatgaagccctttgaaacaaagaattgaatcctatctaatcctttgaaattcctatggaatggataatcctatagagattttggaggaaatttagcaagagcttcaatctcttgctaactttccttttgagtctatctctctcatccaattcctgtgtttttcatgtggttcaatcaaacagttattcctgtgttttgcaatcctctgtttcatacttatatttctattaaaatcctacgtttttcctattcctatgttttctcaattctgcgcagggccggtcctgagtttccaaaggcccggtgcgaaaataaacataggggcccttaatatattatcccttaatatattatctaaataattattaatagatctatatatatgatatgctgctgataaatacctaaattacatggagaaataatatttatatgaaaaacctcatatgtataaccttaaatttgtttttgggtacgtatgtatttctagatgcaagtattgatgatctaccaatatcaatttctaaatttcactacaaaacaataaacctaaatgtaaaatcttactaattaattgagcgtgggtggccggatgtgcgggtcactcaagcgcaacctctgtactatacacatctaattaacaagcagaattagaaagctattaatccaacatagccaaattacagatgacaaacagatagcatggaaatttaatttgcaacaaacgagagtaccacaagaacgtggtggtgttgctactgctcacctcctctttcacatgtagtgcagtagaaagcaacctcttcaatattcagtgttgaagatcgatttaaagttttgcacttccgccggcggcagcgtcgtcgcggcaggcgacagccgactgccgatggaaggcgcgtggatgcggcggcgattggaatgtagtggatgggattcctggatggggaacgaacgggataaacggcaggcaggtgctaatgtcaacaacacgcgcggcggcaatctcgcttgtgtatggtggaattgggaacgacgtgctgcggcgctgtgagcctgtgacctatatgatacgatgcctcttcgtgtgtgctgcctttctacgtactgggccaagggaggggggaggtcaggtcggggcccctacgacctgggggcccagatcggctgcactgctcgaccccccgggccagccctgattctgcgattaaaaggggcccttaactgatttatctctatcggcaagacagcttgtacgccgtacgcgggccacaaaaccgtgaccgaaactccaacggctgcagaattttttttatttataattttttttattaaaagttttacaaaaataattttccattttgaaaattaacggaaatagtcgcctaccgcccaaaaatcgccctcccagagggcggcgaaaatgacgtggcagacggccgttcgctctcgggcgacggccgtcaacgaaatttgcaggcggcccccttgccgccctccgcgagggcgattttctactgtgcggggggccgcctgcaaatgggcggcgagggggggcatggaattttgcaggcggcccccttgccgccctccgctagggcgattttgcactgtgcgggggggccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagactggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgttgactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgttgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggtgagggatcgacgctccgtgagaggaagagctggcgaacgcgcccgaagaggtggcgaacgcccctgcggagctcgcggaagggccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgctcaacctcacctggactgcggtgatatcggcactgatatcccgtgccgcatcagcctatgcaagatggaaataaaaaattcagtagttgtcctatattatgcaagataaatgacataattgttgaaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtagggctcgatgatgtaattatcataaaaatttagaaatgaacaatccgaactcacgagtggtcggcaggggggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactcatccggtcgcaaataagcatgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacatcagtgcaaaacaaagcaaagttgagttcaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaatagcgccggtgtgtcgtacgccatacctgcatcaaataggttgatcagaaacatataaataattagttcaacataagtaataaatgttcataagcgaattactaacacatattaaacaaaagtacaaacaaacaaaagtgtttagtccgaacactaatcacgataacattatgacacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatcagcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctccttactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagaaacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaagatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaacctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagatccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcgaaagccataggtagaacctggttgttcccatcacacccaattgctgtcaatatctgacctcggtatttacctgtcataaaagttccatctatgcatagaac

SEQ ID NO: 76279 - DNA, 3538 bp, Oryza sativa
ccatttggaataagcctatggagcagaagcttaggaatctgcacaaattagatgtttgttcaattaacaagcacaaaacaagggcaacatataacgtgggcctacacattaaagcaacaactttcagtttgggaacttcaatatcagtgacaaacatttgtttgcaacatactctcttcagtggccccgcccctacaacaagtttgcctagtgcccactcaaactgactgtatcacttttatacatttcttttctcatggattagtattttaatttatcctgaattgcacatgacatttcaacaattctctacttggacccaaaccacttaagcaatatagtaagaagcctcacgtaattatactatgttagcattcaagtatgaggtccatgaggtttgtttgtctcctgtaaatataccgagagctagtaatgcatcacaaggatataacgtcgacagaaattacaagtcataagaatggcaccttccccgtacgccttggatcttcgtatgggagatttcgaacgaccactagcctccataagccaactttgttgtttctgtacaatgagctagaattttttacataagcctctgtttcttcatctacaaacatataaaaacatgcatttgcctttgaaaattcgctggcattccttggatgttgaatcatatcataattccctggaaaacggtatcaaagtgtgagcagacaagcagaatgcaatcataattaatactattactgaacagtgatgttaccaaaaatagcagaagctacaaccagctcacggcatttctccatctctaacagatcatcatcattgatatcaaatccagaaccttggccaggtttctttcctctaacaaagctgataaaacagcacaaatcatttcattcagcatacacatttcagccattaagttttggcagaagttctggattaaatatgggtaagaagatgcaagtaacctacccacagtggacagtcatagactcactaatgtcaaaagatttatttctctgctccagagatggatgcccaccaaatacagagccctgatttgagaaatttgcagtgatgttgtcttcaaatacataacttaagttcttaaggacaggagatggtgaaggttgtggaggcataagagcgaacgcctggtctacaggcacgtagcaaacatcacatgctacagggaaaatgagaacatatcttacgattaatgacaagtcaaacacaaacaaacttgcaacgctaaccaaaaagatgtaaagaactaagcttacgtcgtggtccagtgcgtttcggatcaaccaggggaggggcaactgagaaaccttcacaaggatgatgtgtaaagtttgcaaatgaaagacgaagtcgatttggaagttcagttttgttgacgctactagcagagaattggtcgctggacgtcattagaggccttgtcatgctgggatacacagagttctgtatggtatttgcgacttcatagttatttgcaatgatcattgaagcattatcatctgaaacaagtcaccaaaccaacaagtcaatgactatgctttctaacaaaaacatatattatttttcattcaagaaacatcattttcttttgaattccttgaataaagtacatgtttgagaattccatagtaaaagcatatggcatgagcagctaacgtcccttgatagttaggattggcagacaatttatcatatctgaggctcccaagtaatataacaaattttagtactaagtgggagggtattcggtgatcaagacggaggccacacagctctgcaagattcaatctaccatttcaaatctaagagtgtgtagttcccttgaccttatgaaggtctctaaccatcaagaccacttgtatgcatcaaaacctggtttatagagaagtactctacctggaccaagatatacatgacactgccatcagaccagatcacagacaacaacatccaattagtctagctgatccgcaacaccacaaaactgagacatgtaaatgggaggcgatcacacgatcagcataggccagtatgtaaccagaatgaatgccgcgcgctattgattcccaatgtttagagcatcacaaagacataaactaatctggatttctgcaagcgtgaactgcgtgaccggaacaaactgctagtacaaatgcccatttcgctacgaacagcagctagggagggaagcgtgcggcgcgaattcagcgcaggcagccaattggcagcggcgagaaagaaaagggcagagcgcgtacaaacctttgacgacggcgaagatggagcagaagacggcggcggaggcagcggcgagcagcagcagcaccccggccctccggcggcccaccagccgcagcgcgcggtggagcagctgcagccgctccttctccccgccgcctcgccacccccaccccctgcccccgcccttcctcccgccgccggccgacgcgagggagccgtagctcccgcaccgcatccccagcgtcgccgccgagccactcatcgccaccgccgcagccgccgcctcccctctctcatcccaatcgccgaatcacacggcgccgcaatcccctccaccgaaacacgcgagatcccgcgagctgtggctggcaaccagatcagacaaggcgccgcccacgcggggattagaggatgcaggtggagcaccgacgcgcgcgcgcgcgcgggcggtgggtgggtgggtgggggttagaagcgcggcgcgggcgcggcgggcggcgagacggggaggattttttttgccggttcacggagctggaacctaccaccacaccagcagcagcagcggcagcagcagcatgtgagattcctgcgcgcgagcgcgcgtgacgactcactgacgagacggcgacgcggtggcctcgtcgtcgtcttcctcgcggctgacgagtcgcctggcgctcgcgtggagtgtagtgtgccgccccgtggtgacaagtcggggaggttaaaaagcggcccaagccgcttcggttaaacgccatcactactagtgatgatgacttgatgagtgatgggcaacgcgatcttcagtagtagggtaggtgcacgtcagagcttgctgctgatggacgaaaatattacactttttatttctcccttctttttaaaatatatagcaacctaataccctctctgttttttataaatgacattaatatttaatgtgaagtttgatcgtattattaaaaaattatataaatatcacttcttttattgtgacacgttttattattaaagaaacattaaatgtgtcttattctttagcacatttacactatttttctaataagatgaatgatcaaatactattttaaaaaacaaaaacattatctactaaagaaacagagttagtactgaattaactgccgaagaaatatgtgataatgattgatgccaaattgccatttggcagattgaaatacctggagagattctcaaaaggatttttttgaaaataaaaaatggaggggatgtgtgagaa

SEQ ID NO: 76280 - DNA, 3096 bp, Oryza sativa
agctacaagcatgtgtgattagtgtggttgtgtgcggtcttgccggctttgcccaagccaaaccgcgttgggtacagatcgtcggtgaccagtcgactatacgtgatcttgatgggtttgtggatcaaagattgacaacagattgggctctttatcttgcctttcgtgggcttttctgctttactattctttattgggctgggcctgatagcagcaaagacaaaccaattctttctttatttgaatcgcaatcggttctacttactacaacctattcatgtccaatccagcaaagttgtcagcatgggagactgagttaagatcaagaaattaacggattcactgaggtaattttacgtgataggaagaacaaggttacagagaaaattaaacgatagcgaaataaacatacaagctgtctcaattgcataacatcttgattattacagccatactcctctaccatataagcatcgtaaaccaatgcaaaaccagcactaactacgtaccacagcaactaattcatctccccatgcaagatcgagtcaatgaattaattagcctagccgatcgatttattcaggcccggtctctgatcttggcgacgacgacgatcgaacacaccaacatggatcaatggatcagtagcacttgttggggtatttgggggagaagacgaagttgccgacggagtagaggccctggaggccattgtcgcgcttgacgaactcctcgaacttgagcggcaggcccctcctgccgtggccggggacggcgcacgcgcgcgacggcgaccggggcacgtacaccctgcactcctggctcgtgaacgacgtcagctgcgacgtctcgatccggaagtagccgccgctcccggccacccccctgatcgacgccacccgccggtgcccgtgccggcaacgcaggtacgccaccgctcctgcacacacatatatacacgcacacgcacggccgccggcgagatggtacgttaaaacaaaacataaatattaggaaagtaccaaatattaaataaatagaagtgggtaaggctttgaacccaaataagctaacccacaatcttgtgaagctagccgaaaaacccctaacagtttctatgttacgtcgacaacgacaccgtgtaatcaagaatattgattttaccgttcttaaaaagatattgggaggtatcatattttttttagtgtaaatttggtgtctctagtattagaaggtacggaaatgcattaaaaaaattattacgtcttgggaggtactactctctcccagaaaaaagcaaatcttagctatgaatctagacatgcatatttccaggttatacgtgtctagtttcgtagctaggattggattattcttgggacggaggagataactctcgaaaactgtaaaatttctcaatggtgaaatgtatggtcggtctgatctgcgagcttacctgcgagcggggacgcgtccatggcggcgaggtagccggggtacctgcaggtcttgcaccacaccatgccctgcacgccgatgctgaagttcaccgtcggcggcggcgggggcaggcccatggcggaggcgccgccgccgccgtcgagagcgagcagcacggcggcgagcgagagtacaacgaacgacttgacgaacaacagtgccatcgcgatcgaattcgccattaattagtcaacgtaatccacacaagaatacgtaataactagctagaagacgacactaattcgctagctagctaagcaagatctagtctggtaagatatggtatagtatacagacagaattaaacacttgggttaactaggatacgttgcgaagacaagaagcgagagatgatggtgcaatttatagcgtgcgtgtgcgtacgtagaagtgcatagacgcatacagtgataataaataaatagtaagaaatttaagatggctcgtgattgctgttttggattctgattagaaggggatcagagagactgtatattcaagttgtgtggaaaatacgagggttcgttggggaatcgagggccaggaaatgatgaactcgcgtgtgggctggagtgcgctgcaagcgatcagtacttcgttaatagcattatctctgtttaattacttgattccaggtgtgttagaagttaaaatacatgacactatgtaccactgtatcgcactactgtggacacatcgtgtttttttaagacaatcacgtacatcggccgttttaattcgcctagtgatcggagtttagtagtgtacactccagtagatctatctaagtaccatgcatccttagtaaaatcacctggttaggcaaatcgaggatgcatgggatcgatgaacaagagtgcatatcttggacatcagaataactgcagtatacgtagcgttcaaggcatcggatctgtttcgatcgggaatgtaataagctgcttaactggtataatcgacgagcccaaagtctgaagtggagcaagtaaatactactctccccgttttatatattataagtccgctttatttttctcctaatcaaactttttataatttaaccaaatttataaaaaaaactagtaaattagtttcattaaattttaaattgaacatattttaatagtatagttattttatgttaaaaatactactgtgttttttcatgtatacttgattaaaattaaaaatgtttgactagaaaaaaatcatatcaatttataatatgattgatggacagtagtgacaatgccgcatatatagattccaaggttgagctattagacctaaaatcccttatattatgggatagagggagtagtcaagtagtagtactccaagtcaccaacgcaaacaaattttgatcgagcagtgtaaaaacagtagttttttctgattccagtacgtagtagctccttgtgttgttgatgtattgtatttgtatcgtatgcagatgcaactgccaactgaggttccgttcggcagttgcaagcgctggcaatctggtctgccttctcgagcgggccaaaaaagcccgttagcccattaaacctgagtcatttggcccaatactcccaagcgggggctgcaggaatt

SEQ ID NO: 76281 - DNA, 5640 bp, Oryza sativa
tgacgtagtccgcgacgtcgctcgcgaggaggcgctccgcgatcagccccgcgggcccttccccgaggttcgtccagtctctcctaaaataaaagacgagaaatcatcgtgttggattcggaaatataccggagggtaaactaatatatggccccgtcgattggattattcacggcatatttgcaaacgtaaaataatttataaataaaacttttatatatgcgttcttagcgatctgaaaagcaaaggcgggaaaataaactacaatgaaaagacctaaaattaactttaaaattaaagtttaaagtttaactaataagtataagtataagcgaaaagatgagactcgtagaattagagtggaggataaactttgtaccaattattaggctggatgaaggcactcgtttcacacccccccaaaaaaaaaaaacttggagggatctgcgatgaccaccagcgccgcggatcattttctgccgtactgatctggatctgggagcttggtgccgctggatcgtgacggttgtacggtagctttgccgggcgagaggctgccggaagaaaatttggtgagacggaggtcctacgctaacaagaaagacttcgtttccaagcgcgacatgtgtgggcaccaatcttaaagcaactccatcctcatcttcaacctcacgcctcacgaacgttctcccattccttgtttgcccagcggctcaccgctgcccccatgctcctaacgagcttgcaaagaggagcacgtgggagcttgcccttccttggtctgccgagcagctcacagcaggacattgggttggggagcagtggcgaactccagcggtctagatgaagaatttgtagcaagcttgactgcttgaatagttgagtacatcgagcacaaattgatgggcagttgagtctgaccgtagggtgaggagcttgctgacctctcgcaggccaccgcttcgcccccaccagtgtgaccttgctgcttcgctgaacaagaaggttgaatcgacgcgttgccctccatgtgtgcgagctcgtcaagatgccgaatgggagtaaggaatcgcctcccgccgatctcctgttctctatgagcgagagcttgccgccagactgagctggacggatcggaggaatcactcatgcgccgtttcatctgtgcaaacggaggaattatctgtgcagctgtaccgaaaggggagaactgagagattgctttgagatcggtagggaacacgtgtcacgttttgaaacaaaatctttctgataaacataagacttcagtcctaccaaattttcttccgaggctgcctggacttggcaggacgctctcctcttcgccccacaagaagagcgcctcggcatcttgcgcgtcggccggacacaaagatttgtaggtcccacatctctcaaggactgaaagcaccgaaggaaaactagtcggattggcccagccgcagcagcccatagttattcggctcgttactgtgtagtcgttggagaaggtatacgcatcggaaacgattttgcgactctttgtgtatttctatttcgggccgagtttagttccaaacttcttctttaaactttcaattttttcatcacatcaaaattttcctacacacataaactttcaactttttcgtcacatcgtttcaattttgatgttaactaaccacatcctcggtacttttccgagaaacaataaaaatgctccattttggatgcccctgaaattggcaacatatatatcccataatcttcgacaaatgcatgcgcatccctgaaattggcaacatatatatcccataatcttcgacaaatgcatgcgctaaacaaacgtcagatgattgaaaaaacattaaagttacaatgttcagtatcaaatatcaaatacgtacattggtcatttcaaggaaggcttttttctaaaaaaaaataaacattgcgcggaagccccatggttaaactccatagctgtattgaagggactgtatcttaataaataaaattatttatttgcttcgaaatacttcaacatgtatataaaactttctccacaaaagtgagaatcatggtaactatgtcgtggcttttttttttaaagaaaacacacaatataaatgcacatactcataatgggcgtacacacccctataaacacacacgtacatcgtatctctattagcacctttgaaaggttaggtatatcactgaaagaatgattagctataaatgcgattttgtagtagtacctaggaaataaacaattaagtggtgttttatatgagtagcgagattttgcagctagaagcggaggtctcatcgtgttcactgtcacgccataattattttaggaattaataaaatgtttgtagaatttatattaaagtgggagtaattaaacaagtgaagttaatatgagaagtaaaatagcctttagtaaattgtggcaatactttactttccccatgtcatacaatactctctggagtttctcagaattttcggagcctaagatttaattttaacaaaacaaacatcattcagtaattatttgaaatgaaaaacaccctctgatcttaggccaattctagcccgtttcccgcctagtgccaccagtccaggaccatttggcccaatagtacttactcacatctaccacccaacatgggccgcagtcggtgggcctatcgaggcagcgtcccccgctcgttgcttttctcctggcatgcaaaagatgaaaaagatttgaaaaacgcctctgaaacaacagcatgatcagatgcacaaactcatcataaatcgaccgaaaggatagacgtactcagataattttttttctcatgacattacactgacgagcgaactaaaaccactgcaaacctaagcgacgagctactacaaggttacaacaaatgctccatcgaccaaaagacgagctagctaatttctacccattattaattccaaataacgtgcacgaacttaattaaaccatgcatcatccaaccaaaccactaactaaattggcgatatgcgtgaacgcacatctcgaattctccatgtcaatatcgatcgtctcatcacatcatcggcacgccggcggcgtcggcggcggcggcggccgggcacttgccgccggtgccggggccgaacatgagcgtgctcttggggcggtacacgccgcggacgcccttgggcagcgacgccaccctctccctctccagcgtgagccccagccacttgttcgacgggatgaacggcgccgcgcacagcggcgacggcgacgagcccaggtagacccggcacctgctccgccggaacacgtccagcctgtacaccatcaccaggaagtagccgttcttgtccgtcgccgtgctcgtcatgttcagcaccttgtccccgtagcacaccagctgcgccgtcgcatctgcaaaatattatcatagagactatgttagtcatggaaaactgttttaatcgctcggatgattgttcacctgtttgatgcatatcatctaaatagctataaaaactttttaaaaaaaattaattacatatattgctccacaaacatacaagttaaaatttaactttaataaattgtaacaaaaataacaaacaaaacttaaattactatatatatctccaaagtgaagattaattaatttctacatatgtaatgaaaatggtttacatctccgacatttgcctacggcactggatactaacttggtaggggagacgcgtccatgtagcggttgtagccgctgaggttgcaggacttgcagtagattgtgccctggacgacgacgaccggctggatacggctcggcggcgaggtgcgcggcggcggaggaacaggaacaggagccggagccggagctacatacctccccgacgcatgagaaaccgggaggagaattgcaaggagcagcgcggccatggcgcagtggatcttggaggacaccatcgttgatcagtgtaccgcacttagctcgagtggaactgaaaaaatgagcagtactgatcgagtgtgagagcccttccagatatgagctaatttatagacggagatggctagggtttcctgccgtttggagtaatttggttggtttgcttcatttgcgatcaaacaactgatagctgctaattgagattccatttggatgcatcgcagttaatgctgttgttggcttatgacagtagagtccgttagggttctaaacaaatgcatcacactactccagtacgctgctgcaagcatgaaagcgtggacgtctttgacgcctgtagatagccaacgcaggatcgaattcgtgaactgccaactgttctttacctggcttcatctcctgcaatttgttgtcacctttgatctcagcatcatatccattctcagagtttttgcttactgcaaatatcggcagaagatactactacacctgaccaagtgactactgcgtttactttgacagagtctgagccttttatcggattcaatccttacaccaacttgacacttctttaccgtgctcagttggatttttcgtgttttttttttacccctgaaagttttagatcgagctaggcagatagctgaagaagaagctgtacatagcttttcggggcgttaaaagtttaatctgatttgtcattggagagcgtggccagtactgatgttcgcgctgaacggcgacgacctgtgtttgtactcttctacatgaacgaactatagagtagttttttgagctgggtatttgtgcggagttgcttctaaggcaggcaagcctccctcctgaatccttgatttctggttctgaattcgttcatcgatcgttactagtcagtactctttttttcccactcagaagatgatctagtcactcgatcaactacttgtcacgaaatggatgcttgtagcagaggaaacgtgaggatatacaagtgttcacgaacagataatgctatcaaattcaaatgtatgcatgaactagggaataaactatatgtctaattttttttcagtaagtttgcctcgactgcaccagttttcagtcgagacaaaatttgactcaggttgactcattgagtgggcatttgggcctgcaagcggaaggcgaaaaggcccatctcggtatctctctttcattaggcaacccaacacgagacgggggccaatttacagtgctattgctcctctattgggactccaattgtaatgcaaaagcccatgaggttctcttttcgctgggctgaaagctcatgtagtcttgcaggagggaaaggctctacatgcatgatgcaactacatcaggacacatcaaacctaaaagaaaaaagaaaaaaagatttggagggagagacgtcattctaaacatttttaagaaaaaaattatgagcgtgttagaaattaaacacggaactatcaagtgcatgtcaggagacatcaaacctgtttttcaactgaaactttgatgaggaggaggtaattgagaagatgcttttcgctggtgatatatattgagcttgcaattgacggtgacctagatttcttgattgagaatctgggagaaatcatgaaatcatcaggagtatgtgcgccgatggaagtacgcttccggttgctat

SEQ ID NO: 76282 - DNA, 7446 bp, Oryza sativa
aattcctgcagcccatttgttttttttaatgattttgataactgttcttattctctgagaaattggagtactagaatttcaggaagcaccgaaggacggccagtttgataggataccttgtcatttgctgaaattaatgaagtttagatagtttggtagctagcttattgagctatagcaagtagtagttcttgcgttcgcataggccggttcccatcccgaacagttggcacgaaaaacggagcggtccattagtacatgattaattaattatttgctattttttttttaaaaaaaaggatcaatatgattttttaaagcaacgttcgtatagaaactattttttgaaaaaacgcaacgtttaacagtttgaaaagcgtacgcgcggaaaagttggaaacttagagttccaaacacaccctaagtgtagtcgtcgaagcattccggtatcgtgaaatgttgcccatgtttctgtatgcgaaccagtaaatttattttttgcatgaagattgaattatctaaaatcacctagatacctgctaactactagtttagattcttgacccaatcaaagttttctgaatttgctagatggaaatttgttttacagagttacaataattcagcaactctgtagcatctggcattcatttttttcccctttcttttgttaatttcttatgtaatacatgtacatttattccacgagccagcaacttgcaatcctacagatgattaattaattaaacaaagagttattgcattccgcaaatatcttcagccttcaggcaagctgaaaatcttcaggtttcagtatatcctattcgcaatcaatcaatcaaccaatcaatcaataatcttaattctgtgttcatttctcgatgaatccggtcatctggaggacgaggttcctgacgttgcggaggtcccgccctttgagcgtcctccccttgccggcgcacatggagtacgccgccgtccttcctcggagcctcctccgatcaacaatggcgtgcggcggcgcgaccataactccattattcatcatcttcttcttcacagcgtcgtcgtcgtcgttggtctggtcgaacatgttgtactcggaagcccacgaccgagaccgccgcttccggcgagaggcggcgatctccaccggagcagacaacgacgacgactccggcgagcccacaggacgacgagccaccggagacggcgtcgtggtgacaaccaccgcgccgtcgtcggagttgtcctccgcgggctcgggccacaggatgtcagcctcttggaattcctccatggcgtcgccgtcgccgtcgccggccgtctcctggacgacggagagaggtcggcgaggagacggcgagggcgtatttatatacggtggtgtgcgctgcaaggaggaggagaagaggaagaagctggcgtgtcttggtgagcaagcacaattccttggggagacggcaatgagaggagcggagcggagtgtgtctgtacgctggaaggaaccgaacagggttgatgtggagtgcggtgcaccttatcgtcggctgccacgtggatagcacacgctaatacagttgcgttggtcatttttgtttttgaacatgtgggtcattttagtttttactgtgtggcacactctcgctataagcccttgtgtagttcccaaatttttttcccaaacacatcatatcgaatctttcacacatgcatgtagcattaaatatatatatataaactaattgtacaatttgcatgaaaatcgcgacacgaatattttgagcctaattagtccatgattagccataagtgttacagtaacccatatgtaattaggcttaataaattcgtctcgtggttttcagacgagttatgaaattattttttttcatttgtgtcagaaaaccccttccgacatctgatcaaacgtcctatgtgacacctaaaaattttcttttcacaaactaagcagacgctaaatccctgagaatgtggagagagtctgaaaatgaactacagttttgttcagactgttttgatttgtgctaatataaggatttgattttctttttaaaataaattatctgaaatattatagcatgggtttaattgggttgtactccctccatctcataaaaaatcaacttagtactacgaatctggacataggatgtctcatattcggttctagattcgtttttttatgggacggagggagtatatattagcgaggatgaacaagttcttttgtgcaccacagcaaaacggcaaaacggcaattttagagtggtgttatgatttctgccaagtttaatcctacgctctctctaactaggtcgcttactgtgtgcccacgtgttgattaacaacgtaacacacgaggtggtattaaactggggtagtccagtttcctggtaaacccaacttgataaatgacaattttcacacggcaagataggtatttacaatccacggcatcctcagtgtttgatcccttttgatatactgaagcatgacaaaatttcccggaacttatttgttcaagtaaaattaaagcaacgagaccaattcaaatcgagctcccaaatcatcttcttacattttaattcctcattcatgatacaaatccagtacttccatggatgcatatacagcttcaacttcataacctgtccttaaccctcaatggcagcagcgcatgcatcatcatccttcgatgaacccggtcatccgcagcaccgagttgcgcaggtggcgcaggtcgcgcgcccgcttgcacggccgcgtccccaacgacgacggcagcgtgcacggcgccgccgccatctcctcctcctcctcctcctccggccgccgcacgccgaacagcagcagcaggtgcggcggcacgatcaccaccttcccgacgacgctgccgtggccgtcctcctccatgctggcaccaccgtatctccagttccaccggtgtaagcgcgctcccctgcaggggacgtccaccggccgagagtgcttgacgcgcggcgtgggcgcgcgtgtctcgtatggctgcaccggcggcgcaggcgagatcgccggcggcggcgcgtcgtcgtcggcggcgtcggtgtcaggccacagcacctcgaactcgtcgagctcctccaccaccatcgccatggcaaggcgtggcaaccagctgccgagagaaagagagagagagctcgcagctcagctcagctcaaactgaggcgcgcgccgcggcgtcgagcgcgtctaaatataccggggcgcgcggcttgcctgcctgatgggattctaccgcgtctgatcggatcggatcgcgagagaaattctggggcgacggcgaccgctcggcgggcgagctccacacgcgtccgcgaaagagaagcggcggtggggaggtgtacgtgtggatgccgcggccgccatcgcgccgcgggctccggacgcggcgaacggaacacacgtttcctctcgccggcacgccgccctgttgcagcgttgcaagggaatcgacgcgagccacttagtacgtgactgatcgcagtgtgcatggtttgattttttttgtttggtgatgaatttattaagcatgggttgattaattgggcccggggtcgtaatcaaggctgtaatcagtgagcagttgggaattgggatcgacaaaatgcaactagggatataggaatatacagtatatgcttctgttctgctccagtgcactactacgccagtacgtagtagtagttgcgcccgtcaacatcctcactattcatcagcatggatccatcaatgatcaatccgtgtgaacagccaaacagggcaattttggctctggtttctgggtggatttaggctggacgtgtttagttacttttcacaaaaaaaaattagagtatacggacacacctttctttgaattattaaatgtagactaataacaaaataaattacagatttcgcatgtaaactacgagacgaatctattacgcctaattaatccatcactaacaaatgtttattgtatcaccatattatcaaatcatggcgtaattagcctcaaaagattcgtctcacaatttacatgcaaactgtgcgattgatttttttcgtccacatttaattgctatgtatgtgtccaaacatttgatgtgacggaatttttggaagtttgaaatgaactaaacatatccttagttcttatcttcactttcccaactcatctccctcgtttttcacacacacgcttttcaaactgataaatagtgtgtttttacaaaaattttctatatgaaagtaactttaaaaaaatatttttcaaatttattttggttaatacttgattaatcatgcactaaacactgctttgttttgtgtgctagggagtaaggttcccaaccctcactcccgaacacagccttatccgtcttcccaacgccggagaaatacccagggtattttagctagattctcatggtgatgggctagacaatctggatttaaagtttcaccccttctaattatttatattaggtccttctctaatattcgcgtatgtcttcccaacgctgcagcagggtgtgaagtcggcagacttgctacaggcctacagctagtgatctccacgactccacctaacctaggttgtgtttagttccacgtcaaaattggattgaaagttttttttaaaaaaagttaaaagtttatgtgtgtaggaaagttttgatgtgatggaaaagttaaaagtttgaagaaaaagttagaaactaaaccagcacctaaacttaggccctgtttgattcagcttataggattattataatctagattattaggagtaagctgaaacaaacaagtagattattatgctagattattataatctataagccagattagtataatccaataatcttttttagaggagtttttttccagattattaagtggctaaatactctctacccttaaatgtctccaataatcccaagaaataaacaactcacaacttattttatatcagattattataatctagcttagagtaatctgatttaataatctagattacaataatcttaaactgaaataccttaaacctgcacggaaatctcgccgggtcaaggacgacgatgagggcgccacggacgatggaccagacggaattggggcagcccggggctggggcggcggggggcggagcttccgtagttgtcaccaagaccatgcgagatcaggtgagtcgtgatgtggacgagtgtcacaactcacaaggatttgttctgaaaaaggacgtccacatcacataaatctcaccacaatcagagccgttcaatcttgatcgaacggcgcagcagacaacgagatgcacttggtcttgatagtgcctaagcacaattaaagccgttcaatcttgatctaacggcataatatacaatgggatacacttgacagtacaatagtaaaatgtgtattgttataaccctgagtttccgtattctatacccgacacgttcctccttccaaatcttcaatagacattttcacgaaccaaatctgctatggtgtaaaaggaaataatctatggttttgctattctctccgtttcatattagaagacgttttgattttttctaaagtcaaacttcttaaaagctttatcaaatttataaaaaaaatgtaacaatatttatagggattaattcgactaacataacatttatagtaggatgttatatagcaatttcctaattatagtattaaattagttttaataaatctaacattgaatatattttaatagtttgtttgttctatattaaacctgttgttgtattttttttctttataaatttgatcaaactaaataagtttgacttataaaaaaacaaattgacttataatatgaaacagaggcaggatctcatttgtaacagattttttactcatatcttttgatttttcttctgtataatcttacataaaagatttatatcctgtagatccaacttatagttgcacccagttatagagcactttatactttgttacttctatatagtaattacactcagctacaatacaataaaattatattttacaactatttttgtctttaaatttacgatttttgacatatttattctttttttatttcattcaaaacgggttgtatctattggttggtaattccataagatttgagcctctaagttctacctaaagatcattagtagtcccataatcaaaggctatcctgtggcgatacgtttcatcccctgcgctgacgtatcacatgctcaatccaagccgctcaaatgtgatcgaacgtctcacggagtcccggagcgggttgactggttggttcctcctcctcgccgagtcgccgttgccgacttgccgtcgtcatcgagttgccgcccgcccgccgccggctactgtacctcagtagttcgcgccggtgcgccgcctcctcgctgccctagacgattgcccgatgcggcagcctcagccgccgccgtccactggcactacggcggcggattcagttgccaccgtggccaaatcaaaggatggctactcatcagggcgcctccgccgccggccatggcaccctgccctgttgccctgaattatcactggcacggcaatgtccggcaacgctgcctccgatgtgcagcgggatgatcacggcgacggcagcatggagttacacatgccgacggcgacttcactgtcggctgtgcactctgcactagtccactactgcagaagttcagagccatatcatcctgatctcatgtttagtcagatcttgcaggccgcaggttatagccctctggtctgtgacctaggctgatcctgcggtgcaaaataatcgatcgaacctgttgattcagtgaagcagattgtgccttctctgctcgctcgtgtcaatttggccgggcacagtattgggatttgaggaaggcgtcaacattaagtttagtttggatcaaaaaattgctttccagtttctcttcttttctttttttttttacatcttcttgtcttgtcattctgtacataaactctttctatataggcgtgaattgtttatgattatttcgttatcaaacatgacaggaaacaaagcaacggttgcagcaaatgctatacaattcagacagacagcaccatcaaaagaacctccttttcaggcttgaaatctctgggaagtgatcagtagaatccttggaactcaattgtcaaataatctcaaccaaatctaatgcagaaattttatttgtacaaagttttaatgctgaaactttgcttttttgcagatgaatatatctttccccacagtatgtgcaaatgtgcaatcagcatctccattgcaacagttacagtatcttgagagttgagtgagttgccacccttgatttcctttccctagtccaa

SEQ ID NO: 76283 - DNA, 549 bp, Oryza sativa
ttgtgatagggttgtctattggatcacctaggtttaggtctagtcgggtggttctatttgcaatggatgaacaacaatagatgaatgaacaaagagggagtgagaggatttagggttgtgaccagtcgttgttgaggaagaggaagtccggccggccatcgtcgttgtcgtcgcgggcttgacgtggacggcggcgacgatgtgctcggttccgatggcggtgatgcggttgcagcagcgacggtgtcgacgacgaggcgtggcgcggcggtggacttcccgtcactggctgcgccccctcgatcggttagggtttatggggtggagtggcggcggcgacaaacctcgttccttgtgtcgttgtaccgtcccgtcctccacccctctttatatggcacagtgtgacgggggcccaccagccattgggctgggcgcccccgatcacggcgcgggtcaaggcccccttgatccgttgggctcaaggggagggagatccatctaatattctcccccttgatctcactaattcctttatcttttctattccat

SEQ ID NO: 76284 - DNA, 19920 bp, Oryza sativa
  unsure (1)..(19920): unsure at all n locations
aacggttaaatatatgctaaaaagtcaacggtgtcaaacatttcgaaacggagggagtatgtcgggtcctaatcgtgtgggatatgtatgatagaaggccgttgaaaaatgatcgataaaaaattaagaactaatttataggtaaaacttttgtatttactcatgatttaaaatccaatagtagtagcttttaaattttaaattttggttgtgcaggctgataaaatatcaagaaaacgacgagggacgtttttttgcacatgatgggtgtagacaaaaaattgtgaagcggagataataactacagaaaattcgagattttagcattattattgatttattgtgtggctcaaatgggagattagaccggagaaacaatgcatgccatggtcaagattgagcagagtccatggtctatatgcatttgttttttgaactgtggtctatgcatatatacatccaaagactactaaacttgtgttacacggttttgaacttggacaagtatatacaagcatgctaatagccagctagtgcttctagtgtccaagacacagagtttcgtcaccgtggagtttaattaggtctaaatttaggtcttcatggaacattccgttaaaggtgccttctttagaccaccttggttaaactaattttacaaattattacaatggctaaactgattaatctaatgttatatattttatctctttgagaaaactaaaattggaccgcattgcaagctaactagacgttttttttttgcaagctttctctattaattcaaaatatgtaggtcagtggcggatcgagaaaatcgatttattgatgtcataatatgtctattggtgttatagtatgctaattatatttagatcatgatgttatattatatggataagcagtttcgctataggttttaccgaaatttgtcggtgtcgcctgacactagatccgtccctaatgtaggtctcaaagcattctccgcttttcgtttttttccctaaaaagaacttattttgtactgtacgtggtttctttgcacttaattttaattcttttgttcatgttctattttccaataatcgcacccctaaatgtccatttttctctttgatttgatgatgactaaaatgtcttcacgtacgacttctactctcgtctttgatccatagctagtacacaaaggggacaagaagaagttgaataatccctttttgataagatgggtgaaaagttaagctgacgttgttgggttaggcgtgacagataaatgccaaacagagccgctcatttcgtaaagatatactacttgacttgaaatcacaagtacacaccaaggacaaagctagatggttagtgagatcagcagtcgagagaaaagacaacttcataagtgatattggaagataagtagtttgaaatctgaacctctgaacatggcatgaaacttcagaacagtttcgtgttgtcttcaagcttgcaaagactattcaaagttttcttaaatgaaaaaaatatattctggccttctggggttcatgagatcgaacggtaggcacggcacaggtgtgtatcatcatgcgaagatgatttgattatttgattgttaatcacgcttaccaagtgttcctgccattcagattctgttggaaaaagcagaactacttctcacaactttctgttctgaacatcagaacatggacaactcatgctagagaacatttgatggagttgcaggggctggagctttcagttgaacttgtctctataaaatggcagttgaatggggctgaaatattgcaactgaaacagatgattttgctgtgaaggtaaaggagtttaggaaactgaatttcatcttgtcagtgacagtttaaggagttcagtttgctccaacatcttacctttggagcctcaaccgatagtggctgcaaatatgtggagatttaggccgcgttctaaactgggtttcagctgtactaattcatcgtttaaagtgagcaccctttccaaactgataaacaatatgttttgtggtaaaactttatatagataagtttctctaaaaaatcaaatgaatccatttttaaagtttacaatagataatacttcctccgtttcaggttataagactttctaaacatctatataaatgtggacaatgctagaaagtcttataatctgaaacggagggagtacttaattaatgctaatggcttatattattttttctgcggctaactagctatcctaaccgctatatagagcgcacccttacttggctagacatcgcatccaaaatctttggcagaacgagaaaagatttggttctctgtagtatctcatgttcacttgccaaacaaggatagtgcagagcagtgatttttaacttctgttcttctaactttctctgaagaaccttgcttggaagctgaatgtgtaagtaggatgggaccaaatcttcagcagttaataagtttcagttaagcaattgattactagttgtgaaatcttgaggacactcttgccaataggtagaatgttagcttggaattggatggagcaacgcttcactgatgaaacctggttctcctcatgcaattctcagcattcagtagtaatcatcaatcaagctgctaaacagaatagccatggcagttactacctcagtcctaaaatatataaaaatctataatcaaatgagacattttctagtatcagattcgtattactaaaaaaaatattccatccgatactaagttcttatatattttggaacggagagagtaagtcggaatgcatcaaacggatcccaatgaaattgatccgaatctacgagagcgcaagcgaatattactacagaatatcaggggttacatgcaaaaagttcttcttcccattcccctgaaactgaaaaagatttggcacgaatcgaaccctccaatccattgcttgcccttttttgtgtcctccagcttctagaaacttctagaacccaagtaagtccaagccgccgccgccgccgcctacagttgcttgcaagccgcattggcccaggtaacacgcccgcgatgtgctggtcattctggtgttgataggaattcacagttttgatctctctgctccattctgtagcctccaggtttggcgctcaccacctgttcgacgaaatgcggcaagagggagcagatgtgcgcggcagccacaagatcaagaagacgactgctgatgtggaaggcgggggtgaatggatcaacgccctcccggaagaggtcctgcagcacgtgatgtcgttcctgccggcgaagcaggccgtccggacctgcgtcctcgcccggcgctggcgccacctgtggaaatccatgcctgctctgcgttccatccatggtatctgaacaagcacgatgtcaggaacctgaacaggtttatgaattgtttgattcgctaccgggaccgcagaatgccactagatatgtgcgagatcaaaatcggtgcttttggggagggctgtggtgaaccacaggttgactcacttatcagatatgcctctgttgcgcaaagctcggataatgaaggtcgaattgcatgagcacaacgataactttttctctagccaagctgcctcttatctcccagcgcttgacgaggttagagcttagtaatgtgccattattatgtggttttgttgattctttgagcttcccagcatggaggccctatggatgaagttctgctatatagacggtgagaagatatcgtctcagtcacttaaagagctgaccatgattgactgtatattttttcgccaatttcggatttctgctccaagtttggtgaggttggaaataactgattgtgtgggtaaagctcctgtgctggaaataatgccatctctagtaaaggcatttatcaggttccgagactctagagatatttgtggtaaagaagaatttgggggtagttgtactaatgctagctgtgataattgtggtgctaatggtgttgacagtggagattgtgtgcttctgaagggtatttcaatggcaaaaagcttggagttggtagctgaacctggtgcggtatgtttttgcctactttgtgcttaattctgttgttgtgtatgatcgactgtttgtgttgtgctatctgtatcgttgttttatttgtttagtatatgtattctgtaaattagcacaatgtggcttatgtgtgtggctaccgataagatatctttaatgtcatgctacatcaaggtggtttatctgtgattactagtataatgtcttgtgttgcaatagatcccaactaaaagtctgaaaaataaaatactacaaatgaataactatgctcaaatataaaacttacatgcatttgtgtatgagaccagttggctacctatgtatactcatctgcaaaaaaattacaactgagaaatctctaaatatttagtatttacaacaagattttcaagtgggggtgggtgtagagcataccgtcaccccgactccctcttctaagttctgaaagctgtgcactaacactatctgtaaggagcatacgctgtgcaatcatgctaaggtccaataatcaaactaaaattttctgaaaaatatcccggtgtactccggcaatagtcaaatactccgtatcatcggttattcagaggagaggaaagcactaacaaaaaaaaattgactagtcaacaggctgcagtcccaacaggatctctgccacgtgtctatccgactggcttaactccaaccgacagcagcagagcagctgcactccggcgaattcgggttaatctgcgtggacgccggcgtcagtcattgagcctgatacgcttcgtcaggccagggaagcagaggcggtgcagcctctgcgcgggttcgtcgtcttccaggctcggagggcgctcgtagtagagcccaactccggcggcattgtcgccgccgcgtcgctcctggaactgcacgctcggcgcgcgcttgacctgcgacaggtgctcgagcaccttccccttggtgacctccgtgctgctcgacctttttctcgccgccgtcgctgtcgacgtcttgtaatggagcttgttcccctggttcttgtacatgagctcgtagccgtggctgggtatctctatgtcgtcggggagcttcctctccttgccgacggcgaccgccgtctcgtagcaccacgcggaggcgacgtggttgatggtgtagccgccgccgccgacgaggagcagcggcaggttgaacccgcggaggaagctgacgcactccgcgtggccccgcaccgacagctccatgccgccgaggcggtcgccggagagcgagtcggcgccgcactgcagcacgatggcctccggctggaacacctccatggccttgcccacgatcggcttgaacagcgtgtggtacacgtcgtcgcggacgccggcgtccaggggcacgttcacgctgtagtgctcgccggcgccgtcgccgatttcgttgatggcgccggagcccgggaagaagtccttgtggggcgtgattttgccgtaccggtggaacgacagcgtcatgacccggttggagtccaagaaggcgttctgcacgccgtcgccgtggtgcgcgtcgatgtcgacgtagatgactcgcctgaaggtgccgaggagctcgttgatggcgagcacgatgtcgttgacgtagcagaagccggtggccttgcaggcggacgcgtggtgcatgccgccggaccagttgatggcgatgtcggaggcgccgtcgacaagcgcgcgcgccgcggcgaacgacccgccggggtagccgcggcagtacttccagaggcggtcgaaggcggggcaatcgtcgtcgccgccgatgccgtggtcatcctccgccttctgccgaagcgcggcgtcgttgaagtagctctccggggtgaggtcgcggaggaggtcgacgtactccggcgagtggaagcggcggatctccgcctccgtggcgggtctcgtgcggaggcggcgcatgtcgccgagcatgccgtagacgccgacgaggctgtgcgccatggcgacgcgggcgggcaccatgacatggtcgtcgctgaatttgatgtgggcgatgccggggtcgtagtagtagcacacccgccgcttcttgtcatcggcgcacgacggcgacggcagcgagttcccgccggtggccatcgctccaagttccttcttggaagatcgagatcgaacagaatgcagcaatggtgcagaaatctcacatggatatacaaaagggacacatgagtctctgtccgagtcggcaacgaaaaccgtatcgtaaacaaacaaactagctagtcgagataagttttaacaaccagtatgataaccaattgagaagtaccgtgtgctagttttctgtaaccaattcgatcaaagctgtatttctatgagcttcagcaagcaacagtgttagtattaattcttgcagacccaaagcacacactttcagaattcagataaggacttcagcatggacgtcgtcagctcgatcaatcatctgctagatctctgaacttctcagactgaatcctacacaagcacgaagagcatattagttcagataacctttggcatatataaaaaaactttgaattgcatgataagggactttgcagttgataaaagtatatactatagaaattattacatgctcccgattactaaggctctgttcttttggttgagttgggaacccatccctccggtacggaaaacgaagcagtccattagcacgtgattaattaattatttgctaatttttttttcaaaaatggatcaatataatttttttaagcaactttcgtatataaactttttgcaaaaaacacaccgtttagtagtttgaaaagcgtgcgcgcggaaaatgagatgggggagttgggaactccaggaaacgaacagagcctaaatgagctgtgttttctcctaacagaatcattgaagagtatgatgttgaaagtataggtataatgaatgccaaagtacgggccagttcaggagtgatgtactcaagtcgccaatgattcatttatttggtcatgcacaccagttaatggaatatatatgttcctcataattggacgcaatctagttgccattgttttaatgagtgcatccaataggtgcgaaatgtgcaagacaaactagacaataagatttgggtatcatattttgattggtttctagcaagaatgaaacgattagaagaagatatttgttncnngtccaacaaaaagtacctcgaggtaccggtatctcataatgcccatcatgcccaggtagatccaacgatcggaaacgatttggtaccgtgagataccggtccctcgagatactttttgatggaccggaacaaatctcttagaagaaaacatgaatatttgagacagtcttttagtaatcaaactagactgcatgattcattttaaagttttcgatccactcaaggagaaattactttaatccattcatcgtataaacatgaatatttgagaagtctgttagtaatcaaactattcatcgatcagccctaaagttacagttcgtatcaaactagcctcccgtagggtccctcgctagtaagtactagccgtgagacgtttggaggctaggttgaagggaggagggactagaaccttcattgcttaactaaataaaatagaatactatcacttttagtgggatgattaaactcctgagaattaaaatctaacttaaagaaataaatttaccaagacaagcattcaaactaacaaaaccaatcgtatcactaataagaaaaccttccaaggccagtctttgtttacttattgataagattgctggcttgctgtttatttgcctgagaggaaagcatctctcatgaatcgggctggtcagctgtttatggtaaaggtggttcttacagctgcacgcccacacctgtatatcaaatgattgatatggatctcccaaaaaagggttctcaaagcaattgataaattacaaagttagttttctttggaagggccagagcaggtaagtggaagcaattgcctagttacttggccagagtagctcgcctatccaatatggtggtctaggtattcattatgtaatagttcttgaatgatccctaaggatgagatgactttggctccaaaagaccgatctgtcaagaccttgggatggtttacagtttgaagtacacctcaatgtcagggcaatgtttttaattaccactgttactcttgtcggggattgcagcaaccaatgttttggactgatcgctggttatatggctattctattgctgaattaagcccctcttttatttgctcttatcctatcacaaggtgtggagactggagagtattcaataaaatcagcctacaaggacatttttgtctaatcaattctttttgccccttggaagaaaatttagaaatgagtgaaatacatggccggtccctaaacttgtgtggtggtgtcacttaggtccgtgaatttgaaaattacacgtttaggtccgtgaacttggtttaatgtatcatccaggtccaatcgtcctttgactgcgtttgaccaccaacgtggcatgtcacgtaggcaacacttttgctctcagccccctccacatcataacacgtcacatatatcttcttgtaactatatagtgacaccagaatcccaaaaaaaaaaaaatcctcaaatcattcttctccttgcatgtatagaaaatgcgatcccgattagcaattgccattgctctgcattccaaaataaccttatccttacacaacgggcacttgatcaacaccaccttcttccagcgacttcaagacgaggacgagcttggagaatccatggggatgcctagcatgcaagccgtattacgctgcctcccgctactaatccgaccgcattgccccaccgctaaccctgctgcactgcgctgcctcctgccgctaatctcaccgcgaggccgccacagccgctacctctcagcctccttcccctaacctcaccgtcaaaaccctagccgatttagggatattttgagggatttgggttgaaatgcactggacagggcaagttatgtgtgaaggtgtatgtggagggggctgagcacaaaagtgttgcctacgtggcatgccacgttggtggtcaaaggacaattggaccgggggtggtacattaaaccaagttcacagacctaaacgtgcaattttcaagttcacggatctaagtgacaccacaccacaagtttaaggaccggccatgtatttcactctttagaaattatgtacaccacttcactgcaaattctttgtttgattagcaatccttagttgatgtcggacggtggacaggatgcccaaataagaccttcctcacccggctgcttgtcccctttgtgaccaagcggatgaaaccattcaacatctcttgatttcttgggtttttgctcatcatgtctggtttgattcttttctgaagagaggtcactacggtaccagtgggttccctacctggtggcgacattcattgaagttggttgacaagcaacaaacgaagggcctctaactgatcaggaagaaccgcaatgggtgtgtttctgatggagagtcccctagtgtcagtactattattagggctatatcagaggaggctgccctgtggagcacagccggagctaaggagcttaggctgttggcttgcgttaggagatcaggtttcttcttggtcatggttttagatcggttgtggcatgtcttatgtaatatttgtaagcttgaactggttatgtacacctatatattagaggggggaaaaagaaaagaaactgacactcacatcatcagtaaccactgtgccccgcatgacacccttccaggatcttaggctcataaacccataacattcagaattttaatgtgaataagctttaattactcctgcacaaatctatgtataagattaagaactactacaactgtaatgcttgactctccacttctgaactgttgctgacctctgctgctgaactattgctgaaccgtaatgcttgcttcatatttataatgtaaatgtaatgctgaacgattgttgcaataaaattaatgcatagaacattctacatttttcttcgtatatatgggccatttggccttttcatattcaaccaacatttctagatataagaagatatactaacgagagaattaggaagattcacaatatttaagttgcaaggatggattttcagtatctcaaacctggatagtgattttgtcaggagaaacgccacaggcattcaagatcttgaaaactttgtgaacccattcttcattccttaaacatcttactttgactctttcaaggttctgaaactggaccaattgtccaattgaactgctactttcttcaatttccaccatatcttcatggccctagagcagacaaaatatatcttggctcaatcaatcatggatgataaccgaggtaagtaatcactatgaaattagaatgcatataccttataaagttgaagagtgagcttctccagaattgatgtttgttggagaaagcaaccaagagcgcagaaattatgcccaacgacccatccatcaagaagcaaagtctttaacttgctgaatgtggggcaccatgtcaagtcttgcttcaaaatacaatgtacaaagtaagatggaacatatcattttaacatacaacacgacatgaaactgtacattggaatggatagaccttttaagtaaattcaggacgtaacaaaacaggcaataaggatctctcgagtctcgacagacatagacatattctagtcttaaaaatactgattgaagtcttgcaaaaattaccagagatctaaactatctagtgttccacctgataccagaagcataaaaaccataaaaatgcaattattcacccacccacccacacaaaccaacttgcagggatgtcctcaaataggtacaaggtaaggcaggacagaaatccatgataacatacaacaaattatgttttgagtataaagctaatgaatatgaacacacacgtaccatcccagcttcagctactaattccaaatttgcagcatttgacagacctctgaaaaacttatacttgacactgccatcaccgtcaggatcaccatcacaacaaacacatgtaccaggatcatatctgcatttccgacaaccccaagacaaagtcccaaacttcacagatgctgttactagcaatggcatgctttcaagcaaaggaatcgagccgtaattatcacccaatcgtagtgaaatgagacctgggacagaaatacgtgtgctcatctcgaagttacatttggtgacacagagatgctttagtgactgggacaccatcttgtcagtggaaattttgcatgattccgccgggcggagcggccgagcggagcagcgtcgccgctgccatcggcccttgcgccctcttccttttctcttctcctctccctccccttgagcccaacggctcaagggggccttgacccgcgccctgatcgggggcgcccagcccaatggctggtgggcccccgtcacactgtgccatataaagaggggtggaggacgggacggtacaacgacacaaggaacgaggttagtagcngccgccactccaccccataaaccctaaccgatcgagggggcgcagccagtgacgggaagtccaccgccgcgccacgcctcgtcgtcgacaccgtcgctgctgcaaccgcatcaccgccatcggaaccgagcacatcgtcgccgccgtccacgtcaagcccgcgacgacaacgacgatggccggccggacttcctcttcctcaacaacgactggtcacaaccctaaatcctctcactccctctttgttcattcatctattgttgttcatccattgcaaatagaaccacccgactagatctaaacctaggtgatccaatagacaaccctatcaatggtatcagagccaggttagcgtttagtttggttcggggatagacatccacagagaagaaagaaatccaaagagaaaagcaaacgatccaacggatcaaaaagatcgaaaccctaaccctaatcttacctcgtcgccggccgtcgatgacgccggccacggagggggggaggggcaaagaggcaccgccgaggagccactcgacggccgcgcgcgcacccgcgggtgcacgcgcgcgccggcgagggggcccgcggcggcgccgccatctccgtttttcggccgccgctctctctcacacggtgggggctagagacggtggagggagcggagaagagaaaaggaagagggtgcaagggccgatggcagcggcgacgctgctccgctcggccgctccacccggcggcgcgctagagaaaaagtgggcgcgcggcagcgcgaggtcgccggccatggcgcggcggtgcaagggtcgccggcgtagatgacgccactcggcgcggccgcacccgcccgcaagagagaagaggctagggtttcggccggccggcggctggggtcgggtttttgtccctccgatcttagcgcccggccgtccgatcgaaaccctagcgatcggacggccgacggcggccgggccgaaagcggcccaagtggggagcgcgcggcggcggctttcccggcccaggcccaggttgcggccttgggggaggggagggggcgctcgcccgcgcgcaaggtggccatggaccgaccggcaaaggccggaaaagttcaatttaggtccctcggggccgaaagaaaaagaaaagaagagtttaataataggtcctctcagaagctttttcaattatgtataattattgtgattatttctaagcaatttgaaccaacgtgaaaattgtttagagaatagataaatgtgagaaatgcttctgaacatgtattttgtatattttcatgcaaattacaatagaactttgaattgtttttgcatgttttacctctgtttaaatttgaaccaacgggagaattttacagagagtaaataacagagttttgttattgtttatacgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatctcaggtggctactccttgatgggttacattaaagatattccgaccctgaaaggagataactacgaagaatggaaaagagaactcgaccttgcctttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacaattgagccaaccatattgggctcaatcccagagtatgacactgtctctaaatacctcgaaagtataaagagccagtttactggttcttcaaagttttatgcgacacagctgataaagcagcttgttacagagaggtaccatggaggtggtgtaaaagaccacattcttaggatgagcaacatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaacaacagtttacagttgagacaagatcagtgtctacactgcaagaagacaagacattccaagaaagatcatcctgacttcctgacagtgatcatggcaaagaaaggtgagaacattattacatttgtaaagaatctcattatgattggttattctagatccacatggtggatttattctggagcaactattcatgtgtgtaattgtttaaagggattccgttcaatgaggactacgcaaagaagtgaaagatccattagagttgctaatggagttgaagcaaaagttgaagctgttggagattttcacctagaactcgcgaatggcttcacacttttacttccagatgtttttatgtccattctttgcaaagaaacttgataataagtgtatccaaattggattctgatagatatgaaatggcaaatgtgaactatggtataataatcaatgtattggtcttgtgttgcaagatcagctttatttgttatctctttctgagaatgtgaatgttgtgtcctcgttgacaaaagaaaagaaaagcgaacttctgatgtctcatcgaaattatggcactgttgtttatgccatatttcgagggggagaattgagagactggttaagaatgtagttcttcctccattggagttctcagttttagaacgatgcatacaatgtatagaatgcatcggtgcccaaaacaccgtatgagctatgaatcctccgtgtgtggggaagtcctgcaaaggataaagtatttaacccaaaacagtaagctgccattttattggctattctgaaagatcaaagggtcatcgtttctactgtctaaacagttatacaaagtttgtagaaacgagacacgccatcttcttggaagacgaaatgattagggggagctcagcaattcgagaaattgatcttgaggagaggcgggtgtctatacccgctccgtcgactcaggaacctttcttctctctacctgctaatgttgtgccagcaatgcatgccgttgcggtaccaacacctgttgttatctctcctgtggcaacaatgaatgaaagtgaggaacctgttctacaggattcaacagaaattattgccacatcagaggaggagctgcaacagcctcaaacagataatgtgccagaataggaggcccctagaaggcctgaaagagtcgcatatggaggatgatcccatctcatatgaagaggccatgagaagccatgaaagatgaaatgaaatcaatgaaattaaatgatgtctgggatttagaagaaattcctaaaggagccaaaacagtaggctgtaaatgggtctacaaaaccaaatatgactccagagggaatatagaaaagtttaaagtgcgacttgtggcaaaagttttcacgcaaagagaaggcattgattacaatgagacttttctccagtctcttgtaaagattcctttatgattataatggcactagtggcacattatgatttggaattacatcagatggatgtaaaaacggaatttctaaatggtgatttgaagaaaaaaagtatacatggcacaaccgaaaggtttcgtcatgaaatgaaacgaaaatatgggatgccgtataaagagatccatttatgggttaaagcaaagcttcgagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgagagacctccgtgaggcttcatatgttttgggcatagagattcaccgaaatagaacaaagtatgcattgggattttctcaaaaggcatatatatagaaaaggtgttgaagaaattcaatatgtacatatgcagtgctacacctgctcctatagtcaaaggcgaaaagtatggggcatcacaatgtcctagaaatcagtatgagctcaatgaaatgaaaataaagccatatgcgtcaactgtaggaagcctacagtacgctcaagtgtgcacacgacctgacttggcatttgttaccgggttatttggcagattgcaaagtaatccaggcctagagcactggaattagtaaagattatttgcaaagaacaaaagcctcatgctgtcttacagaaaatcagaatcgctccacatagtggggtattcgaattctgactttgcaaaagataatacaaagttaacatcgggggatacatgtttaccctggcagtaggagctatttcatggaaaagctcaaaacagactaccactgcagggtctaccatgtatgccgagtttatagcatgccatgaggctacggggcaggtgaactggctaatgaagttcatacccggttttaaaggtggttgatagtattgagaaaccactaaagttatactgcgataaagaacccacagtaatgtactctcacaacaattagtcaagtggtgctgccaaacacattgacataaagtactatgttgtgaaagacaaagtccgggatcaaacaatcagtctcgagcacataagaacagaaaggatgctcgcggatccgctcatgaaaggcctacctcccaacatgttcaaggaacatgtagcatgcatgggttttaagggaagccttatgaatcctggactatagggcccaaaagttaaagtatctgtttctgaatagagatgtgtatagtggctgtcgaatccatcggtaattaaccgtgacgatgaaacatgctctatatgtaaatctgtgatggaatagaaaaagctaaaggaaatagtgagatcaagggggagaatattagatggatctccctccccttgagcccaacggctcaagggggccttgacccgcgccctgatcgggggcgcccagcccaatggctggtgggcccccgtcacactgtgccatataaagaggggtggaggacgggacggtacaacgacacaaggaacgaggttcgtcgccgccgccactccaccccataaaccctaaccgatcgagggggcgcagccagtgacgggaagtccaccgccgcgccacgcctcgtcgtcgacaccgtcgctgctgcaaccgcatcaccgccatcggaaccgagcacatcgtcgccgccgtccacgtcaagcccgcgacgacaacgacgatggccggccggacttcctcttcctcaacaacgactggtcacaaccctaaatcctctcactccctctttgttcattcatctattgttgttcatccattgcaaatagaaccacccgactagatctaaacctaggtgatccaatagacaaccctatcacaaggtcctccaatgcaggtaagcttgacagatcgtcaatgaagttagtctcagtcctattacgtttggtgatgcaaagacgctttagtgactgggaaaaaatattgtagggggtggaaatcgtacagcaattcatctgaaggtcctccagtacaggacagtttgagaaatcaagagcatggttgtccagctttacagaccgaagctgtaaggtggtcaagtgtttagagatgagaggcatgctcaattccagcggggctaaatgttcagattgaacgaggaccctgagcacccgagccttgcacatgagcgcatgcctgatccatagttcagcatacttgacctcgtagatacaaggtctgggcatcatggtaggccagtatgtgtaggtctggaactcgagctcatcaagaggcaccgggtcgcgcaagagaagaagattgttgacaaacttgttgaacctctccacacccacccatctgtgtctgatgcgcagcacgggggcggacctccaaaggttgcgccagcggcgggagagcagacacgtccacacggcctcgtgcgctggtaggaaggagagaacattgtggaggatctcgtccgggagggtgctaagccagtcttcgccgctgttctcctcggccgtgagtccctcgcgtctcctgccgccgtcgcgcctcgtagccattccgtcgaacaggtggcgagcgcccttgctgcgcaagagcagagaaaggtgagacgtccaaaaaagccatcacggaacaaagagaacaaccgagaagacacactcgcctcacctcagtcgccggaagactcgctctccggtctccgctgccgccgccgccgcctggtagggctcgtcgcggcgtcgcccgccgccgctgatcgatggagcgccgagcggatggttgtgctgtgtgctgtgtgcagtgtaagcttcacctctcaagacttaactgtcaatataagcccaaggacagaatacggcccatgtgtgtcagcctcgagtggaggcccaagacctggatatggcccacgttagtaggcctagagtggacgcccagtttatctcgggcccaagacagtccgaccatgaacagcataagcaagacaggcctagaccagtagaaacccaagattgatttcagcccgtacgttctagtaaattgaaggtctatattgtattcctcaacatgttccatagtccgatttgctgttggctccctataccgtaaatccgtaatacaagcaacaacaccttcctcctccacatcagtacaagttcaatttgactccaatcatcttgggaatatatttgtggatggttttcattcgacgcggcacctagtgctgcttacgtgctactacaatcaggaaggaaaatataaaacaagttacacgcataggccgaaatgacaagagcacatgggcctgaattaccaggaggcgctgtttcaccgattaaatcaaaaatgttttactaaatctttactattataaaaattgaatatgttttttctggttctttgatatgccatctgtgtatgagtctgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttctgggtttctaatctggaaaaatccagtcccccctctcagtgggcaaggtcctccttttatatcttaaggggataccacatgcaccatttctctcttttttgtggggacttaccccaccttttcataaacagacggagacttgtatggttgccgtccgaatgaccttctaatgggacggcccatacctacctccacttccgccggaagcaggcgcgacgtggaatcgtggctgtctgctgacgacatgaccggtattagaccagtcacgtcggtcattcttgtccaccacgtgtcagcttagcaatctacatgctcgcccttcttcacacaacatcttgcctgtaatggtttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacattcggcgtgacacgctcagccaaaccgcaataaatgtgggtaggtg

SEQ ID NO: 76285 - DNA, 14188 bp, Oryza sativa
  unsure (1)..(14188): unsure at all n locations
ggttaggtgagccccactgtgctcacctaacccatacgcggagcaaaaacccacgaggggtcggggcgcctcggccctcggggccgaggggggtgcggcccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctgaagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtacaaaggcactgaggaagggatctgtttccttcctttcgccattattccccttgtcttcgccgcttgcgccctaactccttctttcctgtgccctaccttcgccacacgcgctcgctcttaatcttctcttcctccggcgccatggcacggggttccgctctgctcgatggtagcgtgctgccgccttcccggatcgtgagcgagaggcaggctgggctgtcgcgccgcttcatgccggaatctgccaccggccgggagatagtcacgctgggcgagggacgcccggcgccagactacccggggcggtccgtcttctttctcccctttgcaatggcagggctggttccaccattttcttctttcttcatggatgttctggagttctacgatctccagatggcgcacctcacccccaacgcggtgatgacattggccattttcgcgcatctgtgcgagatgttcattggggtgcgcccatctcttcggctgttccggtggttcttcactgtgcagtcggtgtcgccgccatcggtagtcggtggctgctacttccagccacgggggccggtgctgaaccgctacatcccctgcgccctccgcaagaagtgggacgactggaagagcgactggttctacactcccctcgccgacgaagcgcgcctccgacttccgagccagcccccggcgcaggcctccagctggcgggcgccggtagatctgggggatggctatgacgccgtcctcgatcgcctggcgggcctgcgatcccaggggctcacaggggccatggtgtacggcgactacctccgtcgtcggattgcaccgctccagcgacgcgctcggggcgcctgggagtacaccgggtccgaagacttcacgaggacccaccagggagtgagatgggactgggctcctgaggacttcaagatattggtccaatgggtgctgaatctcaactccgtagaggcggccctcattccccaaggaatcctccccctctgcagcgatccagaccgcgcctccatcctgaccattatgatggcggtcggggcctcagaggagcgagctccaaagggccacgacggcgcaggcgggagccgcaggggggaacaatctaccccgagagggggtcgtgcttctgggcccgcgacaggggcccggggagcagccgccctgccgacgcccgggggaagaggaagcagggaggaacacctcccccatctcctccccgagggggcggggcggcgcgtgctagtaacaggcgcccggagggggccgcgccaacatcgcagcccgagggggagcacaagaagaagcggccccgtaagatgggggagacagaaccatctcggggaaacctcatttcccctccaaagtggtcgtttaaccgaccccctcgcaggttcgtctctcacccatcgtggctgtattcattctctcaacgcgagttttcactcacccatcttgtttgtcttctggttttttctttcgtttcagcgagatcccgtcgcgtctctcccgccattccaagtccggccagtctgaggccgaggatccggcggccgcagaggccctcaggcgggaatctgaccggcgagaggccgcggatcgcctacgggaagccgaggaggccgcccaggaggccgcccgggctcgccaggccgaggaaaccgcttgggaggaggccgcctgggcccgccaggccggggaagccgctcgggaggaggccggatttcgccaggacgaggcgatggcgacttctgaggcagctcgcgacgaggccgcgggcgcgtcgcttgggcccactccctcaggcgacactcaggcgacaacttccggggcagctggcgacgaggccgcgggcgcgtcgcttgggcctactccctcgggcgacgctcaggaccaaccgggtccgggggacatccccgagtccggcacttccatcggcggcccgagccgcgtggcatcctctccaaggcggctcttccccacgccttctatcgccctactgaacgcagagccccttctgcaggccttggccgccgcaaacaccacggtgttggatgggttaagtgcccaggtggaggtcctgcaggcagagcgggcggagctcgacgccgcgtgggcgcgtgtcgaagaggggcgacgctcggtggaggccatggtggaggtgggccgtaaggctcaccgccggcacgtctcggagcttgaaactcgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagctcgacgccgcccagggggtgcttgacgctgccgctgcccgagaacagcgggcggcggagaccgaagcggcgtcccggcggcgcgaagaggcccttgaggcgcgcgccatggcgctggaagagcgcgcctgcgtcgtggagagggatctggcggaccgcgagggcgccgtcaccatccgggaagcaacgctggcggcgcacgaggctgcctgcgccgaagaagagttcacgctccgcctccgcgaggacgcgctcaccgaacgggagcgagctctcgagggggccgaggccgcggcgcaacagctggcggtcaacctgtccctccgcgaggcagcgcaggaggagcaggcgcaccgcaatctggaaggtgcccgcgccgagagggccgtattgaaccaacgggccgctgagcttgaggcgcgggcgaaggagctggacgcgagggcgcgcagcggcggggcggccacgggcgaaagcgacttagccgcccgcctcgcagctgccgaacgcaccatcgccgatctgcagggcgcgctggactcgtccgccggggaggtcgaagccctccgcttggcaggcgagatagggcccggcatgctttgggacgccgtctcccgcctagattgcgccggtcggcaagtgggcctctggagagggcggaccgtaaagtacgccgccaaccagggaggcctcgcccagcgcctctcgaagatggctggggctctccaacggctccccgaggagctcgagaagacaattaagtcatcctcgagggacctcgcccaaggagcggtggagctcgtcctggcgagttaccaggctagggaccccaatttctctccatggatggcgctggatgagttccctcctgggaccgaggaccgcgcgcgcgcgcaggtccgggatgccgccgaccatatcgtcgacagcttcgagggctcggcccctcggcttgcgttcgcccccaactccgacgaggagggcaatgccggtggtgcagacgacagtgacgtcgaggccggcgatccgggcgcatcggattgagcccccagacccccgccattcttcagttttttcttcttttctttcttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggcttgtgcccaggttctggtcctcaaaaggcgcgggtcggggctagtgcctggggagatccacatgtcgagactggccaggccgggaacgtggtgaccgagggttatgggtgacccgattgtgggtttttgccgattcccccccggagttcaccacgcctcggggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttatagaaattcagatataagagagaaataagaatatgcatatgttgtagcccccggccaaccctgcacgcccgaaggggggtgcggggttggcccgagcccgaaacctgactcccgacccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgattttgatcagcctcgcaatacatggtagcccggggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcgatcgcgacatacagatactcaaacccgcccggggcccgcctaaacggtcccaggatatcgagtccccagacagcaaatggccacgaaagtggtatggtctgcagggcctgggccggctaatggatttgcttggcgtggaattgacacgctctacatcgccggaccaggttgaccgcatcattaagagctgtcggctaatagaaaccctggcgaaaagctttaccaaccaaggtgcgcgaggcggagtgggctccgcattcgccttcatggatatcggcaagaagcacaacgccttgttcccgaggaatgcacttcaagaggattccattagccgcgcgtcgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacaggcctcaggggccggtcaggcgcatccgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatacgccgtacttggcgcacgtaggcgtccatctgcgggtcagagcactggtactccttacagacttggttaacgaccagctgggagtcgcctaacaccaggaggcggcggatccccagtccagctgccactcttagtccggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggcggtgtgaggcagctgcgaggggtccgcgctggcctcggggatcgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactactgtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttatcttctgtgctgatgacctcggggtcggaggataacaggggtggccttcccacagtggcttcggggccgtcctgggggtcgggggctcctggcgtcgtcggaaaagcgggcaaagggccaactccggtcgtcaggggccttaggcctccgttaggctcgggggcctcttcttcctgctctttcccgggtcgggtcagcacagggttagcctcggggtcgaagggcgataggtgcggccttcccacagtggcctcagggccttctgggggtcgggggctcctagcactgtctgacaagcgggcagagggccaactccggtcgtcaggggccttgggccaccgttcggctcgggagcctctcctccctgctctctcccgggccaagtcggcacagggtggggaagcgtgaaatgagaattgttctcatcgcgctccacaaccaatgccgcactaactacttgcggggtcgccgctaagtagagtaacaagggctcgtctggctccggggcgaccagaactgggggagagcttagatacgccttcaactgggtgagggcattttcggcttcctccatccaggtaaacggtccggagcgtttgagaagcttaaataagggtaacgccttctctcccagcctcgatatgaaccgacttagggcggccatgcaaccggtgacgcattgcacatccctaagtttgctggggggcgcatccgctctatagcccgtatcttctcagggttggcctcaatgcctcgggcagagaccaagaaccctagaagcttgcccgcaggtacaccgaacacacacttatcggggtttagttttatgcgggcggagcggagactctcaaaagtttccgctagatctgagagtaacatttcctggttgcgcgtctttacaaccaagtcatcgacataagcctcaacattacgtcctaattggttacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgtgaggcagggggtaagaatccttaggacatgccttgttaaggtcggtgtagtcgatgcacatccgaagcttgccgttcgccttgggaacgaccaccgggttcgccagccactccggatggatgacctcacggatgaatccggcttccagaagtcgcgccacctcctcgcggatgaaggcttgacgttccagggcctgccgccgcactttctgccggaccggccttgcgcccggccgcacggtgagacggtgctcaatcacctccctggggaccccgggcatatccgccggtctccatgcgaagacgtcagcgtttgcccgcaggaaggagacgagcgcgtcttcctatttgccgtccagaagaccaccgatccgtgtggtcttggacgggccgtcgcccagggcaacctccttgaccgggacctcgtcgcctgtgatcatccgttgcctcggggtggcgggggcggaagcgccaagcctctcgtcgccaccctcgggcttggatgcagcggcgaggtggtccgcgcgctgctccagacaagcgagcgcgactttgaggtcgccatggacagagatggggccaccggggcccggcatcttcatctgtaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccggtaggtcgatgtgacctaacggccacgtgtgccccggcgtcacaccgataattggctgggacggccggagcaccatccccggggctttgatggcgtcaaaggccgcaggggaaaggatgttgagggccgctcccccatcaatgaggacacgccccaacttcacgttgcaaacggtgggagaaaccaccatcgtgatctgccctccccgggcaacgcacggtgggtggtcggtctggtcgaaggtgagggcaacctccgaccaccgcgcccgacacgtcgcctcatgagtaggggccgtggccagaagctctcgcttcatggccttgaagctccggcgagaaacgtgagcacacgctcccccatcgacggtggcaatggtggccccaggctcttggaaacctaggtcatcatcgccgtcatcgatgtcctcgtcgggggccttctgcttggcctcacttcgccgattaccggaaggaaccgccggggatttgccctctcggcgctcctgcctcctctcctcctcccacttcctcgtccgctcagccaaacttttgactgcacggcagtccgcaaggtcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtttggggctccttggaggcgatcttttcaagcatgcggttgtgccgcacaccccccctgaacgcgtaaatcaccgcgtgcgcagggatgcatggtatggtgttgcggacttgacagaaccgctgaatgtacaagcgaagtgactcatcatcccttcgctgtactgcgtgcaagtccgcttcctcacctgggcgcggatatgtgccttggaaagttcatggtgaactgttggcacaaatcctcccaagagtggacaaacgcgggtggcaagttcattagccaaccccgcgcttgtcctttcagggccatgggaaagaaattcgccatgaccctgtcgtcaccccgggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaactgggggcacggagggctgatccccgcgtccgtggtgaggtgacactccggacgaggaggcgccctccgttgcgtggggagcacgtcggccattacgccggcgctcgatactgatgcgagcatccggttccccacgcagatcttcccgggtcggaggcgttgacgaaggagtggcggccgaatggcgaacagcggctgccgctcgccgcgccctccgtcttgacgatgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtgggtgtcgaagtcacggatccttcggccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaagagtgcgagagctcagaaaatccctcgcagagccccctacctggcgcgccagatgacggagcgtggggctcctcaccgggagaccgcgcaggcccccctttgccggttcggccgggggccctgggtgaggttctaagctcttggtctgtggaaagttcgcgagagtgaaatcacacaagacacgggcgatgtatacaggttcgggccgctgagaagcgtaataccctactcctgtgttttgggagatctgtgtatgaaggagctacaaagtatcagccagcctctcccttgttttgggtttctaatctggaaaagtccaatcccccctctcagtgggcaaggtcctccttttatatcttaaggggataccacatgcaccatttctctctttttttgtggggacttacccccccccttttcataaatggacggagatttgtatagttgccgtccgagtcaccttctgatgagacggcccacaactacctccactttcgccgggagcaggtgcgacgtggaatcgtggctgtctgctgacgacatgaccagtatcagactagtcacgtcggtcattcttgtccaccacgtgtcagcttagcaatctacatgctcgcccttcttcacacaacatcttgcctataatggtttaggatgaagcctggcatatatctgaccaggactaacgtgccatctctgggaggtaacacgctagctccagctggggacgagcgcctagaagccctcgtcctgacgggatggggcgaggcgtgcatcagatcgcctgtcgccacctaacccacgatctgaccggtctgtgactggtcacagaccggataaacgagtgcactgcactgcgttacatgcggcgtgacacgcttagccaaaccgcaataaatgtggttaggtggggccggctgtnctgacctaccccatacccggagcaaaaacccacaaggggtcggggcccctgggccggcggggccaaggggggtgcggcccaaccccctcggggggactaagaggagggcgaatgcatcaccctcgggcccgacgtccctcgggggtaccaggccacgtatgcgattgtgtctgcctcaaacctctagtcatgatactcctgatcccatgtcaccgacaacatgcatatagaagttaatatgaatgtggatgcatattaatatgttaagtcattcataacgtgtgtttcatatgaatgtagccaatactagaatgatttacattatgaaatagagggagctaataattaattaataatgtactaaaggattgctctattttccgtgtgtaccgttccggttatcaataccagcgcctcgccgcctacagagcgtctgggggaagccccccgtttcacccctttctcctcctcctcccccaaccccaaatcatatcatatatcccagccggagttgtattgacaatcgacactttttttttccaattttccttaaaaacacacacatgcatgcactgtaacaattattaaaattcttaataaaagtgcactggcatatgtgtttttttaggaaaacattggcatatatgttgactacggaagaagttcagatttgaaccctaacgcttgaagtcatgcaccatctaatatgatatcacatcagagatgttcaccgcatcatattaactttctgtggacgtatctcataatcactggtgctagcctccaaacaaagaacagaacgcacagcggagtgcaaaggggcccaccgaagatgaccaagtagacaagattggacttcaccaggtcgacggtgatggggaccccaatcttcgcgagcaccgtgatccccatcctcctctgcagcacgtacgcgcagatcagcatccgcaccacctccctgttcctgaacagcagcgtgccggtggtgaagacgcagacgcccaccgccgtggcgcgggacaccggggccagcaccaggtacaccccgagcgcgaaggccaccagcaagctcctcgtcgacttgcgcatccacgacagggagtgcttgaagtacctgtgccggatcttccagtccaccgccgccgtcccggcgtagatcaggctgaacgtggcgagcatggagcaggtgaaggccaccgtcacggcgtacatgaacgcgtcgaaggcgtacctccccgacagcgccggagagcccgcgacgacgacgacgttgccacggccattgttattattaccatcgccagccgcgtagccaccgggcggcgagaaagccgccgcgaacgcgacagtggcgacgaggacggagccgacgcccaggatctgcgtcgactccgtcattttcttggactcggcgatctcgtctagcttgggtacgtactgctgctggaagtgatcgcgccggatgttgccgctgagggctttcgctaccaccagggaccaaagtatccacgttcgtgcgttctgcatcaacaaattactaaattagatgcaaaatcatctctaattaaagggacttactatgtttcagttgattggttatatatgagttggtttagagactagagatgtctataacaagggtaattttaatatctctgagaaggtactaagaggtaccatatttctatggtaaatttaatacttctaggtattaagtaaggtactaaaattttgatatctcaactgtaaaattccccctatataacaattaaaaaagaaaaaaaaatatccaaatactcctctaaactttagatagaaatacttctacaccctaaactttaaaatcagatctttgcaaaaccattcatattactccctaaggtggttttgtatagttatttttatctaatttttatataaattggatgagtttgatcacatggcatacatattggacacacatgtgtgtgtatgtgtatgtatgtaggtacaatggtacatacgtatgtagacagctctattaaatggagaggcaagtaacattagaatttagaaattaccagtcaagcgaaagtgatttaccgttttgtagttaagcccagcgggaatggtacaccttgagaggtcagccggagtgaggccgtcgttgttggcaagatccaagcaaaccctgcgattccgcagcaggtagcagaacacgttgaggacaccgctcgcgaccgccaggtgcagcgcggtgttgccgtcgtcgtcctgcgcgttgaggatgggcgtcgccagctgagagccgtcccgcctccgcctgtcgtcggtggcgaatcccacgatctcctccctcccccggtcgacggcgacgtggaggaaggtcctc

SEQ ID NO: 76286 - DNA, 7722 bp, Oryza sativa
cacccccacccccctttccacataaactccccccaccccatctcctctcccccctgaataacatcggcgcctcccaaaagcgaaacctcgacgccacacgcgcgcgcgccatcatgcctgtagcctccgtcgtgctcctcctccacctcctctccatggcggcggcggctacggcggcgctggccatggaccccgccgagagggagacgctgctgctcgtcatggaggccgtctcctccgaccgcgagtggcgctccgtcggccctgacccgtgcggctccccgtggcccggcctcgagtgcaagcctgtgccggccgccgggaacgtgtcgtcggcggcgggaggctgcacgtcacgcggctggacttcggggtggcgccgaacccgacgtgcaaggacggcgcggcgttcccgcacctcgcgttcgcgcatgccgcacctccagtcgctgttcctcgtcgactgcttcaagaacccggcggccaccacggcgttcacgctgccgccgtcggccaacctcacctcctcccgcctgcagcagctcagcgtccggtccaacccgtcgctgtccggcacgctgccgccgcagctgtccagcatccggtcgctgcaggtgctgaccgtgtcccagaacgcgctcatccgcggcgaggtcccgcagggcatcggcgagctcaagagcctcgtgcacctcgacctcagctacaactcgctcaccggcacgatcccgagccgcatcggcgagctccggagcttggtcggcctcgacctcagctacaactccttctccggctccatcccgggccagctcggcgacctcgccatgcttcagaagctggacctgagctccaacaacctcaccggcggcgtcccggccaccatcaccgggctgacatctctcaccttcttggcattgagcaacaatggcctaagcggccacctcccggccggcctctccgacctccttgacctccagtacctgatcatggagaacaacccgatgggcgtcccgttgccgtcggagctcggcgacattgcgcggctgcaggagctccggctggccaactccggctactcggggtcgatcccggagacgctcggccggctggcgagcctgacgacgctgtcgctggagaacaacaacctcaccgggaggatccccgccgggctgagccggctcaagcggatgtaccacctcaacctgagcaagaacgggctggacggcgtcgtgccgttcgacggcgcgttcctcaggcgcctcggccggaacctcgacctcagcggcaacccggggctgtgcgtcgacggccgcgccgtcttgcaggccgacgtcggcgtcggcgtctgccgccgcgccggcgacggcggggacatcgcctccgtgtccgccgccaccgacgtactatcagttggcacattgttcaggcgagatggacaactctggctcgccggcggccgctggtcagcgctgctgctcatccggccggtcgccgtggcgctgtgctgcagctgctgccttctgctctgagctcgcggcacgcgcgcgcgtggtggtttgatctgtatgtaactctgctatgttagtggtagtataacttgtcacgttaattgcgagaattccgaggcaagggaaaagagtttggtagtgttggggtacttctacacttctacagtacttgggtgtggattggattggattggcacgttggtttcaaatcgtcgcgccggttgttgggttggggcccggatttgtgatcggtcaaagttagcgtccgggtcccaggggagttaggctgtgtttagattcaagtttagatccaaactttagtccttttttatcacatcaacctgtcatacatatataacttttcagtcatatcatctctaatttcaactaaaatttaaactttgcgctgaactaaacacagccttatggtaactggctgtgatttgtgcgtggccgatctggccataaatccggctgcgcctgcaatttgcaagcagttttcaggcactctgcagcctgagctctgccctgcttttcattgcttgccgctgtataatccaatgagtgttatgcccctcattgccttaagtaagggaaccagatgcagtggtcaggtgatcatgtactccagcgttgatgtctgaactgtttgtactaactgacagtatggcttgtctatagggatgcatgaacaaagtaggagtatgtgttaaccggactatttctcatctgcactggaattttatcatctctttggttctttctttaactataaccacggttcgggcttgatgtccgggaagatggaagagttttgaagtcctttgggaggtgctgagagttgcaacgttttttgagctagggagtactccacgtagtactccaagtagtactagtgcatcacattaccggctactggacttcaccgtaaagatctcaagcaaggcttggtttagtttccaactttttcttcaaacttctaatttttctatcacatcaaaactttcttatacacataaacttccaacttttccgtcacattattttaatttcaatcaaacttttaattttagcgtgaactaaacacacccgaagaaagaaaaccgtgtgacgagaaaatacggcagtactgtttgtactgtacggagtaagagtagtacagtactgtactcctaccaaggaggaaagagaagtcccgtgtcctgtgacgggaaaatacatgctgaggagtacctggcaatgtacaaaatcattggtgtctatgttcagcgtgcatggacatgaactgttgaaaaggacagtgataggataagtgattgacatgataaatgtacatcctgccggggctatacaacaagcttgcggtagctaggggcatggcgtaaacctgaaagattgttttttaaaaaaacaagagtaaacatcaaagcgatcgattgatcgaagtgataatatgaaaagaagaaagaaaatcggttccctgcaggcagtaggatcgatcctgaccatgttagcactactgccggctggatactcctagatcgatagataccctccatggctccatgtaccgaaagcgagcgagcgggagagagagagagagcagagagcagagagcagaaaccagttgtcattagctgaaaatgacgaggggaaaatggacgagtgattaacgcacaattaattactccctccatcccctaatatagtaaactagataggattccagataattatcctaggatgggtctagattgttatagtctggacgaagatagtagtaagtagtattaattattttaaattcagaaaataaatttatttgattgcttaagaaaactttgatataaaaagtctctaaaaagaacgtactaccgtatactccatccgtttcacaatgtaagtcattatagtatttctcatattcatattgatgttaattaatttagacatatatgtctagatttattaatattaatatgaatgtgggaatgtttataataattgacaagagttgctcccaaacagctcaaacaaaagtagcctaaaccgtcccattcttataaagtatgtacacatatcttaactactttaaaagtacgattgtttctcttcctcttcttaaaaaaaaaactgctccctttatttcgaataaaaatcactaaaattgtggtaaaaaaaaagccagtgcagccattctccttgttccctgaaaaacccactcaccatcataaaaaactccctatagaaaccggtaaaaaaactacccttaaaaaaaatctcataatcccgttactacttcaccgtaccgcatcgtatgtgtagcgtgtggcttggggcctctcctctcttacgccgtgtaacggtgtaagctcgctcgctcgctcgctcgggacatcgccggtgaaacatggcgtcgattgtagaatatgcatgcacggtgatgctacattctctactcgcgaaagaccaccactcacccatcgcccatcggcgcgcacacgcacacggcacacctggtgcgcccgtgcgggcgcgggtgagccgcacaggaaaagagagcagcagagcgcggcacagtgcctcactgtgccgcctgcgcgcggtgcgtgcgcgcgtgtcgtgcacttgtgctgtgccctggtcaaagcgccgcgccggggaacagcaacgcaagcaaagcgagcgagcgcgcggtggtgggcacaccaaggaaaggagtagtacgtactgtacgcgcgcggcggccgggccgtgcgcacgggcgcgcacctggctctggctggctggctggctggggttctctgcccgcctcacgtggggaggagtcgcgagcatgcagcgacgccctgtagcgatggatggatggccaggacggctcgtctctatccgagacctgggaaagggatggggtattggggtgtcgtcgtcttgttgtgtgtgccttttttgatgctacgcgccacgcatcttgcggtggttttgggagcctcggccggccggccctggcgcctggcggcctgggcttttgcaggaaatgggcggcacctgagtcgtcgtctcacctgccgctgttttggagtacatttgtgctacttgcacaagaaaattagccgtactattttgtgcacgtgatgtgtttgcgcgtgcccagtggctggcggtgaacgaactggtcacttgtacaggccactcaggcgaagttgcagagtacagtgagccattctacatctacctgtctactctcattgggcctaaaagatatcgcaacaagaaagagagcccacagcaaatcacgcctagtggaccttaggagttaggagcccgttcagcccagaggaggaagcagatcataacgcaccggggccttccaaaggtagcgactggctttccgtttgtcgttacaccatcgtcatgggccttatggcaatggcacagtactgtactccctctctcctctctgtctcttacaaatttaagatttgattttgctatatctcactcgaaagattttttcttatctctcactcgattttctcactcaaatttacagtgtattttcttgtaagttacagtgtaatttataaaacttatgctgtaacttttgtaagttacactgtaatttttgaatcttcgcatgtaaattttaaattttgtattggatttggtctttttcttgaggatatggtaatttagtgttcattatggtgtttcttaattgctttttgctttttattatatctatcggattttaatccaaatattaaaaatctgtgtgatacgatcataaaaatctttcgaaagatgtataggtactccctttaagattaacatgatatattctaatacaacgaatctggatatgtcaaattcattgtactgtagtactaaatcatattcagttatatattcattttcttagaatggaggaagtagtactactctgtccctaaaaaaataaactctagctaaaaatctgggcacgcatgtgtcatctgtccagattcataggtatgattttttttttgcgacagagggctacttctctagttttttttttatggttgtcctagcctattcttctctagaagatctgcgtgatctaaacaaggagtgcaaagacaagtgcaggtagactcagatcagacgtctttgcacgctggtacttgtagctggattgctggaagcttgctcagggcacccgcaattcgacccctacttgagtggcaactgagaaaccttgatctcagcttttcttgttaatattttcctgtacaatgcattttttgtggtggttagcagtgtagtattaatataagagagaaaaatcttggatttgtcaccttattaaggctgtgtttagttggggaaaagaaattttttgggtgtcacatcagacgtttgaccggatgtcggaaggggtttttggacacgaatgaaaaaactaatttcagaactcgcctggaaaccgcgagacgaatcttttgagtctacttaagccgtcattagcacatgtgggttactgtagcacttatggctaatcatggtctaattaggctcaaaagattcgtctcgcgatttatagctaaactgtgcaattggtttttctttttgtccacatttaatgctccatgcatgtgtccaaagattcgatgtgataggtgaaggggaaaatttttgggaactaaactagccctaaggtagtactactagcattgtaaagtgttttgatattattgaacgtgtgaaggatggatcttgctatagttctgcagccttttcccaacagtatatgcctgtgctgtccaatcatgggaagggaataattggggcgggacaagccgttggttttgcacgaggccaatcgcgttgctctccccgcccgttgaaagctcatcacggagaaaacttgcgagttactctcctctcgagctactcgcaacttgcaatgttgcaacagattgtgcgcgccggcaaagccatcagcccatgccccatgcccgttaccgtgccgtgtcaccaacaaatcaaaccgagcgccaggtgatagccagaggccgccgacctggcctgacaccggtgggtgggtgtgtgacagtgtgagaggaacaagaggaattcgcgtgaaacatcgccaaaaaacgcccaaatttctcgtgggattcgtgtgaaatccgagcaaaactcgcaaaaaccggtcgactcgtgcgtgcgtgccctaccccgtgtcggcgtgtctcgcggtgtcccaatgggaccatctctggtcgttgcctgtcgtccgtctctggttaccatgcgacgcgacgcgatgcgaagcgacggctcgcgtcgcgagtcgcgcgacccaccaccgacccggcccaccgcgagcgagcgcatctccgcgcgccacgaggccgccgctggcaggtgggacccacgtggcccaccaccaccacctcctcgtcctcttcctccacctccccccctctctctctctctctctccctctcctcctcctcctcctctcctctctcccgtcacgggcgcatctctctctctctctctctctctctctctctctccccgcacagccgcgccgcgccgccgtcgccttctcgggcgagggcgaagagcgagggctcctgctcgccgccgcccctccccctcgtccgcggcgcgccggaggtcaggtaggagccccccccccctccgccatccctctctcgcatacactctcactcctccctcctcttcatcatcctccaccacgttgccggcgcgaattggcccgagcgtttgggattggggacgtgggaattcctcccatcccgtcctgcttctcgtggagagagatttcgcctgcggatggattccgtacgggctctctctccgcgccgccagatccaggaggggagttcgtgcccgcgatacgctccagtgggcaatccggtttcgctttctgtaggttagctgggcaggcaattttcccatgaattgatttctgggattggggggcgagtttcagtcatctttttccgcgggataaattgatgtttgtttttgtgttcctaccgcagtaagttaaactatgcatcggtaactcgtcgagatccattgatgtgctgtaatatcgtacttaatactcctgatttgataatagctatgaagattttgtgtctcctaaagagcacaaaaatgttaatatgcttcgactgggacttaggtagaa

SEQ ID NO: 76287 - DNA, 14654 bp, Oryza sativa
cgagatcgaggtacgaggtgtgtggagggactacgtgatttgcttggtggtggagtttgtggcttgcggggtggccattttatagggggtggatgcatatatgcatggttgaattgaaccgttccaactttgaaaaactagatggcaatttttgcagtgtactttctagccaggaaagtttggcgcacagtacaacgaagacttgaaaccatgcattgacttgtctatttcaattgtgcttgcagaaaccatgcattaattattcgaagtggactctaatttcctttagtctttatatactttgtactacctctctctctgtctttggttctaaaacacggccgggtggttgtttcagacttgtgcgcaatagtaataactagctcccggctagcacctaaataaaatcatatatttttagtatgattttacttaaaatttattaaatagctatctcattgtcttaagagtttgaaagaccaaaccttatcatccccgtgtttttaattatatagttttttaaaagtcacaccagttgctaccccttatgtcatctccttctttatttgcttgctcgatctaccactatttttattcattctccttagaaactttaaaaattggatcttatagtttttagagttttttttgtcacgttgggtttcgtttttataatttctaggcgtcccgtcaaacattgccattatactcctctatagtccgtccactatctcttctctttattgtcattgagattttaaaaatcgaacataattatcgtttgggttcatttttactttctagaagtcccgccaaaccgtcagcggctttgccattgtacttctctacgcctcgcccgctgcctcccttctttattgtcattgagattttaaaatcgaacatgattatcattattttcttttactttttagaaattccgaacctttaaaaattgaaccttgtagtttttagagttgattgtcttgttgggttttattttttataatttttagaagtcttgtcaaacgatgccactatgcttctctacggcccgtacgccgcctactttttattgtcattgtggttctaaaaatcgaacataactatcgttggaattcatttttttatttcctagaagtcccgtcaaccgtcggcggctctgcaactatactcctatacaccccgcccgctgcttttcctttttattgtcattgagattttaaaaatcgaatataattatcattggatttttttttactttttagaagtcccggcaatcgtcttgttcatttgcttcacggccttcctatcgtctctccttttaatcgttattaggattctattttgtgttttattaacagtttttatatgtcgtatcaaccgccaccactctactccattataggcatgttacttaatttatctcgtcatatgttttaaatggtcttttcgttcaatagtctttatttttatcataaattttagttatttataaattgtattccaaattgaaatcttatttttcgttttgtaatttcagaatttttttttcaattttaattaatatcgtattgtgttcttttaatatttttattttttattttcaagagaaaagcccatgcgctacaacgggtgacaactattttagtcttattattgttatatggcttagttatgatgattcatcactgtgagaatttgcttggatctatatatttctagaaaatcataagctgtggttaggagtctgttcgtctaaagttagcatgcgaattttcttatacgactcctatatttccaaaagcggacgaacttaaaaccaactcaaaggatatatattttttcaaaagcgaacaaatttataaaccgactcatacacggatgacgtaccggcaaaaatatcttaaattttttataatagtagagattttttttaaaaaaatagtagaagtagaagagaagattacggacaaaaagtcctttttttgagggaatcgtacttttttaaggaattggacgtttttatttttttttatacggtagaagttttttttctctttttttattttttcttgcctttttttctccgcagatagtcggactttttttatggagtcggacgttttttttacgtagaagtttttttttctcttatttttttctgttttttttccaccggaggagtcagtcgtttttttttttgggtagaagttgttttttctcctttctttgttttttcttgatttttttcccgtcgtctctcttttttttttccaccggaggagtcggagtcggacgttttttttacaatagaagttttattttctatttttttaattttttctcacttttttttcaccggatgacggatatgtcttttcaaaaacaaaagaacttaaaaaccaacttatacacggatgacgtaacaaaataccggtaaaaacatattcaatttatataatagtacagatttcagttgtttcaaaattgtattcctacttgaactctcttttaatttttctaattttggatattattttattttttattctgaattttaattaatcacgtattgggttgttatatggattcttctttcaatatttcttatttttaattctgaatttcagctattttaaaattgtattcctactaggactatccttttcttttctaattttagattttagtttatttttatttcaaattttgattaatctcgtattgggttcttatatggaaacttttttcactattgcttatttttaattccgaatttcagctatttttaaattatatttctacttagattctcctttccttttctaattttggattttattttatttttattttgaattttaattaatctcgtattgggttcttatatggaaacttctttcaatattgcttatttttaattccgaatttcagctattttaagattgtacttctacttggactctccttttctttctttttttttactttttctccgattaatgtaggacgtggtgcctcctttcaaagctgttttaataatttaatagattaagaaagtgagttgtaatttgagtcctattttatcgttaaagttttgctttgaattatatttaaactatttgttttttatttggatcgaataataatattactccgtgtttagttacaaaataattcttcaaacttccaacttttccatcacatcaaaactttcccacacacacaaacttccaacttttccatcacattgttccaatttcaaccaaacttccaattttagtgtgaactaaacacatccttattattgtagtttggatcatcataaataaacttttctatgtatatatatcaacaacctcaaacaaatcggctccagcacaccgccgaactcctccatctatgtgcagtctatatatttgctagagtggaggctagacatagttagaaaaaatatttgggtgatccatatttaaaaaatagcaaaaattacctagtacaaagtagaaaaaagaaaagttgatttaagggtgtgtaaagtaacattttgacaataaaagatggctcaaattacaatttactcttaagtaaacctccttactcatatttggtgtttcagacatattaacacaatcatttaaatgtaactttgacatataattaatattatcaaaaatatctaacaaagttatgcttttatgatttatgttacttcaattttggcaaaattttacacttttgaagtttacttatccaatgtaaataataagtgtcttatgttattacactatataatcagaagctcatcttcaaggaagtaaaaccataccatctaaatgtttacaaagatcatcaagattatttgcatacgaaattctgatgatcaccacgtaaaagggcttccatggattaaaaaaaaaaggcagaaatgatgtagaaatgaccgtttgagggaagcacataaggaacacatgaataagaagatatatcgataaatgattttttacgagactagatctcatgttaaaattcatccgaaattccttctctctccgttttatattataagtcgtttgattttttttagagtaaagcttcttttaagtttaaataaatttatagaaaaatataataatattttcaatataaaacaaacatattattaaaatatattcaatagtatatttaatgaactagtttggtgttataaatattgctaattttttcctataaacttgatcaaacctaaaaactttgactaaaaaagttaaacgacttacggagtataatattaaagagagggagtatgtcctaagccaattcaaaggaactttgtagaattttggatagcgatgactttcgccccttttcccttttctcatcgaagtccgtattgtgttagtttcatcgtcttatctttgcaagcaatcgattggattggaagttattttcgaacgtcctaagctcctagctgtgcactatccctctatatgatctcttattaacttgtctactcagttaagtaatccatgtatgagcaacaaggacagttctaattaagaacagaagccatattcgtcattttctccgaaggagaaaacacggcctcaatacattgttgcctacactgctaagtaatccctccatgagaacaacctgttgactgaagttccatcgctggcttaccggttactactacgcaatgtcaattttcacacaagacaaaacgggtgaaaatcctctgcaagagatgaacagaacaggtccagccttttgtgtggccacaacttgtaccatcacgaactgcatgcgagaattcacgtgtaagtagaccattaggtccagttctgcagagatgtcgacttctaatttgtggatagaaactttcctccaccagttaatcgcaacccgctaatcagggatgactttgacatgatccattgatcagtgatttcattagctttcagctatagaatcaatgtatcattggctcatgtcagttgataattaagtagcaacgcggctgcatctgctttggacgcggtgaagttttttatggaatacgtaattacgtatgtacgaggcaaatgcttggtctgaacttaagaaatgttaggcgggacacgtaggtcacgtcccagtcaacttgttcaggccatggagcaaaccatacgtcgaagaagttgtagtgatccagacatagtcacatgatggagattggagagtctacttaagtagaaactgactggccagtctccaactggtgatactctgctcttagttttatttttttccgaaacaacccgcacaaggtaatgcgttgatatatcaggaaaaaagaataagtctgtagttctagaagactagaaaaaaaaagaaaaaaatagccacaccacgcatcaacgtctaatcctgctactgaaaacaaaacaagcacacgacacgccagaggaatagttcttctgaacaacgtctaaaaataagggaacaacgctaagagcgccgccgccgcccgtcctaaagaaccaggacatggttaatacttaaagaaaccattagaataggagaaatgtaacaacgtcccgagaggaatgcggtgacgcaggcgtcgccgttatcggcccgaaggctaggctttcgcctgtagtttcctactttctcatgtcaatgtgtgcatgtcaagttcaacagacactactagctaatcctcttcaacacgcagccaccgtgtcgacgcctcaccaccggccggccatcgaagaagcatctcgacctctggcgtgctccagattcatccacatgggtgggctggagaggaagagggtcagagagaagatgaatcccctctccccgcactagtccatccagtgtggccatcttgcgatggcaaatcgccgccgcaagaggaccaacacctagagaggagcttgtcgcagtcctcaacgcccctcttatgatgctaccgttgttgccgccatctcgaccaggctgcccgtgtctcctacgggccgcctggtcgcatcaccttcgcctccgtcctcccactgtgacagtctcgtcaccgcaccacctcaccttgccgtgctccaccatagcaggctcgccaccacgccggccatgttccactaatcgtgctccttcatgccagggccatcatcatggtcttccctctggagccccacaacaggtgtcgcactctccacgcgcttcgccggccacacgtcgtcgtgtcggccggcgccgtgcgcttcctcctgtcacagcgccactgtcgaactggatctgggagctctagatccggcaccaccgccactgccgccaccaccttctctccagctgccaacctccaccgccgtctgcgcccctgcattgggaatgccaaatccacttccgagagcgtcggatccattgcgcccttgccgatcgactctagccgctgtggacctgcaacgccatgcgccgctccgtcctctcgtgccaagggcgagcttcgctgggtcacgactcacgatgtcctcaccaccgccttcccagttggccgctcgcctttgcagcagcgagctccggcgacggcgaggcgttgagggtggatggaaggtggcgacgcaggcggctagggtttcgcccccgagaaatctgtgcaagagcgacgcggggagcggttagtcttagttttattattagcctgaaactctgaatgagctctaagtggtccaatgaacactgatcatacgtcagaattcatttttactgcatggtagatatgcatgcaaataagtgctttgatcattattcagagtagtgagtgcactgggttaaggcccagttgtctctgttcattcaatcatcattcatcagcctgtgtttttcgacaggcctgagttttagtacttatagcctcctgtaaactcgtttctgtattataaatacctatttgccttctcaatccgacggtagcaatcctgcctttcgttgagaaaggagaaaaaacacagttgcagctgtttctaaccctctcaaccaaaccatttcttagaagaaaaattaaggactgaatttcatctgaatatggaaaactgtccacacatctagaactcagcttaaaacaataatgttctgctacccattttctactgaagggaactcgcagattttttttccctctttggatgaaataatccttgtactagtaaaccacacattcagaatttccatctttcccggacaaggcaacacacggcacacatggcacatcttgaaccaagttaaattcgtcgacaccagcggcgtgatctacggtgcgtagaccaacgcaactgtgcgtggccacttgcaacccgtagaggacaagggcaagttggatggccagccaagatagactagagtgcacatcaaaatctcgattaatccccacgaagttgcagtaattcggtggctacaaagttggacacgaagcacgagcctaaagggctcaaatggccaaatggtacgatgaaactggaaagtgcaggagaagattcaaacacaatgaaatcgggtacttcatccctttcttcttctttttttcttccctatttgtatttcgtttctgtgtaagcatccagaaaaggaaacaccatgccattaacaatctaagagataaaaataattccatgactgcatacgcagtgtttcccattgtgttcatctaaaaacactcacctcatatattatctggtctggataaaagtgaacaaggttaagagggtgagaagccaaagggtttgtctgtgacagctgataagagcagcaagcaacaggcgattactgctttcttaaccaacaaaaaggattccaaacctgtaagataggacacatctgtcaagcaatatctatctatctatctatctattatattattaaaacaactttgaaatgacgcaccatgttcgttgtgggggttagaaattcccacattaatcggagaaaaagaaaaagaaaagaaaaaggagagtccaagtagaagtacaatttaaaaatagctgaaattcaaaattaaaaataagcaatattgaaagaagtttctatataagaacccaatacgagattaatcaaaattcgaaataaaaatataaaaatccaaaatcagaaaaggaaaggagagtccaagtaaaaaaaacaatttaaaaatagctgaaattcggaattaaaaataaggaatattaaaataagtttccatataagaacccaatacgagattaatcaaaaatcgaaataaaaataaaataaaatccaaaattaaaaaagaaaatgagagtccaagtaggaatacaatttaaaaatatctgaaattcggaattaaaaataagaaatattaaaataagagtctatataataactcaatacaagattaattaaaattcggaataaaaataattcccacattaattggagaaaaataaaaaaagaaaaaggagagtccaagtagaagtataatttaaaaataactgaaattcgaaattaaaaataagcaatattgaaagaagaatccaatacgagattaattaaaaattagaataaaaataaaataatatctaaaactagaaaaaataaaagagagttcaaataggaatacaattttgaaacaactgaaattgaaaataaaaaataaaaacattaaaataacacaatacgatattaactaaaattttttaaaaaaattctgaaattagaaaatgaaaaataagatatcaattaggaatacaatttataaataactaaaatttgtgataaaaataaagattattgaaagaaaagaccatctaaaacacatgacaaaataaattaagtaacatgcctataaagaagtagagtggtggcggttgatatgagatataaaaattgttaataaaacaccaaatagaatcctaatgacgattaaaaggagagacgtcaggcaggccgtgaagcaaatgagtaagacgattccgggacttctagaaagtaaaaaaaaatcaattgataatcatattcaatttttaaaatttcaatgataataaaaaggagaagcagcaggcggggcgtataagagtatagttgcagagccgccgacggttgacaggacttctagaaaataaaaaatgaattccaacgacagttatgtttgatttttagaatcacaacaataaagagttggcggcggacgggctgtagaggggcattgtagcatcgtttgatgggacttctaaaaattataaaaaataaaactacaagtccaatttttaaaggttttgaacttctaaaaagtaaaaaaaaaaccaatgataatcatgttcgattttaaaatctcaatgccaataaagaagggaggcagcgggcgagccgtagaggagtacaatagcaaagccattgatggtttagcgggacttctagaaagtaaaaaatgaacccaaacaataattatgttcgatttttaaaatctcaatgacaacaatgagaagagacagtggacgggccgtagagtagtataatgtcaacgtttgatgggacatctagaaatgaaacccaatatgacaataaactctaaaaactataaaatccaatttttaaaggttccaagaagaatgaatgaaaatagtggtagatcaagcaagcaaatagagaaggagatgacataagaggtagcaactggtgtgacttttaaaaactatataattagaaacacgaggatgataaggtttggtctttcaaagtcttaagacaatgaaatagctagatagctatttaataaattttaagtaaaatcatacttaaaaaatatatgattttgtttgggtgctagccgcgcaattgcgaattgagcgggccacccagctagttctgattaaaacagcacgcagaactggtaacaaatcagagacacggtaaagattaacaaagaaaaacagcagacgaattggccccatatcatggtgccatacctagagtgagctaaccagctaaaacgtacggccaaaagaaaagagagagagaacattgcaatctgcaaggcaacaaaacaaaatcatatgcagagcatgagcgcgtgacaccattctgagaaacgctgagacggctgaactattaatgtcacaactgagcactacatacagaggagctgtgatgacgagctggaatctcatcaatggcacctctggctcacacttgcatcacgatgcagagtcacggcggtttcagggatgggccagctcctacaagaggaaacctggatttggcccatgatgattctacaaaatcagctagtagtgactggtcagtgtacagacaaacgactttcaatcgccttgtacatccagtgtgcaaactgttccggagcagcaaacatcagtggtaggcccatcactgatgaagtatcacaagaaacaaaacgcatacagttgaacttgtcccttgagaccgcaaaggacaaaaatttagatatcacatacaggaagttgcgcgatgaaaagacatgtaacttatggcgctgcaaaatttatctgtctagacatgctgtaaggacaatagctcattcagtttatatggacaggttctaaggcctgcatcaagcaaagacattgtatgcaggttttgtcgaggcagtacatggctgaacttgagaattcagataaatgtgataaatagcatagatctatgcattgtttttaaagaaaatagaggtacatttgtaaacaggcattattatagagagagagagagagatcaacattctaaagattaattaatccaatgaaaagaggcaaaggaaattgcatccatcaggacgaatgtgggatgataagcaaaggagagcacattgcatgtgacgcaacaatctaatgaagcatgcatatattcacaaagaccaggactgccaacctgattccattggaaggcattacaattaagtggtaatatcaagccgaggttcaaagcaaaagccagtgaaaagctggagaggaaatcttttgctcacagggcattttgcggaccacttccactgcttctgcttcgtatcgaaagcaagcaaagcagttgcaccatagctttggatgtagacaaggtcgtctgtgccactgctagcaaatacatcatcaaactcaccaaatccttgaaataatttatgaggcattcgacctacctcttgccattgttttttgtgaagttcccatattccaattcctttgatgatgtcaggtctgttctgttttgcaatcccaccaaccagaaccagcttctccctcaagttaagcagacgtccacaggtgagagagcaaggtgctgggatcgacgattgcattagtgacgccttagaaggcccagcaataaggtcatacatgataatgctatgacgcggttcaatattaccaagaatgcctgtggagtgaattaaacagtacaatactccatcacatatcacgctgtcatcaccccctctccaaccaatgaacacctcctcaaccgcagtcacccatgaactactctgtgagtcatacttgtataaagagaaatcccatcggacgtaatcctctggaacttgcttgcattttgccaatgtaatggtgtaattatgagaggaacgatctacctttatggcaattgtgctgtagtctggaaactttgcaccagggggctccaaaattctcttacaatcttttgtgataggattagatacagaaatggcattcctgctgtcattgtccatgaaacaaactaatccgcaagaagaagagacaaagcaactgctcttatctatgcatggaagctctaaatcataccatttgcggagaatcgggtcatatgcatacccagcagcactttcattagaagtgaacataaagtaccatggcctctgaggcaacatgtgggtccaaagaaacctgcttgagtagataatgtcatgccatcttttgcaaactgctgttgaccttatcatgcttactataggtaaaaacgtgaaaattctctccaggatatcatcaggaacaacagtgtccaatgaaagcaaaaattctttgccttcatcgttatcctcggagacaattccgaaattgaatgcagaaattctaatgtgatcaatagaaagagctgtccatgaagaattatcttccatgacatcagtcatcaagtgtgctagcatagatgacctgaataaaaaaaagttatatttataggacagttgcaaagatcatttacctataaataaataaatggaaaataaaacgaacatgggatcataagctaattacatcagtatattatttcaagaaaagctcggttaatgtttaaccacaggaacaggaagttaccattgcctattgcagacatactaacacatgatatgtaagtacatgatatcctaaaccattttatttcgaaagcgctcaagctatgtcagttactattgcagcagaactcaattaccataatgttagttcatcaatcttctgtgctatctgtaaatggtttgcatgccgtggcacagttggagcacattatgttcctcctagtctcctacccaaatgttataaggaacagatcatataaaatatttccacgggccaccgtttcttcaaaaaaaatttccagttcagcggtattttccgtgcggtttaatccgtacaaaaaatcgttttcatatcaatccaccgaataaactctgaaataagatcatgctgaaccgaacagaacaagccgcagctactccagttagtgatggtacaccgaaatattgctggtttgcttttccaagcagaggctcgcagaatgtgcagcgacgaagcaatacattatcaacaaataccaaacgcaccgccgtcacccacagttacagcgcattagaacagcacgagcaaggccatatcttatcgaatcccacatttctcacaaagaaataaagtaaccgagttttttttttcttcttcttctaattttctcaaatggaaaaggaatagagtaggggagaatattaagtgctcgtacttgcacaagcctccgccggcgacgtctccggcccctcatcctagagggcagaggcgctccgtgcccgtcgccgcgccgtccatcggaagcgagctccgagcagaacctccgacggcgccgacagacgatgctaacgcggcgcaggaagatgccggaggagggcacgaggatgctgcgagggggcggcgcgaagggagaaggctcgtcggcgggcggcgccgtcggtatttggttgcgtaaccggggcggcggagggaggcgaggcgaggctacaggccgggcttcgagaagcagaggccgttcggatttatttatagtgcaaaaggaaaggtggtgagatggcgattggtacacaatgtgtgatgttgacatccacggttaagattaacaaaccgagagaaaacggcgggggcaggattaattagccctatctataccaatctttttcacttggctatatgtatgaatcattgaatcgttctctctctaaaaatagtcttactagtgttactcagtatatatagtcggtcgttactagcgattggaaatttggaattggagataaggttggaatgtggttattagaaacaattgtccttgtagagaaacgtttagagtttttcgcctagctccacagggtggtaggctagctggcctaaattcgaaatctcaccccttttaattatttgatattaggttctttcctaatattcgtgttttttttaacattgtccttttgaaatgtttgtcacttgatttgggttttactcgtattagctttgaattttgactatataagcaaaatggctggaatggctcatttcctaaggctgcattcgttattttagattggaagagattttcagccacacgcaaaataagaaaaacttattgtcaaatgattaattaaatagtattaactattacaaacatgaaagattagatttaattaatgtttaaaaacttttatataaacttgttcaagaaaaatacgtatcatttaaccttttaaaagtgtgtttacgaaaaaaatgagaaagttgtaattgaaatttgaataaaataacaagccataagtctagtttatttttttttcaaaaaaatcctcttttctcatatactcactctgtcttctaatataagagattttaacattttacttgcaaaaaattggaattatttttttgacttactttattatccaaattattttaagcaaaacttttcgtttttttaatatctgtacaaatattttaaataaaacgaataatcaaatagtgcaagcaaaatgtcagaatctcttatattatggaatgggtggagggagtatgtggtcagaaccgattagataactcgttccgtcccctctagctcatccccgcaatgcatcgcactcctcgtcgataccgtactccctcgtacccggcaacaccaacggacaatgtacccgagcgtacacgactcggtccccctcccccggcccggccgtgcccccgcgcaccgatcgatgcgccgagtcgaacacgtcgcgactcacgagcgagcgactccccccgccgcagcccgcaactgcacaccgcaaccacacctcccgcgcgcgcgacccggcgacccgagccgcgcgtcgatctgcatctgcatgtgctgccgctgcg

SEQ ID NO: 76288 - DNA, 9297 bp, Oryza sativa
tcaagatacttagattatttatgcacccacatatcattcgcctttatgaggtgatagacaccccagctgatatttatgttgttatggagtatgtcaaatctggagagttgtttgattacatcgttgagaagggaagactgcaagaggaagaagctcgacgctttttccagcaggtaggctttgtaccattttcctggattggtttttaaggaatacactcagtaatcccatctctagttagggtttgcacaagttctaaatgcagcaagtcactgtcaatttttcattttctgttgttgcttccgcattacagatttggtaattttttatatgcattgtactgatatgcttcagttagcatccgaggataattttcttttgtttgatctttgaattagatcatatctggtgttgaatattgccatagaaacatggtggttcatcgtgatcttaagccagagaaccttcttttggactccaaatgcaatgttaagattgcagactttggcttgagtaatgttatgcgtgatggtcactttctgaagacaagttgtggtagcccaaattatgcagcacctgaggtatttatcttgaatgatttgcattattactccttcttcatgattgcataattgcttctatctttctttacctttttcaattccttttccatttgactaggtgatatctggtaaactatatgctggccctgaagttgatgtgtggagttgtggtgttattctttatgctcttctttgtggtacccttccatttgatgacgagaatattcccaacctttttaagaaaataaaggttagcaaagatgtgatatatcctactgataaaggtgctgcctcatctccttttatatgttaaagtaaaactctgtccgttttgatgttctagggtggcatatatacccttcccagtcatttgtcacctttggcaagggatttgattcccagaatgcttgttgttgatcccatgaagaggatcaccatacgtgaaatccgtgaacatcagtggttcacagttggtcttccgcgttatttagctgtgccacctcctgacactgcacaacaggttaaaaaggtaacatgctgccattatgcatctaactatttaaagccgtattctgcttttgaaactttcagtgtttgatttgatcaatgtgagttttgtagctcgacgatgaaactctgaatgatgttatcaatatggggtttgacaagaatcagctaatcgaatcacttcacaagagactgcaaaacgaggtgtttgcttcactccattgctcctctttgttgtttcttggggaatgcatgacaaagtttctgaataatgtgcaggcgacagttgcctactatttactattggacaataggctgcgcacaaccagtggctaccttggagctgagttccatgaatctatggtatgtcaactcatctctctctctcatttattgctttctattgattccaaattcctggcaaatgtgctgttccctgtagcactacaaagtttatgataatttggtgctttgctttctgtgatccaggaatcttctctcgctcaagtaactccagctgagacaccaaactcagccactgatcatcggcagcatgggcatatggaatctcctgggtttggcttgaggcatcatttcgcagctgacaggaaatgggcccttggtcttcaggttttatgctgttactataaggttcttatttattcactttatttattataagttatcctaattcatttgtctgtatttatttaacagtctcgagcacatccacgagaaataataactgaagttcttaaagctctgcaagagctaaatgtttgctggaagaagattggacattataacatgaaatgcagatggagtcctagttttcccagtcatgagagtatgatgcataacaaccatggctttggtgcagaatctgctataattgaaactgatgacagtgagaaatcaacccacactgtgaaatttgaaattcaggtatcattttgaacttgacatatgattattaaccctgggatcatgtatcggttagaacctttgaaatgtagatctgtgcacgatctagttaagtcttacatagttacgcatgcctttactctatatgtgatgattaagctgcagagtatttatgaactgttaccatattcatattccttaaggctatttatgattgaggaagtccatataccgcatctttttttgacgtgtaaagtgtaatgtttggaatattcaatttatgctgatatacttctaattgctgcagctttacaaaacaagggatgaaaaataccttcttgacttgcaaagggtcagtggaccacagcttctctttctggacctgtgctctgcctttctaactcagctgagagtcctttaattatgccgttgtctgcttcccaactgaacttcctgcagcataccgtggattgtcacgtttcatttaagatatgtacataatgaccataatcctccagtagataatatttcctggagtgtgtagacgttagaggctgccagtgatgtattttgacggtaattggccaaaccagaggtaacaggcaggaggcaaacctttctctgtttttttatttgccgttgttgttgttatatgacggtttagacttatctagagtccttgaaccactttgcttgtttacggtgatctttactagcctgattgcccagcctgagaatcacctctgtcgttatgaaagttgagcagttggcatactattgttgatcctgcattccttgacagatgaccgttggatacatgcagagctgttatctttttttttttcacatcataattactcagattggttacccatttgcttctgtatgtgttgactggaatgttaaataagaatagttccctcttgattatactagactgtgcaacggttcatctgagatctgtgctaccattcataaatcaagctggaaatcagatcatgaaatagtcaggtgttaagttattgagaaattcgagcatagatctgagattttaacgaggaatcttagaagggcaatggagtacaaaaatggatatggtctactaaaaaaaatttatgcacagtagtcagcggatagaacagaatcataaattgtgaaagacctattgtaatctaataaaaggttgaaatctgtaaagtaacacgcaagcctctaatccgatctaagctataatttacatcttcgctaatttacacacgaactatgaatccgcgcaaatggtattactgcatcaggtatgcagagtctgctcggctgaagcaaggtgccccatttgctcggtgatctgatcaaccttctcccggtgatggaagccattgcagcctaattctgcttttacatcgtccttgggagactcttgtctttctgactcatccaaacatgaccgtggagtctctgtgaggaaccgctcccaaaacacatcgttggtcggtccatgcgaagcttcagtttctgacgtgccatcttgtgaagtatcagtggaggaggcaatctcagaatttacatcagcttgtgttgggtatcttgtcacatggatatcttcacgaatctctgccattggcagctctggactctgcacaaaacctggagactctgtgagttcagtggataaatggagatgggcattccctgtgttgggtgagctgggatggaggctagctggtaactgaagatcgatgcctgtctccattggagcagtgttcatctcttcaggacatatagcagtgctgggttcagtaccaccatgaccatgggagtacatttcttcagcagctgtgcaagcatcatttgctctctggaagagtttctccagggagaccaggctcagctcaaccctgtcaaaagcctcaccattggtcacaggaagcacgggaggcatggccggtgcatccgtcccaattccctggaactggaacaccttctgttcttcgcccgccgcgcaatcgtcgacgaagagatccatcttcgggaccctcctcttcttgctgaaatggtcggactccagcagcgagctcgacacggcgccaccgcgtctctgcagcatctcgcacagggaggccacgatgttcttctgccgttgctccatcgccactagcctgccttccatcgcctgcatctgccagttgatcacgtactgctgctggttctgcctctggaggtccgcgacgaggatgctcttctcgtacttgagccggttgatctcttcttcgagctcgcgcctctccgattcggcgagtggtccgtttatctggttctggagggagtggctgtgcacgggcttgcgtcgatggatgttcttcagaaggtgcgtgtgccctcttatgaaatcctcgtttgcgaactcccatctctcaggatcgatttttcggaaaccctgaaaggaagatgccaattgaagtcaaaattcagctacggtcaaaccaaccaagaataaagaactattttacagaaaatcaaataggctatataaaaccggctgctgtgtcaatggtaaaatcatccaaacaaaccaagaacaaggaactactaatttacaagcaaacagtagcacatgattgttgcaatgtttgtttcgtttcaagaagcaaaggggattgtgtttgtgactcacgtaggtgttgagctgcctgatgaagctggagaagttgttgtgcttgaagtacttgggcaacaggtcacgggagaagtcgagcgggttccacacgacgaagctggcgccgccggggccccacgacacgacgtggttggtcgccgcgtcctccaccatctcgtacgtcttgatcaagaacggcggcggcccaccgccgccgcctccgccgccgccgccgcccaggttggaactctccatgtcaaccgcgcctctcaattctcaaaccagcagctgctctgcacgatgcaagaacggagcccggtcttaacgcgcgcagcttcgctctcccacgaacaagtcttaaccacctgaatggactcggcgccaaatccaactcgccacgggccaaaatttttcacattgaaccgcggcgcaaattctcaccgagtcgccaaaagacagcgactttccgatcgaacgccaactagttctgcaaaaagaaatgaccagagcatcacatacaagcacgtgtatacacaaaggcgccgcctgaacagttcaagcaaccatagccgtcgaagcaaagaatgcaaagaaattaagaaaaagaaagcccagtgtatgttttttcattatctcctgatacaatcttgcctgccatgccaaggcgcgccggcacgatcgaatcaaccagacaaccacgcgaaaactcacaacctttctcaattctcacctgatcagccacggccacggagacggcagcagctcgcccgacgacgcgcgccctgcacgagcgggagacgcgagaggaggcggcgcggcggagaaggcggtggtggtggcaacgggtgcagggcgtgcagccgtgctagtgcagtggcgcgcgcgcgtcggcgataatatagaggagagaacgggaggcgtgcgctgcgcgccagcgcgagcgagcgtgcggatttctcctctctccggggcgtttggtcgctgcgtgagacggttgactgaccggggaacgaacgagagagagagagagagagagagagagcgcaatcaggagcgcgagggcttctagaaatggaccggcagcgcagcgcgcggttcgctcggcgcggccgcccggcgcgacagtggtacaccggtggtggtccggtccgaccggaatcgatcgtcgctggtgtgcctggctggcaggctggcatcagaccggtactggtagtatttgattcaaccattcaaataccgcaacaggatttcgggatactgtgcgtgttttcctgcatgctttttccatggccatagttaactcatagtagtactaagtaattaataacgttagtacctggtacctatcaaaagctactactaccttcgtcccaaaataagtgcagccatgagtttcagcacccaattttgatcgtccgtcttatttaatttttttttataattagcaattttgttgttataagatgataaaacatgaatactactttacttgtgacttatgtttttaatttttttcaaataagatgagtggtcaaagttgggcatggaaaactatagctgcacttattttgggacggagggagtagtactccatttatcccataatataagggatcttgagtttttatttgcactgtttgaccaatcgtcttattaaaaaaatttaaaattattatttatcttttttgacttactttattatctaaagtactttaagcacaacttttcgttttttatatttgcacaaattctttgaataagacgagtggtcaaacagtacaagcaaaaactcaaaatcacttatattatgggacgaagtactagtttttctgtcctaagatataataaattttaaagaaggtccaacgaatattattgatgagcgccgaatttaaaaaaataccatcgacaagagcaagtttcatgaaatactattatacatgtgactttgtcctaaaaatactgtcatcgttatggttgctaaggagggttctgttagcaacccctccgttaagtggtataggatggaaactttatttaacatcacggaataaggtgaatcctaacgataatagcatttctgggataaagtcgtttatacgagagtatttttggaactcgcactcatcaatgacatttcttaaggttggacgtttgtcaagatattttttagattttctctaaattttacttatgaatattgataaatggggtagtagcttgtactactaggttttgttcgtctattacttttcccaactcatctctctcgtttttccgcatgcacgtttttcaaactactaaacggtttattttttttaaaaaatacgaaagttgctttaaaaaatcatattaatctatttataaaaaagataatacttaattaatcatgtgctaatgagtcgctccgttttacgtacgccgaacattaggtcccaactactccctccgtcacacaaaaaatccattcttagcatccgaaggtggaattaatagatagtgagaatgactaaaatatccttaatcattgaaaaaagtaataagagtgataggtaggtaaaagggtattgcaggaataaaacttctcgttttatgtgttgatggtaggtaagatggtagtgttgatgaaaaaatcgaacacaccggcctgggagatctgcttaactccagtgcaggtccaaaggttggtgagatgcgggcgtgccagtcagtttgatcctgcaactgacaaaatatgcaaataatagataaaacagccgatcggctgacaagctgatggagtagttccagccgatagccgataatagccgatgccgataacagcggatagcgatagggtttaaacaatcggctatatgtccaatgtagataatgatataaaggcaatcggctgatgatgatgtaatatagaaatataatctagtagaaaccaatcggctagcattgatatgatagaattagcattaatccgaaggttaaagcatacatcggctggaggtccgatgtcatgaaatccacaagattagattaaacagtgaaacctttgttgtcatcggctaaatccaatttatatgtatgtgcaatccttatgagccgatgcaacgtccagataactcaccggctgaaaccccgataaaaccctaattggcaatcaagaagcaggctagagattatggttctaagcacgacttagtagatcaaacttaactaatgcagcactaagtatgaaaagaaacatgatatctagacaatcaagctattgactgagttttcagggtggtagatgtctaagataatctaatctagcaacacgatttagccgataccggcagaaaccctaaaacgagaagcagccgatagagctaaattgatatgctaaaactagattaacagagacatatgataaataggtaggcaaatatatcatccaaactagagcaatgcaagaggtcgaatgtactgatgcagccttgaacaacgccgacgtaaacgatacaattgcctggccggcggaacattggacttaccccttagccggagatcgaacaccgatgcagccccgtgtcaggtgccaagttccgccggacgataaaataaagtagaaaaggtaaaaggtggcgatgcgctgaattgtattgatcatgaagatagattacatagaccccgggtgtacatatttatacccatgggttgatacaagtccttgttagacaagaaagaaacttttctaaagataaaaggaaaagataaagttcttatagaacactaaacacactttcctaaagataaaaagaaactaacaaactattcctaattaatagataactttccatgccgcattctctttgaactcggtctcttctgtataagcttcctttagtagatcaatttccttaactgaatatagaaagaatccgacaactgacgacttgataactctcatcggctaatctcaggacttcgaaaccgatgtttactctaagccgatgactactctgagcttatgttgttttttagacaaaattcaaattctggaagttgatttttttttttttgcacgaagggagtgcatactacatacgaactcagcctagcagtactacgatgcacttgacaccgtgtcttgctcttgtatctccaccatttccacacgggaaaaaaactactactccagccgtttcaagttataaggctttttatcttggttaaagttaaactttttcaagtttaactatgtttataaaaaaatatagtaatatttataatactaaattagttccatcaaatcaataattgaatatattttcataataaatttgtcttggactgaaaatgttactacttttttttataaacttgatcaaacttaaagcggtttgatattgaccaaagtcaagacgtcttataacctgaaatggatggagtatttcacaaatcttattatttcatactgcttctaaaaaccaacagcagtgcacagctaggcagactggcaattagcatgtgcctcttcggctcatccttcttttttttcccccatagagaagatatgaaactactgaccgctgaataatgtcagtgttcatggattggaaaaataactttccccctagcatgcaagtaggctgattatgccctccctgcaacctg

SEQ ID NO: 76289 - DNA, 9553 bp, Oryza sativa
catcagatgtctgacaggatgtcagaggggtttttggacacgaatgaaaaaactaatttcataactcgcctggaaaccgcgagacgaatcttttgagcctaattaatccgtcattagcacatgtggattactgtagcacttatggctaatcgtgtagtactaattaggcttaaaagattcgtctcgcgatttcctgcataactgtgcaattattttttaaatctatatttaatgctctatgcatgtgtccaaagattcaatgtgatgtttttgagaaaaaaatttgggaaactaaactaggccttagtattccttttcatttggaacagtggcaactaccaagttgtccttctagtcaaaacggtttaattgtgttgttttgtgaaacttcaagactataatatctggttgtatatcaagttatcaaccaatgtggaccttgacgtttagtttccttaaactggatgtttatttactgcaaaagaaatcatttacatcagccttacaacgtagaccctgtttagttccccaaaaactttttaaaaaatatcacatcgaatctttggacgcatgtatggagcattaaaccgtttgcactgtttgcatgtaaatcgcgagacgaatcttttgagactaattagtccataattagccataagtgctacagtaacccacatgtgctaatgatggtttaattaggcttaaaagatttgtctcgcggtttccagacgagttatgatattagtttttttatttgtgtcggaaaaccccttccaacattcggttaaacgtcctatctgacacccaaaaattttcttatcaacaactgggtgtgtttagttcacgcaaaaattaaaaatttggttgaaattagaacgatgcgatgaaacagttgaaagtttatgtgtgtaggaaagttttgatgtgatggaaaagttgaaagtttggaaataaataaggcctaacggcccgtagcaaaacaaggcagcacatgcagcaaagtatgcagctggccgaaacatcacaagagaagattacgtgtatggaacagaacaccatttccctcaacaacaaaaaagaaaaagaaaaacaggagtgcaccaaaacacctgaaagaatgcaactgacatgacaggggaacaaaacaacgaccctcaaccctgaacctgaaccccggtgtttttccttttttttttttttggcgatgaagtgagtgcaccatgattgcattgcgcagtgcacaaacggcatattatttccagccagttcatccacagattgtgccggatccatcttcatttgaaaaaggaccattttatgctctaattcgatctaaagtgaaaaggttaattgcaagcagaggaatcaagaaacggcaacagagttctcctacaatggtgtccatgtcagaaagtccagaaccagaagaagctagtgcccaacaccaggagtcggcactggtcgcattaaccgctcggctctgccgccgctcgccgagaatcccctcggcctcggcggcggcggcggcgccagacggctaccctgagctccaagccgccctcgaagtgcatcacctcatcaccgcctcgctcctccgccgccagcataagcttccgcccttcgcaccgcgagcagcggagcaggagcacgacgaggaacgcggcgaggcacgcctccgcgaacctagtgacaccgtagccgcccatggtttggatggtcgagctgcttgatgctactctgctcagtgagtgacagagtgagcgagtgagtgaagctgcttgctcgagttagctaacgaagacgagagggtttctattgctctatttatagcgatcggcaagacgattgattcctcgtggccggcttagagctcttcatgcaaactacagacaagaacagcatagtggaaatgtatacgtgcgacggcataaatacttgattactcagtgatttagtcatagattgttctcaagaaaccggctgactaatccgttgtttagacaagaaaccggggctgtttttagctttacagtacctgcttaatttgttatgtcaagcgtctcgagaaaagaacatttggcagcataaagcatgtttcactgcaaatttcgtttcttctatcttcttattccatctccttccgcaaccgtcggccgatgcggtggcgatggcgcggacgcaggggagtgcgcgcggcctggtgcaggcgcggtggcgcggccatgcggttgtggcctcaacggccggcgggtggtagccaggacggcgcgaccctcgcggccatggcgcggccggtggccgatgcgagtacggtcgtggctggggccggcgtcgtgcgtagcggctggtggtgtaactccatcaaccggcgttcaccggcgactcccagtcggcagcgacggaatccaacaaaaacaacaaaaacggaatcgggaggatgcgaggaattctttttcgcaattcaatgtccaagatgcaaaaggattcaagagatttctctaccttcttctttttcggtctccgttagaacatcgtgctgataacgtattatgtaactcctttgctacatccgtagtctagaggggttgcataatgtaaagtgaagatacaagatataagggtgtggcttattctcatttattcttctagcaccaaatgtacaatatgagcatccatctccttcttatacagccttccttcatatatggaaggtttggaatggacccaattagtgtatatgggctgggtcttcataggcccaagcccataggtttcctaatagttttgtgaaacttcaagacaataatgatccctccgtttctaaatgtttgacaccgttgactttttagtatatgtttgatcgttcgtcttattcaaaaaaaattgtgaaatatataaaactatatgtatacataaaagtatatttaacaatgattcaaatgataggaaaatcattaataattacttattttttttaataagatgaatggttaaacatgtttaaaaaatttaacggcgtcaaatatttagaaacggagaggtagctggttatatatcaaccaatgtggaccttgacgtttagtttccttaaactggatgtttatttactgcaaaagaaatcatttgcatcagcattacaatgtagcaaaacaaggctttcatttgccgaaacatcacaagagaagattacgtgtatggaacagaacaccatttccctcaccaacaaaaaagaaaaagaaaaacaggagtgcaccaaaacacctgaaagaatgcaactgacatgacaggggaacaaaacaacgaccctgaacctgaaccccggtgtttttcctttttattttggcgatgaagtgagtgcactacggttgcattgcgcagtgcacaaactgcatattatttccagccagttcatccacagattgtgcccgatccatcttcatttttttgaacgaatagatccatcttcatttgaaaaaggatcattttatgctctaattcgatctaaagtgaaacaagcagaggaatcaagaaacggcaccagagtcctcctgcaatgctgtccatgtcagaaagtccagaaccagaagaagcatatatagcctgttcactttgatgtcattttcaagcttatcaaattttagtaaaattgctaaaaaagtggctatatttagtttgctgctaaatttttgtaactatataagaaatcatgccaaaattttagcttgccaaaatatggtaaggttttttttttgacatcaaagtgaacaggcttttagtgcccaacaccaggactcggcactgatcgcattaaccgctcggttctgccgccgctcgccgagaatccccgcggcctcggcggaggcaacactgccacgccgctgccaccgccgcggcggcggcgccagacggctaccctgagctccaagccgccctcgaagtgcataacctcatcaccgcctcgctcctccgccgccagcataagcttacgcccttcgcaccacgagcagcggagcaggagcacgacgaggctcgcggcgaggcacgccgccacgaacctagtgacaccgtagccgcccatggttaggatcgagggtgcaagcgactacccgcgaaaacccacttatagacttatctaaactacgaaatcgtttattttgatctataagtgggtttgcgggtgacccacttgcacccctagttaggatggtcgagctgcttgctgctactctgctcggtgagtgagtgagagaagctgcttgctcgagttagctgacactgctctattgactatttatagcgatcggcaagatgattgattcctcgtgatcggcttagagctcttcatgcaaactgccggcttgaaaagcgtatctttttttctgaaatagcagtacaggttttgttccgttgttctctttgaaaggactagcagaagcagaatgtctatattgtatacaagagcggcatagtggaaatgtatacgtgtgacggcataaatacttgatttcccagtgatttagttatagattgttctcaagaacatgtcaaccagctgactaatccgttgtttagacaagaaaccggggctgtttttagctttacagtacctgcttaatttgttatgtcaagcgtctcgagaaaagaacatttggcagcataaagcatgtttcactgcaaatttcaaacctccttgatgaagttgaacgaatcataaattaagtattctactggcttctcctaatcgagaggctttatatagtatattaaattgtataaaaatcgtagcatggcgcgtcatcatcctggccataggggcttcttgacctatcagaaattcagaattaactgtttcagcatccgaatgtcggcctggtagtggttagccgctggtttagagtctgaaaacgaaaagaatcaatggcggaaacggtcggtcttcagatgggggagctttggacgaacggctaagagccaaagggaggctaaatctgactcgagaacgcattgcagccggccaggatctcaacatctggtgaaagctgcgtcgcggaaagtttatgtttctttctgaaccatttctttctcccatcttctcgcgtcgtttcttcatgcagccaatcaggttagcttgtcaaaattggcatattcgtcgcttcaccggctaagaaaaactactacctataagagtatatcacgattgaaaaaaaaaactgccctttcttttaactgaagaatgtctatgaacatgcaaatattcagagttatcatggccgaccatgatagttttgcaaaaggggacggcaaaaaactactagcacacagaatgtttgcagagaggcctttctgtgttgtaggttaggtctttaaataattccgtaaactacaaggatgatgacataaactgctctgcggagaatatgcttaggagataaacacactcagttatactcgatcaagatcccctgctcgctgctttctgaaagcataactccaaactgaaatagagctctacgtagcaactttgtcagtggagaatgtagcccatcatttcaagtactggacagcaaatatgatactgaacagcagcatgattcttcgggtttctttctttgattagcgagacccaaaccacgtccattatccacaaaaccaagtgctccatcggtttgactactactatttccaatttttaatagatgataccattgattttgaaaatatgtttgatcattcatctaaaaataattacataaatattatttattttattgtgacttacttatcattaagtgtaatttaaaagtaataacttacattctttttatatttatacaaaatattttataagacgaatgataaaatgtatatatacaaaatatcttcgtgaatctcaagatatataggttaggatgtatatatgtgtgttataggtgagtgtaacgcatgtttatatgatctcctcctccgttccaaaaaaaaaaacttaatcctagatttgaacctgaacacccaagtttggttttttttttatggagagagtaagcgcttaaaaaaaaaaggaagtatacatcccacggacaccgcagtggctccaatgctccatcaacgccgtccatccgcaacagtcggctcatcccagccaccggagagctgaacggcggagaagacgaccaacccagccgtacgccgtcgtcgtcgtccttgtcaccgtcacccccagcttgcatccgcccactgtcaccgtgtcagcgtcgcgcgcgtcgctgccagctcgtgggcgaaaaggcctcgtgccgcacagcacagcgcgcgattggacgtacggtttcgacgagcaaagtagacgcgcgcggcgacggcggagaggagcggagctccctcgcgcgacgtggcgcagcgcgtggaggagaggagtcgcccgcgttttcactcctccgcctttgtagcgttcgcggggatggggacagaaacgaaggacgatacggatcccatcccatgccgcaatcgccgtcgccttcgatcttctcagaggaaaggaaggaggaaagaaggagacgatctccctgcgtgattggatccaaccaaaaacataagacataatatacgtcctaggttgtgattggatctagtgtgctcgcgtgttcttgttctgattagggggcgtgatgtgactacgaatttgattgagttttgattattattaaatttttttcattttctttctttagatgagtacatcaggatccgagagcgattcggtggccgcaaagcgatccatgaagcccaagtgtacgtgcccattcttgcccctgtctctttaattgttctctgattttcttttgtttggtttggttacatgtctaagatgaaatgtcgcaatgtgtttggaaattgatgagagtttcagttcagggttctttctttgtttcttttttctttctcctgcagattctaagttcacgcagcaggagcttccggcatggaaaccactatatactcctggaattgtatttactcccaatctctacattctgttcttaatttcttcctgcgctatcaaattatttttatcccaaaaatggagtgctagattttagcaatctctgaataatgtaacctggctccatgaataggtcatcggggccttctcgctcatcggcatcatcttcataccgatagggctcgtttcaattgcagcatcacaggaggtaattgcacagatatgcaacatgtattcttgaattctgattatttgactattccggcactacgtgaaatacatttctgcttatatttattaactagctaaatgtctgtactttgctacggttaaatgaaaatgtattaatgtggtgtccatctttttctatagagaatattcatcttaatctcaatttttatgtatctatctatttagatttgattttttaataatattaagaagtttaagggataacttaataaaatttacaatggaagtaggtggggtggctgattcacggccaccaccattaacttcttttaatggtaatttttatcattcttaagaaaatactggcaagtactttttcaaagacaatagaatttctcttcttttaaagaagtatagaagtatagatagtctggcttgcaacggtgggttaaatttgtatttaaactcatttcttttaatacagtgacgttgcaaagttcttacgcgtttgtcaaaaagaataatctggcttgccatgcaggttgttgaattggtggataaatatgatggggagtgtgtgacggctaacgacaaggtcgggttcattcaggacaccaagactgacaaagcgtgcaccagaacgattactgtaagtttatgcccgttcgtttccttgtttgacagttgcaacttccttgtttttcattaacttacatcttaatactaaacgtgtgttttttatagtagaagtttctttagaaaatcaataaatatatatttcaagtttataatcatttaatttcaattaactatgcattaatggcttgcctcgttttacgtcaagagaaaaactaacagctactatggtggtgtttggatccagggacttaactttagtctatgtatttagacactaatttagagtattaaatatagactacttacaaaactaattacataaatgaaagctaatttgcgagataaatttttttaagcctaattaatccataattagataatgtttactgtagcatcacataggctaatcatggattaattaggcttaatagattcatctcgcgaattagtccaagattatggatgagttttattaatagtctacgtttaatatttataattagtgtccaaacatccgatgtgatagggacttaaagttttagtcccatctaaacaggtctatgttcactagaattgagccttagatgacacaactacacaacatggttgcccttagctcttaccagatttatagtatccagtaaataatgatttttctttactcatttttcaggtgccaaaacctatgaaaggccccatacaagtttactaccagctggaaaacttctaccaaaaccatcggcggtatatatacgctagacctggatgagtgatttcaacttaattaactggccattgtggtaccgaaatgaacactaacgtacaacaatcttaattcttagatatgtcaagagccggagcgataaacagctgcggtccaaggagttctcaagtgtgataaaaacttgtgatcctgaagccatcagtgaaggcggagcccctattgttccgtgtggcctcatagcatggagcctgttcaatgacaccttcacattttctgtcaacaagaagactgtccaagtgaacaagaagaacatagcttggagcagtgacaggaccattaagtttggcagtgatgttttccccgaaaatttccagaagggtgggctcataggtggtggtcagctaaatgagaaattaccagtaagtgcagtcaaatcaatcatctttatcacactagactgctcttttcgtgctaacgcgaatattagggaataacataatatcgaataattagaaggagtgaggcttcgaactcaggtcgcctagcccaccaccttattgagctagccggaaaacccctaggcgtttctcgtgctttcttttttcttgaactgaattgtcctccatattcagttgagcaagctttctctgcagttaaataggtggctctccattgttcgctcttcatcttatcggtcatagctaaaatttaaattttcaaacttaattttaaagtttattaaaaattttttatcgtagtttattttctatattgattttttaagtcgctaaacacacataaggaaaagttttgccctataaattatatttttatcgttaataagcattatggcctataatcggctgctggaagtaaatttagttacagctttatcacactagactggtcattttcatcattctttttttttctgaattctccttcatgtttcagttgagtgagcaagaggatctcattgtctggatgagaacagctgc

SEQ ID NO: 76290 - DNA, 2147 bp, Oryza sativa
tactggtcatgtcgtcagcagacagccacgattccacgtcgcacctgctcccggcgaaagtggaggtagttgtgggccgtctcatcagaaggtgactcggacggcaactatacaaatctccgtccatttatgaaaagggggggtaagtccccacaaaaaaagagagaaatggtgcatgtggtatccccttaagatataaaaggaggaccttgcccactgagaggggggactggacttttccagattagaaacccaaaacaagggagaggctggctgatactttgtagctccttcatacacagatctcccaaaacacaggagtagggtattacgcttctcagcggcccgaacctgtatacatcgcccgtgtcttgtgtgatttcactctcgcgaactttccacagaccaagagcttagaacctcacccagggcccccggccaaaccggcaaaggggggcctgcgcggtctcccggtgaggagccccacgctccgtcacatgtggacaataataaaatgatttacattatgaaacggtggaagtattttttttttcaaaaatgaattaatttgatttttttaagcaacttttgtatagaaacttttttaaaaaaaacacaccgtttagcagttttaaaagcgtgcgcgtggaaaacgagggagatgggattgggaagggggggtgccgaacacacccttagtagcatcagagccacaaggtggacagtggtcccgtgctagtggtaggggcaaacgacccaactatatcgactagttaggatgacggtgaatccgaaagcgggcagccgcagagataggaaaatcagcggggcaagggcaccataccgccgcctgcttaaggaggagatgcgggaaagggtggaggtcggctaggagtagagatggcaatagagacccataacccgagacccgacaggtttttactctattagaagctaattgttctaactcttatacacatgggtctactaacgggcgaaaactcttatctattgggtacatggctatgggtccgttctttacccacccgtacccaccaacctgtgggtgaaaaaaaaccgttgattgagtcaaactatgagcaatataagtatcgatgactactaaatcatagcataaaactcatttcacatcttaagtattgttctagtctagttatatgaaattgttatttgatttcttgattatgtaatgtggttgtataattttttttcctcacctttgaacgctaatgttaattaatagtattgttgctaaagaaaatattgatggtttacaactctaatatggctaattatagtacaaaattataaatgctgcaagtcaattatatgggtatgggtatctatacccgttacccacacgggtgtgggtatagggacgattttgtatccacgatggatatggatatttaagtgagaatatttaaacatcacgggtgtgagtatggggcaagctaagagaacccgatggtatgcacccattgccatctctagttaggaggcctcgttgacatcattcgcgccttccggctagctggcggggccagattgacggtattggtggggcagattatggctagacgaggggagttagggtgtgtttagttgggaaaagaaaatttttgggtgtcacatcgaacgtttgaccggatgtcgaaaggggttttcggacacgaatgaaaaaactaatttcagaacttgcctggaaaccgcgagacgaatcttttaagactaattaaaccgtcattagcatatgtgagttactgtagcacttatagctaatcacggactaattaggcttaaaagattcgtctcgtgatttccttcataactgtgtaattagtttttctttttatctatatttaatacttcatgcatgtgtctaaagattcgatgtggtgtttttgagaaaaaattttgaagaactaaacgggcccttattacatggaacaaagaaatttgatggccaggcactggtgtcggcatcagagccacgaggtttggagtgggcaggagcagacgacctgactagttaggatgcagcagtagatctggaggcgaggagccgcaccgagacggggaagctggcctgaggaggagggcgggggttggggggggaggggggg

SEQ ID NO: 76291 - DNA, 19842 bp, Oryza sativa
  unsure (1)..(19842): unsure at all n locations
ttttttgttccatgtcactctcatcgttgagctgtcaatctgccccaccgccgctgtctatctagcctcaccagttagccggtangcacgcgaagggcgcccggaggaggccggctaggcctccttagcgcgccatccgcgtgcattccggctaactgttgaggctagattgacagcggcggtggggcagattgacagccaaacgatgagagtgacatggaacaaaaaaattcgtggcaaaatccaaaagatttctgaatggaatgcaatttatattaaaaaacctatgaattagatggcaaatagtgaaatttctcacctgatcatgacaccctgtttagaaatatgactatgtttagatgggactaaaacttttaagtccctatcatatcggatgtttggacactaattataaatattaaacgtagattattaataaaacatattcataatcttggactaatttgcgagacgaatctattgagcctaattaatccatgattagcctatgtgatgctacagtaaacattctctaattatggaataattagacttaaaaaatttatctcgcgaattagtttttatttatgtaattagttttgtatatgtaattagttttgtaagtagtctatatttaatactctaaattagtgtctaaatgtagagactaaaattaagtccctagatccaaacaccaccgtagacacgaatcaactaataccgtagcacacctagatgcagatgcacctagtcatattctctttctcaacacatatctgagcacctctgttggcgctaccctccaaaagagaattagaacgcacagcggagtgcagaagggtgcaccgaagatgatcaagtagacaatgttggagatgagcaggtcgatgccgatcggggctccaatcctgagcacgaccctgatccccatcctcctgcgcaccacgtgcgcgcagctcaccatcagcaccagctccctgttcctgaacagcatcgtgccggcggcgagggcgcagacgccggcggcggtggcgcgggacaccggagccagcaccaggtacacccccagcgcgaaggccaccagcaggctcctcatcgacaagcgcatccaccacacggaattcttgaagtacctgtgccggacattcatctccaccgccgccgtgccggcgtacatcaggctgagcgtggcgagcatggagcaggtgaaggccagcgccacggcgtacatgaacgcgtcgaaggcgtaccgccccgccagcgccggcgcgccggctgcgacgtagcctcccgggggggagaaggccacggcgaaagccacggtggcgacgagcacggagccgacgcccaggacctgggccgactccgtcattttcttggactcggcgctctcgtcgagcttgggtacgtgccgctgcaggaagtgatcgcgcctgatgtttccgccgctgagggcgttggctattgttagacaccaaagtatccacgttcgcgcgttctgcagcaacacgagcaaagttttacccaattttgattagcttaacgatgtagttctctccttccggtgctaaataatatttgacgctcttttaagattcgattaaactacttttaaaactttggacatcagtttcatacaccaacaaatttataaaatctagagtataattcataaaatccctgtatatttggtctaaattgtacgaaaccgtatgagttttatactgtgttgcgcataacagcatgtattatggtgctatagtttcatacacttttttctaatctactatgcatatgaattttatgggttcgtttatccatcaaagttaattatattttattgtgctataatattaatagttaagttagttgacggtgtggttttctaagaactagtttaaattctagatttgataaaggggctcgtatttaccgctatttatttttttagtggtaggtggcgtttccatcaatagagaggacttcatcaatctcaagatataccgactcagtcctgaagatgctcacaaaaatagtgtgtgcgcgtgctatgggtgcctatgttcgttccatgtttctaacaaaaatacaatactacaagtatattcgtactatttttttttcaaaatgcagatttacatgatttgatataaaatagtttaattgttgtgaatttatttttaaaagaaaaacattattaaaaagggcctgatctaagggcacgtacaaacgtgtataatagcggtctctctttattgccatgtaagtaaatttgataacgtggaagagagagaggagagaaaaaaaaagcatggttgctatacatgacaacaggtaagagtcaactcttaacttttattaaagaaaattttgttgtatgagggtggagaaaagaaaagaagggtagtaaaaaaatattttggtacgttaatgattaagagttcttgttgtctcaactattgtaacagtatattctttaaataatatgtcttacttaaaagaccatatcggacactatttttgtacatgccctagtgaggtaaaagtgatgtaccgttctgttggagtaaagacccgctggaatggtactcctggccaggtcagccggtgtgaggccgtcgttgttggcaagatccaagcaaaccctgcgattccgaaacaagcaccagaacactctcagcaccccggccacgaccgccaggtgcagcgcggtgttgccgtcgtcgtcccgcgcgttgaggatcgccgccgccggaaaccccgtccatcgacgtcggaggcgaatcccacgacctcctgcctcctccggtcgacggcgacgtggaggaaggtcctcccgcgggcgtcgcggaggccggcgcactcggggcacttgtcgagcaagagggcgacgagcctcaggttgccggcggacgcggcgacgtggatggggtagtcgccgtcgccgtccggctggcaggccaaggacgggtcggtctccaggagaagttcggttggtgtccggcggcattggaacgggcacggcaagaggagccaccggaggagtgagctgttctcgatgtcgatctttggtccgtccgccgaggcggcgaagtggagcgctgtgctgccggacgcgtcggcttcgccggagagcccggcgttccattgcattatcttttctgtcatttcttcaatttatggagaaaagcgtgagaaaaactattactccctccgtcccaaaataagtgcagttttatactattcacattcaatgtttgatcgttcgtcttatttcaaaattttttatgattagtatttttattgctattagatgataaaatatgaatagtactttatatgtgactaaatatttttaattttttcataaattttttaaataagacgaacggtcaaacgttagacacgaatatccatggctgcacttattttgggacggatgtagtattaaggtactactgctaccgtgctctctatgagatgatatgatgttaaaattaattacaggagcagttaatttactactagtctctaacccgtacattgcacaagttacgtttggatatttctttaagtgggaaatctaaatggagagcattcttgattttgtcttatggcacgacgctccgccagccatccatccgcgtcttcatgttgtcggagagataggcttgcttccattgcaatggcatcaaagcgaggaaccttcgtggcgtcaggtatcgctatacaccaccaaccatcgaaactaaatattggttacacgagtctattctttttctaatgatgacttatatattttaaatcatatattattttcatttttgtttgtaccatcgtgctctactcaaaatatacgataaaacaaatttaatatttaatatattcaaacatttaaagtaatttacttaatttcaaaagtaatttagtaaaatcgtagaagtaacttagctctgcaatagaggtaactatctaagcattgaaagttgttatattgatcaatcaattgatgttgactgagacacggacacgtaaatattatattgacgaagagtcaaagaaatgagaccacttgacaggaaaagaggacaacatactatctgctagttatcatgtcgattcacgtgcatgctactgaggctaacatgtcattacactagtataatgtttttttatagaatctttgatgacctatatatttttagaccttatattacttttaagatccattttgctcaaaatatgtgataaaatgagtctaatattgagtatatttaaattatttatttattttcttaactcctttagaagtgtagttacttccaataatgtgcactatgtagtcgtgtccttttcaaatgtattgctagattttaagctcttgaaaatacaaatttccagtcacctaaaattcaagccctctacaaatcgagcgtctgatttcctaaaaaaaaaaaatcagacggtctaacgtttcaattgaccgatgactgaaatgttgagtagtacatggtgaaacatttaagaatttgtgaagcatagtaagaacacatgttgaaataggtcgctattacgtatgaaacaatgtgttttattggtttgaaacatattttttattaaaatataatcatgcgatatcttgttataaagatttaattataatgaatattatattatgtttggattatatattggataagtaatttagttgaaaaatatttcaaagattgctacaagcctatatgcatgaatggaatgaagagagagcaagtatatggtagaagagagagtaggggtagttatgtccgatactttaccagccacatctgaaacgtcatgctatacaaggtgaaaaaaaagacattgaaatatttatttttcatgtgtaatacattaaaaatatatgttgaaacatgtcgcattacgtatgaaacatttagtattaacggttataaacatatgattatattttagcaaaataatcatgtgatctcttattataaaaaaaattaattgtaacaaatataatagtacgatcggatcgaaaatccgataagtaatttaggaggaaaaaaattttgaagatagccacatgtatacatatatggataaagtggtgaaaaagcaaagtagtatactaatatggcagccatatagtagcttagttgcgcccgattttctttcctccaatcgggttaccgataggaatcattctcatctaaaattgcatatactcttaagcctaaaattatggtggcacgtgcggaacattatttctttttaactatagttttattgttatattttttttcctattttcttgtctaagtttgaatgttttttttaaaaaattgtatttttttgaaattgtaagttcatgtaatgcaattttgtaatttttggagtatgccttgtttaagtaagtaatagtggagtgatgagaagaattacatcgaaaactcactttgattattcgaaagagtgtaggtcaattttttatgctacaaggcaagaccacctatctaaatataaggctaaagccaaattatttttcgtcatttattgatctcttcgacggaagagggtgtcctaaggcgcactaacgtgtgctttgccctgtcataccagaacttctgaatcacttaccaagacttctggtattcctgtagtggcacgtcattaggtatcgttgagggttgcaaacgtagtgctagatgtgttttgggatggacacatttttatgtcaacaatagggaaacacatggagtcatggttgtataatttgacttatcatggagccgaccacctatattagaacgcctatagaaatacaatatttatagaaactgttgtcttaacttggctgcacgtagaacaggtgcctgcatatgagccccccccccccccccccaaccaaaagtatagaagcagattttataatgcactatatcaagtaaaatgagagagtgtcttctaaaatcgttttatatagtgtaaatcatgttaatcacacttcacacgtgcacatacgtttttaatatgactttagtgaagccaagaggcacgccaaagtcaacctcttggcttgagcttatgccaagaggtgcatttgtcgatgtgcttctgtttctttgatcgtgcctcatcagagtgtatttgtcgatgtatacgtgtgggtctttcatatgatctaaattgatcgtgcggagaaaatgttttcatccctaaatagttataaaaaacaataagatagccaagtatgaaatatattactttacaaatatgtaaataaaaaaatcaacttttgaaaattataaagaaacaaatataaccaggaatgtgtgttaactatttaagttgaatttgtttcttttggtattagttgtaagagtccaatttgatattacgagtgacatagttcatatcaatctatgttaatatatgctgttaatttttttaagaaaaataataactatttagatgatatataagaaatatatcccatcgagaaatgaaaaaaaaatcaatcttcacttgtaggcacgtacctgcgccgcgtaggacagcagcgtgcagggcagtttggccggccggtccagaatacgagagctcgtcgcccccttgctgatgcaggagctccgcgatgcggtcgtgccccagtgagatcgcctggtacaacggcgacatcccgtcgccgccggggagacaggcgagccgcggatgcacggccatcaggtggccgacgaggcgctcgtcgccgagcctgacggcgtcgtgcagggccgtctcacgccggccgttctgcttctccagcacgtcggccaccctgaacctcgcgccgccgggctcctcgtcctcctccatcgccatgtcgaggaggcacctgaccatcgccgcgttccccgccctggcggcgcagtgcagcggcgtgtcgcccctcgcgttggcgcgatccaggagggccatggcgctgcggtagatggtgcgcgcgcagctcaggaacgcttcgctgtcgccggaggccgccacgacgtgcagcgcggagtctccctgcggcgtcgtcgccacgtccaggagcagcgccgccgcggtgggtggctgtggctccccggccgcggcgacgtggacggtgacgtggtttggcgccggagcggcccccagaagtacagcctccagccactcgcggtggccgccgcgtgcggctctgagcagcctgcgatccatcgatacggggtctgaatcaaatgatgattaggatagaacattatattgcagagtggctgtgatctagacccgtttggtatgttgcgattacttataattaacatgtcagagatacttagtcagatgctttaaacaacatacgagacttgctggaagcggctagcactagcacacggtcatgcgtgcaaaaaccatggacgtacgaaccagcggatcagatcaccttgtcttgcattgcatcccgtgtgccgggtgtgaccggccggtggcagagccagcatcgccatcaagtctgtgtgactgtgtgtgtacgactataaccttcttctcttttagatatattaacatgttatttatagtaataagtttgaatttataatgataattacaatgtaaataagtgtgtgtacgacatcattaatttcacaagaagtgtagctataaagtgctatatatctaagccgtaatatatggtaatgatattatacttcaaatttatttatttatgtttttttgtaaaatcataggaccctaaaccctgcacatacatttaaattaggggaacgaaagatctaaatgaggattatgctgaaagagacttggaaatgggcatgagcctaaattaaccaaacaactcgtatgaggagcaaataaaaaattaaggcgtgactcaaggagagatggtacactgaaaagaaattttttgatgcaaacaaaaggtaaattagaaagcttaaggtattgcgttcttcattgatggaaatattacagatttcatggatgccaaactcaataagttttgtattttgatcgtgatgcgaagccaggaaagaactcaagaacgttcagctgataatgcaaagttcttctgttgaacactgccactactacagatttgattttttcgtacgatcaaaatagattttctcatacggagatcccacccgtttatattcagatgtttgcgaaaatcaacatttgcccctcggaggggtgagggggaaccgcaacgcggcaaagccacggtctccacaacgcggccacggcgttctcccgcatgccgcacgccctcaagttgtcagagagctattaggccatttacaatgcaaagacgtggagttcagcctccacatgctagctcggagattcctctccacctaggcacttttcactccctcactaggaacggggagccaaagtaagcattagaataactaacagccacgattcatcaccgttattagatcagcataaaccaaacaaaacaagcagatgtgatgcgaccgaggcagctttattcaacttgtccagaaccacttctctaccgactatcacttttgcatgggtaaaattaactaggtaccacgggttgattgtacagtatttctcaatgggacagacatgccgaaacatcaactatttcccccactctcactactctccatctcaccgtctttcagaaccttggcaaaatctggcgttggagctgtcaaacatgttagccgtcaggtcccgtctcctccatgtctacagccacaagcatccatgccctctcctactcactgcacatcaataacagtttaagaatagtaatattgtggtgaaaaggatgctcactgctcaggcgatcagtgtacaaaccttgtttagagctcatccttgagaggctcggctggggccgactctgccttctccttcgcctgaccagcggtttccttgttcttcttaatgaagtcgacgatctcgtcggctgtcctgccgctttcatagggaaccatctttccactgggggtgacgaagtacagggtggggtaaccttgcacatcgaactcgcttggcacatcgttcgcagttgcatcctgcatacaaggtagcaaaatagtagttagatgaactgtacttgtgataggaaagaatggatgaataatgcactcaaaactaatggcaccacccagatagaaaggaaattaccatcttagcgatgacaacatccttgtcgcttttaagcgtcgtagctgcctcatccaagattggagccagcttcttgcagtgtccgcaccatggtgcatagaattcaacaaggactgaaacagaaaacagcaaataaatgagagctgcaaatcaaatagaggctttgccagcactgataattgaagaagctacaaaaaaatagcaaacttgcttttgaccagggaggaatcagtcgctcacaatactaatataagaactaaaaatcatctcactgaaaagattacgggggacaacagtatgtaccgtttttgccagacttgaagacaaaatcatggacgttatcagcgaccacaaccttaacaggctcgtcgttgacctcaggaataggttcagacttcctgaatggagacaatttaccatcctaaaaatagaggttttgtgagcattgtgcaggtaaacaaatatcctaaaattacataaatagtaacaaataatcacaattatattttacaagtataaaagactacttacaaagtattccttcaaccaagaaacaatttggtcaggctcaacgtgtgccttcaaaaatttcttggactcaccatcctggatgatgatgagtggtacctgatcctccctcagcccaaagtactgtacagtgacagatttaaagttagcatcaagtacattaataattgtttgaaaaaaattataagaaagtgaggtaacaaacctggaaggcaccttgactggcctcaatgtcaccaatgaggaacttaatttccttgtccttgaactcctcagcagcaccataataaactgacttgaaagactcaaacggtccagtggagaagttcaaaaatagcatagcctgcatataatttggtaacgtttagtgtcagtcatcaacaactgcaaattactggcataatgatatacggagtattaaagaacaatatttgaatcactgcgtttaatagtgagaacttgcaaatatatgaatggagaagggtatcagatattacagtctaagcaaagtctatttgaaacacgagaaataaacatttaaattgactattaatatacagtatcaatcaactactgccagctgttattaaaagaatggagcttttcagagagcaaggaatgccaagcgcttaccttggcagctgagctttggaaaaatttcagaaggtaaggatggttgtcagggttcttgtcaaaagtaacaactttaggggtgctgctagcatcaatgaacttctccaaagcagtaacatcaaaatcctgaagagatatgcaaacaacacattattgacaattaaccaaaataatgccagccaataaaggctgtgacaagttgtaggaaacatagtggccaaatgaatagttaaaacaatgaagtttgatatttgaggagttatataccttgctgtcaacaacaagctcatcaaagggcttgaatagcctaaccaatggtctctcaactgcagcatcaccgcgtggaaggtggttggcatgcaaggtgtggccaaagtcataatcagatctcagcttctcagcaacctctatgaagtttgtatactcagtgccacttaattctgagaagattccaacctatttcaattgctcattcaagtcagcagtcaattttaaagcatgaacagtcggaacagaaaatataagttggagaatgtgtcatattgaatcgaggtcttacaatgtagattttcttgtcatcaataaggttggttgcgtcttctggtgacttgatctccttggaagcaggaccaacctgcttcttcaagtattcaacaatgccctcagcctccctcgggcccttgtattcctgaatgttcttgccctggttcctgaatatcttgagtgtcgggaaaccctggatctcatacttggtagcaagaggcttgttcttctcgtcgttggcatcaaccttggcaagaacaatcggtggatcgtgcttgcttagctcttgtgcagctttctcatactgaaacagatcaagcaaagaaaattaatacatgggatcaaaccatttaatccaaaatgtgaaaatgtgctgttaaggaagtgatccaactgtacagaagcatacctctggagcgagcttcttgcagtgtccacacctgcgaatagggtttatccaattagacacatttagaacaagcattggttaaattttgattcagataacacaatagcacgatgcacaagcataatttcataaagaatcaacattgaagtacaaaaacaaaataatagtgaataattgaaccaagactacaaagctatctggatttaaaacctgtgtaagtgaaagaacacccgaaattctcagttgcaaccctgatacagacaccttataactcgaaaaaccaagtaaccaactcactcaatctaaaccactgaaatctgactaggagaccaggcatacacatcacaaacaaggtaaatctactacaatttacagaatcggctcatccgcagtcacaggtccacgcacaatcgaatcggcgaatcctatccgaatctaagactggatcaccaagatcgagaccaacaaacgcatcaattcggcaaacaccgagcctcacacgcatcgccagcttccccaattcccgcatctgaactgaagtcctaaaccctccccaaacctcgcgatctaaatcccccccccccccaaaaacccacctcgcgagatctaacccaacacgcacagctcatcaacaggggggccgtagcagagcagagcagagcacactcaccacggggcgtagaactcgacgaccatgaacgggtgcttggcgacggcctcatcgaagccgtccgcgtcaagcgtcagcacggcctccgccgccgcatcgcccccctcctccgcagccgccgcctcctccgccctcgccgccggcgccgacagcaccacggcgagcgcgagcagcagcgagatccaagccttcgagatcgccatgaggaggagacggagagtgtgggtggctttcggaatttttccctgagacgacacgcttctcacacgggttttaatagggcggagtacgcgaggggggggtttaccggatcacgtggaccaagtccacatcgaccctgaaactgcccaccgggccccaccccgcggactccctcgtggacgcggcgcaccggagtcacgagatatttacaggtaacatttgcgatgaaccccctgtacttatcatcgtcaaatcatccctccacgaggctgagatgtgctaaaactagaggtaataaattactaatatgcccctgatgaggagtgatgtgtaattaagtggaattaggggggcgaaagtggggtggtcccgagggataaatccaatcctgtgacttcaaaaaaggcaggggaattaacgacggccaacgccacgtcaccgcgcgccccgactacgtacacgtacctgtacagccctcggccaatgggagggcgccacgtcagctctatgacatgtcccggagccctgatttgctccgcgcccccaccagcgccacgcaacgcacacgcttccaaaatccggatccgggtaaattaggcggcgtttttactgctctcggatacgataaaagctgtgtagtaaaataattctaatattggcctcgtgtcgcgcgtgattgctgacgcggcgctggatcgagctcgtttgcgttgcggcagtggtgacgtggcactgttgaactccgccacgtttcaccgggtggtcccgatcggatggctactgtttttctttttctttttttcaaatcgatgactgttttttttgctgcgacttattttaaacttgtcgatcacgagaatgtgttcacgttcacggtcatatagataagagacacattttattgtttcgagagacatttatagtcacagatggcagatccggcgatgggcgaatttatttcgcatcccacctcaaaattttacaccatatcacatcaaacgtttaaacacatatgtccacgagtgatactcgtagaccgaatatagagggtattggggtacgttggtacaaggatctacgtaatacgacatcaagcaaacagagaacgaggattatactggttcagaccccttgatagataatagccctaatccagttgatatgggattatatgatggaaaagacaggttataaagggaacgatggaactcgatgaaaccgacgggatcgtaatcgagttggttcgactagatctcccggcgatttggctcctgcaggctccgacttcgtaggctgtgggggttgtgttggctccgagattcgatgccttaggtcctccagggggtcccttttatatcgcaggtcaggcggtttccaagtagaactcggagacatcggaccctacacgatacattgacgacccagtctgtccgagtaggattctttccatctgtaaactccgtgaaggatttacttagttatgcgcagaatgtccatatacgcgcagacatgccatatcgatatgtgacgtatatcgaagggtaaagggtatacctaacccgtaaccttgacagtagcccccgacttctgcttaaatgaactcgtgtaaccaatcgcgacttctggtgtcgaggctgttgttgttctcggtgtgagaactgtggagacaggacatagccgagaacaccatgtgaagcccaacggtcatgagcgaatttaaactgaagtgagaaagactgccgcgcgtaacggaccaagaaatttccggcggtcatctctctcctttccttgaaatttgcaccgtcggaagtgcgtttatttaagagagttttggggatccattttgaagtctgcctgttgtgaagaaaccctccaacctccaagcgcttctcgtcttttccgctcccgcaaaaccctagctcatcaatctcagtcctttctccggcgatctccagtcagcgatggatctcggcaagtcctcctccaccagcgcgtcgctgaataagctacaggaggatggcgcccctcccggtcgtgggaccatggagagagaagaaggaggtactgaaccccagcttgtcctaggtcgcatggttgcgatcgaggactacattctctgcggttttctccctccgccttctgaatttcttctcttggttttgaacttctacggtctttctttgctccatttgaaccccaattctattgccttccttagtatttttttgcatctttgtgaggcctacattggggtagagccttttcttgatctctttcgcttctactacgagttgcgttggatgtagtccaacagggtatctggatgcgtcggattccgactccgggatggcctgaagtcgcgttatatccccttccagtgcccttcctctcatagcaaatggcggacgaggtggttctatcttcagatagaaaattcggatcctgtctttgttgttcctgaggaacaaccagacaagatttcgtcttggaccgcaaagcccaccttgaccccttcccttcagtccttcatcgatgttatcgacgatctccgagtacgaggtttgtcggggtatgaagtcgctgctgacttcgttggtagacggatccagtcgctccaggctcgagcccatctagcctttgactattctggaccggaggacacgacccaggtttctcctcggggtatctttcttgcatttaccctgacttgcttgtgtgcgcgttcctcctgacttatcgaactttggttctcgattcacaggtctgagcagcgaagccgtgggacgtcgtgtcggccaggtgatgatcagtggcccaacgatggcgagcaatgtccccgttctcctttgcgagaagggggcggccgaacgcgacgctgccatcaatgtaagtgtactcagtaggccttctgtgtttttcttccgggatcgccttatgacttcataaagcgtaggctctccctctgactgatatcatcgggccgctcatggaccatcaggtggcggtgtcactaaaagagaaggtcgccaaggaggcgtccgatgctgctgctgtcgctgccacaacaagtggtggcgacgttccaaaaaaggggaggaaattctcctctgtaatcggacatcgtcgaaaggcacctaccccctcggtaagttctcctgtcatttgatcacgtagtcagaatacttccaccccacatcatatcgattgtactccaagccttggacgcgtctcccctgcctccacgacggcagcggcttgtgacactcggcgagaagtgagtgaatgaatttgaggtttcgtgatttcgtcgaactttgtctgaaccacagccttcttgtagggcggcgcgggccaaggcggcgcaggacgggtctggagggacttccagcgcgtctcctgctgtagcctcgacggatgtcgtggtcgtgcccgggagccacgaggcgacaccaagcggcccagccagcgatctcgtggctggtcatggttcgccggctgccgtcctcacctgggaggagctccaggttgagatgtggcgcctcctcgaggctggtgctcgcggcattggccgcgagatcatggaggtgagagcggcggcggcgtcgtcgtcggcgaacgagcgcgccgaccggctggcacacgacttggcggaggctcgtgaggacctcaagaagatgaggaaactggtggccgggaatgagcgacaacggcaggggctcgagcaccgtatgtcggagctcgagaacaacttatcggaaatccgtggctcgttgcgggtcacctatactggtctgcaccagctcgccggggaatgcggtatcaagtctaccatccccgcgaatcccaatgagttctcgctgacgtcttctcttgcggagctggcggcggcgatggaggagattccctccaagcatgcggccaggatcggagaggagacgtccaacgggaactacaccggggcatgccacgtccttgcgtgtgtgaggctggcgcaccctgaactcgatctgcgggagatcttggaatagggggcggctagcgacgcgcataaggatgtgatggaagaagtcggtgatctgggggagtctgttctccccctttttgaagagtaggattttgactctcttgtactccttagacatgctgtataaaactccaattggctccaaccgcctttgtgcgtgcagtcatcaccttagtttgctttagcattttgatcttgagtactttttttgtcccttgtagagatgttgatgtcgaggatgtccagcagcgtgggcagcctgagtcgccagcgatcattccggctcttgcgtttgagccacacgcgtcgccggacgatgtagatcagattttacccgcgagaatggggatggcgatgacttccttaggttagtggtctcttcatccctttttgctcctccgacttgatcaaccgtgttctcgaaagaggagtgcagcttgacttagtcgtttccatattgaacagatctcgagagtgcgcttgctggcaagatcgtcgtatccaatattggaagatgaaatttgaagtagcggagctcgagagaactatgctggaagtaaagaaagagcaagctgtggaaacgctttgaggttgtgaggtatggttcaacttgtacttgaagagttgctgcacgtccatggccaaggtttgtagagagctccgagtaccccgtggagatcctgaggagtcggcggccggatacatatcgtggatgaatggggcgtgtactcagctcgaaggcgtcggcaaacgcattgacgaagccttgaagcaggaatgtcgtcgatcgagccgatatgccggagggcacgtgttggcttgcctacgagatcatcgtccgcgacaggacctcgagtttctccatgaaggttttgctcgttctcggagaactacggcggagatagaccacctggcaaagtcgatggcgccgttggcggagaaggtcttctagtctatggactggagttggccttcttggtagtctttgtaccctgtgatggatatcttagggaaaagtgtaatatagctttgaacttgtgtaaaattgtaaggggtattttgtgaaatagaaaagaaatctatcttaacaaatccttcttactctggatatcgtgtgtaagggtgtgttctcagttcacgactttagttagtcgtttgagtcgtacactctctctagcccccagccttgtcatcggaggatttttctcggaggataagcctcttggacctttgacctgccttggttgaataagcactgatcctagcccccagccgtgaagttggaaagtgaatttccgattacgcggcttggttaatacgcacggcgagaactcttacacgaccaggtcttacatggtctttcgtctctacaggatctgacaaggccttatcggctctgggcgtccccagtagaagatcccttaggttcatcggaggccttctcaagatgacgtaaagggacatggggataggtttcaacgctaggtgtcatcttgttaacaaccaaatttggtaacatcggcatcaggaaagaagattagatcgaagcaaagtcggaggcagagattgagttcggaaacaaagcaggaatcggctggagtccaaatcggatgcgattggcatcggctaggtctgagtcggactaggtaagccgatacagccgattccgacaatgcagcttgatgtatgatatcgggttggattgaggtgcttcaaggtgattgccgcacatggatagagtcctgagaagtcaattgtatctattaattagggtgttttatgtaatctccttagagatacgattgggcaaaagtctgccgcaaagacttgtggtatcctagagtttgataagatagtagtcgtgtctgttatggacatatcttgtgattctcgggtataaatagacccgagccctatgtaacttttaacacacacacacgttcaatacaatttcggcgcatcgccacccttttgctttagttttgtttcgatgagttcttgctttcaggttgagctgcatcggtttcgatcttcaacgagaggtaaaacttgttatgacggcttgtattctcgggattagtgcttccatctttatgacactctgatctcgtttatgtaattcatcgagttatcatatatcttacataatctccggcaataccgctatctaatctacaatcggctaacatctgtctgtagagggtagccgattaggttagatatcgatgttgacttagattatataaggtatccaccactctatgaaacttccagcgacttgattgtctagatattgttcttcttttcatacttaatgttgcatcagtcgagtttgatctattaagtcgtgcttagaatatcaatctctaacatgccttctggttgccaattagggtagcatcggagtttcagccgatcttatctgatctaactatatttgctctatatgcttcattgacatattaaatctgtcctttatgtcaagatattgctgtatctaagtatattagtcctttgtttaatatattatgtctgttttaatatcctgatatagagtagtattggagtattagccgatacatgctagatctatctgatcggctatgctataaacatatatagccctgttattaatatatatttcgatctaagtgatttatactgtctcggcatggcgaccgatctatcccaatcactcgatttaagtatatatcgatataagaactatatattggaaatatctacagccgatcgaatagatttagttctttattgtctatttacaactgccgatcgattcacatatgacatcggctcaaagataaatgttatgtcatcggcacctagccgatcggctatcatttatagatttaaccacggtttctttgcctttatttcttgttgattacgggatcaaatcaactggcacgctagtacacccgaaggcgagctttggacctacactggagttaagcagatctcccaggcctcgtgttttctgtcaacacatctgggtaagggatcatcgggtaggaacactttgattgtaatatgcgcctaaaaataggctccattgatactgtaaggtgtcttacaggtgtggatgacattgactcatacatagaatttacgtagttggtcaatattccaagagtttgccaactcgcgaccatcaccgtctgcaatttttaatgcgcctggccgcaaaacttgtgtgatcgtgtaaggtccttcccatttgggtgagagcttgtttcgccctacttggcattgaacccgtcggaggacatagtcgccgattgaaagtatgcgtgctcggatgcgctcctcgtggtagcggcggagagcctgttggtaactggctactcggacggcaactcgttcgcgatgttcctcgagtagattcacatcgacgtttcgctattcctcctgatcctcgtcggaatacttctgtactcgtgtactctgatgtcgtagctcgctggggagcatggcctcggagccgtacatgaggaagaagggtgtttccttgttagacgttgtcggtgtggtgcgtacggcccatagtactgatgggagttcttcgacccattttttgtcatgtgacatgaatctgttgtagacgcgggtcttgatccc

SEQ ID NO: 76292 - DNA, 7597 bp, Oryza sativa
tgcggttatcagtctgaatggcatcttaacatagcaaaacaccccgaacggcgtgatgaatgctgtcttctctccgtcctctttcgccatgctgattcggtggtagccagagtaagcgtcgaggaagctcaacagctcacagccggctgttgagtccaccagttgatctattcgaggaagagggaagtgatctttgggacacgccttgttgaggtcggtgaaatcgacgcacattctccatttctcgttggccttccgcaccatgactggattggctagccactctggatgaagtacctctctgatgaagccagctttgagaagtttgtcgagctcttctcgtatggcttgtttttggtctggtgcaaatcttcgcagtttttgctttactggcttggcatcgggtcgcaccatgagtttgtgctcaatcacctccctggggaccctcggcatgtcggacggttgccaagcgaacacgtcagcattgtcgcggaggaaggtgatgagcacgaattcctatttctcgcttagtgttgccccgatcttgacggtcttgtcagggttggcactagagagtggaacggtcttgatcgcgccgtccggtttcggcgtcttgtttgtcttgctcactttcttgggtggctcagttgtggcgggtgggctgggcatttgctcgaccatgtcgaggctccacttgtcgcattgtaccgccagctttgtgttcccttgaatagtgattgttcccttcggtcccggcatcttgagcacttgatacgcgtagtgggatgtggccatgaacttcgcaagtgcagttctcccgatgatggcattatacgctgtatcgaattcagcgacatcaaaggtgatctgctccattcggaagttgtttgcttggccgaaagtcacaggcaacgtaattttgcccaatggtttggacgaggattggggagtaattccatggaaggattgatcggtgggtgtcaactcgcttcgcgaaattcccatcgcgtccaaagcactggcgaagagaaggttgattgagctaccaccgtcgatgagaacccacgcaaccttgatgttccgaatagtgggttcgaccacgatcggatagcgtcctgggatgacggcagtcttgggatggtcttcttctgaaaattctatcttctgttcagaccacttcatcttgtgtgcagccccctgccatgtcgaacagacttcacgttccactttcttgtattctcgctttgaggagtacgctgtggaacctccgaaaatgtgtgaaacgtggaggttagagtctggatatgctgtgtccgattcctgaggagccacctccgcatccttctcgaccacgcgtactcgcttgcctttttcaaatgccatgtgcttctcgagcgactttttgaaaacaaggcaatcttccaaagaatgtctgtctatcttgtgtatggggcaccatgctttcttcgtgtcgctaccttgtgggtctgggcgcttgggagggttcgcgtattctgctgcgagaacttccgcttgagctttcattttcccacttttgcgatttttcttcttgcttgactcaggtgcgtccgtggctggtttcttctctcccccggtcttcggcttatcgttcttgcgtctcagtgcatcatctgcgtgggcgcatcgctcaacaatctcgaacaatctccgagtagttgtgatgcgtcttgcacaactcctgggtagtatagcgatctctgacaccagacttgaaggcgcaaattacagaagcatcggtgatttcggggattgtatttctgcactcgttgaagcgccgaacatattccctcaaggattcacccgagttctgtgtcaacgcatgtaggtcgtcttcgatcgcgtggcgcttgtaagttccttggaagttggcaatgaactgctggcacaggtctgcacacgaagagatcgagtagggcgggagatgcatcagccatgaacgtgcagagccttttaacgcagttggtaaataattcgccaatgcattgtcgtctgctctggcggcgtagagtactgtggagtagacttgaaggaactcttctgggtcggtgctcccatcgtacttctctattgctccgggtcggaatctctcaggccattggacatcacgcagggaacgactgaaagctctacacccagcgctgggggcggtgggttgtcggcgatcgtgtgtccttcatggatgtctgtctgatgatgaggatgaagaagaagacgacgatgacgatggatcgcttggttccggtgtaggattacgaggacgtcggctaggttctcgagaatcctttcgccgccctcggttgttgtcccggcgtcgatctccgtcgtcctcgtcattatggcggtgtccttgaccagtgtcaccctgcgtccgcctctcgcaatcatcgtgatcgtggcgatcgtggcgattaacacggtctcggtcttcgctcgagcggccctcccgtctttcattatcgcgatgtcgtgaagagacgcgatgccgggagcgatccccgttgtctcgtgtgcgtcgtgcctctcagcggccattgaggtggtcacggagatcgccggtgccgcgaggtggaggggtagctcgatggggtgactcccactattcgggattttcgccattggcaccgccagttggtggctattccgggtgtgctgcatcagcggcttcttcgaacgcgttgctgaggttggttactgattcccgtagctgttctgtccactgtgcgagatcatcgtttagaacgggatcgtaaggggtctccctcagtattgcgttgatggtcctgatgtgctaggccggtgtagccacttgattttgtgcttccgcattagcgtgtgctgacgtgctggtcccgtcgatagctaatacctcgcgcggcgtactcgctttgatgagccatagtcctcgagtagatgcaggactgatggttcgggtgaactgatgtcgattatgccaacgaatcgatctgaaaccagcgtcgttccttgttccttgtcttcatctctaagggatatgcctaactgctggaccttaggggatgacgtcatcgtggcgctgagaaagaccttgcagcttgagaggtcgtgattctttgtcttgtgaataggacaatagacatcacaggttggagaaatacgctgaattccacgctctttgcaggcgcgaatttcggcgcggacgttgagaaaaacccaacaggcgtgcaaagtgtgtttcctggttttgtggataggacaccaggaccttgtcgcttcggaagttattctcgtcggctcgtggctcttgtctgaacgacaaggtttggccgcattagaatccttctcgagctcggatgtcgtcaatgttctgttctccgcttcggcgggaggatccttcgacagggagtcgtcctgggttgtatccactgcgttctcatttccggtcattgatggaccagctgagatcggcatcgtggtataaaccgggaagacgatttcgccgacttgagtccacaccagcattgttgaagtaggaaatccctggtggaggttggtgttgacgccgttgtcaacgaaactggatgacatagtagtagaaccttgagcaccaagtccccctacctggcgcgccactgtcgacgagtgatacccgtagaccggatatagagggtattggggtacgttggtacaaggatctatgtaatacgacatcaagcaaacagagaacgaggattatactggttcaggccccttgataggtaatagccctaatccagttgatatgagattatatgatggaaaacacaggttacaaagggtacgatggaactcgatgaaaccgacgggatcgtaatcgagttggttcgactagatctcccggcgatttggctcctgcaggctccgacttcgtaggctgtgggggttgtgttggctccgagattcgatgccttaggtcctccagggggtcccttttatatcgcaggtcaggtggtttccaagtagaactcggagacatcgaaacctacacgatacattgacgacccagtcttgtccgagtaggattcttttcatctgtaaactccgtgaaggatttccttagttatgcggagaatgtccatatacgcgcagacatgccatatcgatatgtgacgtatatcgaaaggtaaagggtatacctaacccgtaaccctgacaacatacatgaaatattaaatatatgctaaaataataactaattgcacagattgcgactaatttgcgagatgaatctttttatcctaattactacattatttgacaatgtggtgctacagtaaacatttgctaataacggatttattaggcttaataaattcgtctcacaccctatataatactcaatgtgacacgccaaaactttacacccctggatctaaacaccccctcaaatttgaacaatgtaagagtagtactccttcccaaaatataagaatttagaactggatcggacattttctaatactacgaatttggacagcacgtcccatccagttctaggtttttatattttgggacggagggagtacatggcatgaagcatgatgcgtgtgaaatggaagaaaaaggatttggtacaattgctttcagaaagaattgttgcacagagttgatcttgcacatggtaagtcaatctttgcacggacgttgcttctatggaagaaccttgtgtgtacttcttacttggagaaaacaacttcttcaaaccaatcctgacttgtacgtagttcttcaaaccttacaacgtgcaggtccattcgattagggatgagctaagaggttaggcatatgatgtgaaaaaaaatcggatgtacacattgcgcgcgcagtagaaggaggggatggaaaaaagacgattgcacttttacaacagtagagactagagaaaatacgaagtatcacttaaacactttcaagacatgtgaaatcattctattgtcctcttctagcttcaattcatgttttcaaaaaaacttttagtcaggtcgccttgtccaattgttttcggtacaagaaatgacgacatatttatgtgcaaaccacatatacaattcagacgaacacagggatgattcatcttttgttctcttccccaacgacttcacatgaatcatatgcctttgtaccagctatatatgacttgctttttatattgagaataagcattattctcatatctccttttccttttctttttcaggtttgtcctcgtacaattgtaatgtccaaaggactggaaaagtgcagtaacagaaaggtgcttcacaaactgaaaagttgaaagccatgtcactgcactacgtctgacaaaagaacaacagctataggtatttggcatttttattggctactctataaaaaaagcacattaatatttgtgtcaaagaatttaatttctacccaagatttataggcagagggcatgtagctccacataatggagctcagatgatcaaatacataattacatagtccttactacatggagtctaaagaaatatatatatatccaagtagtgcagcatcatgcacggccactacttattagaaataaaatgaagtgaataaagatatgcttctgatgatgccaccggcgtgaaccgagcaatctttcatgcagattttcgcctccacctactcccacgcacgcacgcaatgagcaatagttggttgctgacttgatccgagctttgacaaattcagtttggaactttggatgaatctgcaattctgacgacaaaagggaagggaaggacaaaaaggttttactttaatcttctttcactcaatgtctaaagtgattttcagagacatacaatgggctttatatctttcttttactcaacatctaaaatgatattcagagacaacacaatgggcgaagacctgtatttatctctgctctgaaagactgaaacagtctctgctccagctacgaagactgtatacttgctggtcatacagatccaggatgtgtattatttgcaaattcatcagaaagcatgactcaaccatcacacacactcacacgtaccatctgtcatctctttcgatgatatcattcaacagggtgacaaactgaaaacaaagaattgcaagaaagattggaatgaacacaacaggatgacccaggtatgatgatgattacagaaaactttcaggaagataagcgagccaaacatagaaattgggagataaaacattgttgcatgattcacaggttctcaaaatgattaacggcatacaaacaacacgaagatctagagcttcaaatactacttcattgtagaatggaaaaaagaacagtactcgccctgacctgagttgaggatagaaattgttacaatcgaggatagaacagtactcgccctgcacctaaattgttacatgcttgtcggaggatgcctggtacatgcatctacgattttgacgagaagaaatgatatttagacatagtactatatcatcgtaattgatgtccttgttgcctgctccagttcttcaaactcagcgcctagcgcttcgcttcctgctcttctttcggctgcccttgtcatcagaatcactgtcagatgcagatgcagattcggagtcagattcagacgatgctgatgatgaggtttcccttctgtgcctcctcttctgctgcttcctttgggtcgccgcttcttgtcctccgagtctgaggagctgtagcttgagctacttccagaagaatattcagagccggtaactgatgattcactgtcagagtcaaatacagaagcctcactactatctgaatcactccgtgaacggtattttctcttgcttttccgtttgcttttctcagacttctccttcttcaactttgctttcatcagcttcctttcctcttccttttccttctcaagatcaggattctggaactgataggaaacaggagcagccgtcttcttcagcttggggttcttgagctgctgtgtcctcgagggccgcgaaatgtagacccgttcgttcttgcactcgtatgtccagtgcccaggctgaaaacacttctggcactgggtatatgcgccaccagaagaagaagaagtttgcgcagcttttggtttcactcccagtatcacagccttctctgtactcatcagatacatctgtctcttggcctccttcctctcctgccagcgcgaaggtccctcttctttctgcccataagcattgacattgcgggcagcggctgcagcagctcgctcggcttgagttctgctcaatcccttggcagcagataaggcctgtgcttttattctctcagctgcagcctgagacttatcgtcatttccagacatcttgggctcacccaacaagaatcaaatcatacaaaatcagcaatattatgatcctgtaaggaaaccaaaatacatcaatagagtaatttgggtaatgaaaaataacgcaaacaataaataagctttctgctataccaaaatcaacacattgatgcaggaaaaaaaatctggcacataatatttttcgttgctataagaacaacatctacttatca

SEQ ID NO: 76293 - DNA, 15243 bp, Oryza sativa
ctggaccccccccccccccccaaaactttattccgtaacaaactgctgctattagtgctagggttagggcaaattaagagaaaagcttccagatctaggagaagagaagctagggtttaggcgaagacagatggtgcgggggtaggaaggtgcgtgtgggttggtgctcaccggcggcgaggatgcttgcggcggaaggaggcagcaggtccgcctcggctgctcgccgagttcgatggagatcggcgcaggcgaggcggcgggcgaactcacgaggaaaagagagagagagagagagagagaggagcgggtcagaatcgggagaggtgaacgggtcgggatgtgggggcgagcgatgatacgtgggccgttaatgggccgatcactatgtcggtcagtgatgggctgatctttatgtgggccggtgatgggcccatgaagtaaataatgatttgtactgatcctaacagggtaaatttacggtgatattagacaaccatgcaaagttttattgtgagatataaaacgaagaaaattagaaaaaagaaaaaacagaaacaatgtttttattttaagattctttaattttattatgcataaacggagttgaggttgtttatttacatcctacctacatgctctgtgtgattctttcagaacttctatataaaaaaatttccacaagttcctgatttttgaacatgcgtgcaaattagagtataataaaattattatttcttgatatcatatgatatagaagtaccccgcaaaaaaaaatgatatagaagtatatttatttgagatccattgccataaatggtcccaatacggaacccatttctgtttctcagaagcatgagcccttaccccaccctagcagaaaacacatacaccattctcagttttgtcaagattttggaggtctattacctgcagcgagactgaattctacccgggaaatacttttttttttatttattaaacacgcgaaactactataaccataaaactgacagctttcaaaggccatgtacagttttctccacactgaaaaaacagtaaagttacaccacttcaaattgcaacctgaactatgaatattgctgccaaatggagtaatatatacagcaaaggaaagtaggagcatgaatggaaaaggaaaaaaaatgtggcaaaggttccaaaaaaaaaaacatcctgactacacaacacacaacccattatgatcatgactgaatgtatctgatatctgtgaattctaactgtcgaatgcacaataacaccttgcacaccaagtaattcccaaggtaatgaaatccagactgaaactcttatttgatggtatatatcatctctaaagccgctaaacctgtaaagccaaatagcttggcaactcctcaaagtgcttccctagcacccattggtcagcgagtcctgcggctgttggctggtttagatggagaagacggtttgttcttagcgaaatcgacaagatccttgaaaagagaatcttcaggtttggtctgccgtgatgcggtcggaactgatgaacctctctcattctcggtattcctctgattaagcgaaaggccttctgtttggctcaccagtccattgtacccggcaccgttgttaccactaggaaggccgtgctgttgctcgaagtactgctgtctttggccataccttgctggaggtggcggtaaggaacctggagcttgcgcttcccatggagcttttggaagatcttcaccggagtctccatacttgttagcatttgaagacgaagaaaaaccagggatagctgttgggtttataaaatcatcatcaggtagactctcctgcctattgacagcaggacgatttgactcgctcataggacgagaaggcatagagaagctgggtgctgcagttgggtttatgaagtcatcagacacactttctgaccggctatcataacttggcggcggattcgtttctgtttttgaatgagacggcgcaggtatattggctggggcagttggattaataaagtcatctgatactttttctgtcttgtaggagtcgccactaagatagtcaacactgcttgcctccgtgaaaactggcctctttgatgatggtggcggaggaagaagtgggcttgggtaaggcctttcactttttggagcagaaggtagattgccctgtgctgctgtgccatcccttgcagacctacagaacatatatttgtacatcagatgacaaacctaaccagaccgggaatcttggtatcataacatgatccgcatcaccaaaacattttcttaaaagcagtcagctgatgttgccacaaccatccaaagcttaaaatagcaatagcatgtatgaaaaataattagtaaagggtactaatagggaaaactaatatagcttgcctgcgggaaagaacagagaactcgtcttctggctcatcgtcttcatggtgcacattaagaagtggggaaaatgaaaccccagtaggcctaggaggggctgttcctcggtttacattagcagcagcaggagctgggcctgaaccgggaggcactccctttgcgatgtcatcatgacgctgaagaacacgctgcagttcatcatttaaaccgagagcttgaaatagaaggctctcatcactgcagaggatacaagacaatatgtcacatgacaatgtgaaaaggacatggaaccaaaatttcagagtaaaagaatagaacatacccagtattgctaacaaggtccatgactcgaccttgataagatcggcactgcccaacaaggtcaacaatgacctcctccctcacaccctacaacatgaagcgcaattagacagaaatttagagaaaaagagcataggtgggtggaatggtggattcaatagttaaatacagagacgcatagagacatcacactagtgcaagtttggtcataataaattaaaatattagggcacattatttttagccagataccagagcaagttctagaaaatacaaaagcttagaaatccctctttaattattcttatgccctcagtctcctatgctgctaaacatgattccctctgaacaaatggaccaagtaaaatagttcgcacattcctgtaagctgatgaggtaacatggatgaacaaagatataaatggatattggataatatactagacttcaaagcctagcaagaaactactttgtcatccattacacatagatctgatcaatgatgggacatgtaatagttacatcctcttctgtgcacaattcacagatacagctcagctcactacatgtgaaatatgctgtagtatgatcatatgaaataaaacacatgatttatgcataatttttttcatgggaaaaacaaaggtctagaagacatgacaatcatattaaagctcttaaaagtaaaagaaactacagaagagatacaaggattatacaacactgcactaaattttgatgcttaaaaaagtcacctcagggtgcctgtggtccaaagcatttaacatctcatccaacacatccacaattcctcgagcactctgaatctcacttagactgtaatgcacaaggagcaagaattaaaggtggattataactaaagaatttcttctgcaaagatggtgaaataaattgataaacacaattgaagtattcaggtattgtttagcatgattatgaaactaaactgtcacaaggcaataagtagaatctattttggcacactgacaccgccatattttgttgttagaaataccactataagtatgaaattcttggaaagttgcatggccctagttctatgaatgtcttgcctgtaaggctgtaacagggagacaaacaaaattactattaatgtaatgcatcataattactttctagtatgctttagagttcaggaatgaggacaaccaaggatagcggcaactgcaaccatcagtaccgaaggttccaactttagatcagagatggcgtacttcaagaaagcaattaatcactgaccacttttttcccccaaaatacttgacactccatagttgctaccaggtatttttccaatatcacacctggtgggcccaaccggaggttcagcttttttttttttttttttgcccctcaaaactactaatgtgttctcagtgactaggaaaaaacaagaaagatctggagcctgatagcctatatgcaccgtgaaccttctttccgtactctccagttgtgctgagcggcaagtcctcagggttggagccttggaggcacacaaatcgtccagaagcaacttggacactgctttctgctgtctgatgcacaatttcagcagaatagagatactttaatccaggagcattttcgaaatttaactaggaaacattttatagccttgggaagtttgcttggctaatgggtgtcatctatagaggaacagagggagcagaacatattgtgagtacgattccactcctaaaacatgcctagccatttaatgtggttgtaggctgatcagtatttctgataggaacatgtgtttgaaacttttcccccacaagtgtgaatttacaaaccaggccatgcttgttccaaccaaagtaggttattctaaagagaatgggaaaaatagaacaaagcaaggcataaagaaacagcaaaagtaaatggcattaagaaactatggatgaatatgacagtactgcttgaagtgaacaagtaaataaggaacaaattttgcattagaacaaaagaacacctcaaggcaggtgcagaaggggcgctagattgaagagaagcttgtatcgctgcatcttcatagctttgacctggaggtggatatagatgtggttgcctcaatggttgagtttgaggaggtgtaaacagtggaaccgtgttctcctcacgaggtggaaaatcaacaccagcattctgcacacaagggcaggatatcttgttcatggtttggacagaaacagaagcaattgaatattaactcaaaagtaaaaacgttgaagatctaagtttacattgaaacaaagtgcagaacagattgaagttgagtggaacagtagtcaagtatgagctgtgatagcacaggataaataacagatgagaaaactggaatgaacacaagtagacagtaccctgagttcttggtaagcagcgtgatactggggatatctgccagatgcacctccaaaagccacttgccatgtgtcaatcaaactcaatattttctcccgaacatttaaatctggctgaaatcataaattggcaatcaaatacagaagcataagaatgtaggaactataggaataagtcttggctggttggtcttggtcttgtggtgccttttcctgcttttcagctttctaggacagcatctctactttcagtttggatgctctaggacagttaggacagcagtttgttgagatgctctaggacaatatgttgagatgctctaggacagtttgttgggatgctctaggacagtatgttgagatgctctaggacagtttgttgggatgctctaggacagcaccctcttagactagcatggctgcatggctgctacaagcagctataaatatgtatccaatcctctttgggaggatatggcttttgagtttgtgaatgaagaaaaccagaaaattgccccactccgagtgccatcctcttctcaatgagagtagccattgaagttctaacatctggtatcagagccacactttcctgtaggctaaacatctcttgttccaccccttcccaagctcggttgagctctcagccaccaccagcagcagcaacaccggctgctcctccttcccctttcccttccccctctccacgcagcagccccccggaggtgcgccatgtccgacgttcggtctcggcgttcggtcgtctcgagcactcggcgtcagcaggacgccgagctcgccgcagcagaagagcgcaggcgagcaacggctcagaccgctgcagcagcagcgagggcggccagactggcggcagcagagttggcagcagccagggcggaggcagaagcagaggcggcggaagatgcggcacgtgcggcggaggtagaggttgagaccttgcgcagcagcatcaacggctccatcgccggcgacatcaccgccgacagggagcttgaggagcttgcaagaggtagggcacgggagcgggcagagcggtgggcagcagcccacctccacggcggcggcggcggcccaagggaccgcgcgcccgccgacgggaacccagacgggcgcgggcgtgccggcggcagcccggagcccgcgcgcggccctcgcaggcagcgtggctctccctcccctgaccggcaccatggccaccacggcgtccagacggtggtcagggactttggtcccggcggtgggtggcctaccctcaccaaaaccaactacatcgagtgggccgcggtgatgagggtgaggctccaggtgcggcacatgtgggaggcagtccggtacggcgacgtcgactacgacgaggatcggcgggcactggatgccctcatcgctgcagtcccgcccgagatgcagttctcgctttcccagaagcggactgccaaggaggcctgggacgccatcgctgcggcacgcatcggcagcgatcgcgcccacaagtcaacactgcaggcactccgcaaggagtgggagaacctggccttcaagccaggtgaggatgttgatgactttgccctccgtctccacactcttttgcagaagatggtgcagtacggcgacgacacctacgacgaggagagagctgtcgagaagctctttcgctgcgtcccagagaagtacaagcagatcgctcgctcgattgagtctttgctggacctctccacgatgtcgatcgaggaggcgttaggtcgcctaaaggtcgtcgacggcgatgagccacagcctctctcggggcctatcaccattggcgggaagctccatctcactcgggagcagtgggaggccagccagagtaacgggaggaagggggagtcccctccctcgacaggcggccgcaagccgcgcaaggcgcgcggaggcgtccagctgcggtgggcgcgaagacgcgccgagggtggcgctcgcagaggtgcccagggcgacgccgctggcaaccacaagccggcacgagacgacgcctgccgcaactgtggcaagcttggccattgggccaaagactgtcgacagccacgacgcggccaggcccacgtcgcacaggtggaggaaaagccggctctgctcctagcacacgccagcatcgagctatcttcagcggcaccggccgcaacggctttcctccacctcgaggagccgaaggtacacgccttcctcggcaacagctccagcaacgacaaggctgatgggtggtacctcgacaccggcgccacccatcatatgactggccggcgggagttcttcaccgagcttgactccagcgtccgaggctccgtcaagtttggggatgcctccggcgtggagatcaagggcgtcggctccgtcaccttcaccaccaagtccggtgagcacaggctgctcaccggagtctactacatccccgcgttgagaaactctatcatcagcgtgggacagctggatgagaacggctcaagcgtgttggtcgagcacggagtcatgaggatttgggatcgccgccgtcgccttcttgccaaggtaaccagaggcactaatcgactctacatcctcagcgcgcaggtcgcacaaccagtttgcctcgccgctcgtcgagacggcgaggcgtggcagtggcacgagcgtttcgggcaccttcactttgaggccctgaagcggctcagcgccaaggagatggtgcgaggcctgccgtgccttgaccacgtggagcagctctgcgacgtctgcgtcctaacgaagcagaggcggctcccctttccccagcagacgagtttccgagccaaggagcggctcgagctcatgcacggggacttgtgtggcccagtgacaccggccacaccaggaggacgacgttacttcctgctgctcgtcgacgacctctcccgctacatgtgggtgatggtcctcggcagcaagggagaggctgcggacaccatccggcgcgcgcaggctgctgcagaggcggagtgcggccgcaagctacgcgtactgcgcaccgacaacggcggcgaattcacggcggctgaattcgcgtcgtactgcgctgatgagggcattcagcgccactacaccgcgccgtacagcccgcagcagaacggcgtcgtcgagcggcgcaaccagacggttgtggggatggctcgggctctcctcaagcagagggggatgccggccatcttctggggagaggcggtggtgacggccgtctacatcctcaaccgctcgcctaccaaggccctcgatggcaggacaccgtacgaggcttggcatgggcgcaagccaggggtctcccacctgcgggtcttcggctgcctcgcgttcgtcaaggagcttggccccatcagcaagctcgatgacaggagcaccccaggggtgttcatcggctacgcggagggctcgaaggcctatcgcatcctcgacccggagacacagcgtgtgcgcacagcgcacgacgtagtgttcgactaagggcgagggtgggtatgggacaagacggtggacgatggttcgactctgacgtacgacgacttcaccgtcgagtatgtccacttcgagagagctgggggagtaggcagctcttcttcaccaagcgtgtctaccccagtccccgagcctccatcgactccgacaccaacacaccctcgggccacggcttcgactgcgacgagctcttcgccgacaccaccacagccggcaaccccacgcgccccagcaccaacagccactcctccgagcacgtctactccgacgccagctcgtgttgagcgcagcccggtggagttcgctactccgctctcccacgacggggagcgcatcgacgcgtaccacgacggcgagcagctacggtaccgtacgatggaggatcttctcggtgaccagcccgtgccaggaatggtgcctcgcgacctggaggcgcagttgcaccttgcgtgcgacgacggtgagcctcggtctttcgcagaggccgagaaacacgcggcatggcgtgccgcgatgcagtcggagatggacgcggttcaggagaaccgcacctgggagcttgttgatctccctcgtggtcaccgcgcgatcacccttaagtgggtgttcaagttgaagagggataaagccggagccatcgtcaagcacaaggctcgcttggtggcacgcggtttcgtgcagcaggaggggatcgactacgacgatgccttcgctcccgtggcacggatggagtccgtgcgactccttgcgctggctgctcaggaaggctggggcgtccatcacatggacgtcaagtcggcgtttctgaacggcgacttgaaggaggaggtctacgtgtaccagccgccgggattcgtgatccccggcaaggagggaaggtgctacgcctgcacaaggcactctatggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttggtgatcaccggcaccaaggatgcggaggtcgcggcgttcaaggaggagatgaaggccaccttccagatgagtgatctgggcctctctccttctacctggggatccaggtgtaccaggacgactccggaatcacgcttcggcagaccgcctacgccaagcgcgtcgttgagctggctgggctcaccgattgcaacccagctctcactccgatggaggagagactgaagctgagccgcgacagcacggcggaggaagtggatgctacacagtaccggcgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccgaggtgtcctggcaaggcacacttcgtcgggtacagcgacagcgaccacgccggcgacattgacaccagcaagagcacgagcgggattctcttcttcctcggcgagtgcctcgttagctggcagtcaatcaagcagcaggtggtggccctgtccagctgcgaggccgagtacatggtggcatccgccgcttcgacccaggcgctctggcttgctcgactgcttagtgatctcctcggcagagatactggagcggtggagctcagggtggatagccagtccgctctggccctggcaaagaaccccgtttttcacgaacggagcaagcacatccgggtgaggtaccatttcatccgaagctacttggaggaagggagcatcaaggcgagctacatcaacaccaaggaccagcttgcggatttgctcaccaaaccccttgggaggatcaagttccttgagctttgctcccggatcgggatggctcaactttcccacaagacgacgcacaagacttagggggagaatgtaggaataagtcttggctggttggtcttggtcttgtggtgccttttcctgcttttcagctttctaggacagcatctctactttcagtttgaatgctctaggacagttaggacagcagtttgttgagatgctctaggacagtttgttgggatgctctgctctaggacagtttgttgggatgctctaggacagcaccctcttagactagcatggctgcatggctgctacaagcagctataaatatgtatccaatcctctttgggaggatatggcttttgagtttgtgaatgaagaaaaccagaaaattgccccactccgagtgccatcctcttctcaatgagagtaaccattgaagttctaacaggaactaggaaagcaatagttggccactgaatgtgagtataatcctcacctttttctttactatcttaaccatttcacttaatatgtctcgctcaatgatttgctggtaaacaacatccccacagtttttgcttagagtctctagcacctgaaaaggaagacaaacaaacagaacaaatcagcacattaaacaagacatgactgtgcacatagaaactatgctctttgtttcctaaatctggaggaagcacaagaagtttccaaaatctggaagaagaacaagaaataacttctaaatttgtgtagctagtgaagacaggtgaattcttaaatttaggaatgaatcgacctaaaactcacattgttaaaacaaaaaaatcagaagataacacactgagtatcaatatacaaggactcttgaaatactcacataaagcgtcagaatttgcacttttgaattcttgtttcccaggcgtttctttaggagcttgagtgtatccttggcttgtctgtacttcagcaaacatttatgagcatgctataaaacatgacaaaccaaaagttgtatggggacattgaaaataaatcccagaaagtatttaagacgaaacaattatgtcaacaattcaatatacaaaactcattatgcaatgtgcatcactcaaccatgaaccgaattatcaacaaattatagcaaaatgtcttaaattagtgtggcatcacatacacagattttaatgttagcaaatgccacagattataaaatgtaatcactgcctggagagacatataaaccatattggaagttggaagactaaaagttattgaagctatatatcacaccaacgtacagcagagtagagaaacaaagttttttttttctctcgaacacgcaggagagttgcatatcattatattaagataaaagagttaaaaaggactcatgcatgcccataacgggaacaaaggctataagaactttccaaagaaacaacaaaaaactacaccatgacttagcttcatctctaacatcctgcatgacggaattgaaattagctgaaacctctccaaagacacatccacctatgtttccaaatcaaccaagccaccaacacaactaatgagttaaaacccttgcgatgttgcttagccactttctgcaaagcttaaagccaccacatggtgaaaacagtgtcatcgggaccttatctaaggtgctgcaagccaaccaaggacaaaactgagaaccatacacttcttgtgaacacacataaagtgagcaagtgctgcacattctcctccttttgattacacaatggatattgccaagatggtcaacactgcgatgggccaatcggtcagcagtccaacaacgatttagcgaggctaaccacacaaaaaaattgccaaaaggccaaagctcaagttttccaaacttccttccacggctcaaataacatgcccctgatgagttttttttttggtgtgtgtgctctcattgctgatatcatcatggcaaaaagtgatgtcatacctaaactgcacctcaacaacaaatgacaccaactcatcaccaaaatcaggggcctccatgagattatagctcaactaaccaatcacaaactatcatcaattattgagttattctgctctccaaaccaacaaccgtacaacctaagattccaaattcctaataaatttggaagaaaaagactgaatatgcttttccaaaaaaatacaaaacatatagcaatagacacagaacaaactagccaaaatcacagattcaatgccttatagaagcagcactaaaaccctgctaaatttaacgattttataaacaagcctaggttaaacgagatacaacaagcaagcaagatcacaacacataaaatgtcagagatgccacgataaccctactaaatcactcacgggttgaacaacatagagaactacctaggaattctccatcctaccatatgatagcaataacaattacaaacaaatcaaagaacctaaacaaaaagtctcgaacagaggcatcatcgagagagagaagccagacccgggatccatgttgatgatgtcgcagagctcgatgttcaccgcccaatccggcccgatcagcatgtcgctcgtcgccctctccgcgcacgccacggccgtcgccattttccccctctcaccaccaaaaaccctaaatcctgcaaacaacaacaaaaacaaaccacccaaatcagcccccaaattcccacctttccgcacctccccaacgcccccaacccgaatccgccccccaaaaacacatcttccaccccgcaagaacccgagcccctcaccgaatctgagcgacctcctccccaagattcggcgccaagaagcaccaaggcggcctcttttcaccgatccggaggtcctggccgcgcctgggacggggaggagagggagagatgcgagcgaactgtaggattggaggaatttcggtggctcggcttggaggaggagatgaggaggaaggagaaaggttggagaggagggtggtagactagactaggcaggcagcaggaaagaaggaaggaggaagagaagggaacgcggccgtagactttttctttgtttagttttcttggtgtgaaagtgagggcctgcaaaattatattttgtggtgctagtttggaattgtgagaaaagtgggatatcaaagtactccattcgtcctatattagattgtgagtttttacttgtaatgtttaactactcgtcttattcaaaaaaattttaaaattatttttattttatttgtgacttactttattatctacggtactttaagcataattttttgtcttttatatttgcaaaaaaaaattaaataagacaagtggtcaaacgttgcaagtaaaaactcaaaattccttatatagtgggacggagtaatactgtcatctagcagccccatcatttggaataagccaaacgacattttaacgaataaaacatgatttataaataaacttttatatatatgtgttcttaacaatttaaaagcaatggctgaaaaataaacttagatgaaaaaacctcaaaccaattataaattcaaggttgaaaatttgaattttagctactaagtattagtataagcgaaaaaatgagactatgatgactgatgaggataggatcgatttttctttatattagatcttgaattttttttacatgggtaaattatgtattttggaaaatatatagttatgttgtgaacttctttgatgtcatgaaaaatatctttttttagaaactctcaacggttgggggtacatactagatagatttctactatcggaaaaaatacattcttatcaacacaaagggtcattaagtaggatctttgcatgaatgcttactaagtaagcaagttctacattttggttgcgtatatggttgatatgaagttacataaaagtgcaatgtgaaaaccctggatgaaataattatataacatatcctatgtaagtcattttcactcattaattatattatccttgtgagtctattttctacacattcacttttttttcttccatttctcataaaaatatcaacacactatttaccattagcactaggcgactttgttcctcttgctacttctcttataaggagagataggggatatttacatgattaaatgtgcttgttaatatgtcatcgtatgaaatagttgcgacattttttgttttgcttgcagtgatagacttggggcattacttctctgttgcatacttttcacaaacaataggaacatttcaaacttttagagaaagtatctcatgttttttagagcatcaaattgttcattgtgtcaaatttatatattactcgaatacacaagccaaaacaattggttttatgtacatggctagaaaattatactccatccatttccaaataactgacaattggcactattcattttaaaccgtgaccattcgtctttctcatttaaaaagtataactgaaaaagcagaggaacaataatcggcaggaatgcaagtacaaaaataaaagattatagaacacagtaaatacaaaaaatgatagtttgattagaccgcgagaaaaactcaccaatcggataagagacgtaagctcaaaggaaatttttcaacaagtttgagttcttactaat

SEQ ID NO: 76294 - DNA, 1150 bp, Oryza sativa
agcatcctagactgttactttggaggttgccgcctcctagacggcttgtggaggtgttgcccggtgacctctccgaggagattgtggaggaggcccgtccccgtttgtgagtggtttggagttcaccaccctcggagtgaaggaagaactaccccgagtgatcgaggcttgggttgtcctctccgtgggccggctcccgccttgcccaccccttgacgaagggggcgtgaggtggcttcgtggttgaccggtgaagttgggctcccctcaacggggattaggaaaccggcgagtttccgaacctcgatgaaaaattccttgtctcttgtctcatttatttgttgtatttacatttgtgctatttatattcatagagacatatttgagcccatatcacttaggtttgcaaaacttaacttagttgcttagttaaccttgcacctcaccttgcctagcaacttaggttagttttgtttaagtgtcattaagttttaaaaccgcctattcaccccccctctagtcggcctccttatcctacgtgggtttaggaggctgattgtggggtcttgctggcacggttgaggtcttttggccagttgagtggtggcgtgctgggctggtggcaatggaggagacagcgatgacgagaaacatgcagtaggtgatagtttaggcgtgtcctgctaaggaaaaaagtggaaggaattagggtttgagtatacgaagcaattgttcaaaagttgttagattttgatgggtgttttttttcatcaaatgtataatagacagactcataaaaaaggaattgattacctgtattcgatggaaaattaaaccccaaatcttgcatattggactaaaaatcaaactccaaggacccgttcgttagtcatgcagatgaggatgtagacgtaggattcatgaaattcggatgagacttcctctggttcgggaacataacagtatcctctcgcgtcgtcctccctaggggcggcacgggaggtgacgacccggctgccccttctccctcacctccctcctccgcctcgctgccgcccgagtggctactggcgcacggccacaaggacagtggcggcggggcccctctctctcgcacgctcgggtgacctagggagtcacccagagaggc

SEQ ID NO: 76295 - DNA, 3003 bp, Oryza sativa
gagcggggatgttcatgtgttcatgtcccattgggttcgtctgcagcgttggattaaaattgtgtggtttgtagagagcaggatgaggagggggtaaatgaaggggaatataataaacgtttggcccggccaaacctggtccattatgttagcccggcccatttagggagcgacccaaaattcagtccctaaatgggcctaccaatttggccctgtggttcacgtggcaatttttttaattatttttagaactttaggggtatttttttaaaaaaaaacgaactctctcaatacgaatggttaaatgtttatatttatattttttaaataagaatggttaaattttatatgaaaagtaaattacatcatacattgggatgaagagagtgtttatgtatttatacaaaatctagatcttatcatcctgtctaccatggcaacacccccgtggcatgacatatgtagtggcgtagctaggatttaaagtaaaggtggttcatctatatgtagtatgtcaattaaaagggtgatccgctatacaatttttattatattaactagcacatatactataattttaaatttttaggtggtccattgaccacggtgccacctagctagctacgccactggacgtatgtattgttttgccacactatttaaactaggagtccaaaatatttaagttccaaagcaaattttgggttctatttttagaattttctattaaaatggttttcaaatttttaaaaatcctcaggaatgcagccgagcgtccgaagcttgtgcactgcatgagcgttactcacactgtgtcacactgtcccgggtcaaatgtgcaggcaggtggcggtggatgtgcaggtatcgtgtacgtatgcaacgctgcgacttgttagagcaagtttaatagtgtagccagctactagctccaatttatttagagcaagtataatagtgggttataagctggctaaatggtaaggtggaggagagaagagaggagagagaggagaagcgggctgtaaacttaccgccggtttggacacaagaaccaaaaaactctgtgagagagacaagtagaccatgtattaattataaagagctacactattatatgggtagactgagagaaggctatagaaaaccttatagccaacaggtcggctgtattattagccttgctcttatagccaatctaatagcttattcatataatagttatctatgaacatatactacatcattaatatatagtttcacctttcatacacacgatgtattagaatccgtgttacagctgattatatatctgtagcccgctttccttctatcttttatcttatcttctcttctcttctcttctctatgtgcttacagataactattatatgaataagctattagattggctataaataaattgaagttagtagctagctacactattaaacttgctctaacaagtcgtagcgttgcatacgtactcgctcgttccatacgtactcgcagcgtaacaaaatttgcttctcttctctatatgcttacaggtaactattatatgaataagctattagatataacaagtcacagcgttacatacgtactcgctcgttcaatacgtactcgcagcgtaacaaaatttgcttctctatgtacaatagtctgctattgtactcgctcgttacgtgcggccacaccgttagtcagaggaacagagggatcgaacgacgccaaatgagggggagaaaacgggaagcaacagcggcgtgaggcgagggatctcgggttctcgctggcttcacgcaattgccaacatcctcgagtagaagtgtaggcgtcactcgatccgtgtagaacaactgaactaccagacgttcgtccgtcctgggaccgaccgaaattaacggtcgccggcatgcaccagtagtcgttggtgtcggcttcaccagtggcccagaatcgcccaaccgggcagtttcgcgtccgcgacctgcaaattttccaatttcactaatccctccctgtgattgattaatctggagtattcggtattccacccacgtggccgtgagcacgagacggcacgagaactcgacgaggcatcgtgtgctgtgtgcgcgcgtttgtacgttgctcagcgagcgaatgctaccggcaagtgtcaagtggcaccgcgtttcgcgcggcgctcctcccgtttagcccacacaggcacacgcaccggcacgcgctccgcaggcggatccaatgtgggtacaaggggattagtctcacaaaacccatagataccccctaaaccctcctcttaatttttttatcatagttgataagatataggtgctaaaggtatcataataatattttagcatagtttaatactgagattatatgtttatatcggtgtactgggtatgttgagtcccctaactttttatttctgatctgcccctgcggacatacacgagcttttgcacgcacgcggtgtgccccggcaggccggcaccgtgctacattgccacgttggtgtgcctgaaaagcggctcaacttgagtgacatttgagctagcatagctatatcttgacacgtcatttttttccctctacgaggtcatgttcttttcagctgtgtcggatcggattatttgctcctatctctaaaacggcattttaaaagataactttattctacttcattgcttagactatttgttctagtttttcaaaatatatttctcaaaatatctaattcattttaataattttcacgaacgcgcaaaaggatcgcatgttaatatattagaataaaatagagtttgtttacccaacgcaatcagccagaccggcttataccaaggaaaggaagatatttcaataattaagtagtgggcaattcatggcaataattcacatagtaatctagataaaaaagaaataagaagacacgaaccaagtgatgggaaatgtaaaagtttttcaggtgggggggggggggtgaagctt

SEQ ID NO: 76296 - DNA, 1388 bp, Oryza sativa
gcgcgcgcgccaacgagaggataatgagatagagcgccgacgcacagaaaacggagcggtatattagcgcttgattaattaagtattagctatttttaaaaaaaaaattggatcaatatgattttttaagcaacttttgtatagaaactttttgcaaaaccgtttagaggtttgaaaagcatgcacgcggaatacgagagagaggggttggtaacatagagcaacaaacgtagactgagttcgtttcccagctttccaactacaaaattatgcgtttgttctcaaaaagtttctgcgggcggccgtcatcaccgctgctagctcgtccagcatcccaagcccagcatggctgtggtggtcgttggtgtgatgttgggacttgtatgtgttgtcacatagtgatggacatgcttttggacagaaattttatgttggatatgaatatcacttggatttgggatggacaaataggagaaaagttgtccaaattttgtatatctgccataattatgtcatttttttaaattaaagtcaaatttatcaaattgagccaaatctgtcaaattgaatccaaatttatcaaagttatctctaatatatcaaagttatgctcgttaaattatgttaaaaagtcaaaacaaacaaaaaaaactttgatacatttgggtcatatgagcaagggcaaccaggacaattcgccccttagttaacaccgttatcatgtcttcacgaaatagggtcgtcaaccttttatttttgattggaaaaaacgaggtcatataagcaaactaaaaaagtagggttaaattggaagttagactttaaaataggatcaaataaacaattgccccaagattacttcatacaaagaaagcattaatgaaatttttttgattggtcttatttacctaatttggattacaacacatgaaaaaaaggtgtttttatattcaacaacgtatccagcttatttgaatgaaaaaaattaaactctacgatcaaaatcccataaaattcaagttgtatattccaatgtaagaatccagatataattcaagttgtatattccaatgtaagaatccaaatataaaccaactaaagattcaactattttagatggtatcctctatctaggtgaggcggtacacccaatgagaaaggatcgccttttccatgatgaggaagcgataggcagaggacatgcgtgcaatgagaagcgtcgtagatgaggaaccgcgctatcgctaatcttctgctagcttcccattccttgcttctctgcagtggagctccaataggtttacctcaccaatatctgccagtagtttctcgcggcactactaccttctgatcacgtgcgagtattgccgcagagatgtgtatttcgt

SEQ ID NO: 76297 - DNA, 5939 bp, Oryza sativa
attcctgcagccctttgcctccctctatttttgtgggccgaattcctttccctcggcccatccctcctctcagcccgtttcccctccccttcgcacgtgctgagcacgcgcgtcgtgcccgagccaagagagagcaccgccctctctctctctcgccctctctgcttcctctctccccggcgccgattcccgccgccgccttttgaacccgccaccgcctttagttcccgcgcacgcgccggtcgtggccgaccgcccggtcgccgccgcagtcagcgcctgcgtcgtgctaccgctcggccccgctgcctgccgcgagctctgcagcgcgtgcccaagccgctccacccgcgtccatccaaatcctggaggcagagcactccctctcccacctccttctcccaaaccggcatggtaaagcccccctttccaccgtcctctcttctctttttccctcccaagcaacgacaccatgcctccactccttggccgctagtgctcggaggcagagacgcagacgccagcgccagctcgccgcccccaccttgaccgcgccagcccgcgctaatcctcccgctcccgcaatttgattctcgccgtccgatccaccgccttcaccgcgcccttgcatccacgccatcgctgtgttcgcaccgcccacgaactgcctttgttgctcgtcagccaagcgccaaccagctcgcccatgcctcccaaaccgacctcgctccactataaaaacccgagcccctcccatctccctcgttgtctcgcctcctctccccaccacaccattgccgccttgaccgccgttgtcgtcgtcgcgcgtgccgtgggagccggcgagtgagaggagccaaagaggagctccgggccgccccatcttcgcactccctctcatcttccctgacgcactcgccccgacgccgcgccgcctcggtgtcatccgccgtgcgccgcctctcggtcgcgtgccgccatcggccttccatccctttccatcctcaaatcgccgccgataccgtttccgcacgccgatgagctccttgcccaaattcttgccatttgcatcatcttggataagccccgagccgttcggttgctcgctcgtccccctaaacatgccgccccgccgttgctctacttcgccgccgccgccgcgcccgcctgtgcaccgccgtgggccccctcgccaatccctcgcgccaccaccgtccttgagctccctaggacctccccaaaccattccctagcgtcgtcgccgcccggcacggcctcgccgccattgccgcacgctcccggagaccgcctctcgtcgccggacctccacggcgcctccccatcccatccgacgccacaaacgagttccctgagtcctagagatgctcccacccctttgagtcaaaccctcatcgtctcatcgtgttgtccccttttgctcgccgccggtggccgccgtcgaaatccgccaccgacgggctcctcccggtgaatccgagctgacgaatcgctccctctcgcccctaccatcggtccggtgtgctccccttgagctgtagtcgctgcgccatgtcccggtgaagccgccgccgccagccgttcgtcctccggccggccttcttcctcctctcgccgcccacgtggccgccacataggcgccacgtcggcttgacccggtcaagccggtcagccatcccctcctccccgtgcgcgtggtccactgtgagccgagcggctgcacgtgggcccgccgctctcccgtccacccggtgcccccccgcatgagccgcatccaccgatccgctccgccgctctcgcgtgcacctcgctcacggtgagccgagccgccgacaagcgggtcccactcaggaccgcgcgaggtgagcccggtccacccggctccccttccccccctctctccccgcgcccctctcttgggccgcctccccgtagcccatgccagcccaataagctcggccgagccgcgcagatcctctcgggccacgccaagccgctcgggaaagtctgatttctctccctcgtccattttctttccaaaaagggtttaataaattattaaatcctttctcctttgattagaaaatccttagaccttagaaaatccatatcttcccaaccgctcatccgattgacgccgttctacttccagtaattccctaaaattgagatctatttaatggcactattaattgtgtaaataggatctttcttttggtcttttgtttaggtttttgattatttgcgtatagttgcggtaaccgagatattagtcaatcgtggttttctcgaagattcgtgaagctccgtgaagaccttgagcaaggcaagtcaccctttgatcaattgcccctataactggaaaatcattattattttgtttgcaacttgcattagtagaatcacacttaacttgcttggcctcggtttgcacgccaaaccgacggacctacccagtagtcgcactaattcctgtaggatgtactaccctgattccttgtcgctccacccttgtggtacttcggtatccgtgctctttgagcgtgtataccaattatcccacatacaccgttgattgtcgaaaattgggaaatgggtttgagaagccttgaaaacccgacctgaggtgtcggtgtgtttaaaaataaaatgaattgtgaaaactcgcgatgcgggagccgtgcctacgtggcgctgtcccgtattcgcatataagggccgattcctgtgggaaactcatcgagcataatcaaagtacaaccacaaggtggaatgggacaccctggctaagtaactagttggttcagggaaacctcgcatgccaatagttgggaacgccggggcggggtcggacaaaccgggttcctggtaaggcaaggacgagaagcttgcttacttaccgatcaaggtggttggagttgatttgtgaatgcctaaaatggcttatgtttatgtgaggatttgatccttctatgtggcatgaggtaaccctgggtcggcttgggaaaggctttgtcgcgcgcctctgacaccggccagtgtctggagtaagttcgtgtcttgtgggtaaagtgtacccctctgcagaggttaactaactgttcgaacagtcgtgcccacggtcatgggcggatgtgaggtagttcccgttgcgtagatttgtttaccagtgctttgtgaaaagttgttgtggtgtgggaatcgtaaccagaatcagcctatgtggcagatggatgacctgagtggtcagaaacgaatctgtgtgattcgggatatctgcgggcatcatagactaggcttcccgaggggaagcggattgctttgctgctgggcagctggactctgggagtccgagaaaatgaaaaaggctctgggagccgcctaatcaagtgaaatggctctgggagccgataagtaatgatctgacccgggaggtcggtacattaccattcgagttgttgaaaagcatctcttaaagtcgaatcaagacgcaagtctcttttcgacccaaacttaaaaaaaaaggaggtaaatcacttagtgattccaaaatgctttcaaacaaaagatttgcaaaacaaccttacctctcttccaagcttgcattaaacacctaaattcccgtgacttgctgagtacgaaagtactcacccttgctctatataaatatatatagttcctctgccttgaagtgaagatgaagtgaagtgaagattagggtttcgtcctggttcccagccgtcgcctgtggtgttgggtgttagttcgttggttccgctgccgctgttgctgttggtgtttcctcgtccgcgtcgtcggttgcattctcgggccgttctaagctgcaacctaagttaaggtaaataagtcctctatttattttaaggattgcaatgattcatatttgtcaccatgggtaccagcactatgtcctgggactggtactgagatcacggtttcgtaggaagcggttcacgtcgtttttcctacgacacgctcctgtcaggtgccgttgtacggcggtgccggattggggtgtgacaagaacactttcggttcaattggatcgataaatttctaagaaagataataatgcccctaaaaccacatgcttcaaactgcatgatgctatagtaaaaatttagaaattatacaactctaaatttaccatcacattatattccatcttagctctagtttcagctcaaaatattttgaccatagaggcatccttgtttttttgaaaaatttctctctccaattgagtcgaaagtgtcatccaacaaattatcaatttttaagtatcttttagccgtgacatgtttttataatgtctactagtaaattgtacattttttaagtgtctgtagcaaattttgccataaaattatgtattgtatcgggacgaaagacatagagagagtagtgtgttagcaagctctgttgctgtctgatttactatgtttttcattttgctttttctgtcacccttagtgattatgtataatttctctggtacttaaaataaaaccagcaacgtttggcttaggtttaaaaatacttgtaaatcaattctaaaaccttaatttagctatgtcttatatgtcaacgagaagctagccaagccaggcaaagcatgtctctctcttttattttttggaatttccatggtagaatttattaagaatccctaatattgaaatatgaatagccgcaagtcccagcgtgtaaaaacagcttagttaggcagcctgaaccagaagaattagtggtgccccgacttaaaacgacgtagaccgccaagaaacgaaccaaccggcaaccgccgccgccgccgccttcgattcgattccgatcgagttggagaaggccgccgctgcccaatggctccgctaccctcgccaccgctgctggccgaatcgctcgcgacgctgcgcacagcctcgccgtcgccgcccatcccctgctctcctcgccgcacccggccgttggtttcagctaggttcgcaagaacggccggccgccggagccggagcacggggggaaggagagaccttaggagctgtgcctatgcggcggaagctgagtacggcagcgcggaggatgaggtcgccgacgacttctactccgttcttggcgtcgtgagtgttctggaacattctgttgaacaattcctttgcaataatttcggtttacagtttattaggttagtagggaagaactgtgcattttagactggaatcattagagatcaatttcttctctgtaaaaaaaaaaatcctacttttggtgagggaggaaagatgcttctttttttcagagtggactcagacaattgttctgaacttctgatgagtgatgagtgatactctgatagtggttttcctttgagacgacggatttgctgctaataatgacccctgatttttgcatctccagatgccagatgcaacccctgaggaaatcaagaaagcatactacagttgcatgaaagcgtgccatcccgacctcagtggggacaaccccgaagtaacaaacttctgcatgttcatcaacgaggtttacacggtaaaacccttcaatgaaaccttgggtccttgtgattgcatatggcaattgtcttggaagatgtgttttgcattgaattcttttttgttcaaaacgctaacatgaggtgttgaagagcaggtgctgagtgatccggtgcagcgtgcagtgtatgatgaaatccatgggtatacagcaaccgcgaccaaccctttcttcgatgacagtgcacccaaggatcaggtgttcgttgatgagtttacctgcataggtactgacattttttggtatgaatagagctataaaagatgctatttggttcttcataaagagatttgatatatttcaccttgttgatgtggggctgcaggaat

SEQ ID NO: 76298 - DNA, 2508 bp, Oryza sativa
acaaaacagaagttgcaaattgagttacgaattgcgctgcatgaatgcataggacaaaataaccatacttgtttgattaagaaaacataccagcaacaatagactttttaaatgtctctagcatgaagaaaccatgaagaaaacatcgtgcgtgtaaaatttatatgaccaagggccatcatcagtgctttagctttagtggcaggcctggaagaggaacatgagagaggacaagagaggcactatgccaaattgtcacttaataggatttaaatcctggttccaacaagtgttacacgtatatgtctgattaacaggaatttattaagacgaggaatttgtcactagacttcatctcttccattatcatgtgttataagaggtatactcacaggtatttgtgcacagcttccatgtaattaaaaaaaaggcactatatagtggcaaattcagagtaagggctcgtaactagcgcgattcaatgtcaatctccaacctcacaattacagtgctcatggtagtaagtttttgttatttacactgagatacacctaagagaggttttccattattgtacaacagtaacaacagctggatggcttgctatcaatttgagttttcactgatacgctagcattctgcagagaacaaaaaatatgtcaatagagcatgtgccaccggcccaccggccaccgccccacatgaaagtattgagttatgaatcgctagcataacagctggggctttcacttatgtgctgggatttctacagagatcaacaatgccaacagagccatgtgaaaactgtgagagttttaaactataaattgctaacagcaacgtccacaaatttccaccataaagcaggaccggttttatgccttccagacaggttcattgtttcgttgaagacgccatgctggagagcgaagaatgttttgtttaagaagctagagtagtggggagtgctttggagggttttctacctgtttatttttggttgcaaagtatgttgttgcaaggcacatgatctgtcttagactgtttcaccttttattttattttcctattttgactgggtacattttagtaggtgcagatcgagtttacctcacttcaaaaataatattctattctgtcaagagagattctgctggtgtcttccacggatgaaaagctgatgttaaaaaaaaaaggagttcctttaaacaggtaaacatgttcagatattcaggcaactttttgcgagtttgccaattatgcatgacttcaaatttgcccaccgtgtgtaagggtatgtactattagagaaaaacaagtacggttttttaatgattaaaaaccaatacttgacagtcttgcaataatgtggacggcaaatagaagaccctgaaaacatgggaatgcaataagaaaaatacttatatattttttctatttatttaatgtatagtgctcgtgtaagttttataacttttcttttgaagtgcttgagcctaaaatctaccaggcctagcaaatatatgtgaaggaaacatgaccacgatagtataactgacatgaaaccaaacagaagttcttaatctcacatcaaattcgtttgatcaaaataaagaagaaacttatatattggaggaacacaaaaggcactggagttgaattctatcttacatggccaacttatgttgaaaaggagaaaattacttcctcttgggtgatgttttgctctcgaattgttaaatttagatacaacacataattgaccagtaagttgatgtcctgctaaatgaaaggatcaatgctactgtgcaagaaatgcaagatgaattgggtggttcaccctctagatagtttcaacccacgagaaaatgaagaattataattaccagtttaaagagaaagatatttaggtgccaaacttccagagttaaacagattatttcacctgacaggactcctcctagcatgttgctggcaaaaaattgctcatgtagacttgtgcgagcatttcaccaagctttacttgtgattcagtggtaagatgcagatgatcttcatttaatgacagtccaaatgcgtccacagttacaacattgggcaggttgataccaagctgagctttcctcactttttcaatgttctttttattcccagatgcaagagcaacctgtttaatgcaaacaaatcttgatataaatgataccccatattacaaatgatatcgagtacaaataaagggtaaggttggttgacacataagatggcatcgtgtgtgtagaaagagtgaaaccagccatcttatattggtaactgaataaagaaaattcaaggttcaaaagaaagattacagagccatgcaaaataaaacatattagtttactagttaaaaccaatcagttatcttgtactgggggatgtaaaagagggcctgatgatgtattaaatcgaaactattaacttcaactttatacatcccttaaagcaacatctaggcacatgtataatcgt

SEQ ID NO: 76299 - DNA, 2917 bp, Oryza sativa
caggttttagtgggcaagtaattaattaaccaatcacgattgaccatcgtgaactatcattaagccatcattaaataatagtgaatcttaagttatcccaatagtgtgctaatgtttctaagcatggctaagcaatcatatctaatatctagttgaaccaatatatatatagcccaactagtcaagttgtaataacccaaggtatcaaggaataaagtgatcaagaacaaaaaaggctataacaaacaataggttaattccacccaatgacattcgaaaataaatgcaatagttgaatagaaacagtagctttaaacgggatcaacatgctcaaagggttgtttaggatctgtgtgacttgccttgctggccttggaactattcaaattcttctcctgcgaaaacggactctccggaaacgtcggaatctaaacaggaaagagcaaaatcaccaaaacagcacataaacaagcatgaacagtacatgtggatatttttaacatgtagatctcaattttagaaaaatttagagacttgaaccaactaaatccgagctaaaatgaattagttatgaatttttgaagattaaatcggattaaaacacttatatggattttaattgaattatgacgcaataatgaattatttttgaaaaggaaaaggggtttattgcgtcagcggctagggtttgcgggggaccgggcccccggcaacggttcacgggaacgaacggccgaaatcgatccatccaaaacggacggccgaaatcgatcgggtctacggcggctcacggcagacggcccccatgacgtcagcgggaacgtcacctccggcggcggttggggggttcaccggttcgggcgcgcttgctcgccggcgaacgacggcgcgacaacgcggacggagggcaccaggacgtagagcgcggggcggcgaactcaccgatgaccaaaacgtcggcggaagatgaacggacggcggcggcgacaaaaaagaagcggcggagaccttcggcttgacaacaacggcggtgctccggcggtctacagcgacggcaaaggggcggacaaggacggcggcgacttggcgaccacgatggcgacctccccgagcgatgacgacgaccggaacgacggcgaagcacggctggagcgacggcgacaactgcggctcgaggttacacggcgctagggcgcttccgacggcgagagacgaagacaatggtggtggcgggtagcggcgacaccggggatccttttataggggcaaggaggcagcggcgaaggcccacggcgaccggcgacgcgaaagaaacattggggttcggaggaaagagatcgatccgattcgacctcgaatccagaactttccaaagcgatttagccgatgattccaaaagagaaaaggtagaggagatcccgaagattgtttcccctctattgatttcaccggatcgggaaagacgcggccgaatttggaaagcgggcggcgggcgacttgccgctagggtttccggcggcggcggccggaggtaaacgaagactgacaggtgggccccacctgtcagcgggcggacgcgcgcgcgcgagcggcggctgctgctggactgggccgactgggccggggagagagagagattttgggccgactttcggcccaaagccaaaagagacttttaaaaaacctttttcaatttaaattattcatgaaatgcaattccatttattaaaaatacttccttagctcaaataaatcccagaataatctaggaattatagaattaagcaaagtatttaatgaaattttatctggccccattttatattggaatctattaattaaaattagatttctcttctaggcttttaaaataaattctaataattccaattaaacaacaatttatatattttggatttttagggtgtgacaaacctaccccccttaaacagaatctggtcctcgagattcggaagaactggcgaacagatgcggatgagctgacttcaattcatcttctcgttcccaagttgattcttcttcggagtgattactccattggacttggcaaaaacggataactcgatttcgggttcttctctcatctatttccaaaatacggattggtttctcaacataggtcagatcctctgggacttctatctggtcaagattaggcttcttcggtaggtacccttaaacactttttcaattgcggacaccatggacacacattagggactccggccaaagattgaggtaactctaactgataagcaacctctcctcttctactgacaatcttataaggtcccacaaaacgcggtgccaattttcctttggtgtgaacacgatgaactcctcgaacaggcgtgacacgaaggtacacataatctccttcttcaaaactcaaatctctgcggcgattgtcggcataactcttatgacgagactgggccacacgcaatctttctggaatgatcttaaccttctcttctgcttcccttaggatatcagtcccgaaaacctgacgttctcccttttgatcccacaaaagcggagtgcggcacttccgaccatacagtgcttcgtaaggagccatctgaagactagcttgataactgttgttatacgaaagttctgcataaggtagattcttatcccaacttccaccgaagtctaaagcacaagctctcaacatatcttccaaaatctgattcaccctttcggtttgtccgtctgcctgtggatgataagcagtactaaagttcagcttagaacccatctcttcttgaagcttcttccaaaaatttgaagtaaactgactgcctcgatcagacactatttttttagggacgccatgcaaacacacaatccttgccatatacaattccgccaaccgacttccggaataagt

SEQ ID NO: 76300 - DNA, 2005 bp, Oryza sativa
  unsure (1)..(2005): unsure at all n locations
atgctctgaaacccaacccagcataatactaggactgtttatctgttcataacagattactgaatgtgttattcatgtgtgttatatttccatgtccagcccagtcaactgtattcactggacttctgctgcacagctttctctccttgagaatgaaatgcggagaatagagcgggtgaatgtaagtaatccttctttcagttatttagatgtacggtatatttttgtggtcatataaatctccagttctttggtttgattattaggagtttaggaccttatggttaacttctataacatagatgtaatcacaaaaactcctagttaaaataaacggtgcacaagaaagtttcttatatccctgttcctttctttctgttagcatttttctggaactcaagtgatattttacaggtgatattatcttgttttctcctaatagcctagtagtacactaaagggaatttcaattttgaacaggttgggctgatgagtgctgggatgggagtttcagttgatgtattccgattggtaaatttgtatgtctttattatgtaaatttggcatgtactatctaaatttctctgtttgcatatcctcaagattctttcttccatgtctatgttaaggctaatagagtatagataaagcatacttttgtttaagcatacagattatattatgcataatacttctctatgttgttaattttacttgttcttaagatattttctatttaacaggctagcgtgcgttgggaaaagagacagtcaaaagttttggtatggttccttcccccttcgtcatctttgtgtttctcatagagttagatgtttttaaggatttcgttatcatttacctatttgtatctttgcaaatgggtcattgttttgtaaactaaacattttatgtaaacctttattttgttacaggaaaaaattaggacacggatgacaaacaaaaagtattcagatataagtagttcttggactgatatctggggatccccaactcgataccaaggaaatggtaagctaaaacaaataacacagtttgttagaaataccttgcatggtaaccatgcagaccagcatgtattgtgtaaatataattgttgttaccaaaaatataattattgctcattcttgtatttctgaatccgattgagatttgctgatgatatcagaagaagaaggaacagagagagcgaagagagcagctgctgctgctaggagatggcgagaatactcgagaaaaggcgcagacaggccaccggagtacaaacttccagaggcagcgggcaataaagagtaatagcagaacaaagaaatatttctatcctgcttacgttatctgatagcatttcgtcacctgtacatatagccttattgtttgaagagagctgacatgtagattgctctctcccaattcctcatttttcatttgtaatatatagctgataacaataacctgtagaatacaaacgtcaatagttaaacattcggaatgtaaaagatgaatatgtgcacattctccttcaacaatggtatacatcctgaagatccatcttttcttgtgtgtgtttgtgcagatgaattccggggcaaatttcctttggcagtagtctggtaacccccaggcatcgatgatgaactgcaacatctgccaaaggacaacttgcccagcaatgcagctgcacatctcatggtctcaacctatttctatccgtgtgccacatttagtttcatgtgtagagcgcacagttcactgatcattgtgcagtgatatttatactcgctcctgcatggtgaaaggnnnnnnnnnnnnnnnnnnnnnnnnggcctttctctgctcctcctgcaaaggcacacggaggctgataggatatactgtaggacaatgcctgctctctagattgtgcccacttacaggaacaaagtctgaaatggagagatcattgtagtgcatatatctccaatctttttaggtcatggggctacttccc

SEQ ID NO: 76301 - DNA, 12707 bp, Oryza sativa
gcgacattgagattctctgcccaagcaagctcagctgatccaaagtcatctctgcatccctcagtgacccatctgaccgggaagcaataagtttcagggcatctctatcaacatctagtccttcgctagtagaaatccactgtaaagtgttgacaatgtcacactccttcagtttgggaaagaagaacttttggcacctcgacacgattatatgtgggagatcaagattggggctgatgaggataaaaaccacacgccgaggtgcacgttcgatgaccttcgatatgacactccacgtatcaggtggcaatgtgttgcaatcatctactataaacaccctgtgctgagttggtacaggtgaaagcatcacattatcaaggatatccacaatgctgtcaaggtcaatgttaccaacaggcccaatctccactaagctcctactcttgcccagattgtgtgcgatacaagacgcacatgaatcacagggcctcgggtgctcaggagaatggcaattcaacgcctttgcgaacacccgagcgcatgatgtcttgcctgtgccgtgcggcccgtagaacacatacaccaacccaattttcctcttcaggatggcattggagagagcctgcaccaccaagctctgcccaatcatgtccttgaaagtcttgggcgaatacttctgcgtgaggctctggtgccggcctcgatgcgagccccgtgacctctgccccgaccgtgcctctgatgcgaggtcagaatcaagctcactggtctgattcgagaatatcccgagctcccccgagaagctcctggcaatgccaccgatgccattgcgcacgccgtcgacgagcagaggcaacgagtctgagtccgaactggtcgaggtcagcctcgccgtgaccgggaaatgcggatgcgaacgcgagccgtccatgtgaccgcacgagcctgcggaggtggcggcaatggacctccgcgccgccgacgccgacttggggtcggagaggccgcacgagaagctccggccggccatgtcgaggaaggatttgccgcggtggtggatgcgtgaccaattccaggggatgccgcacacattgcgcgagtcctgcgacgcctgcggcctctgcagctccaccccgcactcgtcgtcgtcgtcgtcgtcgcctccgacgacgccgaagaggtacttgttgccgcagacggcctcctgcgagctggagttcaccgagacggcggcggcgccgtccacgccgcgatctagagcgccgccggtggcggacgcgggagcggcgcgccggcccgcgccgcccttgaaccggcgccgcgggccgcgagacggcttgggctgcgggttctccgcgagctggtcgagcagcgtcttgagcgcgccgccggggcgggagctgtcgtcgtggaggtcgtccccgagcccgagcccgaccccctggggctcggcggcgaccctcgacgacgagtccaccgagcggcgggtggacgggtcccgcagcgagcgcgagcgctgcagcgcgagcaggtcccgcatcagcgcggccgacgccgacgcggacgaccccgtcgggctccgcctccgccccgacgacgcgctcccggcgccgagcccgtgcgcgtggtggtgccgcaggtggatgcagttggtcaggtgcgcgtgtccccgcatgtggtgctcgccgctgccgccgccgccgccgccactccccatccccgcggccgctgtcgccgccggcgccggcattgcgggcgatcgatccggactcctcgcctaaatcatcgcgtcgcgtcgcgtcgcgtcgcgtttcgcggcgagcgaggccaagaggagggtggtgggttggggggcgtggcctcgggtggcgtccccgaagtggccgtgctttcgacgtcgcgtcgcgtccgcgaccgcggcgtggggtggggggagtcgtagggttcgagcctgccgtttggccgttggatgcatctgcagatctgcaccctcacgcccgcgtgtgattactgtgccggttcggtaagtttcggggagctgagaatggccagatgatagtcagtttttaacaatataaaaaaactggattttctagtttctatttttattttattttctaaattttataactatatcttctcataatatgtaccaaaagctaaatttttttggaagaagcttctgatcttgagagaagctgcggtagctagaagattcccaaacaggctcgaatatatttgagagcataagattataagaatatggaaaagctgaagtcctaatttctgatttccaattcattttgtgaattctataactaaagatttttaaaatttgggtgaaaatctagattgtttggcttatgccagctgaatattttaggagaaaatgtagttggcagaaactccccaaaatagacaaaagctcttctagacaatttaaatttctgtttagattctaaaaaattatagatgtaaaatcgtaaaaatgaattgaaagtcagcaactagaaaacacaacttctacagatttttagaaactagctatcagctacttcttgtttcttaaaattttgaactccattgaacaagtctgagaccgtctgtgacacgagattattacccttgtgctaaagttgagtggtctaccgctaacagtggcaaaatggcgctaatagagctgcttgtttatgctttcttttcgaggctatgtattgaggctaaaaaaaggaaaggtgctaaactgctgattgcacgttgtgtcgtgctacattttagtttagataggtaagttgttggtttattaaggtgagctaggatgccattcggtgggagaatctctctacgagactcgacacgctgctgattatcttttggttcagagcttttccttttgttgacttcacgttgcctacttggtctatgctttggcaccgtaccacgaacgtgcatatgaatatgtgatactggccgacagcgtcggtaattacttattactgtacctaacaagttaaccggagtaacgtaccagtaggtaatgttaatgtcaaatcatgagaaattatcgtgccaagtacacgacagagtcatcgacccgtatgagagtagtaccgcggtatagccatggtgggtccgtaatctagcagtagctgcggtactctagctgtgggcctgcatgtgttatctgtttttttttttgttcacagtgatacactagtacatccatccaaaatgtagagtaatatttctaacatattacgttgtctcgaaataaagttatttctccgcctatcttctctcaaccaatcacaactattcttcttcatctactttctcttttcaaccaatcacatattttctccaatcattctcatctacagtattttcttaatacacgtgctaaccatttaagttatcgctatcctatggtttggtgattattgcacgaaaccacgtaattatcgtgatatatatagtaattttaaaaattgaaaatatcatgatagccgcactgttttataaattgtgatggtgacagggattggggaggggtgtacagcccacgcggcagtggcgagcactgggcagcacggcccgggctacgagtagactctacggccccttataatcataggaatgaaaaaaacgaaggaatagcaaaaagattctgacaggaatacaagtgtaaaacagaggattataaaacacagcaaaaacatagaaataaccgtttgattgagccgcagaaaaaacactgaaatttgaggagagataaagactcagaggattcttaacatgaggtaaaacctcatgctaaatttcctccaaaacttacatgggaagaggcattccataggaattttatgggattacataggattcattcttttgattcaaatggctatataggaaaaattcctataggaataaaatcctttaaaattactatgaattttctttgaatcaaacgggcctacgagtgaaattgctaggcccagaaaatactccgttcgatctgatcttcctgcattcttcatcagccagatagcactgtagtttgtgcggatgaattcacgcgaattctgagggtttattttcggtgcacaacaccagcaatccagccaaaaattgaaaacagcatatcacaatacaccgggaaacgtttttgaaagagagggctcctacccccaatgggcgcggaaatcgaggcgaatcattgtgttctctcgtccaactgcagctctcggaacagaacgaaaacgaggagaccgaggagaagatgagtgcatcgtagtacactcgcaccactggaactccttcctgtgctcctggcgcagtagcttcagttcgccgcgagtcaaaatctgaaacctctgatgacaccctcaccagtactgcaaactgacatatgggcccccacagaccctcgggcccatatgtcagcgagcagtacggcagaggatctagattgctgatgaagcgtgtgcctcacccgatcttcaggtaaccagtgtgtatcgttacatggtacaaaagtatgctcaagccctctttgtttagatttataagctaacttataagtcgaatagtctaaacctaaacaaacaagtatctttttcgtttggattttttgaagccataagccactctaacactattaagccaaaagctaggttggataagttttttttggcttatgtgaggtagatgtattacttaaccactaaatttagtacattaaatccactggcttataaatcatataagccaataagctgacttaaaagtctaggccaataagtctaagcctaaacaaagagggcctcaagctgccgggcaatattatcttttttgacgctgacttatttattttctttactctgaatgtactccctccgtttcacaatataagtcattctagcatttcccacattcatattgatattaatgaatctagatatatatatttatctagattcattaacattaatatgaatgtggaaaaagttagaatgacttatattgtgaaacggaggaagtagtatattatcttcagtcttacttcaccttgcaccgtccacacagtaaccctgactgaagcacagatcatacagtacatgatacgtgtagtaccatttttactgtatcagggtccaatatggagtagtcctagactctgatgagaagttgacaaaacatgccctggtgctctggtgagaaattgctacaatactctctctttacatgtgggctgcttcacacacagcacggcagcatgtagccggaatactgcctaaccctatgaggacatagacaaagtagcaatctgtcacaaaattgatcagtgaagctataagccagctaaatactgaggtggagaagagaagagaggagagagagaggagaagtgggctgtaaacttacagctggcttggacataagaaccaagaaactctatgagagagataagtgtgccatgtattaattatgaagagctaactatttgttaggaacctaattgggctgtatatgggccaagctagccaagtcaaagcgaggcccaagcaagcagaagggggcagcatacaaaagcagcagcagcagcattgttggaaggcatcgaacagaatagaacccggcacggcggctcagcaacggcggcgacttggttcgggcttgaaccttatcgatctccttcttcctccctacttctgctagtaacttgtatcccctattcaatcccatttccaccacaaagcttgagttgtagtaatacaattgcagctcaaaaccacctcgaccttcattgcttgtactgtatattggttcattgagatttagatattgggttgctaacaatctggtatcagagccgttcggttcactgggattcttgtcatggaggagtttgggaggcagccatgcaagagggagcaggaattaggttgggaaagttttcatccaagcagcgcccaccatctgttcgatgaaatgtcaagcccattggaggtgtttgaggaacacgttcttcttgtcatgagtgaggagaacatcacatgggatgaagcactccatctgttacaagaggaactgaaggatgcccaatgtagatttgatgagaagctagatcgttttttggaggtgttcggcttgatgggagacaagagcaatcaatctgagggagacaaaaggagcaatgaatttaaggaattcagtgcctccatcaaggagctcacccccaccaccgaggctgctgcatttcaatcaccccaagcatcaccttcttcagcgcccaccaagtgttcgatgatttgctttggcctcgacaccatgtccgacctcaacatggcagcagcggttgtgtgcgccaccacttctctagcctccgtggagttagtggctagagggaacgcaacctgtgaaccctacgtcaacacccctggtcatcccaaggagacgcacaccaagtgttcgatggttggctttgaggtcaagggtggcaccgaccacaccaaggtcacatgccataccatgatgggtgtgcctgatggcgttctagtacctgaagcatcattccatgaagcgtccaagtatccaatcctgtagcccatcacagttggatacgctgtgacagattggcgtgctcacccccgccgatcggaagatttatttataagagcaggtacaataacaagctataagccaactataaatatattttaaagagataaaggaagagagagaagaacagcgagctagagatctgtagccaactgcagcacggactccaaaagcaatgcgtgtatgacaggtgggaccaggtattcatagtatagtaagtaactattgtacacatttgctattacattggctatagataatttagagttagtagtgtgctatactattaaacttgctctaaacaggccagatccgacaacggcaatctatcagcagcgattccagaggagaaatcatgaacaacgatggtccctgttatggcgtctgcttgcttcatcatttcgtttaggctaataaatcaaaattttaaatttaatttaaaagtttagatcgcacaccgtactgtttgtttgcaccattactgtagcaccgaatctggacaattgatcggaaaagccaaaattatatgcagtcgttaacttgaagttcctaatataactgctgattcgtactcgtagtactttgttcatcctgagtgtctctctctctgtcgttttggctgatatgtctgtctgcactcagccgcttgtcccactcccaagtcccaaccgcataacattgtgcttcaaccttcagatgtgttctctgcatactagaacaatgtaagatgctcattcgtgctgctggactcgttagttcccatcacaagtcacaaccccagcatgttgcagcagtgcaacatcctgtatatgggtttatatatgtaatgaggtcgtacaagtaacaagtgtacaactctagcgcaagcaagttcagagacaatgctgcacagaaaaagcctaattatagagtaactgcagaactacgaaagtaacttaaacttcatttatgttctgagaaatacagtcctgagtcagcgatcaatgaacgatttacatcatttacaggatctgtttttctattcacataacataaatcttcactcaaccatcacggttcacggatcaaatttgttggctcactcaaaacgtacttgggcagttcatacttggcacctgcagcagagttttaaaggttgttattagtcttgcgtgatatagtggagcaaaacagtataggtggtgaagaaacagcgagaattcccaacgaagatctgctcacctctctcgtcataacaaagcgtcatgtcagaatttgaaacaacaatcccagcactgttcactatggtttgtgcaagaggtaattcagcttcagcagcagccctaagtgcatcccaaatctctgtaaagatacaacgagctaccagttatttaactaaggcgatatttgtcagagcacactgttaaaattaagcaattgtgttcaaattttaagccatgctacagttgtaaaataaactccaatgccaatatgaatgatttctacaaactttcttaaattcgaacataacagggcttgttgtattgccaaaccaaataaagattattcagaagagggcatagataaagatggaccttagcaacttagctgcgaaatatgatttaacagtatacaaacattcaattgattttgtttgacatacataatagataaatgtcatagatggaactatggaagagcgttttcccaatcagccttgaaaaatcagctaaatacctttctggcctccatagtgtggagccgtgtcccagaattcttcacgcatctttgagagttgtgttggtgttattgcctgagtgtgcttccaaggttttggctttttgagcttcttactgttctctgcattaaagaagaaggttcaacattacttattcattctaactcatgtcaaagaaatctaataaaaccttgctaggatataaatgcatatcaagcaggattctagttccaggaactgttctgcaataaggccttgttacaacacgacttatttataaacctacattcatctactgtgaatagatgtatcataattttctgaacaaaaaaagcagattcatctttggctcttcactaacttggcctgtatttaaagtagcaataccaggcaatccaactttcgaaagaagtataaccagtgctaaaaaaaattgaagtttcattagcgagcagacaaatatcccaagtgtgaggctgaaatttcacagatgagtgtgtctttctgtaatgttccacctaataaagtatctataactagataaggtgttagaaattgatcttttcgataagcaagacaagatttagcaattggtgaaggcaaagtgcttaatctgaacaaacttttgattattctacttcgagaataatctgtcactttatttctctcatcatagacaaatgctacttttgcaacatacaaacaaaatagcttttctcctttaagaaaatgatataaccaccaatgctcttggcattcagaatactggtagcgttatctctccactaaccaaatgtgacctccatgacgtaggaatttgcactactcactctacttgtatcagataccatccccacatttcgatacattaattccatgagagcactgtcaatcctgcaacataccattactagcagcagatttgatacactacatcacagtaatgagtaatctacaggtgatactaagtttcatccaagtcaacagttctactgcagctggatacttgcaagacgcttaaatcgacagctcaaagtactatcggattatcagttccggtcacaattcgatcaataaacgagaagactaatcaacaatagaacgaacaacctactcctagctaacaacagctctggaaacaattgatctcggatctcagaatctgagcagaaaacaagaacaaagacagacaaacgaatcgaagcatcaaggaagagagagtaagagtaccatcaactttgggagtggatccagcgcagcccatggcgacgacggccgatcgatcagacgctcatgtgggggggacgcccttccagaagcttccggaagcggagccggatctcgcggcgggagaggcggggtgtagtagtgggagacgaggaagaggacggtggatttaataagggttaataaagtggacgagtaggagtaggagacggcaaagcatcagcagcagcagcaaattcagcggcatacgagcggcaaagccagtggaaaaagagaaaaaaaaaaaagaaggcaactgctgctcaggtgacgtcacctacgcaggtgaggtgtcccgccacgtcacctgccgccgcgggcccacgtatcctcccccgcctagacctgttccacgtcgcgacggggcacagatgtcgctgccgagtgggccccacgccggtccacgcacggggatcgcgcctccctccgcttcccgctcttcgtggtcccggttcagtggaccaacggaggctgacatgtgggccctacatcccagccggtccacgtcggttcacagcaccggctcccccttcccgtcccttcccgtcgtggtgccctgcacgcatcctctccgccatttttccgccgcatctggagctctaaaacccaaaccctagccactgcgccgccgccgtcgccttcgccgccggcccgccgccgccgcttcagccatgaacgcctttcggttcctcggggacatgacccacctcttctcggtcctcgtcctcctgctcaagatctacgccacgaaatcctgctcaggtgagcccgagccgtacagtgggggtagggtttcggccgcttggttgggggtgggggggattctccgctcacggatctgtgtgttggcgcaggggtgtcgaggaagacgcaggagctgtacatgctggtgttcgtggcgaggtacatggacctgttcacggactacatctcgctctacaactcggtgatgaaggtggttttcatcaccagctcggcggcgatcgtgtggtgcatgcggcgccacccacaggtgcggcgcacgtacgacaaggatcaggacaccttccgccatgtggtgctcgtcgccgctgccttcgtgctcgcattgctcttcaacgagcggttcaccttccgcgaggtgatgtggtctgaccttactttgcttgttcaccgcactgttgaattgatgctgcaatgggacgcccgataaagtggttaattctgctgaacctatgtgcattaagaaatatgatatatctgcttaatatgttttcccatgctacatttcgttgctaggaaccgtaattaaaattcgtgtacaaggctgctagtgctgtgcaatgtaaccttaacaaatttatctcagtatgagccaccctagcaatctgagttcacagtttgcactgacttgaacaagactataggcacaatcatcgttttgttcagtgcagtgaagaattgtggataccctattaataaaatcctacttaagtaaggcaatgcagactgccgacagatgtttgttgatctatatgctatttgctgatgttgtattgttgttagacttcaatagtggtcaaatgccagacaatttctcagacctcattctagttgttttcaaagaacactgctacagtaggagactcatctgaaggtagcatatccatagaatgtaacaaaaggttaggtgaataacacctatacctattgaattaatttagaattttagaaacctatgtattatttgctcagtatacatcatcctgcactaatcaggatttcttccctttgggtaaatagaatctaatcccatttttctgtagtttcaattgtatggtacagattatattcttcgaagtggccactttttttttctagagcacacatacttcttcctcttgtttctactggaaccaattagtcagaatgatgcatagtaaagtagcacattagtaaaacacggtcatgttgcatttacatttgttagtatgatacacaaattaacataatttcaccgttcagatctgctgggcattttcgatttacttggaggcagtggcaattctccctcagttagttttgctgcagagaagtagaaatgtggacaacttgactggacaatatgtattcttcctagggtatgagttttaccacacaagctttttaccataacatatttatacatgattcctgtattacaagagaatgaaacatgtttgcttttcatgcttcaacggcttctgttgcagtctccaagtttatgatggaaacatgaaatatatgcatgcattaactatttagtttttgtttggtccttaggcttgagaatattgaatatgcatgtatttttttttctttatggacatatgacatgtcacatgttccttctgtccatttatattgctggtcataaattttggcacatgaaatgcatcccatctattctttttttgacgtaagaaggtagagctggctctaccttatagccatttccttaatagaaatgaggtagtacaaagttttagtgaaggaaggaaacgaagaagaaacggaggggactttacattagttttggtatttacagatttaaggttctatctgcagtagctgcatcccatctattcttagttctctttcgtcgatcttccatttttcctggttagttctaggcttgattaattaagcctacatttttttaatatacattgtgtccagattcggattagggcatgctttaaatagtgaacgatcgacatgcttctaggttcccagttggtctctttcaagtctcacaatacttgttttgcagggcctaccgtgcattttacatcctaaactggatttaccgttacttcactgagggtcaccacagcagatggatccgtaagcgcctgcccctcgtatgcttgtgtttcatatcccatgttctatatatgaaaagaagttctgacgatctgtttcttccagcttggattgctggtttggtccaaacagctctttatgcggatttcttctactactatttcttaaggtaaactggatactgttgtcaaacctcatttgcagactctctgggtactgacaattccatgtcggttgttgcagttggaagaacaatgtg

SEQ ID NO: 76302 - DNA, 2932 bp, Oryza sativa
caaattaaaaacctaaacggttaaaatccaccctttttgcaaggggctaaattccacttagctccacacatcgcattaccaaacattaattcacatgaaaagcaactccatcggctcaactaatctgttctttccgttccattacatatgaactaatattgatcaaggctaaaaagcaggctatatttttatcttacattaatttgtttgtagtaggtatcatgcgaagcaaaactatagtatacatatgctcatgggacgctaggaattgcacattgacctaaaaaatattttaagcctgaatctctattgagatcttgtcattgattatttggggccatttggttgaaacacagcacaactttgtcaagaaaggcaattcataaaagcaaaagtaaacaagtgaactggcgcgtcatcatccacaaatctctgttttaacttttaattagtacgtaactaacaaaaaccaaagaaattattacattaggacatgtacagacagaggaatagtacaagagatgtgagactttcagaaagtacaggaaatgtgttgcaaataaaagatctcagtgccaatgcagggtgtttgtcctctgtatttttatgcattcctttccctctctaaataatctctgtgtgtgtgagccagtcatagtggtgcacattgcacttttcactggtgtcatatcgtttcatgcatcttgcactgattttatgtatgcaaagttggtgtttttgcatcattgcatgagctccttttgcatgctgatgcttgttgtataagcagatcactacagaagctttatatcctcttcctggatgtagcccacttcttcatttgcatcatgttctaatcttcagcacctccatttttgcttttgtttttcttgaagaaaccatagcacccaattctctttctgcacaaaacaaaagaatgggtttgttagatcattttctgaattagatatgttctagtagtccctagtgggaagatgatgattagaattgctattgctgaattaatagcacaataggtcatcaaaaggacataaagcatttgtgcaatgattaggattcaggtgacaagaagccggccttaattaagcttttggaaaaggaaacaaaaccacttgggagaagaaaaaaagaaataaaaggaaagtagccaacatgaagaaagatcctacaaataatttgtctgatcataaattggatgtatgaatgattggagtccatgtggcatccaactgtggccaaatctattcaagaccctacaaatatgtcatactagtctgaaatagtctatctgatgacctatttttaaggataactagtgcaacccacaatattgattactaatgtgatgctaaaaacaaaaaattacaaacaacaagttgaacatatatactccttaaacaagcgcaaccattgacaaacaacggccatatatagaattttctgaaactgagaaaccaaacattgtctgaaactcatcacaaattcagaagccaaactaggagtgaacaaaagactatgtcaagtcatgccccatttgccaagaagactttataggtagaatagattgactgctaattaagttagattgtgatgaaacaagatggacttgaagctatgactctcactagccgtgttgaccaatctgcctccaaacttgatggcttcacactaacttactcaacggggcagtgtaaattgttgggttgtttttagcagcctaagctgaacaattttttcacacttgacgtatttgctgacagagctatactttgatccagtctattaccatctccagactttgaattttgtatgtggttatgtgtgagctcttgacctcagatttttggaatttttcaaaaagttatcttctagaactacttatttgtctcattcatctgttggaaaaatgggttcttgggatggaactgctagctggcaggaaaacgtttaatggcagaaaatcttcagcatatggtggaaatacattcatattattattgttgtttttcatttaatgttgaattcacctttcttatttgtgagggaaaactctataaaaatggagattaaagtgtactgactgctatgtgcgagctattgacaaacagtaggattttcaaaaaggttaacttctagaacaactgttttctccttcatttttggggaaaacaagttttctcaggatacaaaactactaattggctggaaaaaaataatggtggaaaatcttcagcacataatagaaataattcctatattatttattgtttagtatcaaaataacttttcttatttgtgagggaaaactctacaaaaatggagattaaagtgtggtcattgtttcttaattttcaatattttaaattgcgattctgatctcaagcgattcacaaagaacccaacacaatctaacagaatcaagaagagcataattttttccccaaactacaactaaataagttccatcaacctaagttagcaaactctgttctccaacttttttaaaaacaaacagattttgaaataagacaccattcctaaaacccaaccaaactcccattcgagaataataaaaaagagatatgcaaaaaaaaaaagatccaatgaaactaaactttacatctagaaactgaaataatgcacaattagcaagtctaaaataatttacctgctcctgctcctggttgtttgagccttcgggttgccgccgccatggccatttccgatgctgctgctgctgctgcttccatggccgccgctgctagtgctgttggtgctgctcgtcctgctgctggtgccggcctcgctgaactcgccgcccttgctccaccactcctcctcctgcagctgcgcctcctgcttcttcttcttcttccccttcgtcttgttcttcttgccgccggcggcggcg

SEQ ID NO: 76303 - DNA, 4776 bp, Oryza sativa
ccttccctcgccgccatcgggttccccagcgggctccgcatcctaaccctctcgaactcccctcctcccccacccaccgccgacgccgacgacccctggaagttgaactccagccgccgctgccccgacggcggcatcggcatcatcccgacgccgagagagagagagagaggttggaagagagatggagagggagaggaaggtgtaataatggcgatgtggaggaggaggcgaggaggcggagggggagaagaagaggagagaagaggagaggagggaaagcgatggcgggtgggtgcaagcaagcaaggtcgttggtgagagatttaaaagcgggatttaaatttggagggagtacattacatacaaagctttaaataataataattaaattataaacaaactacactgtactttgtgtatatacggcgtggcgccgaactgtacatcacagcaaagctgctgtacatctccgtcaggtccataccgtggattcgtggagccattgggttcggaatcatctatcataatatcattatcgttacgtgatcttaactttatattatcccgcacgacagtgtttataaaagtagtgtcattatggtagataatgtgaacccgatggactaatggtagtatcttcacctcccgcacgtaaaacgaagggatctattatggtattactaattaagtattagttaaaataaactttaaaaatagattaatatgttttgttaaaacaactttcctatgtaattcttttttaaaagactattgtttagtatgtttggaaaacgtgcgcgtgaaaaacgaaggagtataggttgggagttgtgagtgacaaactcagcctaaaatcttcataaacccgagacaatggctactgttcacacctctcgtattaatatgtaagatgtgtgcagtggtgaaatggtgatgtgttcgctaccatgtgtgatcacgtctgagtcggatgacgcataattcgtgatatattaaaattttgttattatgttaatagatggcggtgtaagtgattggtaattaatgcgagtgattaaaataaaccaagggtacatgacatgagtgttgaaatgtttgctagcttgattgttgcaatggcgtttaatcggtgttgtaggatccaggggggtgaatggttggtatacccaaaaaccgaaaacttttagtggaaataaaagttaccctcgaaatcgacggaagtcggtctgaccgagattgatctgccggtctgaccgaagcgtagccgccggtctgactggtgttgatcttccggttggaccgccctggaatccctgctgcgcctgttgtcgtccccggtctgaccgaaggtcacccgccggtttgaccgccgccttgccgccggtctgaccgccgatgtgtcgccggttagaccgccgaaacccggtgaaacataaattgaagaattctaaaagtagatgacgactttattgattctctctgtatttacgaagtgcacaaacagcactccttacagaaatttcgactaaactcaaaaccctaactcaaaactcaactcaattgctttcaaaagcgataccgggaagcctcatgctccccctctatttatacccgaggcaggcaggaaccaaactcatactaggagtcctaaacaccttagaaaaccctttagtacaagaaagaaactttacataaccaatcgtaccaaatttggactccttccaaattcgactccgcatcccatacacacacaatacctccatcgtatgccatatggaatctccatcaaccacgtgcatcaactctagcctaagtatcccgcataatctctgaccaccacggacgtcgtcttatccccaagccgactcccggtccatcaccgcaaatactctcccgagacatcgagtcacctacacatgaaataaataaagaaaccatattccgagaccaagctatctccaacttgactcattagtagcaaacaacagtattacatacgtatagtatccatctagaagccataatcatgaaataatcacggatatccaaacaaacaacccgaaagcgaaactgacacagtgtcggccggtcagaccgcgggctggccggtccaaccgctcgattaccgccggtctgaccggcatacacagcccggtctgatcggtcacatgaaataatgaatcctgcgatcacctgtgaatccaatcatctccaaaccacttcatgaataaattccaaataacaaaaccaataatctccaatgcccaattattcatcacagaataataataaaaaacacctttgattttacaagtgtgagtgctttactttgttgtaacaggaatgctaaaaaaataggatcctgtttctcctaacccctcaagctggggtctggggaggcatgtgctaccgccggtaggtccggccgatgagccactaggcaccattggtgtagcctcctacttatcctcatctttacctcaactcaacttcggttgccatgggccacctcctttatgttctctcacgtcgctagtagtggtttgtgtgtgcccacacgagacacgaccataggtctaccaggtgtaccactgcctccatcgttgtacgataataccacataccccgcgttgatgttacatggttgtccgatgataagtaagatctatatggtggaactaactaaaccttcacaaactcaagacagtggccacggttcacacataacaaaaatatgtgagatatgtgcggtggtgaaccggtaacgtgttcgttaccacatgttaaaacgtctgagtcggacgaggtgtgttttatgtagaactcataataagaaattttcttattatgtattctacatgtcagctgtacggttcttttttcatttgccacgtgttaatgtaattctatgaactagttagtacgtggcaaataggtggcggttttggtgattgataattaatgcgagtgattaagaaaacctaagggtacacttggatttattgagtgttgaaatgtttgcttgcttgttggtggttaatcatcagtgtgagtgctttactttgttttaaacgtgatagtataaaattgtgccattttcatgacagaggaactgttcctatccattatatttcgtgcagcccctaattgttgtgatactttagttcattctgaaatgtgatacccatgctatataaatatggcattttcatgacgctgaaactgtactgatcgatcgattgtgttcagcccctaattgacacagcatgcaattaacagctcgatgaaagcgattcagtgtttataatttgcagcatagttcagtagccatccagatgtctggcacgtgcttagaccgatggagaaaaaactgacatgatggttgctacatgtcttgagctgttacatctcacaaccactaaataatccgtggttaatcaaaatactactgctgcctttgttccataatatatatcactgtcaaacatgacacgatgtctaaaactaccttttaacttttagtttcttacacacactataagatgtagcaacaaaaatcataacgatagaaaaagtaaattcaaatatcaattgaacaatattatttcttaaaaaataaaatttaatttgtattagactaattttcagtcgaatatttaatgagttaaatctttataaatctgtgacagagagagtagcactcgtacctatctcagattaagcaagacatcaactaaattattataatctgtaacttgtagtattagatctctcttaagtttatagaatataatctcaaggattacgagactaatattttggatgattagaatagaattttagtggcacagtaatcagtcaattttcttgttcctttttgtctgtcactgcatgcacaaattgcacatataaatgaacagtatgagagagataggagactttgcaggggggtcaggaagtcatgggtttctagatgttggtgataatttgcaggtggttgaggagccactggggactctagaatgaaatgacttttgaaaaacgggtacaaatattttcccgtgggggacgacaaggcttctctttcgatgggattctaccttttctttggtttcaattcacagcgattgtagtgcttttttttatgtaaaagaggaaagaaaggttttattatttatgcggacgagatgtctttatatgttttctcactgactagcggaccgatgcaaatctatgttgaatttttaggtcaatgttttcgttttcggaggatcgatgttgggtgaattataagattttttataaagaattatgtcggtaaagctgttgatgcatgcttggagtagaacttgttaatcagctgtctgattgtaatttgcattcctcagctccttttcttagttttgtcttctcaacactcaattcaccatctagaacaatcatgcgcacgcatggttgcggtacattaatataagttgaaaattaatactagttcaattttgttcagaaaaaaaggatagaagaaatgttgcttcaattactatgacgatatcaatctgccacagaagacagaatctacacgtcgttttcagatatggttaaactattccacagcacaaaactttgaaatattcagatacaagtacaattaaaacaactgaatatatatatatcttgagtgtctcattttcaatgaacaaatcgtcagatattcattattagatacagatacaggtcttcagaagatatcaaaagcgaaatattatattatgg

SEQ ID NO: 76304 - DNA, 14125 bp, Oryza sativa
ttagttgttacagttcttaaaaatgatatttttgtctagaacatgtaacagttttcctgttgcaaaaaacagatagaaaacttgcaaataccaagttgtgttttcattaaaaaaacaagttcggtgattgggagtagagaagaaaaccaaagcttaaaatgtgaatgtaattgcagagaatgaaattgtagtgtaagcattgaaactgcaagcaaaacactaattaactcgagtgttacctgtgttctaattccattactaattgtatccccttcactgaccaaaactcatagtcaaccttgagcaggatgagctgctacagacccatggaagatgtgctgcaatatgaaggaccatcataagcaaggtagagctacttgttttttcttcaatttagtgagtcctacttataagtgtttaggaaatactgcctcccacaccatgtaaataaatttaaggaaaaaaggaggcaggacaagatgaagcgtttataatgcaaactattgaaaatcacaattcgtggatatgtgccatcaaatttgcttggaaactctctctctctctgtggagattatggatatcccatatctacacggcgatgatatttgggctgaatataggataccgaatatagatagaatattttatgtgtatctcgggtttgtttctcaacttgtgcatcaaggaaataccctgggacttagtcggttacgactgtattttatctgtatctgcatattccgttagggatatagattatcttttgtaacacggactcctccccatatataaggggggtccgggtgcctctaggggcatatgttgattttcccaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacagttggcgcgccaggtaggggtagcgtcaagcttttcgccgatcagtgcaatgggttccatctccggcatcgacgacctcgtcttcccacccgggcagacgtttcggttcggcagcctcgacttcgtcaccagcaacttcggcaagatctctctccttgactcggagtcggaccagtcgggagagaaccagatttcggccccgtttggactcccaaacgcggctgaaagttacttcaagaccatctcgaccgagtcggcttcaaaccactcgggcgagatcgcaccttcaccaacgtcaccagatcaagatgatggggcttacccaccgatcctgatgaagctccccgacgatttgacggccgtctccatcacgacagcgtctctttcccgtaggcctaggcggaagtcggcttcaataccgatttcgcctagcttcagggaagttggcgtcatcctccaaccactcggcacggtttagacggatcagctagatggcgactacagctctcccaccgtcgactcgcgccccaccgacatcgtggagtacgacgagtttagctctcgctaccacgacccggatctcgacgacttcgacggaagcctagatgacaactacacccctctctactttggcgtcttcatggccaataacgagacggaggagcaacgccaagcccgggagaccgaagcgcgtcgcgagactgagcgccgccgactggaagaggagcatcaagcacaagaacaagaacggttacggcatgagcagcaggagcgtgagcggaccgcgaaggaggctgaggatcgacggcagcgagctttggaagcagggcgccgggcgcgtgatctcatcggccagcaagatgttgaagggacgccggtttttcgcacccctcaacagaatgcggttgccgcgatcaccctcctcgacaccctactcagggaaaacgagctcaatcaatccgatcacgtcgtcaacatcttgaaccagacgaagactatgattgcggcttcggtcccagttaactccgaaagcgtccatacgccgactggcagccgagtcccccacttccgatctcatgactaccgtcatccaagcctcagcatcaccggcgcaggatccaatcgcaggagcaggggccacgacgagcggtctgttcactcacctcccgatccccatagggagcgccgagtggaacggcctcgctcaccacctcgtcgccgccccgtcgatcttcgcgacacaatcatacagcgccgagcagctcgaggctatcatcactcgccggaccgccacgacgacgaccttgacggagtagcagccttcaccgacgacctgcgtcgagtggattggccagccggcttcaagccgactggaatagagaagtatgatggtaccactaacccagaatcgtggcttaccgtctacggtctcgcaatccgcgcagcaggaggagacagcaaggccatggcgaactatttaccagtggctttagcggattccgcccgatcttggctccatggattgccccgtggtacaatcggatcttgggccgagttacgtgaccacttcatcgccaactttcaaggcaccttcgagcgtcccggcacacaatacgacctctacaacgtcattcagaagtccggagaatcccttcgagattacatccggcgattttctgaacagcgtaacaagatctccgacatcaccgacgacgtcatcatcgccgcattcaccaaagggattcgccacgaagaattggttggcaaattcgggcgtaagcctcccaggacagtcaagctcatgtttgaaaaagccaacgagtacgccaaagctgaagacgccgtcaccgcgtcaaagcagtcgggtcccagttggaagccaaaaaaggatacgccggcttcgggaggaggtggaagtaacaatcataaggaccgcaagcgtaagcctgcggaacttgttgcaaccgccagtcactcttctcgacagcattcgcgcgtcaacacgtttgacaagatcatgaactcccaatgcccgcaccatcctaactccaaccacgtggccaaagattgtttcgtctacaagcagttcgcggatcaatacaccaagactacacggaagaactccgatgaagaacaaagcacgtcgaggaagaaggacgacggcgacaccccggcaggttttcaagaccaccgcaaggagctcaaccatatcttcggcggccccctggcttatgagtctaaacggaagcaaaagttgaccgaacgggagatcaatgccgttcagcccgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcatcgacggtggcagtgcactcaatatccttttcgccaagaccttggatgatatgcagattcctcgctccgagttaaaaccaagcaatgcgccttttcacggcgtaattccaggattatccgcaactccactcggccagatcaccctcccggtcacttttggcactcgggaaaactttcgcacagagaatatcagctttgaagtcgccgatttcgagacagcataccatgccatactcggacgcccggcattagccaagttcatggccgtcccgcactacacttacatgatgatgaagatgcctggtccccgaggagtcctatccctacggagtgacatcaagcaagctgtcacatgcgacaaggagagttgcgacatggcccaaacccgcgagatggcgtctgcccgagaggatatccgactggctgcagccacggcgagcgaaggagaaatacctgctaccaagacttctaaaagtggagaaagcgaagctaagactaagaagattcccctagatccctctgatcctgctaaaactgctgtaataggcgccgagttagattgtaaataggaaagtgcgctcatcacctttcttcagaacaataaagatatctttgcgtggaaaccatctgatatgcccggtattcctagagaggtgattgagcactcattacatgtcaaagaagacgccaagcctatcaaacaacgactccgccgattcgcacaagacaggaaggacgcgatcaaggaggaattaaccaagctgttagcagcaggcttcattaaagaagtccttcatcccgactggctagcaaacccagttctagttcggaagaaaacagggcaatggcgcatgtgtgttgattacactgacctcaacaaatcctgccctaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgcccttcggggcatactgctacgtcaccatgccatttggactgaaaaacgcaggagcaacttatcaacgtatgatccagagatgcttctcaacgcagattggccgtaacgttgaagcttatgtggatgatgtagtcgtcaagaccaagcaaaaggatgatttgatctcggatctggaagaaaccttcgcgagcatccgtgctttcaggatgaaattaaaccctgaaaagtgcacattcggagtaccgtcagggaagctgcttggttttatggtgtctcatagaggcatccaagccaacccggagaaagttactgctatcctcaacatgaaaccgccaagtacccagaaagatgttcagaagctgactggatgcatggcggcgctcagccgatttgtttcaagacttggcgaacgggggatgcccttctttaagctactaaagaaaacagatgatttccagtggggacctgaagcacagaaggccttcgaagatttcaagaaactcctcaccgagccaccggtcctagcctcaccacacctgcaggagccgttgttgctgtatgtatcagccacctcccaggttgtgagcactgtcttggtcgttgagcgtgaggaagaaggccatgtccagaaagtccagcgaccgatttattttgtcagcgaggtcctagccgactccaaaacgaggtaccctcaggttcagaagctgttatatggtattttaatcactaccaggaagctatctcactactttcaaggtcacccggtaacggtggtcacatcatttccactcggtgatatactgcacaaccgcgaagcaaacggacggattgcaaagtgggctttggagttgatgtctttggacatatcattcaagccccgaatttcaatcaagtcccaagcgttagctgattttgtcgccgaatggaccgagtgccaagaggatacccccgcggagaagatggagcactggaccatgcattttgacgggtcaaaaagactttcgggcactggagcaggagtggttctaatttcaccaactggagaaagattaagctatgtactttggatacatttttcggcgtcccacaacgtcgccgagtatgaggccctccttcatgggctgcggattgcaatttccctagggataaagcgtctaatagttagaggcgattcacagctggtagtcaaccaggttatgaaagagtggtcctgccttgatgacaatatgatggcatatcgacaagaggtacgcaaattggaagacaagttcgatggactcgaactaagtcatgttcttcgacacaataatgaagccgccgacagacttgccaactttggatccaagcgcgaggtggcgccttccgatgttttcgtcgaacacctttatacgccgacggtacctcacaaagatactgctcaaattgcgggcactcatgacgtagctatgattgaagccgactggcgagagcccctcatacgatttttgacttctcaagaactccctcaagacaaagatgaagccgagcggatttcaaggcggagcaaactttatgttatgcatgaagctgagttatacaagaaaagcccttcaggagttctgcaacgttgcgtatctttagaggaagggagacaattgctgaaagacatacattctgggatatgcggaaaccatgctgctgcacgcaccattgtcggcaaagcttaccggcagggttttttttggcctactgcagtgtccgacgccgacaaaattgtgcgcacgtgcgaaggttgccaatttttcgccagacaaattcatttaccagctcaagagttgcaaactatcccgctgtcttggccgtttgcggtttgggggctcgacatggttggcccgtttaaaaaggcagtcggcggttacacgcatctctttgtggccattgataaattttccaagtggattgaagctaaaccggttgtcacaatcacagcagataatgctcgagacttcttcatcaacattgtgcatagatttggagtgcccaatcggatcatcactgataatggcacacaattcactggcggagtttttaaagacttttgtgaagactttggaattaagatttgctatgcctcggtggcacaccccatgagcaatggacaggtggagcgagccaatggcatgatacttcaagggattaaagcgcgtgtctttgaccggctaaaaccctatgccggcaaatgggtgcaacagctgccatcggtgctttggtctttgcgaactacacccagtcgggccacaggccagtcaccttttttccttgtctacggggcagaagcaatgttgccgagtgaagttgaattcgaatctttgcgctttcgaaatttccgtgaagaacgctacgaagaggaccgagtggatgacttgcaccgattggaagaagtccgtgaagcagctttgattcggtcggctcgatacttacaagggttgcggcgttatcataatcgcaatgttcgatcccgtgcctttttagtcggcgacctggttttgaggaaaattcaaactacacgggatcggcacaagttatctcctttatgggaggggccatttatcatctctgaagtcacccggccaggttcctatcgactcaagcgagaagatggtactctcgtcgacaactcttggaacattgaacatcttcgtcgtttctacgcttaagtttatcattgtacttccctatcttgactgtcaacatcaagttttcttcttgaagttgtcagtcgggggctattattataataatggagtgtgattttttatcaattcaatttgcttacttggtttatcattgccttgttcgatttttctacttagtctgcgaggactgaaagttttttatagcttctttgggttttaggctcaacaaagcttgataaaagcttttaagaaatcaaagatttggctagaactatcaagcacagcataaatacaccagtattgtacaaattgagcctccatttgttacattcatactcagtcagagtcagtcctttcatcatcagagttattgttgctcggctgaaggtcgttgttgcggaattgctctacaacgtcacttgcaatcttatcagccgcattttgagcattgctgataagatcaagagcagcctcttcgcttgtcccgtctgcaaatccatcaatggtgtcgatttcaattctcgggtacaaggatttggtcatcgccaatgccatgctagctcccatacttccagctttcttgatgttcttgaaatatacatccggtgcaactctcagcttgtcaaagatttcggttgcgtcaagtgcactcggaccactgttattgaggaacatagcttggacaagtggtgtagcgacattggcaacttcatctcttgctcctttaagcctcttgattttatcaaccaggacgtcaaactgagcttgagatttgattttacggtctacaaaacacatttacaataagaatctgctacattaaaaagaggaaagttcagattgtcagctggcagtaccttcaacctccttcaaggccgagtccctttctgcagctagttctgctttgtcttttctcaaagcttcaatttgcttctccatttgagccatcctggtggcttgcgctgtttgaaatccgaatgtttgaggatccagttatgacagcataaatgggacagatctagagattaccttttgatgaaccactcagctcgtagtttgaatcctggagctgagcaattcgttcccttaattccttctccgttttcttggcatgctccttggcctcgtgtagctggctcctaacagcttcaagagttcccaaatgaggaaccagcttttctaaggttgtggtcttggcctcattgcgaagatggattctctgcacggtggttcatggattagttttgctaacgagaaaacaaagtcatcaaaggcagtcacctagaagacttacattcacaatgcgagtagcttctccaagtactttcttcagctggcacacttcctcatcttctttttggcgatttatgacaatgccggaaacttgagagttctcgtcccaccatttgagtaagataggaggacgagagtcatcagctgcctttatgcggagaatttcttcttcgtcgccgcctagtggacctgatgtattcccaagacattagacgagtaagctggagttattcagaacggcatcacttgagaagatgagttacctgaggatgtgcctagctgagcgtgaggtgatccctgctctttatccggagacccaatcactgagtcattaccagcctctggtccttgagaagttgtcgcctgcgcttcagcttcaggaatctcttgatttagacctacatccgactggtttccagtcgggggctcttgggttgttgcagtttcagtagctgccgactggtttccagtcggcggctggtcactcggattggccttgtcatccgaagcatgggcaccagtcggctgactttcggcagtcggctggctttcggcagtcggctcagcatctttggataaatttgactctgtggcagccggatcaggatcttttccagttggatctatatcggacggtttcctgcaaagtgtcctttcaatattcagcgtaatttctatgagagaagcatgccggaataaaatggtaccgagaggtttatacctggaagatgttctgatctttggcatttgacggccagccagttttttcctaggcatggtatgctttgggagtttattgggcgtgcccttgtccccagatttgttgctgtcatcgacttcgtcgtcattaagcaccagctttctcttgcgagaacctgtctgcccagccggtttggaggtttgaggttgcgggtctgacctgattgtcggccctccacttccctgaacggtgtgctggcgaggagatcggcgttgagcaattgggggatcagatttcatcaatacgtactcctgaatgagatgcttccacggttagctcactcaacatgaagataaaattatgttttggtcatgagttgaaggtttcagatacatacctgcggaggcggattgaatgcattatatggtacaactggcagctgatgtgagtagctgacgacaatagcatttgagaagattttatacattctctccttcatgattttaaagtccagagagtctgggtcttcacggtttggatcatgcttgccgtcaaactcaaatgctgtgcgggatctctctttgattggagataatcgacacttaatgaaatgccgagtgatttgctctccctgtaagccttgctctttgagcttcagcatgcgttccatcagttctaaggcttgggcggcttcatctcccatgggaagagagttccaggtatcttggtatactgggggaagacaggagtactcaggaagagcgggctcgggattttgaatataaaaccagttggcgtgccatcctttgtttgaagtcttgaaaggcatagagaaatacttctggctcagagtgcccctcagttgaaatccagccccaccaactacgcatggtttgtttttgttcggttgaggcttaaggaaaaagattcggcggaacagagcaaaatgaggtctaatgcccaaaaaagcttcacagacatggacgaaatttgcaatatggactatggagttcggattcaaatgatgtacgctgattccatagaaattcagtatcccacggaagaactttgaggttggaagagcaaatccaccataaaagaaatgagagaagaccacgacctcgtgtgtatcgggggtcggaaaagcctcaccgcacgctggccgccacccgatgatctccttggcagggagaacgccgtgcgccaccatctccttcaggttctcctccgtcacgtcggacggcgcccattggccttcgaagctttctttctcttccgccatcgattttccccgaatgcgctgatttgattcgagggatggcttgggagaggtgaggaattgaggcggtggatcacgggaaggattttgatcactttttgaaggtggatttgagtggaatggtgaaccctagtttgccggcccagctctgtactgtagcaaggagtggggaaaatggcgagagttccggcggggaagacgaagcgtcgtttggatctcgggttttcttgttaagggtatcggaggtgcgaatgggcctaggcctgaacagtacctcagcccaatacttttaacagcgtggcccattgtgttccttagggacttaggcattctttgctttggcaatttatgtacacaatagtgttgcccaatgctgataaaatcctttttacgcggtcatataattctttggaattattgcgatgcaaattaaaaggtgcccgacagaaaggcgttatgctgtttttgtacgcttttttaggctacaaaagctgtctgggttaacttggaatgacttgtttttatcatagtcatttcctcggtatgttatatgcctgttttcattatggtaaatagtcatagcctaggctattagacttattcattaccatgatttttataatatttggtgggtaatctttagagtcttatattcggatgcctgtcaagtgtgttcattcgtgaactttttagagtgttaaccactcggatttcttttattatggctgaaaagcagtcggctggaatgcctctttaggcgccgcgtatgcttttgtcatatgatgcataattatgctattattttgttctcaactatatgtttagtttgttgactaatcacatagttgggggctatacctaattaggtgcatctattcgatgcaccatattctttatcttttcgccctttacagtcttcgtcttcactactcggcaggccttggcatgaaaagtttgaagcactcggattattatctttgagcaggctatgatggttgactgcaaaggtctcgggggctactgtggagattatggatatcccatatctacacggcgatgatatttgggctgaatataggataccgaatatagatagaatattttatgtgtatctcgggtttgtttctcaacttgtgcatcaaggaaataccctgggacttagtcggttacgactgtattttatctgtatctgcatattccgttagggatatagattatcttttgtaacacggactcctccccatatataaggggggtccgggtgcctctaggggcatatgttgatttttcccaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacactctctctctgctagtctgattcatccttgttagtgtaagagcagttagtgagaatatgtatgctacccgtgcaagcacattgagatgacagtgttacttgcaagttgcaacaccatatgcgatgacagcaatggaagagtctctgagtgcaagcatagggggacaaagcttttatactctatgcagccctgatacaaaaacaaaatggggtgccattcttccaccatcaggatttgatcttacttgtcaacaagcaattatcccacagcgtgtacagatcgagagctagcaacaaaacctggagaaatattggggcaggttggggatggcaactagcagtgagtgcgggctctggtctccggatggagacacaacaacaccaaaatgaagcagaccaaggccagctttcagagtccagatgaacatatggcaacttgagatgaacgacgtgcggcagttggatggaggcggtggcggcgggggaagtggtggtagggggagcgggagagcgggtagagaagggagcggcggccgacggcggtgaaggaaccgtcgacacgggagggggttcacaagatttaaaagttttaattgttgtttatttttactgaaacatttgatcgtccgattcgtttggaggaattgggcgcttgatttggaatctcctctgcaactaagagatgctcctaactttacccatccacatcctactaacattgcaacctcatcatatctgcaacgtcagagccaaaacaattagtgatagaacatcacagccggcaattaaattttaaagtatacattatttttctctattttgtatatatacatgcatttacagaaatatacattttccgcggtacaggaacacggcaccgtgccatcagtgcagctcgaaggcacggaacggacaggaggggcggtgccgcgggaccgacgtggtcctgcagattggtcgcacggcaccacttgcggtgccggtggtgcggcaccggcatctaagcacgcatgagtttttaataccgttcaaaacattgtttatttagttattgtttaactctgtttactactgttcacagagctggttccgcgcaatggaaccgcaggactgcattggtgctgcgtttttgagccgcgggactgtcacagtttcacagtttcggcccgtaggaccatcgcggttccgctcgcccgttcagcgggaacggcctggctagcgctctcgtgttcctgtattcaacctgtgggatacgtatgtttgtgctatttcttctcgtgtaagtatgtaaacctaaattattaaaaaaatagatataatctcaaaaaaaattctcacagccgctgttcgtgttgacactatcgaatttttttcatttttaaatttatttttttaatatttacagaaatattatatcagcagaaagatttacaaaaatagaccctgtcgccctctatttgggcggcaagctgacgtggcacacatgcgcatgacggtcattttagggggctgtgaattttgcacgtggcccccttgccgcccagtggggcctccgtgcaaaattcgcaagggcagtaaggggcttagatgcaaaaagaactagccaattgcttttttgggagggcaaaaattacatttagccccttgccgcccttacagaggactgtagggggctaagcgcaaaatgcgcacacggtgccgtcacgacgccgtgtgccacgtcaacttgctgcccaaatggagggcggcaggatctatttttgtaaatctttccattgatataatatttctgtaaatattaaaaaaataaatttaaaaatgaaaaaaattctgatactacctgccaaaaagtgagaaaggccgaaagacgccgccgtaggactccccctcgcagagaaggaataagttcactttgggtccctctatttgtcggttagtctgattttcgtcccttgaccgcaaaaccgggtatgacccgtcccccaacttacgaaaatcaggcaaacaaggtccctcggcagtatgaagggcggttttggccgacgtggcgcctacgtggctcgtttgactaggtcttcgtcccacgtggcactgacgtggcgattacgtggcattgacgtggcgctttcgtggcaattttatccgaaaaaataataaaaatcgtgggacccatatgttagctaaaaaaaaaaggtggggcccatttggttccacctatcagcctccctcctttctctcttccccctatac

SEQ ID NO: 76305 - DNA, 23624 bp, Oryza sativa
agagggggtagagagaagagggggctgatgtgggaccacatgggccccaccttttcttataatttttgtgtagctgacatgtgggtcccatgttttttttattatttttccaggaatcatttgtcacataagcgccacgttggacgaggacctagtcaaagggagccacgtaggcgtcacgtcatccaaaaccaggcacaatactgccgagcgaccttttttttgcacggagtcatacccggttttgctgggatgaaagccggactgggcgacatatagagggacctaatgtgaacttattcccgcagagaacgagatctgagcccatcttgctgtcgacgagtcacgaggagctccacttcagaactctaaaaataagagacatgacacacctgtgactgcacgagttgccctcaattcacttatcttgttcaccaaaattggatatcaccagtgtgacataagttttcacaaaatccatcggactggtatgtacagcaccttacagattccatacacaacatgcaccattcctaggaaaatatgactgctacatagttgcctccctagatgtaaaagatattaaggcaagcgacatgatcgtgcatatcaaaactaaaatgaaagagtatgagcatgacagatgactcaattcatcaatgccggggccacaaaccacataatattgtacaagttgagcaataaggcagggcacattcacaactttacccagcattgtggaagtccttcagatctgattttgacaaggatcagctcatctctgaccacagaaacagtggcatcaaggcagcctttgctgtttatatcagtcatcatcagtatcatctgtcttctgcttcttccacttataggccgcttcgaggatcttgaggtttggtgccagcgcaacctcatcagggaaaatataatccatgtactcctcatacctactaaggtttaggaaaatgttttatcagcacatttgttccctaaattgcaggcagcctaaatggaaaacaagctatgcgaacagattaggagtcaaaactatttattgtctccttttgttataccaaatttcttaacctccttttaagggcagatagcacagagtaaaatgaaacttgttagagaaactatagaagaatgaaataattgagtaaggcacatacgcagtagtggagccatcctctgaaggatctggtctctttctcttcactttccttggtgcctttttctgcactaaggtaacatcaccgagatgaccaaagctcacctccttattaagccattcttcaaggagcattgctctttcctcctttaactctggagcactagttctgaagtattcaaatgcccgttcaaatacagctgaaaattgcaataaagaagaggttagatttattgcactatgaatgacaaaaggaacagaggtactcaactggacaaagtaaatttgttctccaaattctgtttacctcggcaccttcgaacctgctctatctgctgttgttgataactaacttcatttttaatctcctcactttgactgtcttccccacccaaaccaactgaggcctcaaaactcagcatagctaatccataccttcaaatcctttgttctatcaagcaatctctcgtagagttcacaagttctgtggaattcatttttatcaatttcaaactgcaagtattcctgtaagatacaaaaaaggaaatgattaagaatatacatagcaaacaaacaaaaggaatttcatattttaaggtactcttggctgactaaaattttaaggtggtctatagattttctaagatcactactttatggctgtctgaattctcaaatattgtaacaaggattgatgctgtacaacagttttgtataaataattttataacagtttctgcagtaattaattattctagtgaaattaatgagagaatctgtcaatcataataggacctaactatttaaaaaacttcctaaaaggcccaaattttcaaaatgttctgtattctggacatcttttttccttagaatgataaataaactgaaaatcaaaatatttactagtgatgtttacaatgcatggctcattaacttctgtattgataaataaactgaaaatcaaaatattttcaacaatgaatataatggtacctttaaattataaatacatatattgttggactatggaatatggatggtcaaacattataaaatatgaatgttggaatgcttaggtaccacagcaattccgaaagcacaaggaagcaagttttttttatgtgcgggtgttgtctcagacaatgtcaattcaacaaatcactagaatatgaaattcaactgatttaggaactaaaggctaaagccatgctaggaaatatctatcacttttagtctgaaagccataaaaatgacgatatattaggataatagaaagaataacataccttccacagaacttccggcgtatcaagggctgactgtgcaatagcaagctcatagatcgagcgagctctatcagtctcaccaaggctcttctctaattcggcatacttcatccaggcataacagtttgctggagaccattcaatatacttctcatagagagtcctacaacgttcaaaattacccagatacaactcaatctcaatgtactttttgaatatcttgccctttggagccatcccaatagcatttccaagaatccgccgtgcagccttaagattcttctgccttatctcaaactgggctgccatgagccacatcttagaaaaagtgagtttcttgtgtggaatcaatttgagacactcgctgtaaacttccctggtccgttccatgtcctttgcatcaagctcctcatacaaagcataatttatccatagataaatgtatcgttgccagtaacgcttctcctctgcaggtgggatattagcaatggctctctcatacacctccctgatcctgtccttgttcccaacactctcctcaagcctaatgtaatcaaaccatgaatcataattgagggggtttttcctcacctcgtcctcatactggaatctcctcttacccacaatggcgtcctcaattccttcacggtcaccaaactgtttttcaaaggcaaggaacttcctgtacagctcttcagcctggcctttgggcaccctgtcaagtgcatacttgtacactgcacgggcgcgctcgacctcccggcacctttcctcaaactcagcaaaggctacaaacaaaacctcagcatgctcatcatctgccagcaggtctgctgcacgctcgtacacccgtcgtgcccgctccacctctccgcgcttcatctcaaactttgcgtacaggatgaatgtatgtggctgcgggtgttcggccacaaaacgttcaaagatggcccgcacacgctcaatttcaccgtatcttagctcaaatttgatgtacgagttccaaccagctgcgtcaggacgccatgccatccacagctcaaacaccttgcgggcgttggcgacggctccaagcacttgctccatatggatgtacttgtaccagagctggtcctggtccacccagggcaggagggagacggcgcgatcacacacattacattcggttcatatgccgattccgcatctcgaactcggcatatccacgccacgccagagcgtgtggtcgcggtgggcgacgtcgagggcgcgctcgtagacggagcgcgcgcgggcgaagtccccctgccgctcctcccacctggcgtacttgacccacgcgccgacgttccaccgggcgcggcggatggcgtcctcgaactccttgcggcggcggaggcggtactcggagagctcgacggagtcggcgatcttctgcttggggggacggacctcgggctcctgccgctccgggcctcgcgcaggatctgctccgcggtgatctggaccgaggccggggtcttgttcttcacgcgcgtcgcccggggcagcttcacctccgtgtcccgcttggtgaggaacccgagggtcgggtcggaggcggatgacggcgccatgtcgccggcggcggcggcggcggcgcggatggcgagcgccatggccgccggtggtgatggggagagagagctagggttagggctcgggagggccggagggagggaggaagaggaggggattttcgagttggtgcgtttgggccgtacgatctggatgcgacggtgggggttgatcgggtttcgcaaacgggggcaagccgccaagcccgcgcgtgggctatatgattgggtttttgggtagatgggctttgtgatggatccgcagcgcggctcgaattcggtttcgggtgcttggctcgagttcggtttgcgctagccctgtggtagggcgagtggtgcggtggccctgggccccgccgtgataagggcctcgatcagtcttgattaatcctaacactggattatttattcaccgttccacacattttctcctctctcttctttattgagatgattattgatggtatttaatataaccaccactaaatacaggatcgatcactgatacatgttgatacgtacaattatagttatcactgcattttcttataaaaatgctagcatgaattacttgatactgtcacaattttctcaaagtcgtggaactattaataggaaattggattgtgtttgcaatgttgtctctacaataattacaataatttaataagtataagcttacctagcgtagcgtagtgtcatcgtaatcgtaatttgggctggtttattttatgatggtgggagtggggccaaagtataggtggccaaatgggccgggccaaacgggcggcccgcggcacggccgttcctgtagcaggcacggcccggcacggcctgctacagtaacgggccgtgccggcacggcccgtgtagccgtgccgtgcttgggccgctggccgagcccgcgggccggcacggcacggcacggctcctgtagcaggccggcacggcacggcccgcgcacggcacggcccggcacggcccgtcaggccgaaaagcgccggcggcgcgtgacagactgacagggcgggcggcggtccaacgggaaggcgacacgtggcactaacggctatttgaccgttcaaatttgaaaataaccgttgggaggctaaaaaattcataaaaaattcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccggctcgaagagatcgagaacctccggtgtgtggcaaagcttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatgctaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgtttgtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtagaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacatgtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcggagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccacttcgagcaactctacctggatccagaccaaccccagtagaattttgttagaagtaagttctgacctttgagctgtactcttttctttgtcatggttttctcattttcccctatgagtttttacatgacaaagtttttaacgaggcagcatgtatcattgtatcctgtaatgatataaacattaataaaggtcattactatttttaacaaattcttttgcaatattttcgcaagtgtggatttacctttaaattatttcaaaataatgaatcacaatctatatttttaaatttttcaacacaacaaaaaaataccattttttctttttttttaacattagcaaatcattacttttttaaaaaacttttatttccattttttaaataccattttttcattttttaacattagtaaatcattacttttttttaaacattttatttccatttttaattttttttccttatacatttcctttccttttttaaaaaaaaaaaaacactgtgcttcacgggccgccgtgccccgaacggcccgtgggcctcgggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggaaccgtgcccgtgccgggccgggccgtgccgcccgtttggccacctctaggccaaagtaactcatcctaacctagaggatgcaattattcaggtttagtaggacacctcttatctatgctttctccttactctgttagatatgtgatttagggtcttatgatctttatctatcaggcgtatgtgtgtagagcgtgtattgcatttgtatgttctatttagaagatatattagctctacaatcgttaagaaaaaaatattctacatattatacccattgagggcctctatttttatttcgctctgggcctccgaaatgttaggaccggccttgaacacattttgagaagataccagagaagagagaaatagcatcgggttgtagatttgtagccagctacagcacggactccaagatatgacaggtgtgggaccaagtttgaattgtgtagtatatatctataggtaactattgtataaattagctactaaattaactatatatgatttggagttagtagttggctatactattaaacttactcttaggctgtgttcttcctccacatttcccaactcatctgccttgtgtctcgtgtgcatgttttttaaattgctaaacggtgtgtttttttaaaaggtttcaatacaaaagttgctttaaaaattatactaatctattttttaaaacaataataaatatttaattaatcataagaaaatgcgtcactccgtaaacatgtctctggtgtctagaaaaaacaaaaaaccttagtgtctccggtagtgttaacaacgaaagttggtaaatttacatcggatttggagttaaggccgaagcggatttggaaggaaatcgataacggaaacagggtatgaatcggcttcggaaccgcatcggctacagtgtgcatcagcagttaccgaatcggacaaggcaagccgatgtagccgattccggcaaggtgatattggaatcattgtcggattaagttgatgtgcttcatgatgattgccatgtatggatcgagtccgaagaaggcagttgtatctattaattaggaatagtttgttagttttctttttatctttaggaaagtgtgtttagtgtcctataaggactttatgttttccttttatctttaggaaagtttctttcttgtcctataaggactattatctacccatgggtataaatatgtacacctggggtcattgtaaactatcttcacgatcaatacaattcggcgcatcgccacccttttcacttccacttttgtttttacgttccggcggaacttggcacctgacgcggggctgcatcgtcttcgatctttggcgaagggataagtccaatgtttcgccggcccaggcaattgtatcgtctacgtcggcgtcgttcaaggctgcaacagtacattcgacctcttggattgctctggtttggatgatatatttgcctacctatttatcatatgtctctgttaatctagtcttagcatatcaatttagctctatcggctgcttctcgttttagggtttctgccggtatcggctaaatcgcgttgctagattagattagcttagacatctatcaccctgaaaactcagtcaacggcttgattgtctagatattgtgtttttttttcatacttagtgctgcatcagttaagtttgatctactaagtcgtgcttagaaccataatctctagcctgcttcttgattgccaataagggttttattggggtttcagccggtgagttatctagacgttgcatcggctcataaggattgctatacatataagttggatttagccgatgacaacaaaagtttcactatttaatctaatcttgtggatttcatgacatcggacctccagccgatgtgtgctttaaccttcggatcgatgcttatttatcatatcattatttgtcgattggtttatactagattatattgttattttattacatcatcatcagccgattgcctttatatcattatctacattggacatatagccgattacttaaaccctatcgctatcggctggtatcggtatcggctattatcggctatcgaccggaactactccatcggcttgtcagccaatcggctgttttgatctactatttgcatatcttgtcagttgcaggatcaaactgactggcacgcccgcatctcatcaagatttggacctgcacaggaactaagcagatctcccaggccagtgtgttcgattttttcgtcaacacaaattagcacgcctggtgggaccacgaattttatatccacatgtctgaagaagaagtcaattccaagatcatggtcacggtggtgaatttaatggaggaacaacaatattggctcggggggcaagcatatcagtttcagcatggtggagtacatcagtatcggctcatgaaagccgattacaagatagagaaagaagataattttgaagcatgagttctcatacttcaaaagtggagggcatgtgttaatagtgaaatttggtaagcccggagtagtcatcggcttagagtcagcatcggcttcgaagtcctgagattagccgatgagagttgtcaagtcgttagttgtcggattcttgctatattcggttaaggaaatttatctactaaaggaagcttatccagaagagaccgaattcaaagagaatgcggcatggcaagttatctattaattatgaatagtttgttagtttccttttatctttaggaaagtgtgtttagtgtcctataaggactttatcttttccttttatatttaggaatgtttctttcttgtccgacaaggacttgtatcaacccatggatataaatatgtacacccggggtctatgtaatctatcgctacgatcaatataattcggcgcatcaccaccttttaccttttctactttattttatcgtccaacgggacttggcacctgacgcggggctgcatcggtgttcgatctcttgctaaggggtaagtccaatgttccaccggcctaggcaattgtatcgtttacgtcggcgtcgttcaagggtgcatcagtacattcgacctcttggattgctctggttcggatgatatacttgcctacctatttatcatatgtctctgttaatctagtcttagcatatcaatttagctctatcggctgcttctcgttttagggtttctaccggtatcggctaaatcccgttactagattagattagcttagacatctaccaccctgaaaactcagtcaatggcttgattatctagatattatgtttcttttcatacttagtgctgcatcagttaagtttgatctactaagtcgtgcttagaaccataatctctagcctgctttttgattgccaataaggttttcatcggggtttcagccgatgagttatttggatgttgcatcggcttacaaggattgcatacatattggatttagctgatcgcaagaaaggttttactgtttaacctaatcttgtggattttatgacatcggacctccagccgatgtatgctttaaccgtcggatcagtgcttgttctattatatcatattgctagccgattggtttatactggattatattgttattttattacatcatcatcagccgattgccattatattagtatctacattggacatatagccgattgcttaaaccttatcgctatcggctggtatcagcatcggctattatcggctatcggttggaactactccatcggcttgtcagccgatcggctgttttatctgctgtttacatatcttgtcagttgaaggatcaaactgactggcacgctcgcatctcatcaatcgttggacctgcacaggagttaagcagatctcccaggccggtgtgttcgattttttcgtcaacaagtagtgaagcagcccgaattcagattttctagaagatatttttttcagggacgggggtgaattttattgattaaatagagtcattacaatctcgcagaacaagatcatgaacataaagtaggagcatcaagtctccacaccgcactatgtcaagtccttctatttaactaagctagttcatgatccactcaattacaccctcttccaacatgatttagaccgatttcctacaagattttctatggacacgactagattgacgcgtgggtttctccacacatattggtggcatacggcatacccattaggggtgaaatcgctaatacatgactagccatgcgcctctcccccgcgccgccatgtggcgcgcgcggagagggggcacgcggtggaggaacatgtgcgcgattctttttttttcggtttttctcttgtttccattcggttttttcgtggctttttttttttatttttttttgtttttcccttttggttttttctggtttttatacaactttatatgcgtatgtatagaaactctatatacgtacacaaagtttgtatatgtgcatataaaaaatttatatatgtgtctttttttatacgtatgtatacaaactttgtgtataaggtatacaagtttgtacacgcatatgaagtttatatacatgtatatatattttttatactcttttttttgttttttaatacatactccctccatacccacaaaacaagtcgtttaggacaaaattgtgcttactaaggagtgattaatttgaggctattcttccatgtctgcccctattaaatgagggtgcgggtgcattcatttgagaagcaaacagagctcaaatggctactgcagtgaggtttgaaggttgagtgcttgggttcgatacttggtgagctcattacttttttgctgattttgcatggcgcttgcgtgtgtatttttgggcacgtatttttcgttttttcgtctgggcactccgtttttgcgtatttttgggcgcgtatttttcgttttttcgtctgggcactccgttttttttttctgattttgcatggcgctctagcgggtgttttttgggcgcatatttttcgttcttttcacgggtagatgtcgtttcagtttcaccatgcctatttaaacggcttcttctctttccattattgtgcttaacctgctcactttcagtccgcgagagtttccatctactgcatgcaaggctgttccagctgttgctggctttgatttgaatgtccgcctagaagaagatgaggacggcaatgttcccttccatctcaacgagccaatattggaggatcacaacgttaatggtaatgtgtttgttctttccttttttttatattcacaacaacaacatcaactaagtttctattctaagttttttctttcctttttccgacaggatttgatttgaacatgccactagatgaatttggtgtagttgatttagatttttttacaaaaccacgctggtaatcttgatctcagtttgttctttcctttttcatttttttattaaagcagtggctattttttttgaatgtgcttgttttttttctttgactagaacatgctgtacagaaccaagctcctgttgaaggacaacatcgaaggaaggacatgacagaagaagtcacaaaacaagtgtactaagcattgttgaaggacaacaagaatgggaaactaggcaagaaagatacaagaagggttgctgatcaatttggagtgcacattcgatcagttcagcgcttatggaagcgaggtaaaatccaacttgctcataacattccggttgtggttgctagtcacaagaagggtagatctggtcgtaaggcaatccctcttgatttggaacaattgcgcaacattcctctcaagcaaagaatgaccatagaagatgtgtctagtaaactaggtatttccaaatctaggatacaaaggtatttgaaaaaaggtttgcttagacggcactctagtagcatcaaaccatacctcacagatgctaacaagaagactaggttgaagtggtgtgttgacatgattgatcaaagtttggttggtgatccaagatttaaggatttttttgactatgtgttcattgatgaaaaatggttctacctctctcaaaaatctgagaagtattacttgctacccgaggaagatgaaccacatcgcgcttgtaagaacaagaattacatccctaggctcatgttcttgtgtgtttgtgctcggccaaggtttaggaatggagaatgtgtttttatggtaaaattggttgttttccacttgtcacttatgaacatgctgtgagaagtagtcagaatcgtctttgtggagaactagtaatcaagccaataacttcaataacaagagatgtgattagagatttcatggtaaacaaagtgttgcctgccattcgagccaaatggccaagagaagatgtgaacaaaccaatttttatacaacaagataatgcaccttcccatttgatattggatgatcctgttttttgtgaggctgctagggaagaagggtttgacattcgcctagtttgtcaaccacccaattctccagattttaacattctagacttggggttttttcgagctattcaagcaattcaataaaaaaggaggcaaagacaataaaagatctagttccagccgtggaacatgtaaatggatccattgttcacttgtttcattgttttgttcaacaattaaagtactcggtgaaagatttattccacacatgttttgtaggcattcttagagtactctccatggaaagcaaacagaatgtttgtaacactacaaactgttttgaaggaagccatgaaagtaaaaggtggcaacaagatcaaaattcctcacatgcaaaaggaaaaactagagagagaagatcggctgccattgcaaatctcatgtgaagcatccttgcttgctgaatgcattgctagtctcgctgcagcaaattagaagtagaatattagatgatgcaagcatgttagtctttgcaacatgctagccgaagcaagaatattagcagcaaattagtttttgcttgcatgttaagtcgactgaatgagacatgtaacttactattcttgcttcatctttgcatcttccaactccttcatactgtagatctcgtccaactttttgataacgtgctcaggaagaagtatggtttcaccatccatttgaagtttctccacatcaggaatgtataactcacaatcaaacttttccatgttaagcaaaaaccttgctatgaggtcgtagtcttcatgtaaaaggccacaacgggcacacttgcgagcacggcggcgagcttggaagcatgcttctccgaagacgccgccagcgtggaatgtgccgcagcgaggacactgcaccacctcgacggactctggtaccacctcgacagagtccggcacctcgacggagtccaacgccatctccgattctagcccctcgacggagtccagcgcgttgacgatgtccagggtgtcgacggagtctggcacctcgacggacttcagcgactcgacgtactccatggcgcgaccaagctctgaaccctaactatagccgggcggcgaggaagagagacgcgcatgtgcgagcggcaagcgacgagcgtgtgctgcatgcgggagatgaagaggaaagatcgagcgccattaatcacgtccattcagcttaaggcggcattaatcacgtcgcctcgtttcttgcctcgccgctcgttgctcggctctcgcgtcaggggcatacgtgtccaaactaaaccccgctgaggaacgacgacttgttttgtgaaaacgggtaagagcccagaacgactttgttttgtgggtatggagggagtatgtatataaactttgtatatgtaaacaaagtttatacatacgaatataaagtttgtatacacgtatatattttttatatacgttaaaagtgcatggatatatataaaatttttatatatatgttgtatatacacgtatgtatatttatatacatataaactttgtattcacatatacaaagttacatgtatgtacatacgtctattgtaaatagaaacagtacactagaaggaattagcatatgtatgattgatctctttttattaataattaaaattaaaaatagttaacttgacactacgctaaaaatgctatattttgggacggaggagccagaacggacgttttcatttttgcgtcgaagacggccccgattgcacattgcaggccggaaaccggccgagcccacccattagaaaggacggacccaccgtgcagagctctcctccgctccccggcccggtcacgccgccaccgccgtcgccaccgctccccgccggccgttgtccgtctctctcgccgcaacctcgaccacgacctggggctggggcaggctccgcctcgccgccgcccggcgactgccagtcaggctcgcctcgagccctttccgagcccaacccgtagctataggccctaaagtggagttaggtccaacgccacattgcctcgccgacgcaagtagcccaccgcaccactgtctcgtcgactccgctgctctacaacgaccactccccgaacccggattgagagcgagcgagagcgcgcgcgcggggagaagccgagggtgaagtcgtcgtcgtcggcggcggcggcggcggaggaggaggaggaggagacgacgatgcagtggtacctggtggccgcgctcctcaccgtcctcaccagctcgcaggcaagccccggccccccctccctaaaccctccacctcatcttccccttcctcttcccgcgacgcgctgtccagatctacgcgctttgggtttttcgtcgacgcgtggagcagaggcctctgtaggaggcggcggcggtggcggcggttgctgctgcttcgatctgcggcgatgtgcgtaatttgatccattggagttgtggtttggagaaatgcagttcagataaggtgtggcctgggggtccgtgcctgcttcagggagcagctacctgagcaggcgtgttctgaaggtgtccattttattcccttgttggggatgggtttttggtggaattgtgaagttctctaggtgtttgcaagttgatgtaaatggtcacggggacgcaccatgtagaacaaacttataattccattgcgggaatgtgtcattccgttcggttagtatggcatgaagatggcccttcatttttcatactagacaactatccagaccattatggtcattttgcacatttcctggtgttccaaacagaattctacttacagttaattccagaaatggaaaaataataggagtaaaatatccttatgagaagaaagagaagaagaaatcaagatattaaatgcaaaagaaatcaagaacatgaccaatcttcagcgcgcaaccaagggctatgacctgacgaagaatctcgggctagaaatagtgcggcattagggaggttaagatggtgagtgacttctctggagcttgcccagcagttatgagatagtagtgtactccagaagggtacaccagaatagcatggtactgaaatgtttgattccaagcgccaaaccagaatgacccacagaacaaaactgacaacttgatgtagaaaacccaatcattggaggttaacgagcagacttcatggtcatagttaaattaacttaagttattctagaaattgtccattacttgtttttttccttcaattgcatggtttattttctaagctctagagtttttaattctcttgcatatgtgcagggtatcttgactaccctctcgcagagcaatggcaaatataagtacgactacgcaaccattccatttctcgcagaactcttcaaggtacatgaagtttatgctattgtttacagtgatatctgtatatcctagttactgaaggcactcaagagataacattcatctatttatttattctgcatgctgatgttaacctgttcttgatacagctgtctttctcaagcttctttctttggaaggaatgccagtcttcatctccaccaaggatgacaaaagagtggaggagtatacgactataccttgttccttcagtcatatatctcatccacaacaatgtgcagtttgccaccttgacctatgttgatccatctacctatcagataatgggaaaccttaaaattgtcacaactggaattctgtttaggtgactcttttgtaccttaatgtcaaatatttccactgttattcttcctgatattattggcatgatagaatatatattaaatatccttgtgtactctgcttcatttgataaaattcaaacttcaagtgcattctgaacttgaaagcagtcaaagacttatccaaaataacatacacgatagaaatttttagcttgtcttcaaattttaagcagcttacccataatgccaattgtcattagcatatattatctgtatgtttgatgattcttgataatttaaattttatattttcaactattctggtggttcactatatgacactcttttgttgtttaaggtttgccctgacccttgaaattcagttgacttaatgtccgttttttcaggtcataaaataatttaatttgctacactgcaatcaattcactgaaatagctatacattttttcattttaatgtttcttgctccacaaagtaagaatatcaactagtaagaattgtgcaccacacaagtgttgcagagccattgaatttgtgacagctgacaattgagaaatcaatatcttatgtttgtgtttcaaaacttatgcattgcaactagatattgacacttcatttagttgaccagccaacatgctgaccaaattaatttctggtgcttgattgattaagtctcattttctctctaaactgtataggcttgtcctaaaaaggaagttgtcaaatctacaatggatggcagtagttttactggctgttggaactactacaagtcaggtttgtgaacattttgaaactttattcccttttgttttagcatatactattgggttatgcttatgttatctcacaaaactcctcatacaaacatgttacaaaaaatggactggtggcctgactggaaaaaaaaacctagtctggtcggtttaaataaaataatgattgagagaaaatccaggcagattgacttttgctactgttgaggcttctggggttcaaacctgggatcttgagtcccccgaatgcatggattgggcctctaaccaactgagctgagctacacatttgatttatgggagatcttgtagatatttaaaaaatgtttttattatgtgtagccttaaaatctattgaaaatatcatttccaaactggccagttcaccggttaactggtcagatcagcaaacaatgaaccagcaaatgaccagttcaaccatacatgttttttcatactacgataccacggatgactgcttcatcctttatggggcactcgtcttagtggcatgtgtgtgtggatccaccttgtaagtgtgataatcattgatccgttctgatagtagaaaacatatttaagtctgcctaacttatatgtttttaacttgatggccgcaaactttgtgaacatgtaactgagtaatatgtgactgtatttttttcttctattctttggtgcggtatatttacacctgatatacatgctccaagattggatttttcataatgtttcacacttactcaggtttccaatagatatacatataaaaatcagatttctgatgttcattagatgatcgcaagctatttaatgtgtaggaaagatccactgatattggacacttctccttttttcatgtcaaaatacactgcaataccattaatttttctttgaatattttactgtaactatgttaagtcactaaatttgtttttcttactacccttctgttgcttacaggttaaaggatgtggcgatgctccatgtgattctcttttttcagccccatttcagggttacatgcttgggatactttctgcttgcctttctgcactagctggtgtctacactgaatatttgatgaagaagaataatgatagtctgtactggcaaaatgtacaattatatacgtaggtatctatatctaactctggtccattgtcacagacctgcacaggccaaataccttccattttcagtgtgcatattttctgactatacatttgattgcatcaaaacaattttaaggctacctggtgtgctgtcacaccaggtgtggcaaacactatttcacacttatcttatgcactgtcaggtttggtgttatattcaacatgggatggcttatctatggtgacttcaaagctggatttgagaggggtccatggtggcagcgtctttttaatggctattctatcacaacgtggatggttgtgttcaatttagggtctactggccttctggtctcatggctgatgaagtattctgacaatatagtcaaggtgacagtttattcttaatcttagctgtgcagaaaaaaatcatctcactagcgtgtttcctttatactgtgaaagacgtaaatgaagataaagttcacaatataaaaataagttatccacagatccaaaatccatggacgatagcatggggtcagtcatccacctacatatacacatgcaaaagaatcaagatatgcctgattctagtgcctgcagtgcagattgatactgtgtatttgatttcatgccaattacgtatttgctatttgtcaaagaaaactagttgaccagactcttcaatctttagagagcatgctttatttgtactgtacatttgtctttaagaaaacatggaaaaacaagtatatttggtgtcctaaagcaggataatgtggttattcatgtgtgctgaacataagattttcaccatactgaactagttaattttttttgtgagtttgtttcttctcttttctttccttggttgagctagctgctattcattcccaatgcctttctactggccactccttgataactccattttcctgtccaatcaagtgacccatggagcggcagttcaaactttcgcctatagacattattattttttgtcagattcattgaaattaatagaccttttttcagtggtacttttttttttaacaaaacgatgagcgccgttttcattgaatatagaaggggtaaactgtacacaaaggaactgtaaaagtaaggggccttaggccctagctaactatactgtaagccagtctccgagtctttttgctcctgccaagacccaacccaagttttagcctcctccttgatttttgccatcaaactggccgtcgagagctctttttgttggaaggttctccggttcctctcgttccaaatctcccaggtcactagcagcgttaaggtgcatagtgcctttttgggtactccttttgtgtttgcgatggcctcccaccactctagcactgtcaaaatatgttgccgctgggtggggtttagctgggcgcaagcggtgcagtctgctagtgccgcccagatcctttttcagtggtacttgtattggggtttagcaaaatgttaatgccatcacaaatctgtagacagtaagaaggatatgccttttttatcttatacaattgaagttgaaggattgtcttatgaacctctatttgaacaggtgtactcaacttcaatggccatgcttttaacaatggtattgtctgtatatcttttcaatgtgagagcaacacttcaggtacctctttttttttttttttttggttattggagccctttcatccgtttcagtttattcaattttttttacatgttggatatgaaaccatgtagattactgttcatacttacacatgctctatcccctcccttttacagcttttcctaggcattgtcatctgcataatttccctgcagatgtattttatgcctgtgaacatgcttgttgaattgccacaagcattgccagttacttcaaagtaggtacatgccagtgatgccactgttgtttaacctgttgatcagtgtgtacggtcttctgatttaagcagaaaggttagttgattatttatagctcagcttttgtgagtaatcccatggaaatcggaggctgcaatctccacagcatatgtgtacagtgtcatgtttcagataacgtgaaagaagagtggagcaaacatgggtttactgctacactttgccaattttttggcaaaaaggtgaaagcatgccttggaaaaggaaatccagaatccctatacattctttagttagtgcttaatggtttattcaccttgtatctaaattttctgacattcagtggatgcaaaactggtgagtgatcatgaaatagtaaatctttgcagaaaatttaagattccctcgtcagttgcaatattgcagcacagcagcatccatacttttttttttgtttcaggtaggatgcagaacttatttttatcacttgtcgagcagagctcctacattattttcaagacaaaaatgatttgataatacatatttgacatcataatcaaataatctattttttttctacgatgtaaatagcgtagttgacaatatgtcagatgacatattccaccgggactagtttctagcatcttttattctattaccctgtatttggatcatcaacaattacacgtaagggttttccattcctgctggcggtaactatctaagcttattgtgaggcatggacttgtcaaaattcatttgatttacaaaggtataacattgcaaaatcaatttagttaatgaatcagattgtttattaggctctgttttcttgtcatactgctgcagttgcttaacccttgatatgcatcccatcccatgatttgcaaaactagaaattctatgatgtccagataaaatttgcccatggaaatggagggcccctcctatagtaccgtacctagaatgatgtaaaatgctttcccaaggatggagtttgtatgttgtctttggcttgcgtgcaataccaagcttgctggtcagtggtcactgaaatatctttgaaactgccatatggttattgttgttcattggaaaacgatataagttggtgtaaatgtgcttgaaaattgatgctagggtttgtgggccgccccttgttttgctaattttagttctgcccagaacccttgaatagtgtgcctggtctcaaactgaatttaagtccttgttagcctgtataacaagtatatcttgttattcctcactacagtagtactagtaactacttcctccgtttcatatttatataagactttctagcatt

SEQ ID NO: 76306 - DNA, 946 bp, Oryza sativa
cctgcagcccatataccattccaaaccacgaacttaaccaaatattaaccggtaatagcatttttaattatgatgagaggggtgaaactaatcacaaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaataccctttgcacaacacaatccactacagcgcacctttcctggatcataatcacccccttataaacaaggcatggactccccagcgacccccgtgggcttatctccgccacttctcagtctggtgctccgcaatgaaccatgctatacaaaaggtaaagccgttgcccatgctggcttgtggttggcacggttaatgtttcacaaccgaaactcgtgaaccggtccttaattgtcatgagcacgactctcaaaaccatgtgctcacaacccaccattatcaggttttagttggcaagtaattaattaaccaatcacgattgaccatcgtgaactatcattaagccatcattaaataatagtgaatcttaagttatcccaatagtgtgctaatgtttctaagcagggctaagcaattatatctaatatctagttgaaccaatatatataaagttcaaccagtcaaattattataacccaaggtatcaaggaataaagtgatcaagaacaaaagggctataacaaacaataggttaattccacccaatgacattcgaaaataaatgcaatagttgaaaagaaacaatagctttaaataggatcaacatgctcaaagggttgtttgggatatgtgtgacttgccttgctggccttggaactcttcaaattcttctctggcgaaaacggactctccg

SEQ ID NO: 76307 - DNA, 1457 bp, Oryza sativa
aatggcccaccctctggttaaaattggaaattttaacctttcaaaatgggaaagttaccttccacctattttgataggaaatttttaaggtctagaatttgggtacgttacaatattatattgaattcagagtaataaatagaataaaagaaataggagaagattaccgacaactccgaaattcttccgactacttcttctctactctcttcctattctagtatacaatatagtacaatagagcctcttataattcagctcaatcttggaagtctgtgtgagagtgaatgaagcgaggtccttttatagggcagttatgacggttgtgagaagggaaaatgtccgaactgccccgcaaccatcattgggagaacttctggagcgtccacgccaaacccaggatcaacggtgatcagggggggttcggccgaaccagagggttcgaccgaacctgggctgggccctcctggcttggccttcggtcggtggagtccatggaccttcctctatccatttctcggaattttgggttgatttactgatgtttcgatgaagttcacaacccctccttgtatggatacataattctcctcactttagtctgattttcctcccaacttcagggttttcatctgcataaaaatatacaccaacacttgtggaatattgtggaatatgtgagattaagcacctattactatgttggatgttttattatctagactttatgtagatgttggcagtatgggattggcattgaacaaccgccaacaaaacccccccacacttagccctttgctcgtcactgagtaaaggttagtgtaaaatgaatttcttcaagatatgtatcaagcatataaattattttacaaccatacctgcacctgtgaactttatcagtggctaacttaccatcttgagtaattgagaaatagaacgatcttgattccagtccttgcttccctgttacactcatgggatttttataaattttcgcaaatcagctcttctcctcctattgacttcctctcttgtccctcaaggatgtatattttctttttggatccttaccaaggcaaaatgtgccataattcatccctattagaaggctgatatgtggagcttggtagggattaactgtgacatacctgcatcatatatagtgcaaagcccaaaaatattgactcaaaaagataatcaatcatactcctagaacaagggtctttatttatggcggaaaatgaaaaagtaaaatattttgtggaatgatggaataaagaaatgattctccctttttcctatactttcgctctaattggttctcttggcatgattatggaagggcatggctatattttctttgctcaatattttgagagcaagctttatttcatcttctttcttttctttctttttttttctagccatgcctttccttccttttctcattttctttt

SEQ ID NO: 76308 - DNA, 4320 bp, Oryza sativa
ttaccatccacagaccagtggtcaagcagaaacatcgaacaaacaaatcaagattattctgcaaaagcggtcaacaaaatgggaacagaatggaaggatagattgcagaacgcactgtgggcataccggacagcatacaagacacccattggaatgtccccatatcagatagtctatgggaagtcatgtcgactacccgtagaacttgagcatagagcatattgggccatcaggaattcgaacatggattttgagggagcaggagaatggagaaaaatgcagattgcagaacttgaggaatggagagaaatggcttaccacaacgcaaagatatataaagaaaggacgaagcgctggcatgacatgtcataggctctccagaccttccattatatttgagagatgaagtgaataattcaagtcatcaaacaagcataatgaaacatccgacgcctcgagagaggaatattggagacattgctgggcccttagcctgccagtcaacttcagcctgagatgtgcccgtcaaaccactcgaaggcggcgatcagatgtgttacacattcaggagacttgacaaaaatggctaaagatctgcaacctcccaaatattcctaactcatactcatgtgaatctagttcccaggatgtgcactagattcacactttcatcttaagcatgattatacatagcaaacacaaataagatgaaagcgattataaactacatctactttagttacattggccaaccggccaaataaatatatagaacaacggaagcttgtctacccaatccacaagcacaccgactaggggtttaccccattaagttcaagtcctagaagaagcagtcgattacccgcatcactcaaagactaagactaaaacctgcaaacaaaagattaattcaatagcaagagtcagtacattattagaaataatgtactggcaagcaccaagacaagcctaacaccctactggtaatatggatagtctctgtccctgtattcacattccaccttcaacaaagtgttgatttcccgtaaagctaactgtagtcctttaagtaagtagatatcttaggcttttgcaaggcatataaccaaggaaggcataatatggttctttttagcataaagcaagttttatttgcataaaacatttctaaatcaggtttactttcaaataaatttcagcaaactagtacttgacatattgggcatcaaggtaggcattaatcatgtataaatatgcacctcattgccttccatggcagcaaggagatcattctcaaatctcatcacaatttgaaggtaaatttcagcatttagaagaataaacacaactctacactcaatagatatccacacgccgctcatgaccgcgagcacggctaatcgattagtttaaactctgcagagtttgtacactttacccacatgatgtgaaataataatcatgcaagagcatggcacgcgatacataagttcccgatttattacccgcaacaaagcttttccaaaattcatgatttagccttacaccagcacgatacgtgttactccatcctaagccatacacgttatatgacctagaaccgttaagtggcgggcccacgccttaaacttaacgccgtggtggcggacacaacgggaacccacccacgtggcacaataccgttgtattggacagacttagtcacctaaactaccacgtcggggtaaataggaagttcctctgagttatccgaactcatacacaccggcctacagaatgtaaggctaaaccataaataatttactaagcttgggctatcccatactagcacatgtggttgtactgtatacgaaatgaactgacattgagtgaagtccttaggtcggtttgggcacactctccccctatcggtacacaactaatcaccacatgtgcaccacttgaggcctaaacctaaaatccatgttttccacccttttatttattcaaatctccagtattaaaggtctgcccagaataaatataaatcaattttcaagtttgtaatgagcccataatgtcaaggaaggcccttcttagcaagggttagctttatagtaacctagtgtcccccaaactcatataaaaagtgggatagtcataatggtcctaaggttagaataataggataaggatataaggtggggtaaggttataaagccaaatataagaatttgtttaaccagttaacccccattttaatttgttagtaaaccattgacaagcaagaattggcaaccatttccaataccttccaaaacataggttcaaagtgatcaaagaaaggaaggtgggacttgccttgaatcaggaaaatgtcagcacctaaatcactttttcaccgtttaagccatcatctataccaagtacacgttatgccatttaaccccaaaatatgcgtaaaattttaaatgctctaaaatggatgatttgtgcacagtgaatagggactggtttaaaaagaaattaggtggaagaaattccaattcatccttttttaattgggagttatgaattttacaaggttcatcgggataggataagaattatttaaggactaatgtggaaagctggtgtaaggttaattttaattaggttaaggttggttaatggacaaaagtggttttttaaaactaccccattgggttcaccaattttggaagttaatatgaattctttatgcattttacaagttataacgtgttacgggtgtatagtgttatataggttcatggctttagaggtttaggtccagaacttgcctcatctagctagtgatgtataaaatgagtattttagttaactaatctaatcttagttcataattttagagtttatattattttactacacattttataattagggatgttctatgttagttacttaacacaccaacctagaaattgttatatgagttaagtttgataagttttggtggaaggggatggaactatgcattcactggtctaacaagttttatttgggtttcattatagctagagtgtatttctatatacatttatatatatacatattgctcaatcaatactatgtgattagtacctatcctataaatttaaagtttagagctataacctgtacagaaggttccatattttattttaatatgttgaagcccactgtttgctggttctatagatatttggttcacttcatttagactaaagatgaattttctacaaattttacaatttaaggttgctctatgttggttattacttacataagtatttagaggcttttatcatacagtaagtatataattttattttataatttggaagtatatgttttggtgattctacaaaacttgggtttactcaaaaaggatctaagatgaattttatatgaacttctaaagttcagcttatataaactagttttttttaaagataatagttttagaggcatttgatgcagaatgtgtagatgttttattttactttgtttttagagaaaatgttggtggatctgtagaaactaagtttgctctgaaatgagttgaaatgaattttgtatgcattttataattttgagcatgctttatgtgtgatttaatttggataaatttgagaggctaaatttgtactgtgagtgcaagttttgttccataacatcaaagttcccaatttggtgagttcacagaaatttgaatcatcttaaaatgagctatatttaattttatatggattttacaagttttagttactgttcttttataatttcagattttgttcctaggtgtgcattgtcagtcccaggccaatatgcaaaaagacccctagagtttcagtaaataaacccgcagtcctaggcccatatgtcattgagtgaaaacattacataatgaaccttatagttgtttaaattctccaagcgaggtccctgtctccttttccattcgataagcagcagagcagccatgggcggcatctctgctcgccggtgtcggcgacaaacggtgactccgttggggttgcgaccaaaatagaaaatgaagggcatgatattgcgattccattcctatacatttctcagacagcagacatcggagtagcgccagcggcgagtccgagcagaggaagttttcgggtggtggtgcatgtcgtgctatagactggatgtactcaaagggatgcatgcatgtggtcttccaggctctagggtactcaccgcgggttaggttgatgttttccggggtcttggtgacagcaacggctcgcgcatcctcccggcgacggcgtccttctgcgggtg

SEQ ID NO: 76309 - DNA, 1190 bp, Oryza sativa
tttggcaggaattttggaggtcgggtggttttcttttataatagggggtttcttctataatcccatataaactgaattagggctattaccttacgaggggcctaaaccagtataatccttatctttttgtgtgcttgatatcgtatcgtgtagatccttataccaacgtaccccaataccatcaaaatacggtccgcgggtatccccgtcaacaatatgtatacgaatgttttcagttttacatattgaaatactattttatttgtcagtgcaagatattaggtattatgtactaagaacgacaaatcagttaggccctatgcatagcatttcagatttcgattagaaatagcgggaaatattatatcacatgggggcacaatcttcccaaatggccagtgggttataggccacgtgagaaacacattattgcaggctggcacatgtgataattgatcttccttgggatcacgttaagagactggcctgcaataatgccgtgagtcttcgcatgcggttgggccacctgcatgcaaaaatgttgattttcgcagacacatgtatgcaggtgagccatcaaaccgcatgtcaagatcgttttttgtcgcatagaaaaactaattttgtcatcaagaatttgcatgcatgtgccaaaaagtctttcagcttacaacattatatggtcatagattagtttcagttttgttgggcagcgagaggccgatccataacttctgcctttgtgaacgacagcaatgccaccaatcgagaaatgaacggctgaatggcttggacccaccgtagtgactaatcatgtcagccataaattaataacaccaggtgtttactctatagaaaagatcaacgaaaataatcaccggtggcaaagaaagataaaccaaaactgagcacatccttccccttttgctcccaagtcccaacgtcgaaaaatgtatggattgacatcctatatctattcatcctgctatcttcgaacgagaaagtataacatgaaaatcactcgttgatgcagcctaagaatgatgcaacaaacttctttttgttcgatctcttaacataccgtgccttactgcctagagcccactacggtgctctctattgttagtaaaaagtaatctaaaccgtggatctaaggttcaaatctatttatattaccactcatttagtgg

SEQ ID NO: 76310 - DNA, 3775 bp, Oryza sativa
ataggtcatagactgccctcacagaccacacatgtcttttctgcacattttgtcctcactcgtgtgcacccgggaaattcttccggtcggtcacccatcccaaattgctccaggccaagcacacttaaccctggagttctttggagattggcttccggaaaagaagttgcaacttgttgatatgagtattctattaatcctattaagccctaggccgggatgttacaccctcacccccttaagagagatcgacgcccccgtcgatcaaccctaggccaggaacgtcctctcttggccacgcccatgtgtccaatgacagcgcatgtgccatgctgtgtaaccactccaggtctacaccagccatgcgcaccatgcctgcgcaactgcgatacacgcgcccgtgaaaccgcgagagtcggctctgataccattttgtcacgtcccgccttcccccaagccgggcccacttacatctgatagctttcataggtcatagactgccctcacagaccaacacatgtcttttctgcacattttgtcctcactcgtgtgcacccgggaaattcttcccggtcggtcacccatcccaaattggtccaggccaagcaaacttaaccctcgagttctttgtgcatttggagttttggacttgtattccataatagctcccatgagcataatctaaaagaattatttcactaaacaaacctatagttaatcttgagtgataacatgtggacttaatattaaactcaaatatcatcttctcagtctaaaagaagtttaatgtaatccctataataatattagatgcaattatgaagtgggaacacatatacaaacaaaggtcatcttaattctctaaaatattttgtgcaagataaaatcatggaaaaatttatgtggacaatgattagcacaaacttatcctccgtaatttggtaacgtgttaacactcaagttgatatctcaaattaatcggtcgaaacagacaactaaaagaaatcaaattaaattttaatcggctaaaaccatatttcatccaaaagtacatttaactgcacataagtgaacatggaaaataatttattcaaatactagattagttatcatgaataaatgtaatttttctagaatttttcttctctgtttaagcctcctaaaaattcaatctagctttctaatagcccatctttgtttaatttctgtgagcagtccacccattatttttgagtgcaaccaaagaaaatggaatctaggtgtaatcatttacctccagtaaaatcaacactaattaatttggtccacacattgaattatgtagtttcaaagttagaggagaaaataattccgaaaattaatctaaaaatcaagtttacccagaatcttacccaaccctctcaccctagcctagtttgccacgacctggacccacctgacagcctcttaagcttgccttgactctgtccatcacttcctccactgttccagccgagagagggagagattgagcgagccgacgcgtggccgcaacgtgtcgtcgatctcggtttcccttttctcgctctctactcctcccagacgcgtcgccattctccacacatcactttggagctgaagaagccgagggagaggttctctgcctctccgtcatcctcaacctcgccgccggtcgtagtgacgacgaccttcgccatctccgtttgagtcaaggtcacctccatctctttcgcgttcccatctctccacacaatgccgagcatttcctcttttgacctaaacccctctcgtgcagtgcatcgccgggaacgcaagccacgtcgacaacgccctggagcacgcaccggagcgccgccgcttcaaccatcatcgtcgtccggccattctcattcacctcagagaaagctgctgcgccattgtcattgcctcaacctcctcttcaaaacgcctcaagaaccccagccggaaacatcaagaacacggagaacacatccttttcttcaccggcgccaatctaggatcgcctccgccgtcatcgtcgattaccgctgcctcggtgagccatggttcgattccttgcgcatacaccatcttcttggacctcacaaccttcgggcttgctggttggaagcagctaattgtcccgttcaagccgtcgtcgttcacccgaggaggagcgccgtcgccgagccgttccacaagtcaccgttgccgccaagacctcgacaaccctagctcgacccacggtgagcatcctgaagtctaaaaaaccacatgcatgcatccttttcgttcgtaatcgacttccatgcgcacatgcactttcaccccaaaaccaccgccgttcacactcgccatcggcgctactccgatgtcctctaaccaagaaaactagaggaatggaatcgcgagagcttgctcttcattttatcttttgacctcaacctcaagcgagccaccgtttgccgccggcgagctccagatcgagctcagccatggctagctctgctatgtctagagcagagggatgacttccgtgaattagattaagtgcagggatccgtttacaattatagaaacacactgacatatgggcctaggactgcgggttgattcctagaaaactcaagggcctttgtgcatattggtccctcacagccatggggacccatcctttaaaatctgaagaaaaattaggaaaatgccccaacaattatatgtttagcagaaaaatgcacaagttgtaaaatctatattaaatcaaatatagctcattttgaagtgattccagtttctgtagattcttgaagtaaggaactttattccggaatataaaacttgacactcactgaacaaataatgtttttaagatttattttagattaggtcatgcataaaacatgtaccaacttattaaataccaaggaaattcatttcaactcattttgaaacaaactcaaaaacttcagattcatcatcagacactttctgattaggtaaaataaaagtaatgacttactttgcttcaaaagcctctaaaactattatctttaaaatgactagttttagataagctaaactttagaaattcatgtagaacccaatttagcttcaatttgaataaacttaagttatgtaggatcactaacacatgtatttccaagttatgaaataatattatatacttgctgtgtagtaaaagtctctaaatattcatataaggatttactaacatagagcagccattaatttgtaaaacttgtagaaaattcatttttagtccaaatgaaatgaacaaagtttctatagaaccagcaaatagttatcttcaacatagtaaaataaaatttggcaccttctgtaaagaacattgatcaaacccttaactaagtgaaataagaatttaaacacatagtgtggtttaagtaatacataaacatgtataagtatatatatacactttaggtctaattaaacctaaataaaaacttgattgaccagtgaagccatagttccatcctcatccactaaacttagaagaacttggctcatataacaatttctaggttaatataatatattgctagtttagattaaagcgtctctactttataaaatatgaaccatagtagtaaagaccataaacatgtgagataaaaatgttttagttaaccaaattattccttttattcaacttaaacatgaagtagcatgttctgaacctataactcaggagtcatacatatataaaacactatatgcctaaaacacgttg

SEQ ID NO: 76311 - DNA, 697 bp, Oryza sativa
aattcctgcagcccaattttgttacgctgcgagtacgtattgaacgagcgagtacgtatgtaacgctgtgacttgttatagctaatagcttattcatataatagttacctgtaagcatatagagaagagaagcaaattttgttacgctgcgagtacgtatggaacgagcgagtacgtatgcaacgctacgacttgttagagcagggccaatagtgttgataggtactaacttcaatttatacatagccaatctaatagctcattcatataataggtatatgtacgctcatcctgaataaatgatatcagattatttgactggccattgagggaccgcggggtacacatacgtaaaacaatgttacacggattatattacatgagccggatgagaggagcaactgctgatcaaggagtgtatcatatgtgatataaaactcgagaacctgaagccatcattgaagggggagcccctattgtgccgtgtggactcatagcatggagcctgttcagtgacaccttcacattttttgtcaacaagatgactgagcgagtgaacaagaagaacatagctgggagcagtgacaggaccattaagtttggcagtgatgtgtgtccccgaaaatttgcaagaaggtgggctcataggtggtggtcagctaaatgagaaattaccagttagtgcagtcaaatcaat

SEQ ID NO: 76312 - DNA, 1109 bp, Oryza sativa
caccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataatgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatactgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgtttttttggatttttagtgaatataatgaaatttcacaggggaggggctggggtttataggggggaggcaaaaatcgccctcccccagggcggcaagggggccgcct

SEQ ID NO: 76313 - DNA, 736 bp, Oryza sativa
gcgctcgatctctctctctctctctctctctctctctctctctctctctctctctctctgagctgttcctctggggtgtctctccctctctcctgttcttgcgttgaagaaagaagaggctcccgcctcccaccgtccgattggatcggatggtcgagacggcacgtgctagcgtacgcgtatctcccgtctcccttgcctcccaccgtccgattggatcggatggtcgagacggcacgtgctcgcgtacgcgtgtctcccgtctctctttcttctcaaacgtttaaggcttaacggaatccaatgctactataaattccaactatttggtagcccgcgcaattacgcacctagcccccatataaaattatttatatatatattgggcttgatcggtatagcttgctgcgtctgtagctgtgctgcatctacagtatcaatagcatatttttgaattggagctgttgcagtgtagccgcagcaaagctgaaccgatcaagcccattttaatatgtctttttgaaagaccaaatattatcataacagtatttctaattttatttttttaaaaaaatcacaccagttgctacgccttacttttatcatcccttctttatttacatacttgatctaccactgtttttattaattcttctcgaaacctttaaaaattaaaccttataatttttagagttttttttgtctcgttggtttcattttaacaaattttagaagt

SEQ ID NO: 76314 - DNA, 30553 bp, Oryza sativa
gtgggcaatgctagaaagtcttataacctgaaattgaggtagtacttaatactatatgttggccttcggaaatagtgaaacatgtgaatgattaggataattgctagtttctgtttcagaaatttggccactgttaccttgtacaaaatcaggattttgtgtgttcgacatattgttagaagccatacatgtgaatcttttgctaattctgtgccctccactcctgagcttatcattcaaacccaggtagtttatgttttttttttagtggcatttccaggattgaatttttggtttctttccctccatcaagaaatatcttgagtggcaattttcaggacagagggattctttcccctccctcaagaaagcttttcacttccagctgagctagctgtagtctactttctagggttctaaaggcttacccatctgaccgcatgaacagtggacattcctttatctggctagtatgggttaagggataacttgcttttcatgtacataaaaaatgagtctaatgctttctcaaatttagttcttttatgcatgtttggttttttcaacactataaatgttcacttcattcatatgtgagaattgagatgcaaaatatgttagctgtcacaaacttaagttacctgcatcagctggaaatttgtctcagtgcatactcttatggaacttgacaggtgtcatactacaattatgcaaatgcttttctttttttttttaccctgatctcagtaccgtagtgcagctgtatccctttgggggaaggaattgatttaaaaattggaaaatcaattgattatatcaattcttcctgtataaatgtctgtatttttttttagtcaagtgatctcttggagcgaacatgcttttgccgattatattcttgatcgttccttttggagctgttgggaggaaaaaggtaaggtgggcaatatggcttgtcatgacagcattgtgtttgatatttcaagtaggcattgctaaagaagaaaagaaatatccctagtaaccataaaggcagaaagtggtatgcaaaaaattggagaaggtaaccatcggccaccaccgatgaatgacctgaaaagaatgtctctgttaggtggaaatcaactgtggttttcccagttcactggtttcccttcctcctgtgtcctgacctttacctcttccccgtcttgagagtaaaaggcaaagcaaaactgaccatgtaatgtacatacatttcatgccctacatggcactggagaaagagacatgctgtacatggaatggatatcgcctctgccattgcagtgaggtctcttccttctatattcttatatgttgcgggcaaaagcctatgcaaggggtggatgtggtttttggtgttgtttttaatgcggaactcttttttctgaatcctatcaaactttttttctatacttttttttttgtgttccaaaggtgtcttgtttcaactggacaagcaatctgaaaaaaataaaaacagaaagaaatgtgggtttaccgtgttgcctgcctgaaacaaagatgctgtttgtgcacaagcacacgtacggcgcccccagtttgttgtcgcccatagcatcggcgtccgaagtggccactgcagtgcgtgcgtgagactgaagcagcaagtcacatccgtggaacggaaatgcttataccacaagctagttctgtgttgcatgccgaactcgtgcaccgctcatccgaaccacattccattatccccctcatacgccctaacagttttaaaaatttccccatcggttgtccccgaattgaattcaggttattgtttcagtcgtaactgattttgaatttaattagagggtccgtcttttcctttttgtcactctgttttaacttgagtaaatttcacaaaactacatgttttatagttcaagttgcagaaaaccacacacactttaacacttgggacttaagtatatatattttaaagtgtagaatgaatggattcacccgcgatatgacgtgactgtttcacctaggacgagaacatggcatcctattatcagccatcgcacgaaattaataggatgccacgtcctcatcttagatggaacaaccacgtcatctcacggataaatccatttatcgatagtgtggttttgtgaaactaaactatcaaaatatatgtacttaagtgccaagtgtcaaaatatgtgtggttttgtgtgtggttttctgcaacttgaaccataaaatatatgtagttttgtgaaatttactcattttaacttctactttactatgttagtaaaaatataaaattctagatataatcattgtgcagattagtagcgagaagttaatttttgctgagacaaagagtacttcactatgagtagcaatataaaattttaccctgaaataattttcgtagacttataatggacaccctactgttcgttccttttctcttaccgatctaaatggcgtggttttaagaaacttacttcataagaaagctttccaaattcaccttgttaactttttaatatttatttgtgcccttaaataatactccctccatcccattttaagtgaagttttgggtttctatgtctaacatttaaccgtccgttttatttgaaaaatttataaaatatttttaaaaaataagtcatgcataaattactattaatattttatcatctaataacaacagaaatactaataattttattttaaataagacgaagagacaaacgtttaaaaaaaaatccaaaactgggagtagtaataaactctgtgtgattcataatggatcatccatcagaatatatatatagtaccgaaaagaaaattcaaataaagatgaatcatcagacttccacacaaaatgattagcagcagcatgagtggcacggcatatcccagcctcttaattaaaccccactcgtaattaaatggtgcgcgccaactatgcttaattcaacatctcaccactaaaaactcgcgatctccacttctccgcgccacaatccatctctctagcactctccacaccattcgttcctctcctcctcccctataaaaaccctcacactcatcagcaaccttctctgtactgcgaccaacgacaaacaccacaagctaagtaaggagtaagtagctttgcaagattcagcacaaatgggatcgttgggccctgctgttgtggtgagcgcgagcgcggcgaagatggccggcggcgggcagcagccgtcgacggagaggaaggagacgtcgtcggcgttcggcggcgggtgctgcggcggcggcttccagatgccgctgcactacccgcggtacaagaaggcggactacgaggcgatgccggagtggcgcgtggactgcctcctccgggagtacggcctccccgtcgacggcggcgtggaggagaagcggaggttcgccatgggcgccttcctctggcccgaccagtactgaagcttgctgtgcttcgccttggagatattcagaagccgatcgagcagggtaccagtaactgcatgatgctaatttgattaggagcgctctatatatattaattaatctattatgtgtttttattatgctgagctcgtgttaatctgtcatccgcatataatggcgccatggaaatatggaatgatgatgttgtaaatatttcctactactacgttcataaagatatggaagaatacattattttgctcttaaattaattatgttggtggacgtttaattatgcatgcaattttcaaaatttatatttatatcagtgaaaaatgtgttatgcgtccgcctcctcgtcctgggctcattaatcaacagcaaaagtgcaaacaggttgtggcgatcctggttgtcttgcttggcgaatggcgatggggcagtacgagggaagagtggttcctcttctctctctctcgctctctccaattctccatctgcatctccaagccaggatggtaaccgagagctcttgcgatccgtttcagtgatcaaagtattgctggtgttggacggttgtagatctactgtaggtgtagctgcagtcggcctcgtattgcaacggtcagttcagtgctagctttctttcctcaatggtgtgtattagtattgttggcatcacaactaaaaaaacatttttccacgcggttgaggcgtttgtctgtacagaaaggtctaaaaaataacgttcgctattttcgcatgtgggtgcttatgttggccacatgcaaaaataaaaatccaaaaaaaatctcaaaaaggaagaaaaatcgaaaccctagctcctgatggtggcagtggtgcggatccggctgtcgcagcgcaggccgtggtggatcgggctaactcttcctcgtcgtcatcggtggcggtgccgagcatggagccgcccactctcgaccacttccctgtcattgtcggcggctccactgcctgagatcgctaagccacccgctgcccagtcccggctgcctcctcatcgtcagcgacagcgccgctcaaggccaccgctcccgctcgcctagctgcccgccgccgccagctcccgctcggaggagaggagaggagagtaagagagagaatagaggagaggaggttgaaaaaaaattgaagcggtgaagagggaaagagaggagggaaaaaactgtggaaaagaggggtatattttcgcatgcggaccacttaagaggcccacatgcgaacatatattttcacatgcagccccttaagaggaccgcatatgaaaataaactatttttgtatgcgggcccttaagagactcggctgtgaaaatagatttttgcatgtgagcttcttaaggagctgtacgtgaaaatgaaggtcgatttttacaggtacgactagttatggtccacctgtaacctatatgggtcctcgtaaaaaaattgttttttaagtagtgcatgctgttgcccacttggctgagtttggtgctagtttcttttttcctttcttttctcatgactatagctttcgagagttataatattgtatttttctcttgctttatccctacaaactttacactgactaaccgtttgtttaagtagttcgtactttacatttaccctagttcggaaaagccaatattccggcagagatcctagcccagtacaatattccaggccagtacagttcaaactgaaaggaaaacccgttttactcccttgaattgttctgccagaacactttacattacaaacagtaggatttgtagaggactcaaaatcttgggattttattcctttagtgtccttaggactgaagcaatgaaactatgaaaatcctattgatgatttagtttagatctatgccccatttcgaggaaattaaaataaaggctcctctggatggaatgaaattcaaacgaattttaaaggtttttaaacctcaaaaacaaatttccctatatgtgttgtttggaacaaaggatttgagcatttcaaattcataaaaaaaattacaattagctcaaacatcattttatttttctttggagaagttcaatgcatcttttatctttatctcttttccctctcacaattccatcaaaatcatgtggtttctattaaccatccaaatacaatataatgtctcaaattcacgtgctttaaaaaaacatgggatttgcgcatacgtgacattccaatccttgtgtttttttttcatatttgcttgttttttttcaaatcctgaattccaaatcatgagctcaaacctcaaagctcttatagtttcctttgaaaagtctaatgcattctctacccccctccccccctgatctctctatgacccaaataaacttcctaaaaaattcctatgtttatttcaagtgaaccatccaaagtcatattattgtatatattcctgtgttttgaaattattgcgggttctataagagcatggcagccaatcccggcatttttcttgtttgtatattttaaaatcctactttccaaacgagtccaaatgttagctcaggaatcctaattagcttttatgaacaaatagtaaaatttttaatataaaacaaaaatgttatcaaaatatactcaatgttctaaatatttaatggaactaaattgatgttgtagatgttgctaattttttctataaatttgatcaatcttaaagatgtttgactaagaaaaaagtcaaagcgacttatgatatgaaacggagggagtacaaacaaataaaatatatctacaatacttatagttttgtgggatgttttttttttgtcgatgagaaaaaaaacttagatattttcagttgagagtttcacaaaataaattctaagtctttacaactagtttcttgaatcatgtgggtcaaatgtttctatttgtatatgacaccaattttcatatggaatgttttatgtgaaaatgatgcttatacaaatttgagtaaatttaataaactccaaatattttgacaaagatgcattttagtccattgtgttacaaaactagacatttaaggttaaattcatgaaaccgctatggatttaacaatatcacaaaattacagatttatcataaagctacatattgtagagggttctgtcaaggcattgttaccctaatagaggcattaaaattatagtttttgtgataaatttggacttaaattttgtagtttcttgatgttgtggcttaaatatgtagttttataatatatttagcctcgaatgtatagttttgtggtactataggttaatttgtgtaattttgtcatagtttttttttcaaagtacatatatagttttgtgacatttactctagtatatttttttattctgcttggaattgtttaaaaatattttttcagtttacatgtgagaattctttgaaaatgttttgtttgttgcaccgtcacctcttatccattaaccattctacttctagtgacatttctatccaataagtcatatttgaagttctacgtttgaaagattatatgttagtagtatcattttgtcttatgttagtattttttaagagtctttaatcactatgtacacagtaggttggaacgacctaaggtagatttgaattgagtttttaaactgcatgcaaattgttagaagcaatttatattttgtaaaatataaactaaaacctcgagagtaaataaaacttttcctaagtgtgcatacataggcaacatctatactctacagtgatggatggtggcagtgaatctaatacctaacaccgatttttacaattttaactaaatccatatattttttgatattatggaatagtccaatactgttcaaacaaataaacaccatagattagaataagcagacaagccatactatcataggtagtattttatttaaaaaaatccttttatacatcataaacgtgagctttttctagtgtttatagatcacactagcttgaaaaagaaacacatattttggtcgaaactgatgcaaatagacaaagatcaaggataactgtttgattagattttataagtgatataaaatgaagaaatattatagaagttgatctttctaagagtgagtttgaggtagaagtgtttgtcattataggtcttacattatgctacgtcgcaactaaggagtaaggactcgaagtcccgaaaagaaattctttgcgctctcaacttgaaacacaggccgggtttagttcctaacttttttttcaaacttccaacttttccatcacatcaaaactttcctacacacataaacttccaacttttttcttcgaacatccaattttaatcaaagttccaattttagcgtggaacaaaacatacccacagtttcatttcagacaggtaactctggacagtcacctatcaaacactgtctgaattagatcctcagaacttcagaccctgtagctaccattgcatagaagaaacccactagctagttaattaatacaaattaattgttgttacctcccaattatgcagttactaaggctgagttttttttttaacttcaaagaacaactttctcgtttttctttaacatgtttcttaaatagctaaatggtgcacttttgtggaataatttttatatagaagttttttaataaaataaatctatttttaaatgtataatagtttctctctctgaaaaggacaagcttatgtctggattcaaagttaaaattggtttttgcagaacgcgatataacactcaattaatcacaccttaagtactcaccttgttttgcacgcagcaaaaaaggtcaagcaatttgcttgttcgaatgcaattaagctaagtgttgcttcttgtagccacatccttcgatcaatcatgcatgttacagatgatggagacatgatcgagctcagacagcgacgccggcgagatgcggtgcccggaggccgacggcgccttgccggcgatcgagatgttcatttgttcagaatttattgatggttcctgtccatattcttctgaaacttggcactgttttcattagcgatggatgggaatatggacacgaactcttgagtgttcttgtcaggccaagtcgttggctgctttgagtggcattattaatgcgaaggtcaattatatggatctactggacacacccatcgtttgcgtctcgaataatctcgagaattatgattgcgcatgaataataataattattattattattatcacgccgtgtaatcttgtggcgaagctttgtttcattgattcattcaggtttaattttgatattttctattcgatggaaaagaagggtaattcacttttattttacttatatgtttaatatagaattatatatactagtatttgttacagattctagagtcctaattaataaattataattaagctttataagtatatctatctattattatatactaaaagtccattaaacttcctacaaacgctctcaagccgccacgtggcgctctaataaattagagaaaatcctagaaattctaagaaaaaattaaaacatctacccctcgattttcacttaaattggtgggtccaatattatacactgttagatgaaattgatcttaacacaaaccaaatactatgggtcccatctctcctccttctcccacgcatatgtacgtacgtatacttccttccttttctttttcatttttttcttctttttttccatttatataatggatatatatatatttttaaataatcgatcataattttacaaagaaagaatttaccatcgtacaactcacatgtaactaaattagctctacaatatttgaaagtaaaatttacaccattatatgttacccattaaattaataatgtaagataatttccacttaaaccggtgtactcattactttgtactattatttaaaaataatgcactattttaaaataaagtttacacaattatactgtgcacctatcaaataaacaatttaagatctatatacgtgcactaaaccgatggacccattatttaaatcatcgtatctattttttattacattggactcttactctcaaataatacactgtttcaaaataaagtctacaccattatattgtatacccattaaattaacaatttaaaatatatattaactaatttacacttatactagaaccgatggacccatcatttaaatcatcggatctattatttgcaaataataaagcgtccaaagttctcttttggcccattgcacaatgcacgtctacacctttacctttcgcacacgtgacaagcgttgtgtctgagacatttaaggtgatcacgaccgctgcaacgctattgctttgccacatatcaaatcatatatggagatcattaattttgttaataacatgaaaagaaaattaaaggtatgatgcaacgagagaagaattatgcaccgtgggttgtgttttttccagcacttagttatgtttaagctgaaaccgagagttggttacagaataattataatgtattatgttatgtcgtatttggattttgtactatttgttcgtataggtgaaagaaatcattatgttataaatatgagcataatattaacgaataacaatagaactcttactaagacaaggttgttataagggagtttatgacccactttttttccctgattccatagttttgatttttgtttgcacactttccaagtttctaaatagtgtatttttaaacgataatttaactttctagaacctaattcatttgtttatatcctcaaatagctatcacataaatcagataattcatcaatttaacctgtccaacacttttttttcatgcgaatcatggtaatcagtaaattggggatcaaccgataatcaaagtcgtaaaataaatatgtaagagctactatgcacaactataaataggtgtcaaaattaattgttattaattagacacataattaatttcttatataaacatggatgaagctggaacaaatattaccatatgccccatacatatatattacatggttaatattctaattatatgtgttaagtccttaaaaattccttaaaatgctctcaagctgccacatggtgctctaataaattagagaaaatattagaaattctaaggaaaaaaagtaaagtatctattacttgattttcacttaaatcggtacgtccaatattataaactgttagattaaattgatcttagaacaaactaaatactacgaggtcctacctctcctcccgcggcataggtacgcacctacatacgtgggtatgtacgctttccctcccttttttttttcatttttccctttcttctttttttccatgcatacgcttccctctctttcttaatatatcttgcgccttcatgagatgatttaatcccaggaattttgagtatcttgctctcgcatttttcatttgtggccatactacatgatatgtatatagatggactgcattgataattaactagtaatagtttcttatttagtcaaaaaaaacatgattcaaaagtcgtaagtacttaatctatctcctactcaaaattttgtgaatggttttctaagatatcttaagagaaatagaacccttaaattattatgaaataacattatatgagatgaaatttttgagcaaacaataattgtaactttcaataatataagtgcccgcgcatgtgcgcgggccaccttcctagtttttatataaaatttagagcattcacgatgtagaaatgaccttatcaattactgtaagagcatgagaagggacagcaccagccaccagcactcatgctgcaatggttttgtgcgcgagaatcaatctagcagaagtgctcaagcatagtaccaactagcgagaggccaaatgaagtctaagttttcattgatgccatctctaccactccgccactgtccgttctgggggcgccgccggcgttgatcccggtgacaagaagccatcatcgataggctctgccgctagattttaagctatggtgaatccccaaacttacactgtaggggagcggcgtgctaagacctgcggccactaaagcgcagaaggtcacaatgaagaaatttaggattattgacgaggatgaggaggtaaatgaggaggtggttcaagattacatccaggtcttcgacaagccgctgccgccatagcatgtgcaggcactggtggaacttctgcagctcaacatctccgcctctacacagcaactgccaaaggacgacgcggtgacattgccaaacgccaccctgcaggctgtggcatcgttaacatgaggcgtcttgccctgtgtggtactgaatagtgtgtgagtgtgtatatgtccttttaatgtagagttttaatctgctagtgtggaatgttagaggtctaaatgatgttgccaagagtgctagtcaaagggtcagtgttgttctccaattcttatggagtttgtttccaagagtcgaaattggatgttgtaactccctcattgatctatgaactttgtggtcctaggtccaattgttttgttgtgtttcttgcaatccacacaaggagaggagtcattatcatttgtgttgtcgaaagacaactgcgtcacgtcaaaggacgtggttcactcaatgagttgttggaatagtaaagcaatatattaatcggtaaaaaattttgggatcccccaattacacggccctagggagctatttatagttttagtacaggctcataccctctagggtttagttaataaggggaatttacatggttacccctatgatagggacattagagttggtatacaatgtgttttgtattcatgggccctaaggcgatcttcttgggccggcctattagtggcaaagggcctctatgggccgcaggacctccttggcccttagccgaaggcatcttctactttggacgacgacctcatgcttcgccctacggccttcgcccttagtggttcttcggccgaatggtgagcttggtggcgaacccttcggtctttgtcgcctggctttgcctaggcttgatggtgaaccctttggtctcgtcgtttgacttcgcccaagagcttcgccttaggcgcaccccttggacttagccgaagcttgatggattaggttgtttcggcaggttggtcgaaggtcctcgtgacatgcctccaacaatttggaagggggatttattccagagggggtgtggtgcacatcgggcagtggttagtctcagtttacctgaaatggattcaggggggacaaatcttggttttgtcttcgatgtactggcctcaaagggatgatgagatgttgatgttcttggaagagatgacaactattagagaggtttatccaggggaatggataattgtatgggacttcaatcttatcacctcagctacatacaagaacaattctagaatcaaacaccagatgatgaacatttttagaagcaagatagatgaactagaactcaagaagatgtacttgtttgaaagaaggtacacatgaagcaatgaacaataaagaccaaccttggtgaaacttaacaggctttttgtcacaacacaatggtaggaggtttttcctgaagcgcatatgcaggccatgagttcatctggctttgtccactgccctttgttgctatcgtgtggggacagaccgattaggcacagaagattcaaatttgagaccttttggacaaagttagatgacttcatggtccatggaggtggttcaggaggcatggtagagggatgttgatagtgaagacccctatcgtattctatatgtcaaaaaatggaagattgtaaggtgctaaccaaatggggacagcgacgcatcagcaactttaggttgcaactgtagattgcgaatgagataattctcaggttggatgtggcgcaagaaaagttctgacatgtttgtagcggcgacttagggcaccgttgaaggaaagatatcttacactggcctctcttgaaagtataagaataaggcaatgagccagaataagagatctgaaagagggagattcaagcattgccttcttcttcatgaacatgagaactcgacgtagaacgctgttgatcccaaggctggaacatgaggacactttggctacgataatgaaggataggcaatagatgactaccagctatttcaagacggttatgggcttggccaggaatgcatctaaactgatatttttccatgaggtgcagatggccacactcaatctgtcggagttaaatgccccttttactgaagaagaggtgtgggcatcaatcaaaaacataccaaatgagaagtcactaggcccggatgggtatacatgcctattttatcaaaaatattggagtatcatcaagccaaaattaatggcagtgttgttaaagtttggttatggtaacaaccaaaacctggacctactgaacacggtgatcatcaccctgcttcctaagaaagaattatgaaccctgctgaaagattacagacctatcagtttaattcacagcttggccaagctggcaacaaagatcatgactcttacactgaccataaaaggtcaagagctccagccaaaattaggttcttcatgtggctggccattgtttaacggctgacaacttactcaaaagaggacggccacatgagacaacatgcacgctgtgtaacaccggctttgaggaccacaaccacctattcatcaaatgtgtctacaccaacagagtttggactttgctgcaggactggatcaatatgaatttccaactccctatcagtgatgattggacgttggcagattggtggcaactggcgcggaatcatttccgaacgagctataggaagtcttttgactcgttgtttttgatggtgtgttggttcatttggaaagagcaaaacgggacagtgtttgaatacagatttgaagtggcagagcagctcgtcaatgatatcaaggaagaaatctccatttggaagacagcgggcattttttcaatctggtgaggagtactcttctctctctctctctctctctctaggtttacatgttttcttgagggtgctcaatcactcttaacttggcagtttaatgttgagattatactcatgaaattatcttatctaaatcttaatgaaattcggtcggccaatttttcagctgacccggcaaaatatttcatgctcttccttttactattaagaataagaattaatctctgcatcaaataggggcagtttcacaagcataaattttcttaaccagaaaaatcatccttaaccttcaaaatggtggaagaaggcatatgtgcaaggtaacccatagaactgatgatatgttcttttagaactaatactaccaaaataaatcaaaaatcaaaacatcaaactgaacaacaatcttttaattggccaaacttggatgacctctgaaactaaaagagattcagaaaggcagaaactaacgacctcatcttttcgcttattcttatgcttatcaaccaaaatttgaattttcaaccttaaatttgaagccaattttgaggttttttcatcgaagtttatttttcagcctttgcttttactcccttcgtcccataatatagcaacctagtactggatgtaacattttatagtgtctagattcgttgtactatgaaatgtcccatccagttctaagttgctatattatgggacggatggagtagatcactaaggacacgtatataaaaattttattcacaaattacttttcgtttgcaaatatgccgtttggcttattccgtagataagccaaacgatgggctgtaacttatgaaggccaacacaagtactatgtactcttgactcttgacagtcaaggaacacaaagctgtagcctctatcaaacttgctccaatgcattatggtaatttttgttttatttatttactcaattcattggcccatttctttcatctcttgaagtttgtgtagagattaccccttacgcaaggggtggcttctcctttgtcctcccttctctccaccacctcaccatgggagcttatatggcacataggagcgagtgtttcgatgcttatagtacttgttgtaaaccaaatttctttcagggatcccgctaagcctaattcccttcaagtaatcacatttaagatagacattagaaatgaaatttaagagcttttatggtaatctttttagttttcttcaatgtctccacttctcaaaggataggatagatacttgggcatcgcaacactagaagtttttaaataaataatcaaatttatagctggacgtgtagtaagaaatgtgacaaagagttcatctcatttgtactacctccgtttcacaatgtaagactttctagtattacccacattcatatatatgttaatgaatctaggcatatatatgtgtctagattcattaatatctatacgaacatgagcaatgctagaaagtcttacaatatgaaacagagggagtacttcataatatacttagttacttactgaaaacaacccaccacttctatgcaagaaggtatgttcgtctcttacattaagacgcaagtccctaataggtgaggctctcccttataaagtcataagcccacacatcataagagctttattgggatctgttctttaaatagtcatgattagctcctttataaggtagaacacaaaccgtaacaactaacgagatgttgtaagtttgatcagaatataaactccacgcagtttgagttctttagtttatattacaccgtccatctaaccctcctaattcactaaaaactagtaccacctgtcattactgtgctcttctcaggagacgaccaaattgacaaggtactacatcagaactgcgaagttatggattcttagttattactccatccgtttcaagttataagactttctagcattgtctacattcattcagatgttaatgaatttagacgcgcacacacacattcattaatatatatatatatatatatatatatatatgaatattagcaatactagaaagtcttataatatgaaacggagaaagtactatattttagttaatctctctttttaactaccaccatccaaaaagaatgcgattctcatcttcctcagcgattaagcacgcacatcagcgataaattaatcgcaagttcggcatacacaagaaacactaaacagtaacatacataacttgtatgtgaaatcagttaatcacaagaagtacatgacaaaagaaaacttctgcaattaaaaaaaatggcatgctatatgtattgatccaccattatctaagtttcacattttgcagggaagagtttaacttctaaagaaacataagctcattaatcagatcattgttgcaatctagagtggatggcaacaccataaacttaattgactagagacctcaaaaacagcttaagtagcaaggaaactcaatatcagagctcaaacggttaaatgcatagacaggagccaatgtaccaaccataatgctaatattgcaatcacaaacactcaacatgagtttcgaagatatgttacatcttcaacaaacattagaattttacaattgcgcactaatataaattacactactttccccttttatttatgacacaagatggctacaaacgaagcactagaagccccctattaacacagcaccactaaatcatcaggatccacagttcctaaatacacagcacggtaggaacatataagttacttgccagttgaaatgaaacagggcccagcgaagggaatggttggtgtttttaatgcatgaactgtattacagccagttgcgatcagaggtgctagccccggtgctaaagttcaattgcttctgataatccatactgttagcaagcatagccgcaatgttgccaccatgcaccctgccttctggaacaggtgattgaacatgatgaagagcctgcttggtgttagcggcaaatgtctcaccaaagttgaaagagtttccaggaagggtcccatgactaacatcagaatcagcaccagtagaaccaggcagggcaatagttccaactgtctgaccaccacggactcgactatcttccaccagcgcattgtgtgcaacgcacaggcctttcttaccccttgcaaagcgctcacaagtaccgctgccgtctccaaggccagaccctgattggccccataagcagcgtttacctcccccatgtgccttgcaaaagtctgtactcccctgtgcactcttgctgcagccggtaaactggcaccgcttaccaccgccatgacggacacagcagtcagtccgtccccttgcactcttggtgcatcctggtaccacacatcgctttccgcctccatgggcaacgcagaactcagtgccaccatggacactcttagggcacccttcagctgaacagcgtttccctcctccatgggccttgcagagagcagtgcttccctcagcacccttgctgcaattcggatgtgtgcatctcttcccacctccatgagctttgcagaaattagtgctgccctgagctccctttgtgcaaccatcatgtttgcagcgacggccaccaccatgagcgatgcaaaagcctgattggccctctgcactctttgtgcagttcagtttttggcatctcttccccccaccatgcttaatacaaaggccagattttcctcttgctgcctttctacacccatcacggctacaacggcggccacctccatgggctatgcagaaatctgtgcggccttcagcgctctttgtgcatccaaggtgctcgcagcgtctgccacctccatgtgctttacagaagatagtttttccctcggctcctttcttgcaaccttctctctggcaccttctacccccaccatgtgcaatgcagcgccctgaagaacctctagcaccttttgcacatcctggttgtgaacagatttttgtgctgttgcagcgttgttgaaagctgacaacaccagaagtactggttactggactttgtggcgtttgtatcatttttggcagtggggcaagatcttgagactggttggagctacctggtaactctttacttgaaaaatgaccagtgttgttcctggactgatacagataaggaagtagcttaccaccagatttccagcgagcagatgttgatccttcgtccactgtaggcactgaggacatattgcatgattgcagaaatacggcctgttgtttggttgctgcagagaagtccacattcgtcacagcagattcacagggtccaaaattcaaagataactcgagatccacaggcttctccaaaactttcttgccattacaatcataactatccagttttgaagtgccttcattatacagattaaactgaaaattcatgtccaaatcaacagatgaaccatcgtccctgtcctttgctgaagacatggtgcagcatgttcccatgctctgcttgctcgagtctgatgagcttgaggagttacctaaacccaatgacaagtcaacccacttccgcttgatccctcttgacaaaggattgtgcatgctatcttgggcaagcacatcaagttgtgaagaacaagccattggttggctgactggtggactaacggtggtccatttttcagcatttcttggattcgtgccagtaaattccaagaatccaagctgtttatccattgcctctagtggatgaggatatgcagtaaatcctgggagcccaagttgtaattcaactgcttcaggtggctgagaatattaagactcaaatttgaccaatcttaagggaaaagtacagtcagtggcgcttctgggttacataatacacaaagaaactaagaagtcagaaatataagcagctcctttgcctttttgcatcccccactgacaaatccagaagtatcattgcgatccatttcttagtttttaattaagagaaaggcttcttattcagatggcaacagtaaagctacaatcagaagcaaatgtcgctgctttcatccgatcaaatcaaggaagttagattctgcatgaaaagaaatacacgtgttgaacaacccatttagaagagcaacatataaaaaacaaaatgcacataatagaaaaaaaaagaacatactgcatggctgtaataaaagtggcgcatttgttttatgcctttgaatgtttagaggcttaaagcccatatagagtggttcagaagaaatgttaatagattatttccatgcagcactgtagctaaaaaagttttagtatggaatttagtcatatggaatctagtccttcaattcgatgtctgaaatttggttgaattgccttttttatttaaaaacaagaaaagtccatatttgatctccaatttttcgtccctcgattacagaaccatccattatttggtgcctcaacttttacaaccgtgaacatctcattactaggcacagatcatttaataccatcaatttcaatgacacatcattagagtaaaccccggtttgggctcaaggatgaaatatggacggttttaagaggtgcgggacaaataatgaatgattttgtagttgaggtacaaaagtcataccaagtccatagttgagggaccaaatatagacccttttttaaagactgtaactaagtaactaacaaaaagaaaagtgttctcaacatttgtttttgtaaaaccaagggaagcagctctgccattcattttaagaagagaatctttacgtgctaacatccaacatcaacaccctaatcagtcaagtgatactggcattatatggattcagtggggtgtgtaaaatttggtctagtgtcaatttttaaatactaggactaacagctcagtgaaaacatcatgcatatttctaatctctccagtacattgttctatatatgtccattacaaatatgtacaatgtgacatcaaatgtatatgtaaagttgctgaacaacacagatcagttcgttgaggatactttcttagaaaaaggtttgctttgacttagtcttgttgcatattatcttacttattgaaataatttatttgagactcaagactaagaccagaacaaccacatgcatttttcttctgaagaggtggggtgaatgcttgaaattaatgttcatgtaggcatggctttcaaatacaaaaggaaaaatgatgcttagaattgatcctacatgagaagaaacatgaatcaatattcacaattcgtgcagtgcaatgaatggatgcataaggatgatatttacaagcaaccgtaaaagagaagaactaggaatccacattcgtaagtcaagcagtgtaatgaattgatgcatattcttttgattactgcaactagatccatatgccgcagtaagtacaaaaactaaatgccagtgatggatcgaatgcttatgatcagtaccagcgagtgaagaaacaggaacagcccatctaatactgaaaaactctagctgctggttgagaagttcagcaacctcactctgcaatcggggaaaaacagaataaaggcagaaagcaagaaattagatgaaaccttttaactaggtcaacgcgacaaagtaatctggttatctgaacagatgaaaccaaaacgataactttttacaggaaaaggacgtatacatctaaagcactagaaaagttttatcacaattgacaccaagcctagcagctttacacgaagggatcgaatatttgcacatgcatgcagtacaacaactaccacaaaagtagaatcagtgcactccagataggtatcacagtcagcaactttacatggtaggatgatgcatcatataaatcgaaaatcagtgtcgggagaatattattattatcacagtcagcagcttcaaatcttaggagccatgacagatcgatattcaacctaaagagaatattctatattctagccatcatgcaccaggagaagtggaatttggtctccagattcaactatatcacttgataactagtgatcagaaattcatggtttacatccaagaatctatgaagcaccggacggataaaagagagcatcttccacgcatgcaacctaatcaataaaccgaatcaaaaccccaagattttatataatacaccccaagcaccacacctacatcctccatatgcctcaattaagttttctttttttttcttttaaatattgcaagattcagtatccacacttgttgcacggtaaaagttaagaacaaatatttcaaaaaaaaaaaaaactgaagagttgtatcatgtggatactggtaaaaaagattggatcagagttaacactcccaatacgcaggtttacacacgcatccatccaagcgtccacttggagcgaagtcagtgatctaactactaccgaggcaacgagagaatgaaataatcatgacgcaatacacaaacactacaactacaagggctcgggctccccgcgagagagacggataacagtatcattcccgggggcggcgcaacgaagtgaacgagaaaccctctaattcccttccccgtcgccggttcgccgccaagcgccgccggaggccggagcagcatgcgccagagcggcaatcgaactcgcacaccaaaccagcacgcgtcccgccgcgcgcccgttccagcgagctatggtcgggcacgggaacaggcggccgacaggggaggaagaaatggaagggaaaaaaaaaagaattagagagaggcagcaggagacggacctgtggcggcggcggcggaggaagaggcggcgagtcggaggggagacaagtggaggagggtggagaggagaggcgagacgagacgaggcgatgaggtggtgggatgggatgggaggaatggagtggtgtggtggtattgtggtggtggagggagagggagggtgatggtggtggggaaaagggaaacctgaggtgggtgatgcagagacgggtggatggagagggggagggtgggccgtggcgccgtgcaaaagtggagatctgttctcgcagatgttttgtcccctccccatgtgggaaagtgggatgcgcggtggaaaagtttattttcatttatacccttcacaaaggtcatatttacacatattgcttttttattgttgattttacagtgagtcataatttggacagctcatgtttaactaagtcgtataatggtgtatatcttagcttacgcttttacgctggactatattttttttctacaaattgtatgtgcattttggacctggtttttcccttctcttctaccattatcagtcgcacaccaccatcaatcttggctatatattgtctcgcggcacctaagcgcttgagctattgagcacgagaaccacatggctacatctactctacctagcagccaacaagtctttggccactaccgcctctataatctttatccaaattgtgcttagtcaccttggtgctaagcacatgacaactcgagctcgagggcataccacgtgtaggtgaaggttgaggctagccgtctcaaactagcacagagcaaaagcatgttgcttgagctcggtggtcacgttaatctgaggttggccactaccacctttctcctatttctttctagattgagcaacctgtgctttcatccagatcgggctactggaattggatatgatcgcttgtctagcccgctgcaaaagaactctagcatcctatttctagccacctccccattcatttctttctcgatcgagtgtggaaaggttggagcgttgtcataagggaccgctctgcgaagcttacattccctccgctttctctaccaatcctcctcactcctctcggatcaacagctttgtgacatggcacccaacgatggagaagaccattgcggcatatctgttggcaacttttttaacaagtagacaagcacgatcggacacctaaacgcattgcggtaatatggagtcaccaaccaccctcaatttagcaaaaagctagaccaagatgggttttgatatattaaaccggctaacatagccgatttagatagaacgatagataactacacgtcttatgggcaaacggaaggtttacgggacaaacctacaaaggatttcgcactctcgcagcgaagacggacgatttacaacgcaaatcgacaaagatggacgaactagactagaactatgtgaaaagtagatgcaatgtttgaaaaagcgattcaattggctaattatatagatcgtacattgtatgttccttgtcccttatattagggttggtcttgcctactacaagtcctcttccacgtccaatttggcataggaaccaaaggaaagctgaaacatagcctcccgagtaaggaatcccgagactcgataaaaactgacttgggctcggaccctgccggtctgcccggcccatacacggcgatcaaaccggtccagtggaggaaactggcaactttcccaaatcttggcaattttccttattttgaacctagctaccaaatttgggtgtaaacaatatcgttgctcgaatcccctcaaagagagcttgtcgctgaatcgcattgttgttgcgttgccttagttttctctctgactcgctgatcaacgacatgtagaaaaaaaatttcacacaaaacatactccctccgttcaaaaaaaattaatctaggaatagatgtgacccctcattgtattaggagggatcacatttttcctaggttaagtttttttggatggaggaagtaagtgatagaaagaagtggttgtatacatccatgttggtacagagatcgggttttataaattcccaatatcttttaaaaaaagggtgacgaagagaccaaaccaaacgtaaggatccataatcagtaaattcctacaaagcgaaggccgtaactgcaaagctggcaagaaacaacgccagtagtccagacttccagtacaccaaaaccagcacgaggcaaaacgggaaaacagccaggaaggcaccaccctcgcacgttggaaatcggcggcaaattaaccaggcgacctacctacgattccccgaagatctccacacccgtgacagacaggtaggccacaccaccatctgggacccacatgtcatcggcaaaatctgggctcgctggtcaccccatctctccccagtggctgcgggccgcggcgaccgcgggcatggcggaaaatcaaatccccacctccacgtcaccgctgacgcgaacacccccgccgcctctcgtaccactgacacgtggggcccaccccgagcgacgtagcgttcgcaatcttggattttttttattctttacgccgttgtgtgggccccactcgctcgcgcgcacgcactagggggagggggaggcggaggggaggacgagatctttcacgtgggacccaccccgtgtggcctgtcgtgtgtcggaggcaccaacttggcaccgccaccgtccaatttggcacgctgcagtgcaggcgcacgctccctctgtcgtttcttttcaacttttcacttaagtacaagtgtacaactaccactactaccatatcaaaaaaaaatactgcccggtatatcatataaaatactagtaattctgaaaacaataggctccgtggacctgcacgatttggccatttcgataattcgattgtgtgacggcgaccgtgtttataacactgataattaactatcatataaaacactgtgataactggtaaattaacatataggattgtctaaaagcattagaaaataaatggaactcatttagaatcagaaattgaaacgacgagatgcgccggttttcttcttgtttgtttttcttttaaaaatatccaagtagctcgcccatacaacttaatttcgaaagcattggaaaataaatggaactcgatttagaatctcaggatgcgccagttttcttattgttttattttcttttaaaagaattcaagtagcccatgtaagtcactgctatctctaatctcaccgatacaacttaatttcgtaaaaagaacacttcctgtggctctattttcttttctaactttctaccttgatctagtttgtagtaatttcctatcgcacttagcgattttcttatactctatggacctccagcatgatgagctaagttgctccatgtcttctctggttaggcatgaaaaatacacatctccgtagtatgtgattgtcgttgtgtttcgtcaccatagtgttaaaggaattaaagtgcataaaagcataaggtggaaggaggccgaggtacatgcacttttggtgtcgaagggttaacttcgctaactagaatggaggtttatgggtgtgagaaatcgtataaaactggatagagacgagaaataaacttatgaacaccgttataagggtgagaattgaaagactactcacttgtaatgggtatttagattccttttttttaaggttaattggatccatgccactgtaactttgtgagaacaaaaaagggaaaattagaactatgccattataattttacaaaatttaagatatgccatcctgacccacatgtcattgactcatgtggattctacatgtcattgagataccgatgacatatcttaaattttacaaaattataatggtatatctcaaaatgccactcctattaatcatatcggctactcccgtccccttttccgactactctcccacaccgtctccgttcccgtcccacatgtcggtcccatctccccatcttttcctccatccggcgcgaccgcagaaggacaacggcagcagcggctcccgagcactctctccgcggatggcgtcgaggacagggacgcgggggacgaggctgagcaccatgtggcggagggtggggaggggctgaaggtgaggtcgcggtcaatggcacggcgcgcagggcgaggtacaggttgtggttgccgccctgcaggtgcgcgttggcgcggttggcgagcaccagcaggcggacgcggcggcgggaggaggcgagcgcggaggagaggttcccggcgaacccacgtgcaacgaggaaggactcgagcgaggcgagcagcagcgcggcgaaggagaggagcacagcgtgggagcccgagagggagcccttgagcgcatcggcgtcggcgaggagggagcggaggttgtcaatggcgcagatgaagtcgtggaagtgcgcgcggcagagctcctcgatctcggtctcccggtcccgcgccgcggcccagagcgaggcgagtagtggctcggggcacctgcacgtgaacacgcgccgcactaacgggcccaggtcctccccggcggtgatggcgatggagagctgggcgaggtcggcctccgacgccgccgccgacatcggcacatcaccaggctgcttctgccgcatcgggatctggtcatccccattgagttcttcgtcgtgttctcgtcgtcctgccgccttttgatttggttggatttgttcgctttggtcattgcttgttgacgatgaagttgggcatggcagattccgccagcaacaaggtggcgtcggcggggcctcctctcccagctcgctgttgacgccgccctcgccgtcgtcgatccaactcacccggacctcctcgcccagttcgccgtcgacgccgccctcgccaggaagtggtcgggatgaggacgggaacagagacgcgtgagagaggaggacggaaaatgtgattaaattggcatggttctaattttagaaattttcaatggcatgtagcctatataacgaatagtagtggtatttttttaatttgacaaagttgtaatggcatagatccaattaacttttttttaatgttcacaatcatccgtataaaaggaaaattttgttgcacacagcactaaggtttggaataagaggactcgcccataccctctttttttttctccttttgtcctgacatcttaaagttctacgaaaaatgaaaggatggatcatggatgaacctcctagccagccactacggcgagaccttttaaagtttacactttatacatgtggtgatgagtaggcaaacactatactccctaagtcaaaaaaaaaaagtttaatcccaactatgaatctggacacacttatacacaaatttatagctaagatttgatcttttatgggacggatggtataccgtatacaccaccagatgatccctcctgcatacatggaagctcagagtactcataagttgaacacaagaatttaagcgatttcatatcgatttaccttctctgattcacttttcatactataaggcgttgtgggtatcaaatagctagattcatggatcgatgtatgtgatttatatatgtgtccgaattcatatggatatggagtccaaaacatatataatgtgaaactgaggaatacatattataaaatggccaattacataaatgccacagtttcttgtatttgtcaaactgctaatggtttttttatctaatctcatgtaccactagtttcattaaaaaaagttgttctaaaataccacttacttttaaagttgactaatagcaagtcaaaatggtttcaactctccttgaaaaaaaaaagttttacctttttcaataccaaaatgctctgaagactgaacaattgactaaaaatttaaaagcaaattgataaaaagaatacaaaaaacatagaaaactcctcatctcttcccccgcgtcaccatcctccttgccaattgccatgactggccttcccgcacgtctagcgggccaacgacctccaaagccatttaccctctcattatactgttgcatgagctctctctctacgtgcatggccgatggccatgagcttttaacacgtgaaaccgttaatattttgatacacgtttgagtattcatcttaattattaaagaagtttatagaattatttattttttattatgaatttgtttatcattaaatgtacttttaccattatttacattcgtatatttacacgtgatttttttaaaagaacaaacgatcaatcgcgtgtcaaatagttaacgacgtgatctatgaaaatccgaaggtgattttagtccctccggaagtatattggatgctttatacatcgacatatcgtgtatcactgaaattaaccgtaattatgaacacttgttaaatttaggatgtatataaacccgagttgacatgttttaccacaagaaaacctaacctgccgagctccacacaattcgcggagggggcataatatattaatgtaatgctacaacttaattgcaattttaaccactgtcatgcttaattaatcacccgtagaagaagaacacgactagttgagtcatgcatctgatgctgatcgaagttgtgtgccgtgcaatgcgtacgtacgtaggctgcatgatctcatcacgctatttcatattttcctcttggaggcagcaggtgtgcaataatctaagctaggaaccaatggaaacttcacccactttgccaggaaattaggggtaaccgtgtgtctaatcacctactactctgctcatgaccatgaacgcctacgtttcatttgtttctttgaaaggttgattaattaaccaggcgatatatgggcaacgcaatcagcctggaaatatattgttagagggaagaaaataggcgtacgctaaagaacgtgaagacggcatgtcgacattatgggcccaccactgacgcgaacgagtccagctataagataaattaattaagtctagcacgatgacgaaatgtgatgaactcatgatggttaatatctcgatcgatctgctttgattaatttccgcttcgatcgatggtgagagctttcttttcttttctttttgaatgaacagttagaccaaaagcaacctctactctacatcatctatcaaaaagaatgaaattcggggaggacgtactcgttcagattcatctaaaaaattgtttctactgggatggagggagtactcatattaaggggtattcacgcttttgatcatattttgtaacttaactataaattaatttgatctttttttcaaatttactcattgaaccctttttttttaaaaaaaaataaaggtcagatctaaccctattaactcaagaaaaatatatttttatggcgttgatttgatccaactttctcagtgttttttttgcgcaaacctaattaatcttgataagtaattgttttaccatgataaagctcatgacatttacataagtaaaaaaagttacacatctaattccagcactataaaaatgacagaaacgttcacttccaccgccacacgctcgctcaaagccgaatcctgctgaccatcacttccaaccgcaccaatgtcctcctgatcggatcgaggaggagcgccgccgacgcctgtcatccatcgtcctcctcattatttggatcgcccattgctacccgtcatcctccccgagtcctcactcggatcaaggaggagaagcgacgccactcgtcgtcctccacgtttagatctaggagaagaaacgtcgtcgccctgccacctttgagcacgtagccgtcctccctattcggatcaaggagaaggagcgtcgccgttaccgcctcccacagcttgcacatgccctccgcgcgtaaccgccgccattccctccctccacgtgtcgtccctccctccgagtccccgttgacaagcgagatcccaatagcctgctagccccgacgcttcccttccactgcatgaaaaaccctacctcaagttgtggctgtagagatggaaggataaggccaagtgagttaaggggcattttgatcattttccgcctctaaatatactttctagttgcattactaatgttatggttacgataggggccaaatggtaggtttggtttggaaaataggatctaatgggcaaagtaaaaaaaaaaaacagggtcaaattaatagttagcttttggaatggagtcaaacgcacaattaacccttaatgttaattagtggcaccaattgacgtaagctaa

SEQ ID NO: 76315 - DNA, 1588 bp, Oryza sativa
accacctcccccacgctcgctcccgctacagacgcccccacccagggcttctgggcgcttcccgcacgggcggacttcggccagctctatagcttcgtggttgtgttggagatgatggccgccgcagcagccgcgcccgccatgcctggggaggcgtccggaactacctccgtcgcgacgcacgcccgccccgcacccccatccaccatcgcctcatcgtccccgtcgctgcaccacgccccttgttccccaccgccctaccgcgcctctcccttcccccatctcccgctggccacttcccctctcccccattccctcctctcgttgcgtggcgctcgaggcttgcagagcttggccaggctcgccggccgcctctcccctttctgccgctggtgaagataagagaagagaagagaggaaagaaaagaaaagagagaagaaaggagaaaaagaagatacgcgggccccacattttccccttctcacttacatctaggcccataattttttttattttgatgactaggatgccacgtcagcgaaaacacggatctatactgccttgggatcgaaattgcatgattctgtatagtttagggcaacatcaatgtataatatggaagtgggcattagtgtgggaccatgtgtcagtcagtagtagttaaattagccatcacaatgtatgggaataagatagggccacagaataaaataaatcgctacccccaacctcccgggtcttcctcccgcggccgatgcgatccccacttccccagtctcgactccatcgctaccttatccaaaaaaacaaaaaaaaaaagaaagaaggagactccatcgctgccactactcgcatcgctcgatccggagcggtcggccgccgcatcaggccagcctccgagccgccgacgcctcgatgcccagcagcccaggctggcggagcagcagttccctaacctggaacgcctctccatccaactatctcttccgatcccgatccaaaatccttccgctcaacgccgccatctattccggttgactccgacttgatgtcgtcctcatcaccgccagtcccccctctggttgtaaccaatgtgcttgctgctgaaatccgttgaagcttggagtagaattgccatttggttgatagttggtaggagccccaaaaggatggaagttgtgaaaagtgggtgttgaggattgagaaaactgtgtttgagagaatattgaggagaattgtggagaagtggagttttggctaccatttccagaagcttggctttgggagccctggctaagcatgtgcataaaacctctgttggggggattcatcttgtttgatgaaatgcaggaaaaaatgactttgagttgtgtttgtatttgtagaggatgaggttgcagcgttgctgcaagaagttgcaacggctacaaatgtaacggctaactgctactctattattttagtacaactaacagaaaatcactgtacacatgctattttttgttcctctcttgccggcagtagcactactacctggatgttgctattatctactcccacaatggctactacctgcttagatgggtg

SEQ ID NO: 76316 - DNA, 842 bp, Oryza sativa
ccctcacaatgggggggggcttcaaatgacgcttcaccttcatagggggagggctacgggattctgctgccccctctttttccgatgccatcaaaggccgtagtaaactcttaccatacccactgccgggagttctcactcttgggatgcggaatcgctcctccttcggagtaaacggagtaccggtgggtgtggtatacttggggagcatctcatctccttccttggtgaacagggtgcccacatagcgctcggcgagaggtggcgcggccttcccgtcatcttggaaaagccgtcgtgccttcaacaaccgagttctcccgttgtcggccgtcgcgtaggtgaatccccccagattttgtccttgtgacatggcgaggggagagggatcacgctgccgaacggggctgagaagggttcggccgaaccagggagctcgtcgatcggctccaaaattgcaggggagcctggcacagctgcaaggggttgagcccatacagcgtttaccccttccatcgtgtattcttccaccgggatcaattgatttgccggtgtcgcctctccggtgaggtcgtacgtggaattggatgaagagccgatgaatgtaatcaaggatttgccagccattggtgggtatgagtgggaattcgaggaattgggttggattggagaggagagtatgcaaaggtggagagaaagaggaagaagaagtgttctagcgagatccgagcgttctacctccaaatgcgcatctaaacaaactaggaacgagcgggggagagcgaagttcaaaaatggggctgatcgggcgcctccctggctcggccgaaccagcaccttgg

SEQ ID NO: 76317 - DNA, 2454 bp, Oryza sativa
  unsure (1)..(2454): unsure at all n locations
ttatgttggtactcgttctgtaagtgagagcgaacgaggggtaaaggaaaaaaaacttaagtaaagatctttaacaaatatgttcaatgtgtatatcacgtgatcaaactcatctaacttatatacaaattagataaaaaaaacactatccgaaatcaccttaggggttatataaatatgtcggagcccaaaaccaataacttggatccgactgagattaatgtatcaatccctggatcagtaaaattgatacatacaatataactggttcttcattacatatgttaaagtcttacaatactaagggttttacaataataggtactcacctatctaattaatacacagcggaagtttctatacattctgactagtgaggtataaccttnannattttctaatttatcggggtcttcgtagtaatagtcataagggtcctcctcttgacccagatctgaaaaaggggttataagagcaagggtgagtatttacaatacttagcaagttatcacgggaatatgttatgcattgacatataagggagagtctacacatctgtcgacagatttttcatcataaatntgtcaaattttgtacctttggattaaacccataaacgatagatggatgacacgtgtacagcactgctgaggtcccgcatctactaatcgatagtatggatgggcttccgacgttaattcacactctcgtttcttaatcaaaattagttggttatgtatccatattaattattaatccttgagagctcatctgctcatgtatgtgtgatatctactagatattttttagtgcatacaaagatattaccaatccatctactaaagttacattgttgttacactataattataccatagttacaaatgtaattatggatagttacactgtaattttaattacattgttgttacactataattacaccatagttacatatgtaattatggtataattgccctgtaattttaattacattgttgttacattataattacaccatagttacatatgtaattatataattatagtataattgcactgtaattttaattatattattgttacactataattacaccatatttacatacatgtaactatagtataattacattgtaattttagttttctaacactgtaacttcaatataaactttattttgtcttgaaccaacttggcttaattgctctgtggtgtacgtttaacagggaaaactagtgctcttggaatcgatcccccgctacgcacggacttgtctcttttatccatcgtattagttagcacaaatctccacgcaaatcatatggcccaaaaatcgacaaatctttaaacgaaaatctgtcgacagatggatagcgaattcggacatataatagggttctttgcaaaaagcagtattggacaatctggaaaagttatagcaagaatttataaaacatataaactttagatttctaactagggtaccatatgagtcccggtactcaactccatgagtacggctattcgaatagtttcaaagatattctactgcagtagatgtacgctttacccgcagtccacgacctgctgataatcatcgactttagttgtagcccagtattaagttattaacaattttggcacctgttctatgaatttatatcctcatatgctctgaacgtaatgttaacagcagcaagaggagttctggcgtttccgaggtatttaagaggaactgatcgtatgacaccacgtcatctcgatcagggtttagaaatataccatatagtttatactcgagtatcacaaaccatttacatgtacatggtaatggttaaagttgcccttcgcggctatagttgcctcctgcgtgaggacttaaaaataagaaccactatacagaggtgccatattgctaattaacataataactaggtctgtccccattctagaaactgcggtcgtacccgttcgttcaacataagtacctggcgaaacttatatcgatcgagacaatactagccacccggaaatcatccaaatcttacgtattgtcccaatctaagtatagggtattttaaccagattgtaagcaaaataagcaatactaaattatctgagtttctatgattgatttatgcatagaaaatagaatattgaatagaaggctataaataaataatttgtaaaatataggcttaaatgatcaacaggtatatggtaacttgccttgctcgatgtcctgagattgattgatattatctagtgtgtcagaggaatcctcaagacctagggttagacatataaaattcaaattcaaaaggaattcacataaaatccaaaaataagaaaaatagagaaaataaaataaaattcaaaaatataaaaaaggggctcaatagatagagaatgatttttgaagaatattggtccaagtttcactgaaattg

SEQ ID NO: 76318 - DNA, 524 bp, Oryza sativa
attaatgttttggcaattggcagtagctaggtaccataagcttttggcacaaactacataatatattcgttttcctaagaagaaatagcatatggtacatagtaaaaaaaaaagacatgacctcagtacctcactgattttcatggaaagcttatcaagcacctcaatgcgctgttttatgctttcaagagctttggtcagcttcttcttttgcacaagtaaatccacttgggccctcaatttccttttcccttttttttgcccattcggatgctgaccgcagctcttttcttaagattctcagcagcctcagtcaaccgcacaagccttaccctcgtgctatttgctacaagaacaaaccacaaatttgagtgcagcagataccacagtggctgtccactcaattcgcatgcacatacacaaacaatctaccatttgactacaagatcctacttcatttccaatcaaaattaacttgacagcataacgtactatcacaagtctggagcatataacagataagt

SEQ ID NO: 76319 - DNA, 557 bp, Oryza sativa
aggacaccgaaggcaatattttataatttctgggtaaaaagaggtgatatatttttccaaatgacgagattgcccagtgtgcaaagaaaattatatattcagaagaagaagacatgagacgtacttgataaagattaatacgtacgtacccttaaagatgcactaatacaagcatggcaaatgatagctagaagatgaattcatggaaatctactgtcgtcgatctagagatgcagctccaggtccatctgcttgtcgccggcgcccatggaagacacggcggtggctgcagcggcggcggcggcggcgtgggacgctcttgtctagttgagcatgtccaccgtgttgtcgtcgcggccggcgctgccgagagcggccatgagctgcgcgtgctccgtgaagcgctgtgcgccgacgccgacccgctccaccactcgattgggcctacgctgtagccgtgggaggagatggcgccatctttccccacccaaaatcaaaaaatttcttagctgggagcagccgccgcgccgccatgggcaccaccggccttcttcccc

SEQ ID NO: 76320 - DNA, 8591 bp, Oryza sativa
cacctcacaggtgctattcgcgggggactgcggccgaattacggcgaaccggagggctatttcgaaaaatcgccacctcgctcgccccatgcgcgacgcttaataattccccgaagagtgagagaaggcaaaaaggttgggttcgatccccaatcgcgatgtgctagggtttggaggcccgtgctcagtcctcgccgccgccgggcgccatcctccccccctgcacctgctaaggtcagctttctttctttccgtgtctttaagttccctgttgagattcgatttggattccttgctgctcaatctcatgggggcctgcacctcacctgacctgcttcgatcacatctcggactgatttcgttttgtttttggttttagcccctttttttttcttataagcagcaagcgctcgccggaaattccaagcagagagacgcacggatcagatcgccgacatgtctaggcgtttcttgtttcagaaattttcagtgctgtccggatcgatgcctaatcgtcctacctccgctgtatgtatacacgctcctccaaatctttcaaattttttatttttctttcacaacagggaagaacataattgctcttttcctcctttcagcaaggaggagacgtttctgctatccacgatgctctccgtcgttttagcacggtgcttcccaattaccatggccttcctgtctctgtaagtagctattactcaatttctttgcctagcactagttttacactttcaaaccggccaatttataattcctttcctttcctttttttcttttttttaaaaaaaaacatgaacaaggcggtgccttttcttttgtttcctttctcacatctatgcaatttctgataattttgatttttccacaatataagagtgaacttgtatgcctttggtgaaaaaaatattaatttccttatactgccttccaatgcagcaagcaaagtgcctgaattctattcaaagccctcacgcagccaccaaattaaaccacccaacaattggtgtggttccttttgccagccggactttcttctcttatacaaaaccctaccacctgccttctctgggtgaaaccaattaccctgattatgtagcagcagacattaaagcgtaagtctgagtactagcctgtatcattttacttcctgttactttaattgatgtgtttattgttggcttagcccgagtcttgttctactccctccgtttcaggttataagacgttttgactttggtcaaagtcaaagtgctttaagtttgttcaagtttgtagaaaaaaatagtatcattttcaacctaagacaaatttattatgaaagtatattcaattattgatttgatgaaactattattagtattataaatattactatatttgtctgtcaaacttgaaacagtttgactttgaccaaagtcaaaacgtcttataacctgaaacggagggagtactatagataaactaaatttcagcttatttggtcttttctttatttatggggtcatttgagagcatattgtcattgtaccgttagatctggttacagggacggctgttaaggagttacaggccagatgatgattttattgtttgtttgttaatatgtgagcaacgctaagaaaattttagttcatcagttggctccttcccatagtacgtgattgttggaaagcaaatactagtaatctaggtcgatcaaattaaacataatcgaatcaaagaacctgtttacaggaaaaaggtaagctttgctcccctgaactttagctatgggaatttttgtaacataggttctgatcccatctatcatcccataaattttcaacttagaacacagcttgtacgacaggaagcaaaaatggcagttgtttttagggattaaaacaagctatcacttcttttggtgaaatagttccgctgtagaaaaatggactgattaacttagttatgcgacatgagcatctgcatgtatagtttctcgttttctggagaaatctccagttcaattgaacctatgaaaactcgatttctctatgttcacgaagaaattattaaaggtagggataggcatgatctctttctcaccaaatttctaagaccaaactcaacttcgtttggaaagttaaaataagacaaattttgcatgaaacttccctatcactatccgtgcaaagtttgtatttcttgtatcttgcaagcaaatttgaatttggtcttgaaattttgtggagatatagaccatgcctatacctaccactaatatttatggatgagagtcatctcgctgggatgtactagaaagtaggggtggtctattttgtttattttgaatgaatgggtttattgttggcttattgtaaattgcatttcaacttattccatttttattctcccgtgttgcattttgagcatattatgtcgttatggttgctctattgttttttctaaattgggtcatttcccttctattttctccgtcccataatatcacaaaatttgttggacatgagacttgttcagattcgccaatcctaggttgctatgggacagggagagtataaaatattgaactttacatcatcacaatcagaagcataaaatcgcatcagggagagaggtgaaggggagtaagaggctgacgagtgggtcccacaccttttccacccgagtttgccatgagggcaaaagtggcaaatagttaagaccatctctaagaaagggcaaaaaaaaaaacataagaagggtattttcgtattttgataattgtcaaacctaaaagtgacaaatagttaaattccccgtatcagcttacagttactgatggtgtctctgcctctctgcacgttattaacaccgttcgcgaacatacttttttttttcaagatataaatagataaaaatttagcctttggttcaacagaagctagctacattagagttggataacttaaggtgcttaattataaacaacagccgcccacacattaccaaggataacttaaggtacccaatacataatcataaaggttggttgcatgtttctcatatcgatcgccggtgcttctaaacctcatcttcgtcaattcgacgcaatcatttcggcaacgaagtagcctgaaacaacggctggaataatcacagccaagttcaaacgtctctttgctgtcttgagccttaagtagttactagaggctggggcgcgccattgcgcgccgcctgcacggattaaaatctacgatgagggaaatctacgataatttgataagtgacatcatagattacagttcaacagttgtggatatcaatagcatcgtaattagtattgcttcgtccgtggtaaatatcttactacagatggacactttattatcaacgtagagcatctctgttgaaatttcggttcattagagactcatggttcacatgaatatacaatattttcattacataataacccaaaattaatagaaaaataatccctggtacacattgctatacactttgggtttttgcaaataggacaactgaagaataatgggcccaacttttcaagattacattcagcatcccatcatattctgaagaatccaaacatgttggaatgtaaataagtacatgaaagcatacgttagccaatgaaatcatatattgagaagcacatgcagataaataccataccctaataaaaccttaccgcactaagtgcccgagcacggaaaaactgttaataggtcaaccagtgataatggaacaccaaaattccattgatgtttatttatgagctagcagctaattagaagtgggcaaaatttactcagctagtaatatatatcatgcaaaatcacattcaacacatcaaccagaaaatatgatttttaccatttaagtaatgtcattcaatcctgctacccatctatcctcacagctgaagttgtagccatacaagataacagtaaattataagtggaagcaaagctatagaggagctattgtgccattcatgcaataattaatattaggatatctcaaactgaaagtgagaaaagcatgaatatctcaacgactaatcaatctacagagggcccccatcttactgatatatagaaagtagtggtggtgatggtagtagtctatgatgaataatattgtaaatgattaaatcattttgttagctacttatctgtatatgcatgtgtctatttaggtttagggataccttttctttctagtttacaacttcaactatatttagtttagatccattgcaacgagcaggcaccattgaatcccttttctaatgtaacagaatgttatgcccaattttactttcccttgtttcatctggtccaatcgtactattatatggtttcattgaacctgagaaaagtggtacacagtcaattaacatatagagtaaaacatctaactataaatatttgcagaggaaatgcatagagcaaaccacaaacattgataaccaccatcttatcaaagaatcgaggttgcaaaacactgatgcattatatatcataaacaggttccaagattgtattaatatgagagctgcataatccaatatgagttatttaaatatcacttaaatacgattaaaaagaaattaagcattgtagaaaaacatggatctttaaatgccacatttctataactcagaatgaagtttagaataaaggtgagaccattgtcagatttattgggactacagacaacttcaactgatagagaacctaactattttactttgcttcatgaagggtggccactactaatgccttactcataaattctggaaatacttgaacattacagacataagactgtaaggtgcaaccagatccctttttttcctcttctataattcggagtttttcaaaggagacatatgattgcgaaatgcattaaacttgtatacagtaaacttatttagcagtacatgagtacatgaccaggcaaaatatggaaagaaaaaaaaatagaagttatggagaaatcatcagataggatatatctactgaacttaactattgcactaagggcaatacatatatgtttctgctgttattagaagcatgcgattctcgagtttggggattgttttcgcatagaggaggtcgatgacatacagtagtaggtgatcactaatatatcagttgatgccttcccagaagtaacatcaacatatattgaacaaacgcacgaaaaataattccagcatatgtgtcaacctgatgaaggaggaggagcatagcaaagaccaagccagtgcctttggatgatggcagctgctggacttggaaacctgggcaacaccagcagctaaaccaaccaggcatcgcaattaaccagcaaaacttgtgaccgctgatgggcactctgcttaacagggagatgtggagcagaacaatatatgacctagataaatggaaataaaaaatgatcacttaaacaacacacataacattaatatgctttttagtgagtagacaaatcatatgatgaacaaatagatgtagaattacagtaagaaaaacatgcttcttttcaatctgtaaattatgtgcgctaagtgtattaagtagaacattgaaaggtgccaagaacaaacccgggtggtgtgcctcctagattggccgcccacttcctctacctcttgtcgttctgccggggtccgccgccgcgatgccctggccatccccatcgaccttggctccagatctgccaccatccttggatcctcttctttccatcataccattcgctacctgcatctaatgccgctgctcatgaattttccatgtgaaagactaaccatgacttataccttagtaacatcttacttaaatcaagcatagtagcagcttactaaaattgtaagaaaaatgaaagtaagaaaaaatctcgagtgaaacaagacaatcccatggatgtaatttttcaactggcaagcaaaatttacccaggtaacaatacgctaatatgtatgaactatcaattcctgacctaaaaatttaccagtactacaggattaaatgtgaaaattgggactggcaaacatgatagcttaaaaaacttcaaagcaatgccctatagaaatgtcagttatcagaaaaatgaaccaatagataatgtcacaccattgggaaaaaaaattatcattggcaactccgttgtgatttaaatagcagaaaaatgcaatcttggaactatctacaaaataacttttcctcttcagcacaaaagcacaacatgtaaactaatgctctactattgctagttttaactgcagcgaaattcatcagtacattgatcagtgtattttttatgttaatagcaccatgtttctgggagcacacagttcaggaagcaaagttacaaagcatagtaagcatgatataagcatgatataaggatagacctcactgctttccctttcacactgcaggtttgccttgctaagcaaagcctaaaactctaccaatgttaagtgaagggaaggagctaaatatgaaggtaaacaataaggaagtagcattatttactgggacacagtatagtttacagatgattcttctttttgtctgtaatacatccattatgttcatcctaccatgaaaaccaaagtgataggacaggcaaaatagaagtaactattgacgagctataggaaaagagaactgaaaagcaggaacagtgcatctcctgaaatgcaagtaggagttaattacattggatagctgttaattgatgacccttagatatattagtggaatgagtaagcatgttaaaggtgaaagctgtagttttgaaatatttagtattacaggtaagcacttagtcatcagttaacaattggagaaaagcaggcaatgcctgaaaaataatctctgaaggagaatacatgaatacgatttctcgagcaattttgctactacatcgcgtgataggtgagcattgatcattaaccagggagaagccgcaactcatttgctataggtattagatattgcttgaatgtgaaatgtactatcccagaaaccataataagtacctcaaggtcaggacagcggtagaataagggatctcgagcattgactaccaccaccagtttcatggaagaaaagagaataaaagtaagtatattaggaactaaaaataatccaaagaggttctactctttaatccagtaaaagcaaatatgattgagcacaacagagtagcacttccaggggaaaaaatgcaataatactacggaacattgaaagcaaagtcattatgtgagccaaaatttgcaaagcattgcctttaaaaatgcatgtcctacttattttttttttggagaaatgcttggttttagtatcataagtactggcaagcaatcaaccacaagagcgatggatgaaactgatagtgaaggttaagcgttactcaccagatcactacgttcaaggactctccagagctgtctccagatgtcaacgttcttctcaaagggtgtaagcacaagcttgtcattttcttccagtttgcagaaatggatcactctcacaaggtgtctatattcaaacatttaaattgacaagcaatggcattaagtactacattttttgaattgttacagccaacatatgctatttacaacttatgcataaatagtaattggtttaatttgcccaagaaacaaatatgcaacaccaatgctcatgatcagattatacataaggtggttcaaacagaaatgttcaagagaaagctcatcctcgcattagtcttatcttgtaccataaccagattatacaagataataagaaatgctgatagttggatatcagtcccaaggtcccaaacacgcttttgcaagtgaatctccatttcactatgaatttccaagcataatgaataagctacaactcggtcatatagcactaactcagatgaaatttcatatatgaggttgttcaactaacaaaatagagctagaaatactgtctccgcaaaactattatgtcacttaatcatgtcgaaagaatggcaagcaaaaaatagatatgaaacatagacttgaattgaacccacttcaattgaagcacctccacatggcacaagacagaaattagccatcacgtgtagataggctaaatatagaatgagcattgtattatatatatcctataacgacaatgccaatatttatctacgatcatatggaaaataaatcaatctttcgcataaattgaggaagagtaagaatgcatgtgatgtcaatacttataatagaaaaatataaatggggtgcttttagagcaatttatgtattacaaatggaatagtatatagttctgccctctacctgaactaaccaaattaaatacataattttgcaaagagaatatgttttttctaaagaatcataagaaattctagcggactatatacactttctaaatatgcaaatcaactgaagacttcacccaaaataaaaaagtggaaatacaaccattaaccagcatcaaccatgacacatggattgtggtgtggagaaaacaaagtgggaggaa

SEQ ID NO: 76321 - DNA, 7985 bp, Oryza sativa
ccctctccgtctgcgccatcaacgcccattgcaggggcaatctcgtcatttggaaaaaaaatgtcacctttttgatccaaaaattataaaatattgcctccggtgtcctatagccaattacacaatttttaaagtgcccatcaaccgtgtcacatttttgcagtgtctcccaaccaattacatattttttgagtgtcctgtagcaaattttgctatgaaaaaaaaacctaaccaactagactaattgcgctaccatatttagtcccggttgataacaccaacctgggactaaaaagggttacaaatacggtaaaaaagaaagggttataaatcgggagtaaagagtctttccctagtagtgtgggtattatagtaaatatctcaatccatagataattttaacagaactacagaagcacaacttgcacaacaagccagttgcgaggatggaatgggcaggcttgcctgcctgcgccacctccgacgcccgtgcatcgccgcttgcgcccatgcgctgtcgcgtcgctagcggtcgccgctgttgacgtaaaatttcattgtgacatacaaagtcctgggagatttgtttactctagtgcaggtcctaaaataatgggcacggacatgccagttaatttgatcctataactaacaagatagatgaactgttgatcgaagagccaataagataataagccaatgtcaatagggttttaaacaatcgactatatatccgatgtagattctgacaatggaagaacttggaacaaacaatccaatcgactgataataatatgagaaagtagatgtccaatgaaccagtcgaccgatatcaatatagaatatgaaatgtaggctcgttggttaaaacatacatcggctaaaagtccaatgtaaatataacttattggttaacactccgattaaacatagaacaaatatataaacttagcaagacttagattatcagtagtaatacagaatatcggacccaaccaagatagttctaggttacttctgatcagataagctagataagccgatagatatatgctaacgtgatggatatggcaaatctatttaaaataatattgtgattgtagagatatatttactaagacagaagattggacctaaccgagacaatcccaactaaaccgacgcgtctctaaacacaatgcaactaaagatagaattggaatattgggtaggcaaacatatcaaccgaactagagcaatccaagagattgaagcgatgcagccttaaacaacgccaatatagccgatacaattgccatggcgcgaggaacttagggatttctccttcgcggagatcgaaaagatgcagccccgtatcaggtgtcaagtcctaccggtgataaaacctcagaaaagagggtggtgatgtgctgaaaattatattgatctagagatagatacagtgacctcggttgtacttatttatatccatgggtagatagtagcacaattaccccagttgtatatatttatattcacaggcgagctggctacgcgattttggagggaaggctgttacaaatggtatcaaagccgaccctcacgattgcgcgtatgggtcagtgggtgggcatatggcacttgtgggcactgtgtgaagcacatgacatggcatatggcgcctgcactagacgtacggacgtgcgctaacagggggcgtattcctggacatttgcctatatgcctgtgcccttcaaccatatcactcccgggttaacccttttacataaaaagtgtgatttccaagaaatgccatcgacaagtgttagtttcaagaaatgccatcgtataaacgactttgtcccaaaaatgccatcgccgttacggttacgtcctgtgccgttaagtgttataggatgaacattgtatttaatatcacggaatggacggaaccctaacggcgatgatatttttttggacaaaatcgattgtacaatggcatttcttggaactcacacttgttgatggcatttcttggatttagacgcttgtcaatggcatttcttagattatctcaatataaaacccgcttgcggccactaaattgtaggtatcaggtcgggtgtgcccacgggcaaaaaaaacatgtgcacgcccatgcccatcgggttgggtatccgcgatacccgaacccatgggcaatactgtcatccctagtgtttacatacaaaagtttatacctagaatgtgtgtgtatttgagaatgtactgaatgatgaacttgtgtgattgtgttggataaactggtttgcttcggttagtttcacttccataattatctactctaatgcttattattattggttgtgcggttcaaatattcgagttccgcttcatatttgagttcacgattttattcatgtttcattattttgttgaatgttctatttaaattattcaagtaccatgcattatcatcggagtacaatttggttctttatttattatccttgataagcgttgatcgcttatttggttccttattcttttctagtggtttttttaggagctagggtggtttggaatgtgtattcttttctagtggtttttttaggagctaggtggtttggaatgtgtagattatatctctattgatgagtggttttggtatgttttgccgtggcaactcgaggtaagtggttatcagtggtgttatacacacccatatctggggacatacgcttcttgtaaagctcattaacaaatatatatgcatgtgtcattgtctggtatgtctgagttgatcaatggctgcagcgatctatatggactaacttttgtaatagtaatacaaatattacagtataaaacatagctctaattcacagataaattactcataattaaaaaagtggaacgagggtagtcagactctgcagccgcatttgcagcatttacatggtggacaccttggatctgtggctgcatctgtggctgcaaaaaaaaaaaagcatcttataattaaagaaaaagaggacttctataaatagtatgaaccaaggataaaattaccacattaattttaaagaatatctaaaatggtaatagttgcgtagttaattatatagatttaaataggatattacgtacgcaagagagaatatatattgacaaattaatacgtatcggagtactgaaacgatgattagaactaggaaaaaagtccaaatacaaatttagatgaaagcccgtctaggaccctaaactttaaaaccggatatttaaccccctaaactttacaataccgtctatataaccccttaggatggttttgaatattttggaagcttaaacgaacaattttgaataactaatataatatatttgcatacatcagttataattcatcaatttattcttatacaacaatatcatactttatcatgttggtacttatttgtaagtgagagctaataaggagcaaaaagaagattaagtcaaaactttaataactaataaggacccggcgcaacggcgcgagttgggaaggccgaaggcgggtaggcccaagccggggcgcggggcggagcgccgctgtgccgtcggccatcgtgggatgctgccgcgcaggagcggcggttcggcggagcggcggagcgctgatggcgctgctgccgtcggccttcgcgtgcgtgcggcgtgggaggtgggactggcatagtgggagaccagaagttaggggttttttttttgttgcctgttgggtcaggctttttggatggtccaagaaaactgaatacctactcttttctgagctaaattctagggtagtcctgggtctacttggactaccctttagacccgccactggtttggtggcctgtttgtgttttcttattacgttgtctaaacctttgctcgacgtccgcgcgcgtatgtgagtccgattgccgagcgtcactgggaaagggaggtggaggatgtcgcgggctcaaatggtataatcgtataaatattcttaaacaaaaacagtttgatatgatttgtcatctttgatagttcttatctgaccctgaagagcccagtagaaaaaaaaaatctgtgacgatttacagaaccgccgaatataaggtgtgaaggacgactctgtgtactcacccgatgaacctgacgccgcgcttctgacaataagcataacgatctccatcgtcacaaatataagaaacaggcggtatctaaaagccatgatcaaataggggcagaaatgaatatctccgccttcaccgctagcttaatctttcttcgttgttctacatcctgctagtttccgttcaatataaagggtgtgaagaactcatatagcacgaagtcatcaccgaacaaaattttcaaacgccagctaccttccatgtataatatgtgatgtttttctccgtgatctaatctgttcaacgccctggtggaccagttactggacgtactaaggacctaagaagtttcttcgaaatattaaagcgttacagtacagctgagaactgactcacttgtaaaaaacgtttttttgcatacggcccaaaaggggattttgcttgcggtagggctatccgcaagcaccaaatggtcagcaaaaattgctatttttgcatgcgggtgcacccgcacataaaaatcggattttcgcgtgcgggttctgatgacgtccgcacgcaaaaataaaattatgaaaaaacaaatcacaaaccctagccctaaaagccacttactactagaaaaaacattttcaccactcacaacttagaaaaaacattttcacagacgtgaggtttttttccacaggcgggatgacttttggagtcaaatggctgcctatgaaaatataaaccggggtgaagctcgtcgttcgcctaaaaaatcattttttttctaggtggaccacttaattaagaggtccacctgcaaaaaacatgcctactgaaaaaaaaatttaagtcctatccttatcttctcctccagcatcttatcctctccaccactcattgccctcactctcctctctctctctctcatttccctctggctacctcccctcccctcccagatctggcggaggggaggggcgtcggcagtggcgcaggaagagggggcggtggcggtagcgtcggcgttggcgcggccggatgggaggtgtggctcccctccctctcctctccctcaactctactctcctccgccgccggccacgatgacgacgaagccgactgcgacgacgacgctgtctggatccgccgccgcctggattcagggaggggaggcggcagcgcagccggagggggtgtcggcggcggcgctgccgaacaggaggtgtggctcccctccctctcctctccctcagctttactctccctccgcggccggccgcaacaacaacaacgacgacgacgatgccaccgccgcctggatccagggtgggaagggaggccaccatcggccggagggggaggccggcggtgccgccggggggttggggtggtggcgcggatttcgctaaaaatatttttgcaggcgggtgtatctaccgccggccaaaatgattttcgtaggcggaccgcttggccgcctgcgaaagtcatatattttcgcaagcctttgcgtacaggcggttctttcccctgcctggaaaaactatttttggccgcctagaaaaacgttttttctagtagtgattgttgtcgtcctcgtcatcgccatcattgctgaagccgctgccgttgttgtcaccatccttgtcctcatcctcctcctcatcatcgggtgtaggggcgggcgggatccgcgcgggagaagaaaggggtgccagttccgctcctcacgttgccaccgccacatcataggggctggatccgtcgctgccaagtctccacagtgccagatccgccgccaccaagcctccccaccgccgccactaagtctctcgacctgcaccacctgatcatcccctctcgaggccagccggctgtggatccgcgagggaggcagcgaggcccatccgccgtcaccgtcgctgacctcctccgccgccaccggatccgcccctatcgtggccaactggttgcagatccaacctcttcattgacctgccgtatgaaatagaaaacacaatataagacccaaaatgccgagtagtgagcaaaggagatcatagatgaaatagcttgatagtcaactttaacctaagatttgcccgtcaaaccactgtaacactgtaagtagtgaccgaatgtgttatatatgccagggacttgactcaaaatgctaaatttcacgatcatctcaattgctcaaaaccgttagtccgttactcatgatcagctagcccaaggaagttactggcttcatactttcgtcttagccaagatatcaaaactcgtacaacttagaaaccactagatacatatagctaaatcatatatatacggtcgaccagccaatagtaaaggttcagcagaaagtatgtctaccttagttagaaccgtcttaatgatcaaccgttctagcatcactcaaacataagcaacaaatctattctatcaattagcatttgtgagttatgaattttccatgttctatgttagttatacgttatttaagttaaacttaattcttagtgtagtttatatctaagttcatgttaacgccaaaatttagttagattctttagtgggttcggttaaggaaagagcacaatcagccgatggaaatcttatccagaagagtccgagttcaaaaaggaatcatggggaccatgacatggcagcttaatttatctattaattaggcaagttttgattttagaaaagtttgggtcatgtccaatgaggactttatatttttccttttatctttagaaaagtttgtttagtgtccgatcaggactcatatctacccatggttacaaatatgtacacttggggtctctgtaaagtatatccagatcaatacaacttcggcgcatagccaccctttttattttcgtctttgttgacgagttcttgtttcgaattgggctacatcggctttgatctccgacgaggagtaaggcttgttatggctgtttatattggcggggctagggcctcgacattctaatcttgtcgatgtaaacacctatttataatatatctcagttaatctaagttgatgtctcaatttacctgtatcgtctagatctttagtagggttttgttggtatcagttaaattgttttatcgatccagattagctaaggtatccaccaccctgaaaatcagtcaaagacttgattgtttagattttatgtttcttttcatacttagtgctgcatcaattgagtttgacatactaagtcatgcttagaatcatagaaactaacttgccaataagggtttcatcggggtttcacacccggagatttctcctttcccttagtttttaattctttaataaatctctcgaagaaaacattctgtctaacctggagcaaacctcaatttaataatgcacgttataatcagaattgccatgggaatgttttttggtagggatgaaaacggatcgaatacggtcggaaactagctctaccatattcgttttcataattttttttggaatcgaaatcggaatcagaaacccggatatgaaaacggaatcgaatattatcgaatacaaatacggagcgaatacgaagcgaaacaaatacggtgacgaatattaatcggaatataaaaacctctcactactcacaaacgatttttgatattgtgtttctaaaatcatgctctatcatgttattgtgtttttaccgctattattttggcaattttttcgtgactttgttttatcaattaaaaatttgaatttcaaaacttcaaatgatattttgaagcagtaaataaattcagctaaaaaagtcatgaacataaaagttgtagaactcatcaagacatacaacttttattttggtcatttct

SEQ ID NO: 76322 - DNA, 7049 bp, Oryza sativa
catacaaccgggcatatgctagtaacgacaatatatactacatgtcaatattgtacgtacctttgactcgttgtgctatgtacaggctcttgactactcccaactgagcttagcagtggtcaacattaggttaacattacatttttacaatttgcacgttgtcacttgtcaggttagttcacattatttaatcattgaaagctcaatctgttacatttgcaggtacacttgattagttgattacctgtcctaattcacaaaaggaccgagtttggcagcagacaagagatgtaccaccagctcaatccacgactccacgtgtaactgaacctgggcccgtttagttcctcaaaaaattttcccaaaaatatcatatcgaatctttggacacatgcataaagcattaaatatagataaaaagaaaaactaattgcatagttatgagggaaatcgcgagacgaatcttttaagcctaattagttcgtgattagccataagtgccacagtaacccatatgtgctaatgacggcttaattagtctcaaaagattcgtctcgcggtttccacgcgagttctaaaattagttttttcattcgtgtccgaaaacccctcccgacatccggtcaaacgttcgatgtaacacccaaaaatttactcttcctcaactaaacacacccctagtgtactagtgtcctgcccaaaagtattaacatttcacatgataaaaataacaaaaggctataaatagagcatagctgcagacgtacgtgcgtggtgcacaagtatacacgttagctaagatagtactcatattatgtttcagaatataaaacgtttctactttggtcaaagtcaaactgctttatatttgactaagtttatagaaaaaaatagtaacattttcaaccaagacaaatttattatgaaaatatatttaattatcgatttgatgaaactaatttagtattataaatattactatatttatctataaacttagtcaaactgaaaatagtttaactttgccaaagtcaaaatatcttgtaacttgaaacggagggagtacatatataaaaaaaataatgtgaaaatttcttgagcagcctagctctcctggaaagaaaacaaaacaaaatcttaagcaaaaaatgattaaatcgatcgatcaggttaattaagaaataagcacggaataagacaagcatataaacatcaactgtatagtggtggcagaagtattttaacacacaacgcacgcgcaccaatctcatttctagtttactccaaattaaagaccagtcagaattttcgcctttgcaaaactcctctcatttcatttcctcccaagagtcaagctagcccttcttgcttgctccgttcaacgcctcttccccagcttcacagtactccatgtctggacctggaggaggaggtcatggcctctacgaggatcatcctgcagccgccggcttcctccccttcgaccacgacgacgacgtggtggccagcttcttctttggcagatcggcggcgtccggaggaggagccggcgccggcgccggcgctggagacgatgatggtgttgggctcatcacgccctactccagcatcacggattatctgcaaggcttcctgcaggaccccgtgtacgcgtcgtccccgttgggcggcgatgctgccgtgaagcacgaaacggtggtggatcatcccagtcaggccggcggcgtggcggcggcgccggccacgccgaactcgtcggtgctgtcgtcgtccagcgaggcggctggaggggacgatctgcgccggtgcaagaaaggtcgtcggccggaggacgaggaggaggaggagattgacgatgagggatcggccgttcagagttgcaagtaagttcagtattaatttgatcttgttttgtagctagatccatgctgaatttatgtctgatcgatttatcacacgtgcatggctagatagatcttggatgaattaattaatttggcttcggtgtgtacatgcatctacctacctagtttttaattcatcgatcggtacaaattaattaactttacgggtctgaatacgaagattccgtgtgtgtatataccgcgtgtgaagtgttaacgtcggaatttagggtttgttccctcccttcttttcacaataatttgttgaaaccgatcttttcacaataattaacaatatatatatatatgaattaatgattaactgacgagactagcgatcgatgattaacaaatgattcacgagacagtagcaatcatgcaccggctgatatatatgcgcaagaggccaatatctcaactgagacagcatatgtcgatctcgatcgatcgatctggtgcgtgcaggacgaacaaaatgaagaataaaaaaggggcgaagaaggagcgtgagccacgtgtggcgttcatgaccaagagcgaggtcgaccacctcgaggacggctaccggtggcgcaagtacggccagaaagccgtcaagaacagctcctacccaaggtcagctagccaaattttcacttgcatatgcattattctccatcataattggcatgcatatatttgacagaagcagctaccacagcattagcaacaagctaagcacacattggcattggtctgagttttttttttctcagaatatctcgatggatccatatgttagaagtatatatctacgatggacagttcttcacctaatacctgcgtcttcttctgtgtcgtcacttgactcttctctattccaacgaatgcaggagctactaccggtgcacggcgccgcggtgcggggtgaagaagcgggtggagaggtcggagcaggacccgtccatggtgatcaccacatacgaagggcagcacacgcacccgagccccgtgagctaccacatgcacaggcagcaggggctcatgcatgtgagcgcgcgcggtgtcatgcccggcgccgccggcgcctaccagttcggcgcgccgccgccgccgctccttggcttcgacgaagccctcgccgctcgggtgcgaatgacgatgaaccagcagcagcagcagcagcagttaggcttcgtgccgagcatacacgccgccgccgcccggccgacgatgcctcctcttcatctctacaccgcgcagcaagacctcttccttccgtgacaggcagtcaccacggctattgatattagatctttcttatttacggtttacagaatgcatgctgctcgagataaatttgtgcgcggctatatatatatggttacgttaccgatgaccaagtgaagtgtgggatgcatgttttgtgtcctcgtttttttggttggtctacaaaacatgtttgtttgagttgcattgctaagtgcctagctagctatataaacactgtctttaattccaaactgtagatcatgaggaatttgggtcttgttattgatttgaattctgatgtgtcacgccccgaactagtaccgaccggaactagtctgtgacgctccaatttaacctgttaatcaataccagtcccaggacacagtgctggtatcacaggaagacagattatcacagcaacagaggtctctttattatagagtagatgtacagtcatgttgggctgcggacagatcccgagctcacaactgcattacaaaagggaaacggaagccgggacttggaccaaacaacacaggcgcgacttgggaactaggccgaaaccctaaaactcatcgtagccggcttgctcctggaagaactcctcatcagcaggatccgcttcgtcttcttcagcgactggggggggattatttatatagagcaagggtgagtacggggagtactcagcaagccaagggaaataagtgtttaatgcaggcttcaaggaaaggccgttgtttttgcaattgattttagttgaactcctttctgaaaacaactaagtgagtgcttctcaaacgacacggttgagacagtgcgtctcgtccggtcggagtatgtgtaatgtatcggtctttagacttgattcaaggttggcatccggccaacagcttttcaaacggccacccgggcctacaactttcaaacggccacccgggcctagctgatcccatcagctgcagatttttcaaacatcgaacccctttccacaatagcaatttcacaagcagtagtcaaacaaaactacgctaggaatcacctcacatccgcccatgaccgtgggcacggctgttcgaacagtttgttaacctctgcagaggggggtacactttacccacacgacattactaacccggatcacccagcccgtggggatcagccacgtcgggagacctccaagctttcatgacaaggcatttccaaagccgatacaggtttaccatatgccgacgagaggggtcccagaccaacaacaggttaggtcccagaccatactgtgccaggaagcccaggggtcctccccgacaccaccccagcgaatccacatgtctctcgacatcaaggctcccctgataagctagttactcagccaggggtgtcccattccacccatgtggtcgtacttgtcttatgtttagatgaaattccaaggaatcggttcttaagtgcgagagcgggaaaaccgtacacccggtacgttccccggtccgcggttttggaaattcatttagttcacaagcaccgacctaggtgtcgggttttccaagtcttttgtaaaactcaagttttacccaagaagttgctcagattttaaatttgaaggcgcccttcggtactcgcacagattgcatgatttccgaggcgcaactgggtggttacaagggcacatggtataacaattaacaaaggaaggatcaaatgcaacaaactaggtagatccgccaatctgccttgcagacgggacaacagattaagtgcgatcctatcaatgcataatattttgcaagcaacataattaaatttcaaatataggctcaagatgttcaaaggtggcttgccttgctcgagatctggagcttgatcctcgaaatcctcgcactgcgggtcttcgggctccggaactacacgcgaaacgggacaactcaacaaacggcgaaaatgaagccctaataatgacctctaagcgtgccattagatagatctcgagatttgaggaattttggaagttgaacggagtcaaacggatctacggttgggaagatattgaatttctaagattattggatttttggtctaaaggaaaaggatttaattaaatcctttttggaaaagaaaaagaaaagaaaagggaaagagggagggattatagacttctcctcgagcggctagggcgcggcccaagggaaaaggagcggactggccgagctaaatgggccggccggcccaaggcggcccaagtgcgcgcgggggaggggaggagagagagggccggtggaccgggctcaccgtgcgcggtcccgggtgggacccgcttgtcagcggctcggctcaccgtgcggagggagcacgcggcgcacgcgcgcgggcgggggagggacgcggtgcacgcgcgcggtctgcggaggaacggatgcggcgggcccacgcgcagcctcacggctcgcggtggaacgcgtgcacgggaggggctgaccggggtcggcccgtcccgacctcggctgagctggcgccgacgtggcgccgacgtggctgccacgcgggccggcgggaggtagacgacgacgccggtcggaacggatggcggacaacagcggcgagcggcggagcgaaccacggcgataccggcgaaagcgagcacaccgggtggttgcacgagacgaggggagacgagccaacggctcggattcgccggaggaagcttgacggcggcgaatcgcggcggcggcaaccggtggggagggaagagggaaacggcgacgaggtcacgaggggccgattcccggcggtgagagcatctacgcggccacgggaatccgatgctagcgtcggattgggcggagctacgccgagcgaggctggcaacgagcgggtgctacggagctcgagcggcgatggcagcgagcacacggcgggcgacggcaacggtcggggcggcgctggctagctacggggaggctactcgtgctaccaccgaaaactaagggggggagatggagcgaggaggaagaacggagggaggcatcaccgaggtgaggaggggcgctgtgacgagaggccgacggcgcgggagggatctctccggcctcgggccggggaagaggaggaagacgagcgcccggagtccccttccgcgtcctagtgcgcaccggctcctccggcacacacgcgacggctgcggtcggcgagagggacggcaatggcgcgggcgagaaacagggaagaatgggagaaaagggaagggagggcgcttgggtttatagggggcggcaatgtcggtttggaaaccgactttggcggtcaaggcgcgagctgtcgctccggctagcggccaaaacggcgacaggagggagggaggatgacgccggcgggaggaaaaggggaaaaaggagggagagaaaggggggctcgcccctttcttctttgggaaaattgggaggggagcgggggcgtcgcggcagagggaggagggctcggcctccgtcccttggcggcttgcgcgcggagtggcggggccgaggcgatgacgacggcgatgacggcggggcggtttggagcggcgcgacgacacgggcgacaggcgtgggctggcgcggcagagggtgacggcggcggcgaccagatggtcggccactcggcacgcgcgcgcggcttgcaatgggagggcgcggcggatggagaggcgcggctcgagcacgcgcgctggctgcggggccgagcggctgcatgcgcggcagggcagcggggccgggcggcgcaaacgcgaatgacgcgtggggagcggcagcgaaggggcggaaaggagggcttggctcggcgcgggcggctctcgcgctcgcgcgcggggcgcgcgggcggagcagagggagagggaggcgcgcggcgcggcggctc

SEQ ID NO: 76323 - DNA, 10323 bp, Oryza sativa
ccgggccacccccgggggagatgggccgagagggaattggcccatcgaccccgggggaggcaaaatagacttttgcggaggaaaaagatttggaagaatttggattcggaattgaactcaacgatagatcggggattgagatcttgagatggcacggacactagacgacaagcgaagaaacaaatttcgcaattagggtttttaagagataattttcccgctaggcgccacgacggaacgggcgctacatgatgctattaccttattgatctattatccagtggatctattaccttatctttttggctgtgtatccacggacaaaggccggagatataatttatttccattatcttaaaaaaaattgtccagtggatgggccgggcattggtcgatggagctaaaaacggggataaagacgaacaggcgtttttggcaacagctcctcgatccccaacagccggtgcagtgagactagtcgcgggagtacgtgcgcggccgtctaaacacacgatcgagacgtacgcgcatgcagtacgtcggcgcctggctgctcggctcgccaatgtgtctgctgcgccggtgggtcggtgggatcgacacagtacgtctcgatcaatcgtgcaacgcgcgtccatgctccatatatcggcacgaggtgcccgcgcgcgcgtagaccacgacgtccgatgcgagagcgctgcaagtggccggcgagctccttccttgccgatgggcagccacagcccacacggcgcgatccgcgtggagggagttcccactcaacctcccttctgcgtagggaatgagatcctctgcagtcactgcactttacctttgttactgacatatgggcccagactcatatgggcccacatgtcagtgacaaaaggtagaaagcagccaatgcgtgtccatgatccatacattgggtgatgagaaaaggctggaaggctggccttgtttggatgggcccaattcaggcctatccacgtgtgggacagcactaattctctttacttttgtttgctataaaatgagggggaaaagaaaaatatgagattacttggactgtaaaatatagcgttccggagtccgaagcagaggttcaccaacattcccgagcgaaaaaacgaggttctttgttttcgtgaaaattgtttgaaaatcattgattcccgataatatccgatcaaattttatcaattttttcccttaactagaacagaaaaccaatcggtttgtgttctcgagcagaccgaacatccggttttcgaaagaaaagaatttggctttttttggtttttgtaaaccctgctccggagtacaggagagcaaaataggcctttttctgatcgaaaattcgaaataaggagctccgtctttataagatttgtcttttgcttctaagtccttgttattgaatatactgcattggtagtttggtacaaagtgatccttcggtattgccctctgatcttggactgaacaaaaaacaaacctgaataagctgccttctagaggagataatcccaatgaaatcaggatagtttatcacgatgaattcaaccacaccagaagaaaaaattatagactcaaatgcttgtattcctcgatgtactctgctcgattctaaaatcagattagagtttgacaccgcaagagatgaggccacaggttggcctccgccggcgcccggagtgcggagtcaggccgcgcgcttcatcccgccgtggcgcccgaatagccccgcctgcaacacccaatcctcgatcatctcctgcgccgcgcggccgttgtccgccggcatgaggtgcccggcgccgtagacgacgacgtgggagagcgggccggagcgctgcacgtacccggcgagctcctcgccgatgcgccacacggcgcggtcggcgtcgaggaaggcgggcaggccgtcccactccagctcccgcatccacgcctccgtcgataccacgccgtccctgaggtcgcggatgccctggtacagcagcacgcgcgttccccgcagcagcgcctccacctccggcttcacgctcttcatcacgtccccgtgcatcgccgcgcccaccgcgtcgctgcactcctcccactccacgtcgccgcgcgcgcccagcgccgccttcacctccgcccggttcacgaacttccccacggggcccgtctcgtaggggcgcttcttcgccgcgtcgaacagcgtcgccaggcccgtcgcgttctccagccacgacagcacgagccccctcgcgtcggccgcctcgctccacctcgccgcgttcgtcagctccaccgccctcgcctgcagcgcctccagctcccgcttctgcttggcgttgatcaggcccatgaagtaggcggtgtccgcgtgcgtcgccacctgcgcgacggggtgcgtcagcccgttgccgatggccacgccgtggaggttaacccgcagccgcgtcggcagcgtggggttcacggccaggatgtacgacccagccgccgggatatacttgccggcgtagctctcgccggtgaggaagaaggggcgggagcgggagcccggctggagcgcgaagaacgactgcagcgcggcgaagaggtgcgcggcgacgacggactggttggtggggatggcggcgggggacggcgcggcgctgaagcccgtgccgagcgggttgtcgatgaagaggagaccaaaccggcgattccacgagaaggggttgggcgagagggagagcgcgtcgcggttgacgaagtaggggccgagctcgaagaaattgccggcgaggccggagcagccggggccgccctggagccagaggaggagcggcgtggaggccggcggcgtgagcgggtgcgtggcctcgtagtaggcgaagaagagcgaggcgttggttgtcgtgatggggaggtagccggagttggtcggcagggcttccttcgggaacaccgccgccgcttcagctgagggtgtgatggctctggcgctgacgaagccgatgagcaggagcgagacgaggagaagcggcggagccattggtgagtgaccgcagttgagatgggaacaggatgagcttgtcagtctgtggtttgtggcgttgaaatggcagtgaatgcaccgatcaatcagctcagctcatgccggtaataatcagatattcctctctgtcctagtaaaatataaaaaatataagcactttacttctaagcggtttccgaaatgctattttgttcaacaatatctagttttaaataaaaagagttacatattagtttgtttaataataaatctagtaataacaattttatatgattatttcttttcaattttttttattaatagtcaaagttacaaatatttaatttggtactatggccgagtttagttttaaaatttttctttaaactttcaacttttctatcacatcaaaacttttatacacacataaatttacaaatttttcataacatcgtttcaatttcaaccaaacgtttaattttagcgtgagctaaatatatcttatattaaaaatgtttatattttgggacgaggaatagagatagtacgacaagatgtttgtgtctcactgtgttttgtactgtgcggtgtgtctgtgactctgtgcctgcctgtttgtcattgacgagagatgactttggaaagtgacacgtcatggccggggtgtggttgtggtgtaagcggtgattacaacaagaaaatgacatctgaattatgatctgctcgtccgtctccgcgataaactgaagcggggatgatatattctttgccaactgctgcaatttttagttttaaaaagaactgctgcatttttttggtcgctggtttggtccgttcaagggcataaatcaaaccaaataaagcccctcaccaaccctctgccactgggccttgcgtcacttgatgaatccatcactcgttgccattgattgctctcgtcaattctttaccttccaaagctgccgcctgccggattgccggatgtgtgctggcgtgcaggatcagtaccgcgcgacgtcgccacgggtgcccagcacggccgtcacctcgtcgcctcgtcggtcctctgctgaagtgatccatcgtcagcgtacggtcccgtggattttgggcggcagccgatggtaacaacccatttcggcccatcagattttggatcgctgcgagatatccgatggtgcattctcactctctctactgctcacactgagggcccgagaagccttcgcggccggaacggaagagcgagaccgacattgaaacagcgatacgccgatacctgacgaataaaaattgaaaatatccttttttttttattaataatttacgtttatatacatacatgagatgaatttgcgaaaatatacctaacccgcgatgccggcatgtgggagcgacgggcaagcgcaggttggtcagagcgggacgaaggcccgagcggtcacgcagggcagggcggcggcaccggctcggtcccgcagggctgttgcgcggtaccggcccaatcccgtggagcagcggtgccgcatctccgccgcgcgggaccgctggcgacgccgcatggtcgaggcgcgggaacggctcgtcagagcactgatcaataaaaaaaaaaagcaaatcctcccggcactaaccacgtactgagcatgcttcaagccctaatcaatcaactcccggcactaaccacgtactgaatctattgcatgcttcaagcactaatcaatcaaaagaatagcaaatcctccggcactaaccacatataaaagaatctcttgcatgcttcagctgtatccaatggccaatggtgtacagggtgctgggggagggcgtcgccagcggtcccgcgtcacggagatgcggcaccgctgctccaagggattgggccggccggtgccgcgcaaccatccagcgggaccgagccggtgccgcgcttcggctctaaggaaccgagccggtaccgcgtggccctctcctgttccgcgggagcgcgccggttccgtttgtctaagccgcgggaccgacgctgtctaccccaccctgcgcgaccgctcgagcctccggtcccgcacatccaacctgcgcttgcccgtcgctcccgcatccggcgtcgcgtgttagttatattttcgcaaattcaccgcatgcatgtatataaacgcaaattattaataaaaaacggatattttcaaaattttttcgatacctgactgccaccgaatcaattagtgattaactatcctaattagcgattaattaattattaattaatcactaattattattagttaatagtaattatgtacttaatcaccaaataaatggagccggttgacactgtcgctgattgtttcaacgactttcgcccgcgcggtctcgcactttcctggcgtgataccgtctgcgacatctcgcttacgtaattttcgtataatggttgtacgagatcgacgatatattttcgtcaaaaattttgcatccggaatattcgtgaaaaaataaataaaaagtatattttcaaatctaattccacaaatatagctagcccctttattatttatttatttacttatatatgccttgaaatgatgttcaggttctagacggtgcccgcgctgaataatccctttctgaacacccaatcctcgatcatctcctgcgccacgcgcccctgagaatacggcacgaagtgcccggcaccatacacggccacatgcacgagcgcgtcatggcgctgcacgtacccggcgagcccgcctccgcttcgccacacggcgcggccggcgtcctggaacgcggcgaggccgtcccactccagctcccgcagccacgcctccgcgcacaccggcccgttccccacgtcgcggatcccctcgtacagcagcacgcgggtcggcgtcggcgtcgccgtcggcgacgccccgcggtgcagcagcgcctccacgtcacgcttcgcgctcttcatcacgtcctcctcctgcgccgcgcccaccgccgcggagcacgcctcccacgcgacgtcggggcgggcgcccaccgccgccttcacctcggcggtgctgaggaagtccgcgagccccgcggccatcaccgccaccgactgctgaacttccacgtcgagcagcgtcacgacgcccgtggcgttctccagccacgacatcagccgcgcacgcgcggcggacgcctcgcgccacctctcctccctcgtcagcgccactgcctccgcctgcatcgcctcggccgcgcgcttctgcttcgcgttgatcaggcccatgaagtaggcgatgtccgcgtgcgtcgtcacctccgcgacggggtgcgtcatgccgttgccgatggccacgccgcgcaggttaatcctcttctgctccggcaacgtcgggtttgttgctactatgagcgcgccggccgcggggatggtcttgccggcgtagctctcgccggtgaggtacagagggcgggcacggaagctcggttcgagagagagaaacgactggagcgcggcgaggacgtggtcggcgacgacggactggttggtggggatgttggcgggggaaggcgcgacgctgaagccggtgccaagcgggctgtcgatgaagaggagaccaaagcggcggttccacgcgaaggggttgggagacagtgagccgccggcgaaaaggtaagggccgatctggaggaagttgctgaggaagccggagcagccggggccgccctctagccagacgagaagcggcgtcgtggccagcggtgtcaccggctcggttgcctcgtagaaggcgaagtagagcgaagcgttcgccgccggtgggatggggaggtagcccgacttggtcggcagggctcctctgggcaataccgccgccgcggtggcagtggcagccgtggccgagagtgagacggccacaaatattacgacgtacacgaggtaaaacggccgggaaggaggtgccatggctggatggaatgatttgtacctatgggcagttcagttgtgcttgagaatggcactgtcacacacacaaagccttaagtaggagtatgtgtattgtcggaaattctccgaagcgtgtattgtcgtgtaatagctgagaattttctcaggtgcaagttcttggaagtgtacctgatgtgatatatgtaaggaaatacaaatgtttgaagctaaagtacattatcatcaagtagtcaattgagtatttgttccaagctgacatcgttacccacagcaagtcaaacaagtgactagtgagccaaaacgcggctgttttgcgcgtgacagatcaaagaaggccatacatatatggacagaacatatgttctccgtttcctggtcagaggagagcagcatttcttaatttcttatttggtcaggtcaaacaacagatgtcaagccccgcaaaaaaaaaaaatgtcaagagcctaaactgaatcactactagtcattagcaacacatactctttgtgacccatacatattgtttactgatataaaaaactttgcataatttttataggattagtatattcaatctccgctagattcctgcaataactatacatttaaaatgacctttaatttgacatatatattttatatctttgaaaattttcaattttctctcttgttttataacatacttattagaacttaattttgtacatgtacttctgtaaccctaagataaaatctatgtattatacttatgtaagtctagggggaaactattttgatccctcgaggagatatcccctcgttgtttatatgtcacttaaatggttatgaaaaaaattgagaagatgtattaacatgtgatatatcactcgactgtggaacgaaggctgattttatattaaaatttgaatagagtgtttgcattacaaatcggagataaattcgatgcggggttcaaagaagatctttcttctttgcaaacgttattttaaaagtcagcaacatcatttattaaaagccagagataacaacaaggtccatcaaatgtaccttgtaaaaaaatagagtaaattttaaaaaacagcaacttttactcatgctattataaaagttatagttttgtggtaatttctcatgctattgttgcagcaaactgaaatatgtcgctaatgttgtagcaaactaatagttttatcactaaagttgtagttttctgaaatttactctaaaaaatatagtgtcatatcacatagaaggatttctatttgaccaatcaggagctcatcaaggaaagtggaatccatttgtagcaatcgggagacttctagaactatagatggtcatatggcccgaggcccgtggcccgacccaaggcacgccattttggctcggcccgacggcacggtgggctggcccgacacggccacgattgaagaaaaatagtacagggatgcaaaatagacttaaataaccatataaggcaaggcccaaagagtagattaatacaaaatagacttatttccagctatacgacacaaccgctgagttgagggatgaaaaaatagatttattatgtggagaagtacgatgggctgtcgtgccttcgggctggcccggcatggcttgagtcgtattgggccgtgtatgtagctcgtgggctagcacagcacagcccggcgtgtcggtcaggccgtgccggcccaactaaccttggcccaagcacgatcgggcatgggtcgtgccgtgccgggcggcccatttggccaactatatctagaactcacgtgcctagtctttttaaaagtatatttggttgatgaatcggctaatcaaataaagaaaaaaaataaatgaatgtgtcaatcttgaatttataaggattattaacctctatgattaaggagagaaatgggagggagggaggagtccatgcggaccgggaggaagaaaggaggatagggtagcccgtttggacagtaacagttgggaattttcatgggagagtttgtgaaagaaatttaattattttggaattggtttaaattcaaactggattatttgataggagtatcaggcaatctttggtaaattttggaaggaaaaatctgatggacttggcattggatccaaggagatatatatttagtgaataatttcggtggaaaaattcgaattgtgaaattcaaccttcgaggttagaatttggatagaaattttgggattagatttttgggcctcaatgagggattttgagattcgttggcacttaggtccttttcaaaaccattctgacaaggaaaaactgtaattctactagctcccactgtaggttgactctaatttatcctcaagtgagtatatcgattcatccaactactaaaaccagttttgttacgccgagaagacattgctgccgagatcctacatggcatccagttccaagcgcggacttggggatgaactttgtgagctgaaatgatctagcatgtatactacaccaaggaacgatggaaagaggcaaggcgcattgatccaaaattttatttatttatttatttatcataggtgctgaaatgatctacgtataaactacagagcacaatacggtgtgtacggccgtggcagcggactaactacatattctctccgtttcataatgtaacactttctagacttacttcatatagatattaataaatatagatatatatatatatatgtatctagattcattaatatctatatagatattagcaatgctagaaagtcttacattatgaaacggagaaaatactccctactataaatgaagaaacattttgccttacgccttcccgccgctggcgccgaacaatcccttgccgaacacccaatcctcgatcatctcctgcgccgcgcgcccttgagaaaacggcacgaagtgccccgcgccatacaccgcaacgttcacgagcgcgccgtggcgctgcacgctcccggcgagctcgccgcctcggtgtcgccacacggcgcggtcggcgtcctggaacgcggcgaggccgtcccactccagctcccgaacccacgcctccgtggacaccggcccgtccttcacgtcgcggatcccgccgtacagcagcacgcgcgtcggcgtcgtcccacgccgcagcagcgcctccacctccggcttcacgctcttcatcacgtccttgtgctgcgccgcgcccaccgccgcgctgcacatcttccactccgcgtcgccccgcgcgcccagcgccgccttcgcctcggcgccgttcagcagcggcgcgagcgccgcggcctccgcctccagcgacgtcgtcacctccacgtcgaacagcgacggcacacc

SEQ ID NO: 76324 - DNA, 5660 bp, Oryza sativa
  unsure (1)..(5660): unsure at all n locations
cgcccatcgaaggtatgtagctcactattttcccaagccctaaaatctctcagagaatttgtagtattattccgtgggaacgaatgaatattaggctgattaagtgattagttgctatcattcaaagaaactgtatattgtgtgagttttataatttgtcatggtctatatatgcagatagaagtaatattggaatcagccaatctgattccaaattctcgaggagacatcctctcgttatttgcatatcatttaaataattatgaaaaaaaattataagatatattaatatgtgataaattagatcactccacaaactttgcagtaatacctttttcatacgtgcaccagacgaatgatgtgttaagataagagagatgaaaagttcctgagtatagatgacataattaaaatgtctatgttgataaataaactttttccttcctcgtacctttgacgaagttccttgatttctagcgaataaatatatccgccttatacactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtaacacgtggctggctgagccatctttagtcccggttggtgttaccaaccgggattaaagatcgagctgaccttttttttttgcgaggccccgggggtgcgtggtttatatatatatatatatatatatatatatatatatatatatatatatatatatatatatatatatatatatataaaccatgcaactatatgtttcaagacatatatatgcatacatatatatatatgtatatatatatattatattatattatatantatgtatanacatgcataatatatatgtatttatacatatatatgttatgcaantgcatatgtatatagatatatatatgaccanaatatatttacattataganaatgtgtacacatgcatatagaaacatatgtagtcatgtattaattacaatccattatatgtcctagctagctacgatttcaacgtagtagtagtcgctgctagctcagaagctaaggaccggtgaattgtgtntccgtcgtagtagaattcacccttgggatcaaggatttcttcgttgatgaatcccatgagttgttcttgaaccgttgcgataaattccttgtgtgtggtcaagttatccctcatgcgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcacacacgtaatagccgcacaagttagttccctgcttttgctttgcgcactacaaataaatgacaaattaacggcgtgagatctaattaatatacagttgtatgtattaatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacagaggaacttatgacggtacctgtctataaattcgaaaaccttgtcaaacgtagactcttttttatccattgagtcatatacgttgatggtgcaggccgacaggtcgaagagtaaaagcacccagtggaatctgcaatgtgcgtgggatgcattacatatgaaacacttagcaagttcgtacgggaatgaaatttggtatgtaggaagacagtaaaattgaactaactctgtgttgtacggcaacagtatgaacgtcttgtaatgctgcgccttcaggagatggacgagattgtcctctgtttcttgtggatattggtcgagcattgcgacgtttactctccgagggtcgatgaatccagtatcgaaaaccctccgccgtcgggccctttgaatctccattctacaacgataaaagggagtattttattttatatagtctagttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaatggctcgatctcctggtttggttgctctccaagctgagggactggtttggactttccagaagatgctttcttcagcgttcgctcatagtccgatagcttgatggcctccttgacagatgcagacatacccctgaagaatttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcgatggagctgggggggcccttgactttgaagggccggaagaggagcttgcggaggagtaggtgtaggagcccgaggaggagtcggtgcaggatcctgaggaggagtcggtgctggagcctgaggtggagacggtgctggcggagcatgaggaggagacggtgcaggatcctgaggaggagatggcggagccagaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgggccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatagcgtccatgctctgtgatcctacctgccccgttgaggcgcaactgctacggtttcctgacgggctcaccattgcaggaggaatggtcggctggggatcatgggaccgatgtgcggccatgcgttcatcaaccttccttgccacctcctcttgcatgttgagttcgtaactcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcttccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatatgacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcgaagtaacatatatatatatatatatatatatatatatatatatatatatatatatatatatatatatatatatatattgcatttcacgttaacgttcgtcctcgttcgttcgctcgttcacgttccctagctcgttcacgttccctagctcgttcacgttcgttcgctcgttctcgttcacgttcgttcgcttgttctcattcacgttcgttccctcgttctcgcttgtcttcgttcgatcgttctcgttctcactctcgttcgttcgatcgttctcgttctcgttcacgttctcgcggcaatgtacgttgacgtgttcgttctcgctctcgttcgttcgatcgttctcgttctcgt

SEQ ID NO: 76325 - DNA, 609 bp, Oryza sativa
acttttggtgtaccttgcctcctgggacaaggaataatacacgcacgtcaggaacgcctgttgggtgatttccggtcgtgatagctggccccaacgccgccaccgcgcccccactctgccgggtccccacgccgccgccgccgccgcgcccgcacgccgccgggccggccgacggcgccccgacgccgccgccactgcacgccactgccgcgcgcgcccgaacgtgaccgaacgcgagatacgtggacgacctttgaacgaacgcgaatgaacattcacgaaacgcgaacgatacgattacgaaacgttaacgaacgcgaaggaacataacgaaacgttaacgaatgcgaacgaacatgcacgaaaggttaacgaacgcgaatgaacatgcacgaaacgttaacgaacgcggacgaacgtaacaaaacgttaacgaacgcgaacgaacgtgaacgatacgatcacgaaacgcgaacgaacgtgcacgaaacgcttacgaacgtgaatgcacttgtactaaaagtgttagaacgaacgcgtttctacttatacgatttactggtaatacatatatgattatatatgtaacttggcccatttagactaata

SEQ ID NO: 76326 - DNA, 8429 bp, Oryza sativa
tgtgcctgtcagcacggtgtactggcgcagaacaagggcacgcggggatgatgacagctttgtcccggactcagagaaagagatgttgtggaccacaatgctcgagacgttcacgctacccgcgggtacggataacttagtgaaacagtggactctgaagaaaatggcggaacagttccagagcttcaagggagatctctacaagaaatacatcctgaagggactaacaccgaacttcgacgtattcccaaagctaagggatcattgggacgagttcattgcttacaagacagggcaacaagggcaagcgatgatggccagaaacaaagaaaatgccgccaagaagaagtaccatcaccacttggggtcaggcggatatagcgtcgcgaagccgaagtggaaggagatggaggctagcttgcttgagaggggtatcgaaccggccaccgctaattggccggatcgatcgaagttctgatactatgcccacggtggaacgcttaacccagttgatggctcccttgtcttcagcgatcagatacgcgaggctgccagtcgcgactaacggacgcagtggtagcctcttctcagggcacattccgacctgacagagagaaggatgagctgtcactcgccctacagactcccgagcatccaggacgaacacgagggaaaggcgtgattccctggaagattggatttaaggaggacatccacacgtacaggagtcggatgaggagcaagagagataccgaggcgaagattgcagatcttgagtacagggtatcgagctacgagctcagcatgcaagaggaggtggcaaggaaggtggatgaacgtatggccgtacatcggtcccaggatccccagccgtacattcatcctgcaatggtcagcccattaggcaatcgtagcagctgcgcctcaacggggcaggtcggatcacagagcatggacaccatgcaaacccaggacgaaacctcctgccccgttgatgagatcacgcagcggataccatgtgagctgcatattcccttcaagaacttatcaatcaaggtatgctcgtagtttgatgatttttgacttgtacattccgcaagttgctgcttaggttgattactaatagatagcctctcatcacgtgaaggtggcgtcggaaatggccgtcccaacggacccttccgggacttaccactgcaggccgattccagcaggatactcgagggtcgaagttgagctggtggaagccttgtacgaggacctcgagttggactacccaggaggggacgatgagacgcatctacgagacacaagccacgccatcatactatggcgcaagcggtacatcatccttcctgggcgacaagcggcatttcgtgcaccatctcctcaggctccgccatctcctcctgcaccatttcctccgccacctcttattgcaccatttcctttgggtcctccgccacctcctggtgcaccatttcctccgtttcctccgcctcctccgggtccaccgtgtccgtttgcacctcccaagacaaggtcttgccaagctccaccgcctggccgcacaagggcaaggaagaaggcgaaagttgacacccccaaaaacaaggagcccccatacgattgcagtcaagaggagcttgatggttatgtggcaggagaggtgaagaggcaactcaagcctcggagtcctgaaaagaagatacctattgacccgagcgtgaagaaattcttcaagggaatgtccaaaacaaacaaggaggcgttacagatatcggactatgaccgaacacttcagagagcctatcacaagaagtccaaaccagttcctcagcttggagaacaaccaaacaaagaggtcgagccgttggtgaccggcgaagattttggcataacggatttcattgcagacaccggtctatctgtggatcagttggttggagccgcactaatcccgaaggcggaagtggcatacaagtttgaactcggtaaaccgcttgtcaaacctgaacagctggagtcccaaccgacacagatgtacaaattccacgacggtacatggaaatgagcgccaacggtagagagatgttcggggcgaggatcagaaaccctgacttcttgcaaggagacgatgttctctggatccatttcaaggatctcttcgatctgtaccagttggatgccctcgacgtctctctcctgagcgcatggattttgtgagtatctttgagttcgatttgtttcgttcaataattagctcctggcatatatgtaagcaataatactttcctttcatcgttgcagaatggagattcaaagggcccgacggcggagggtctacaatactgggttcatcgaccctcagaaaatcaactccgaaatgatcaacaagtatgagaaagacacagaggacaatctcgtccatctcctaacgcagcagcatttctagacgtacatactactgccgtacaacacagagtgagtttttattgtcattcgaacaaatttcattcccatacatatagcatgtacattttcgatcatatatatctcatctcacgcatattccagattccactaggtcatgttattcttcgacttggatgcatgcagagtcactgtgtacgactcaatgaataaagaggagaagatttttgacaaggtcttcaaactgatagacaggtaatataatgccatctattcgaaagtcgcggggaatctattgctattatgttgatctcaggtaataattaattaatcattgcttgcaactacatatgtagggcttgggatcggttccgtcaattggtccgcgggacttggaaagaaaaacttggacggaggtttcattttccagtgagtacatgcatgatccaaaattatattgaattgaatctctaattacagttaatataaagagtatattaaatctctctttgtttctcgtgtagtgtggaaagcaggaacagggaactaacttatgcggctactacgtatgcgagtatgcccactgcctatcaaaccaaatatgcacaacacgagagcttgatgtacgtatacataaaccattcaaaagttcattgcgtatcgatttgttaagttgtttattaatttcatatattgatacatcattatttttggaatgatagcgtattcacatgagggataatctcccacacaaggattttatcacggctgttcaagaacaactgatgggattcatcaacgaagaagtccttaatcccgacggtgaattctactacgacggatcaacaattcataacgtcggtccttcctcttctgacataacgccggcgtcgaagtcgaagtcgtagctatagctaccgagcaaatgaattgtactatatatgcatgtatatatatatttatatatgtacacatttgcttttgtgttaatatatattttggtaacatatatatatatatatagcacataaaatgttaagtagctttaattaaacatatgtgtgtgtatataatatatgatttatacatacacacacacatatatatatatatatatatatatatatgtatatatatatatatatatatatatatatatatatatatatgactatatatgtattgtaacatatgtatgtgtatatatatatatatatatatatataatcaaccatgcagcaaacagggccatgcaaaaaaaaaaaaggtcagctcgatctttagtcccggttatttcacccgggactaaagatagttatctttagtcccggattcgtagtcccgattggacaaccgggactaaaggggggttaccaaccgggactacaaacggtttctccaccagtgtaacttaatttgatcgtgtctactttacatatggttacctcgaccatggctccctcacacacttttcgggagaaaattgtgattttgctatcgcaaaagaatggtttcgctggaatactatcccttcaaagtgattcattaaaatgctatcctaaactaggggtgttcactgaaatgctattttggatctttttgattattactaatgtttttactctcttttattttttctccggaccaaaatgccctcgtctctatgtcctcctttcgcccaggataatggcaggttaacattgctctagcaaaatatattgctatatatttgtgaaacctatgcacgcctcatgctccgctgcgtgatatgtatatactaattgatcactaacactaatacaaaagctcccgtgcactggtttgaaagtcaaacaacacctctctggttttgacacatgctttgctagagcaatatattttgctttcacatttgtacaataaaaatggtgtgtagtccagttcagtcacaagcgcgcatacacatcaagatataatggagaagctagcttaacccataaaatttgggcatgaaaaaattgtaaaaacaaaatagaacaaatttggacagcatgtagacataatattgaatagcatgtggttcacaaaatacctcacataacaatggttcacaacataacagtggtcacaacataacagtggttcacatgcaccatggttcacatgcaccatggttcacaaaagacctcaaataacagtgcctcacatgcaccaacaacaaaggtggttcacatacactaacatggttcacatacaccaccatggttcacaaaatacctcttataacagtgcctcacatgcatagcacacaatcaagtaggcttcattttcttgggtgtgagcttctttgtacatgtcctctttgagcttgattcagcaatattcaacctccttttacatgtcacttgtgaagcaagtgccggttgtgtgcttgtccctccttgttccattaacattgcaagccggctacaaggaaattgttgttgttaagcaaaaatacatctaggttaatgtaattgtagttggttgtactaaccgtcttgtcacaactgttgggctttcttgaataatggtttgtacagtaggcctagttggggtatgtggtataggagcaggagcaacatgagcagcaggagcatcaggagcatcaggagcaggggcataaaccacatcaggagcattaggagcaggagccggcccatacctcattgtgttccatcttgcctttcgtttcctacaaggtgagataaatatattttaattttacaaggaaaaacaaatgtagtacaatagaaaaaaaataatgacatttagacttacggcttcttctttgtaccattgagcttgcacttgtagctagtttgtccatgacccaactcaccgcattttttacacctctttttcctctaatcgttgccttctctttggcagtctttaggcttgctaccaccaccttccaagcaacccttgatccttagtttcctgtaccttcctaggttcctttttgcaaggggtgcaccaagaacaaaaggtaaatccaccttaggccattgtgatttgtcagggagtggctcaataattgagttgtatgcattccagaatagggccacagagtagtagggattaatgtagttctccaactttacatccctaatttgctaggaggcaatcactgccaaggcatgttggcaaggcttgctagtgtgttgccactcctgacatgtacaagactgctcatgtgtcctcacaacatgcctagcatggctgctactattgtcccaaacctcagcagtggttatgtcagcatgcacaactgacaagtggcctaaccctcgagtcctagctctcaactggtgcaaaatggcaggtagaattgtacctgtgaatttatttccaatccttctcctcctattccacagggtcattatcatctccctacatgtgtcagcaagctcacaaataggtaaggcctttatatctctgatccaattgttaaagcactctgcaagattgttagtgacataatcacatttaatttcagcattgaagccactcctgtaccatatcaatttatggtaagtgtcaagccagagagccacatcggtgcatgctttcttaattgtatccatacactcctcgtgcacttgtgccctatatgatctagctacaggatacatctcttggaagacagatccaccatatttcttgattagattttgcgtaaggtggttaaaacattctctatgtccagcccaagggaaaactcggtgcactgcaatctctaatcctttgcatgcatcagtacaaattgcaagaggagatacttttcctatggccttgagcaattgaatcataaaccaggtccaattatcagtagtctcagcatcaaagaaaccaaaagcaatggggtacatccagttgtttccatctatagctatggcagatgctaaatgtcctttccacaaaccatttagggcagttgagtctacactaaggtatggcctacatccagttagaaatccagtaatccatggactaagtgcacaaaagaatctgttaaaataaaccttcccatcaacctcaatagtgtcaatctcaataacactaccaggggacctctccatgactgcagccctccacctatacaacatatggaaattttcttcccaactaccttgcaattggatcatagccaaactcctacccttagccacagtatcataattgattttgcatttctgatcctcttgcaaccttttttgcagttctttagggcccatacctgagtctgtcctaaggatatggatggccttggaagcaacccaggcgctggttggtgtggtagtctttcttctaccgctagatgtacacgtgtgataattagtaaactttgtcacctgcaaattaaaacaaataaaacatggcattagagcaaaataaagaaaataacatagaagtgaaaatgtcaatgacattaggaaaaaaagtaccattacggttcgctcgtcagcctgtctacgcccattcacatgccaagggcaatcacttgcccctttgcatgctcctacatattttttacgatctgtcgcctttacccaaagttcaaactcctcattgatagcaaactgtctaaccgccaatctaaagaccttcatgttgggatacacagttcctttgaccaaggatggcttattcgcgtcattcaccatcatcctttctcccgcaacctcgtcctcgaccggaggctcaacctcaacctcattttcatcgtgattccgattttcagcaccattgccattgttaccattaccctgttcagttgtagccgccgcttgagcattctcggcggcttcatcctcagccctcaaacccaaaagcacatacaactcgtcatcatccacgatgtttacccttccttcctcatctaacgattcgataatctgtaggttttcccaatcaacaataggtggtggatgtggttctggctgtggctgttctccttgagtaggaggagaactaccaccactatcaggttcatcagcaggtgattgtacaactactaattgactcccaggctcctcctcgagcctagagaaaaagatgcaaataattgcaaacaatagtcagatctatctaaccccttacttccagcaaatcaatcgtgtaatcatgtcactgaaaaaaaaatagagaagtgcatacctcccaacaatctgtagccaggtggagtcatccatggagtcaaaccctaaccacacattgagggaggggaggagggagtggagggcgggaagagctgaccgaggggcagcggctgatgggggtggcagcggatggaggtagcggtggatgggggcggcggtggcggcggatgggggtggtggtggatgggggcggcggcagatgggggtggcggtggatggaggccgtggtggatgggggcggcggcggatgggggtcgcggtggcggcggcggatgggggtggcggtggcagcggaggcggatgggggcggtggcgctgactgggggaggacgaggtaggggagtggcaggggcgggggccggcgccggcgccgaagacgaagccgatgcggaggcgcgctgctgtcgcctctgccgatgccgctcccagcttctccctcagtcaacaccgacgctggatggctggagagatcgattcgatctggtgataaggacacaagggtattttggtcagaacaaaacttaaaatagagtaaaatcatttctagaaaccaaaaagatcaaaaatagcatttcagtgaacaccccttagtttaggatagcattttaatgaatcactttgaagggatagtattccagcgaaaccattcttttgcgatagcaaaatcacaattttctcacttttcggcagggccgtctccagaaattgggggccccggaacgaaatataatttgagattctaaatttacttttgattcagtcgattatttaaattagtaaattatattcatggtatttgatttaaaagaatag

SEQ ID NO: 76327 - DNA, 11458 bp, Oryza sativa
gttggctagcagctttgggcatcgtcactgttgatcaaggattcagaagctggtttcgcatgcacgcacatgaacacatattgttgattatggctgactggttgtgctggtgcagctggtctctctgatttgggggaccccaaatttttgtggggccctgcgctgacggctcagttcacacgccctcgtcgacgggcctgcttttcggttcagaaaccttgaaaatgacagaaaagctaactatgatttgtgttaagcactctcgttggttttttcttcagtctaagcattcatacttaaactgcgaggagatgttcaagtatatatatgattgtaagagatatattaggatatgattgatttgtctttcttatttctaatcatttcttatgtctacccatatatattctaaatatatatacttgtcctctgagactaagtacaacacgtcaatagtatctttctgatgtactattcaacataacctggaattaattaatttaagctactaacatgtctccattcatccccaaattcacagcaatttaattttcttcaaaattcacatctaggaaccctagccctacaccagatccaatgctccgagcaaccctacgtcggatccatcacatccaccaatgtcacccatcctctttgccacagttgccgccccttccatccccttcattacctccaccagatccggaaactccaccactgtccctcctatctactttgccgccgccactacagtcgcgttgtctgctagagagggagaagacgaggagagaggtgggagagggagggtagggaggagagagatagtgcatggagagcaagaaaaaccgatgggcaaagggagatcgtggagagtcacagggagcaaaacttaatagcgagcctgtgttgacggttgttaagtactatctctgttttaaaatataagaacctacgaccgaatagcacatttcctagtactacaaatctggacaaactatctgtccggttctaggttcttatattttggggcggagggagtaccaattttgtccattaactatattagaaaaagttccgtccggttctaggttcttatatgacggggacgtcagatcctttgaggggggtgtctgtgacatcatagtgcaattaggatgtggcctatgttttttttttatttaaatgatgtgacatgtgttgttcataagcattgtgtgcactcgagtagtaccatctttgctagttaagcaagagtgtatagccaacttgtaaggcattgcccctccaaccatattatttttaggttgactattttacgtgaagcgagaatggaagcataagtgaggtgatatttataactgagcgtgctagttggatggaggctggcctgccttgttccgaaggattggctgttacaaattgtaaactaaaattacttgcatcatgttatcttaaatttatgagaaaaaaatgtcgcaacaatggagctggttcatatgaaactatcatttttatactacatgttttcattttttaaaaaaaatatttagcatactaatttaaacttttaagaaatattttttcttgtatactaaagatgtctgtatagattttaggatatattaatttatgaaattttatattaaaaatatgataatatagcttctttatctaattaaagacatactcatgtacttctacttgcttctactacctccatccataaattgaaggattcaactattatcctaaaatataagggatttttaatactactcgttccatccagccattcttaatttaatttctatccaacattattctaaccatcttctaactctctacataccccttatttaatgatgggtatcttagtttttttttcatttctccttaattcctataaaattttaggatccattataggacggagatatatagtaataaaaaagtgcttcattcatagactgatttatttgtacctttgtagattatttacctttacatatttgtataggtaaatagacctcgtatataagttgagaaatataattaagtaggtataaagtcattagatgtctaatggtatgaagtaattggtccaccaattttattagaaaattaaggtggatatttttttggggtaatttttaggatcttcttttatttggtggttaacttaattgttgtaagaaaaacaaagagccaagagccagtgggttcgtcttgtccgtgaggagggaactggatacatgtgttgtacatatgatcaataggtggtttttttttaatatatagatctacagtttaaaataaggtccattggtttgggtatgatgacttcagctcaatataatgcatactcctaccatagttactacaatgtagccagttgagatccatgcttggcacccttcagggtatgagtaagaaaaaatggaggtgatgaaaatagttttttttttgtcttgacttgatttattgtatagacaatacataatttgtttatggtgttaatcgatactactaaattttagtggtacttctggtggtacatatataattttctcttttaaaaattagcagggttgatcattggactctacttcgaaaaatctaatagcttcagtggtgaggaccacgtaaaaaatatttgctcaaactgtgaccctttgctaacatacaagttgatataggtttttattttttttcttgtattatacatctaatttccctatgcatgttcgtggggattaatatttgatgaaatttgttaaaactctttgtgctaattgttaacactatttggatggggacgccataacaaagagatataatatagttacatgtatgtttttttttctagcgaatagtagtctctcgtatggacactttttttttcttctcggacaaatattagtctatcataggaatagggtgttcataatgtgcgtctgcatgcatgcatttatatgagctcatgtgattaccttttaaattgttagtaaaaaagtacttttaaagttttgatgggaagagggtggagcaacgggtggcataagacgacgccgtggcatggcttcttttacctcctcgcaaggagtggtcactgcatatatgctcaatttagaaaaaaccttagagctggaaagaaagagaaaactaccatatgggtcaaatcatatacacactcttcttatttttctttttatatatcttctgtaggtatgtacataggagttttaatttgtatgtacataaggaaggattatatggtttttagacagagggattattgtcatagatataatttaatggttgaaaaataatggatcactgtaacagactcaaaatttcagggaaaaaattttgcgaaatgttttaagtcctgctcttctcgattcttgcattggagtgatcttgcttttaatctttcctttgattttggacttaaactttatttgtaaagttaatcgctcccttttaaattttataaaacctttccatttattttatgtaatctctaactttggctctaaattatatttcctttgaatccattcccgaacacctccaacaaataccctttcaattcccgttcaaccatctctagagcacatgaaatatcaatctctctagagttaatacctttttatttcgagcttaccacactaccaccaaatccagttttatcttccaccaaatacttctcctttgatctttacccaaacacatgaaataccaattcttatttttcctagaaccaatacctttcctttggatctccacctaaatattcctgtagtccataaaatatccttttaaatctccctgagtcaatatacctatcctttagaagtatatcaatctaccaccaattccgttcctgtagaaattcccatccacatatacttccaaatccagttctatactctaacaaatatttcccctttgaaatctcgttcatctaaattatccatttaagatttcaaagtctattattcaacttgggccaatatttgctcgattggtcgtcactttgttacacctcctcatcaatttttatcccttagactaaaccgatataatttcaaattttcctagaatttattctggatcaattccttgatctagacctatcattagaaatcgccattttttctcctttatacaacacctttcataaacccctttgacattcccaaaattctcctattctgattgagccgccaatttgattcctatggcttgatcatatccttggcacaaagaacaatatcatcaccaatattaaatgattgctcttgtgctaagaaatctagtttcattccctttcattcaaaaatccaaattccctttagccataacgaatccccagaaatctgtaccacataatgtcgggctgaagtccaatttatttaccaccatccatttttgccaccaatcctaaatttatccaaagttagaagttaaattattgcctttttgattatttttgtgacaagttttaaaaatttggttcttattgaattaaataaaattagagtattttgatccttattgaattcctttaaaattggaacatcttgatttttatccttttcaaaatttatatcttaaaataaatatttttgattttattttaagaatatttcaaactcctttttgctttaaaaactttatatttaaattctttttataaagttcaaaagaccccaaacttttctcttttaaattttatctcctttaaaatctatttaaagccttccattcaaaattcccctaattttcaattcctttgaatcctattcaaattccttgtccaagttcaaaaagtccacaatcatttatcctttagttttcatcgcctttgaattccaatcgaaatcctctagactcctattcattttgggccgaaattcctcatcaagttccgatgccactcgccccttcccgatgcgccgccactgacgccgtgccatgcctttcctcctccggcgcccaaccctacaacgactgccacatattcgtgccgctgtcatcgaccaatcggagcacagagccggcgccgtctccttcttttccacgttgccgtcgccgagttctccttgctttctgttgatgtgaaaacacgaggcctgggagatctgcttaactctagtgtaggtccaaaacttgcccttgggtgtatgagcgtgccagttgatttgatcctgtaatcaacaagaaacaaagacaaagaaaccatggttaaatccataaacgatagccaatcggctaggtgccgatgaaatatcatttatctttgagccgataccatatatgcatcgatcggcaatcattaataagtaaaaaagaaataaatctactcgatcagctgtagatattaacaatatataatctttatgtcgatatatatttaaatcaagtgattgggatagatcggttgccatgccgagacagtataaattacttagatcgaaatatatattaacaaacaagattatatatgttcatagcatagccgatcagatagatctagcatgtatcggctaatactccgataccactctatattaagatattaaagcaagtagaatataccaaacaaaaagcctaatatacttaaatgcaacaagatcttaacataaagggcagatttaacatgtcaataaaacatataatataagcttagttaaatcagataagatcggctgaaactccgatactaccctaatcggcaaccaaagacaggctagagattgagattctactaagatcaaactcaactgatacagctataagtatgaaaagaaggacaatatctagacaatcaagtcgtcggatgtttcatagggtggtagatatcttatataatctaagtcaacgtcggtatttagcctaatcggctgccttttgataacagatattagccgattataggttaaagagcgatattgccggagattgtataagatatacgataactcgccggattacataaataagattagagtatcatgaagatggaagcactaatcccgagaatgcaagccgccataacaagttttacctcttgttcaagatcgaaaccgatgcagcttaacccgaaagcaagaattcgtcgaaacaaaacgaaagtaaaaagggtggcgatgcaccgagattgtattgaacgtgtgttcatttgattacatggggctcggggtctatttatacgcaataattacaaaatatgtccatatcggacacgactcttatctctaacaaactctaagataccataagtctttgcggcagacttttgcccaaatatatcttcaagaaaattacataaaatatcctacaattgccttctcaggactctatccatgcgtggcaatcaccatgaagcacaccaacctaacctgacaacgtatgccgtgtcatattgtcagattcggctcaatcggctaaccctgtccgactcgaactctgccgatcctagtcgcagccgatttggacctcagccgatccttactctgtttctaggacgatctctatctcgaactccgtctcgactcctttttcacatccgatccttggattaccaaatttgctccttaacacattcctcctccgcaaccgccacaaaccaccgcctcttgttgcctataaaaggatgatgaggttcccccttccttccccacacaaccgagcttgagctctttcttctctctccaccgtgatcagccacaactcagccatcgatcgatctccctcaccagtgctccaccgaccaaacctttttaaaatttaattatcctttaatttctttaaatgcccttttctttattttgggtgaatagccagttcagtccttcaacttttgctcaagggtcaaattagtccttgatgttttataatgtccaaacaagaccctaaagattatcatgtggcttaatatagtccttagacccacttaaaacgccacgtggacatgccatgtcattcatgcatgtaagataacatttaaatgtccattttaaccttcaattttctatcaaataaagaaaagaaaaacaagaagaagcaatcataaaacaaagaaaaatgtcaatttttttagctatcaatgctacatatttttgccaatggtcaaaaccggacctttaaatattgaatttgcatgcatagatgatgtggcatatacacatggcatgtttagagggtctaagaactatattgaatcacacaatgaacttaaggtacttgtttggacaatacgaaatgtcagggactaaattgatccttacgcgaaagagtcaagggatcattttgggtattcacccctttattttaaaataccattttaaattttattttttaatctattttaaaacccccttttgaattcaaatttctttgatttatttaaataccccttttatttctaaaccattcctattttatcccttagccacaaaatagtcgtcgtggaaactttacgcttaccatggagacgctcgcgtggtcttaaaccccgacgtcaaaccgttggtcgtaaaacccggcataacctaatcctaaggttgaagtgttactcttcgcgccccacgcctcgatgcgtacagtggtagaatcctcattactccctcggcctccacagcacgccacacactagctttcaggctctgtgtgatcctagccggtctgctgccactcacggcaatggagtaacaatttccatcctgcaaacccacagaaattttctcaactctctagtcactgtgctgcttaattgtagcatcgactagacgagccaaatatctagccggcatgctacccaaccttagcatcggctaaccaacccagataattagccgttatgctaccatccatagaatcggctaaccgatccaaatatctagccgtagtgctgccctattctagcaccgactagaaaccaaatccaccaaataaactccacctacccattttatcctttccctcaattccaacgtttagaaaccaaaacctctcttttgttttccaaactaaaatctattctgaaccattcctttctcctctcaccttgctccaattttatttattccttggctttatcgtttctttgtagcaatttgcttataggctttatttgctatcttttcgtatccgtaagttagaccgtacaacaagttctatcaacatccaaggagctgacatggacccagatagctacgctgaagccgcggaaaatcatatggcgcaaggcaagacataactaaaattttgatcatatagcaactttcatataatcttcatatttaaatttgatgcatgatatttactcttgtaacatctcatgggcagatgttatatttcataataacattgtggtggtttaaaatgatatttaatgcttttaagcattgttatatgagattatggaaagatacattggacatcattgtatgtggtttattattcagacatctttacaaatttaggaatccggttaaaatgggcatttttgaatgatatatatatatgatgaagtttgttggtgtggggagtttggaaaatttttggtggtttaaccggattataattacccccttataccgtggaaatgacatagttgcgttcatccacacgatcaagtaattggacttagcctagtacattgtcccactatatgaaatactgttggttggctcactaggagcaggattggggtgaacgcatgtataaggaggttgggggcatggttcacaacggtggaacccgtgaaagcagcgaccaagtagctagccttgcctaggcttggcaagtgcccgactgctaggacggatcaataactagtaactagtagtaagtgggaccttcgaacggctctgttgttctcaacctagctagctgtgggcattgtgtgggtaaagctggacagtctctacagaggtgaattaaattattcgaatgtgctgtactcccggttttggagttgtgtcattagggtgattcctactcctgaagtataagtagttttaaaattaaaatgttaaggataaagaagatttatggtttttattattcccttactttatcattattttatttattcatatctcttcacaagtactcacccttgcataatttgacatatagaggaaatgtgctaacaacgagatcagaaggaagcaaggtctacgacaacgacgagtttatctaggctagtatacactcgagcttttgcctgtagagttctttggaattctttggagtttattagttgtagttttagtagttgaagagtttaggagtgtagtactttggattttcttgtatttcaaataaggatatattagtttggatcttttcaccctttaacagttgtataattagattttcttgtatttcaaataaggatatattagtttggacgatcacgagtggatttttggggcaccaagcctaaattgggtttccccacatacttggtattagagctcagcttgactgtaggctgacctagattggttagaataaaacataaggacaaacttaggcttaaaattttgcttaacatatataggaattagtttactccccactattagacgactgtcgagttgaattgcttcttaaatttgatttttgttatgaaaaatgttgtttgtattgcgaaaatttgcatttttcttctagattttactagtttttgtaaaattttatgaaaaaccgttgcaagtttgactgttaagggcagaaattgagatatcagatggtgaggattttggctcatattcttgcaacccttggaataaattgcaatattcaagtgaagatttcttgagcaatatacatatgcaatactacaagtgtctgaattttagaagaatctgttgaacataaatggttagactgccagaagattaaatcatctatatttcatggagcaacaaaacctctcaaagctattggctggatccgtaatattggaaagatattaaatacggtctagagtaatgaccgtgaaaggggaccttatgcatttcatagaaaatgcatatgcttgttggacaaattatgaagctattcagagtgaccagaattctattacatgaattcaatacaaaagggaatgagaacacacaagaggaccattaaaataattcaaccaaacgaaagtttcataagaggtctaacattttgcttattttcctatggaattagtcataggatttctcgatgttttatatcggctcgaataaaggggtagcacactgtagatattttatacgatcatagataaatctataagcgcatgaataccactacagcatttcacatggaagtattccaagggtatcgtatttgtttttccactgggaaggcggcaatgtaaagagttggttcatatagtcgtaatcatgatgtaattaatataccatagcctaaacagggataaatgatgtaataataatgtatgggtagtattttacacaaaggagattcatctctaataataatacacgagatagtgaagaaagacaaaagagacctaaggttcatatgcagttctatatttatggtgtttagactacacttaacaaatacatgcttacaaggctagaactaagttctagccgctcaggcactgctgaaagacaactccctacaggtctatcagtttggttatggcattttacgaactcttacatcatacctggacatgaaggaatacaaatggtaaatagtgctgtcaccacctgccacctacctcatttttcgtgaggtatacccacatccaacgacatttaattaatctaaccaccatgctcacattaaaaaataatggcactaattccccccagtactcccatcgttcggatggacaagttagaactagtacaacccgttaagatcattggaccgatatcgtggcatatatcgactagcctaatcaagtggagcatataattgaagtacagattatacataactaataaagtagtctatgtattataaacactaataagtaaagaagataatttctttgttactcagtcttacaagaaaagtaaaatactagagacatacccgaatctctgagaagactttgaaaccgaagactactctaaacctaactgcactactactagagagaatacaactataggaatgagagaattgttcctttagtgtgtgttgcgagagtgaggaagcgttcttttttttatagctgctaatgatgcttagaaagggcagtatttctcacaaccgtcattgggagcttcatcaggaatgtccatgtgtaaggtggcaatgtgatgagccagaggtggttccgctgaacaaggggttcggccgaccaaaggtccctacctcttgctaccgaccttcaccatgggctgccatgtgggcccctacggtggtgcgcagtggcttggcctcgctggtacgtattttggtt

SEQ ID NO: 76328 - DNA, 1019 bp, Oryza sativa
gctttccatcccgaccagttcactgttcacaaatcggttgggagggcaaggggggcgattttttgctaaaattcaaggtaaaaaacacattattctccattccttctcaatatatcgatcatcatatatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgtccatgtagggactgtaagaatgaacagatgatcgttgatagcgatgaagtgcatgttcatttgataatgaatggattcatgaagaaatatacctgctagaccaagcatggagagcaagaggcgcctgatatcgcagctgaagaagtgttggatcaggatgtagagaacaccgctgtgactcgagaaggcatgttcgtaccttctcctttaggtggagagaccatagatttggacactcaatgtctatctacaatgttgcatgacattgaagacgcagaggacaacgacagagattttgagaagtttagtaagttggtggaagattgtcagatgcccttgtatgatggatgcaagtcgaagcacagcaagttgtcatgcgtgttggaactcatgaagcttaaggctagtaatggctggtcggacaagagttttacagaacttcttgagctgttaaaggatctgttgccagaggggaacaatttaccgcagacgacatatgaagcgaagcaagtattatgtccgttgggcctggaggtcagaagaattcatgcatgtctgaacgactgcattttgtattacaaggaatacgctgacttggatgtctgccctatctgtggggcatcaagatacaaacgagcaaagagtgaaggtgaaggaagtaagtcaaagaggggaggcccaacaaaggtggtgtggtatctcccaattgcggagcgcatgaagagaatgtttgcgaataag

SEQ ID NO: 76329 - DNA, 4609 bp, Oryza sativa
agatcttgatgagttatacaactttattgttgatgaccttttcagttgaaatcatttagtattttaaatgttgtttgaagctggtatattttcaaatctaatttcaaactgtgcaaacaaagttatatagataaatgaccaaaataaaagttgtagatcttgatatgttatgcaacttggttgtatgccatcttttccattgtaattatatcctacctgaaaaattatttgaatttcttatattttaaaatttagattttatataggtcaatcgcctcgggatggagaaatgaccaaaataaaattggtagatctcaatgagttctacaactttattttttacaacttattcatatgagttcatttagtataataaaattcaatttgaaattcatttttgccaaagagtctgatttgcctcctctttgggttgggctggcttatgagctatggcagccttatgtgtaagtcggatatccgatggaaaattccggataatatccgacggatatccaattccggcggatatcacctatatcatattcgttttcatattcgaattcgaaaattttcggatatattcgaccgaaactaaccgaatccgaaaaaaaggtccggtcgaacggaaattatccaaatcactttcaaccctagccgccgccgccctcccccctcccctccggccggatttgggagggggagccgccgccgccaccgccctcccctctcctcgctccggcaggatcttggagagggaagggagaggagccgcaaatgttgctccgtgcctccgctgtcactcgggaggggagccgcctccgtgctgtcatcgtcgtgcgcccgtcactccccttcctcccatcggatcttggaggagagagttgccgccatgcactgtcacttcctccactgccgccaccgtcaccgcgtccgtgccgccatcgttgctccccctcctccggccagatctaggagtggggagggagagagggggagccgcctccgcgccacctccaagccgcgccgccactgcccttccctcctccggtcggatttgggagggggagggaggaaggggaggggagcacagtgaggggaggggaggagtggtgaggagatggtgtggtgagaccgggtggtgatttttataacttcaaaactttttgcaggcggacatcctaagatatcgcttgcgaaaatcgatttttgtaggcggaccacttaagacaatgatcctgccccatggatgttatttttgttaggcagctatttagctccgagagacctcgtctggaaaaagaaaattgggttttctagtaattgcatggttttaattttgcaaaattacagtgttacctagccaatattgttaatagtaatggtattttttaagtgacaattttgtaatagcatgttcaaatttatccttcatctaaaaccgtagatatgaggcttactctcccaccctctcatgtagctaaaaattaaaaagcggtatctataatcttgtattggtgcggcagtttattaaaataagacactagtaatatatatgcaagctttttttaataaaccaacactcttaaaatgtaaaatgattatatgtgtcggttcttaggtggtgtttgggagggaccttaaaaatagaactatgggaatagagccaagccgaccaccaagcaagctagctagcctagtttttttatgaaaaaattttatctatagtacaaacattttcctagtaccataaataccacaaaattcttccaccttttagaaatagcacagcaaaacactattagtataaaaaaataccacaaatctcaacgaaattgacgcgggtggggaggcgacgctacttttcaatgaccaagttgccacttcgccccttttctttaaccagccgtatcttctcccttttttctcgttcttcaccagttttctgttcaagacttgagacctcgcccatagcacctcctcctctcatcatttgccgccaccttcttcctctccttgatccccttttttcgcgatctctctctccactcaccgcctccctctctagttatgttgcatggctgcctcctcttggcatggcccaccctccctccgcttctccacataccaactctctcgccagcctcctctagtaccatctctcgatcgcatcaagaatttagatctactagattcagccgtcacgtgctcgacggccgccatgtgaggcgtggaaaacctctagtctgaatttgaaaggttattgtccaaacacattgatgatgatcattagcaaaaagggattcgcacagtttcaccacaagagagatatgcacaaaaacagccattttcttcttcgaatgatttcgtcgtcggctcatccaaaacgaacatcacaaaacgtcaaaatgcacatatattactgtccatgcaaaaaaaaaatatttattcgtgtccatgcaagatttgggaagaagccgacgttgctattgtgactttctagaagccactctcacgcatcactctccatctcaccaccagggcccacacacacaatataataacaataaaaaaacacaacccccggatgaaggggcccacctaccttcccgcgccatcggacggctgagcctccgctgatccggccacggacggcccagatccaccccgcgtacgtcgcgcgagcgtgagggcgtcggcgtcggcgtgcagatatttctgggcccccgtggggacgacgcggtgggggaagagataaccccagccaccatccagctgacgtctccatgacaggtggggccatgctatccatggcccacgagtcagtggcttgtaggagtaggagtcccggtgagggtagggggggtctggtccggataagacggctccctgtctccgcattgacgcgcgtgacgtcacgctgagaccccgcgcgctgtcgacgtggccgtgaggaggaggaggcggagacgctgacggcgtttataggcgggagtttttacgcccgtgggccccaccacgaagaacgtggggcccactacggctggggaggagcttatttttattctgccttttttttgtttatttattgttcgtgaggtggtcaggtgctgcacgcaacctcatgcgtttttcttttcctgtaatgctgtcctatttttgttacaaactgccttttatcttatgctcgtaagtcaccgcggttgagggttgctaaaccttttctccgcgtacgaaaaacaatgctactttattagcctataattattaaattaataattaactaaacaacttaaaaatattttgacgaggacatcaacactatcgatacatccacgtccccccaagtacagcatgatggtcctattacccgcgctcgtgtacgtcaactaaattatcaggtgagttctttcttgagttcatattcctcttctttataccccggagacgcgtgcactcgtgttttacttaggaacgatggagaggatccaaaggggagaggattcgcgcggggtggattcggactgtagggcagcgccaacttctgatggccgccacgacttcatgcgaactccgatttgggcgtgcaagtacttcatggaaagcttatcaagtctactttcaaatggatccagccacatgtccatatctattctggagcggccgcaattatcattttactcccgactgttttctgtccatggtgctgcgtcacttcttttggcccaatgggctgtgtatccaagttgggcccattaggagtgcgtcctagggttggagcacgaccctatggtcgttcttcccctcttcttatacctctagtcgccgccaagaacactgggggttttgatgatagagatagctacttgctaccagctcgcagcgcgcgtgttagctaaaccgcccgtctgcctgtaatcggaaccccaccatattgtgttttgatagtgaaactttcatctttatctagcaatttcagtgcttgttctacttgttcttgcttgttcttcgattgcttgcaggacgagtgccctcgtggccgggttgacgcgcaccacaagttcgcggcgaccattggagacggtgtatcggttgctaaggcgcagcgtctttggacggttgtagtcgggccgtgaacgtcgtcttcatccaatcaagttatcccttacctctcatcgaaagatcgggccacaaaccctagcgggttcgcatcaggtggtatcagagcgtggttcatcggtgagagaatttacccttcccttcgtcattaattttttttcctatagtccagaaaaggccaacaaaaaaaaatagtagattagttttcccgtgatcctatagaccattgtgcctttttactagtactgcttagttaaggcttgttgagttttcgattgcatcggttgtgttaatttgctagtcttagtgttaggcgattagagtttcgagttcttgccaccaccgcacatcgccaccttcatcaattttgccgtcatcaccaccgtcaccgccgtcgcagtcacccaccaaatcactttctatttgtgtttgatctgttgccgatagcttttgtgagctgccttgtatcctgccgccactagaaaggaaatag

SEQ ID NO: 76330 - DNA, 3419 bp, Oryza sativa
cggtttagctaacacgtgcgctgcgagccggtagtaagtagctatctctatcatcaaaacccccagtgttcttggtagcgactagaggtataagaagaggggaagaacgaccatagggtcgtgctccaaccctaggacgcgcccctaatgggcccaacttggatacacagcccattgggctaaaagaagtgacgcagcaccatggatagaaaacagtcgggagtaaaatgataattgcggccgctccagaatagatatggacatgtggctggatccatttgaaagtagacttgataagctttccatgaagtacttgcacgcccaaatcggagttcgcatgaagtcgtggcggccgtcagaattggcgctgccctgcagtccgaatccaccccgcgcgaatcctctcccctttggatcctctccatcgttcctgagtaaaacacgagtgcacgcgtctccggggtataaagaagaggaatatgaactcaagaaagaactcacctgataatttaattgacgtgcacgagcgctggtaataggaccatcatgctgtacttggggggacgtggatgtatcgatggtgttgatgtcctcatcatatttaatatgatttttgaagcaacaaactgtgctttattcttcacctcaattataaaataatcgatctagtcataaatgaatattcaaaattcagataatatttggttaaacttttaaaattctaacctttgcattaattcaaaaatatttcaactgaaaataaaattgattccaaaacaccctaatgcacgaggaaacatgtatgggcgacgtaaggctatatgctaatgcgttctaacatgtttaaagtccccttattacatttttgaaagtttcactcttttctccatttgatgggatggtaatcacatctcaaataactatagctcatgatagtgatgtgaacgtccatcccaagcattaaaggtttcatttctcccaaaaaaataaatcgttgtatcaggacgcaattcttcttagtgttaattgaaaacggaaaaagtctaaattaattacactgctaaactgatgggtgagtacaaattacctctaaacccgaaaaccagacatctttcactctcaactattaatatcgaatgaagtacccctaattcaatctagagtggttttgatcatatgtggcagcgcagtcagtacttttatatatatatatatatatatatatatatatatatatatatatatcttctatatgcatcttaaattcttctatatctttcggagttgctcctatatcttaaatttaaagaaagcaactctttttttagtgcccatgtgcctatactgtcctgggatataatgatatgaatattcttctttttctggaggccatcttcctgctgccctggctggtctttctctttctccttcattttttacagaaccctctccgtatcttttcctttttcctgttcccaaatctacttccatagcttccattgcattatctagattatgcaaaccttcctcatccaatgagtctataaaatcattatattgttctgcattatcttcttcttctatattctctatttcctctatcaggttgttttcttcttcataactctctagtaataatttctcatttacttcccattgctcttcctcacttaataccttatctaacttttggatttcttctcttggttcttctgactttatttgttctattttaatttcctgggttctgggggtttctatggccaagcttttctcttttttttttcttaatcctggatagttctctatagaaataaagttccttgtctctaattttaggccactcacttttcatagagttattatattcatctgctatatctcttaatttatcttcataatattttatttcactttcatggtctaatttttccatcaattcagatatactatgtcttctgttatctataatatctctgtcagatgattctgcatccaaatcatccgaagctctggttttataatttgtaaatctaatactaacattccctttgctgtcttggtaacttatgaagttttcaggctgactcaaggttttattttttataaattcactaattggccatttttctcctgctctttcttcagagtctattattaaagggctcatgaattttattcctttagaatgcattttttctatcacatcatttacattgattttgtatttggaggcacttctattagtcaatctttctataaattctatacttattaataaatttgttcccttaaactcttcgtatccttttgtttggaaaccaaaactcattttatctatgaattcatttacaggcatcattaaatcaggcgctatataggttatcaacatattttcattcatatctccttctagatagcctaaagatgctttgtttattgtgtcccatcttttatctaataaggttattagcactttagctcctaatttctttcttgtcattcctttgattcctattatgtacataccttggtgaatatacttatatcctgaatattttaaactattttcaaattctttagctactatttttaattctagtggctttgttagaacacttaattctagttctctagatattctataaagcccattcttattctcaaaaaatcccatgcagtatacttgttgaggccttattgcccttaaagtatctcgttgatatctttcgagctgcttatctacttgtgcaacatctttcagctcatctatgtcatcatatttgcctttttgtttatcagaacagttatcatctctgcttgctattcttctaaagagactcctagatatgtccatttttcagaattaatggcttgtgaagatgagattatgccagatgaagccaaaactatttccttacctttactagagttgattttgtctagtaattctttaatataatcactattctgtgaaattttattttgccttatcttataatcttctaataattctaatgtagtatttagcttattattaagaaaagaatattgttctacaaattgcttttgttctttatatatatcttctaacttttgctctaaatcttcttgtctcttactccaatttatatagaaattatatattaaatctacaattaaatttagttggctattattagagtgccaactatgttcttcagtatggcttagtctacaccttatgttgatattatctttggtatttattaactttccaatattagcttctaaatttagcttctctatgattaccaggctctgataccactttataattaattcacaactattcactactattcttagtgctgaattcacttattatgagtacagaattacttagtgctgaattcacttattatgagtacagaattact

SEQ ID NO: 76331 - DNA, 1902 bp, Oryza sativa
taattcctgcagcccttttagttgaaatcatttaatatttgaaaatgttgtttgaagttatcatattttcaaattcaaattcaaattgttcaaacaaagtcatatagaaaaatgatcaaaaataaaagttatagatcttgataagttatacaactttatttttgacaatttttccatttgaaatcatttactacccgaaatatttttttgaatttcttacattttagaattcaaattttatatagttcaatcaaactcggatgaagaaatgaccaaaataaaattggtagatctcactgagttctacaactttgcttttgacaactttttcatatgagttcatttagtgtcataaaattcaattcgaatttattttttccaagaagtctgatttgcctcctctttgggttgggccggcttatgggccttatgtgtaagtcggatatccgatggaaaataccggataatatccgattccgacggatatcacctatatcatattcgttttcacatccgaaaaaaaatatccgaattcgtttccgaattcgaaaatttccggatatatccgaccgaaactatccgaatccgaaaaaagatccggtcggacggaaattatccgaatcactttcaaccctactaataggagtttcagatgaatattcaaggcagaggaagaaaccccgttaacctaataaaaatcatcaaggttcaatccaattaattcattgctctgccggtggttcgccgcaccatcgtttccttgttgtttttggcttcgccctgtgttcacgggtcgagtcctgtcttattccaattccgtcgccgttttcctttcctttcctaaaatggcaccgcctccttgtcctctccctctaccgcctctcctccccctgccgccaccccagccgcgcgctgcgccccaccaaatcctaccaccaccctagctgcccctctccacctctcccatgccgtgccgccgtctccccgccaccggatcgctgcagccatcatcgtctcccgtgagccctctccttccccttatccctcgccgatatggttcaccgtcgagttacctcatctaatctaaaatatccatgtttccctagttgtcgtcatcgccgtccgtgtgttcccgccggatcgccgccatcgtcgctcctccaccggtcgccgttgtttccaggtgaggtatccttttgtttcacctctttgttttgtgtgtcgccgtcacggtaccgccattgccggcgcttgccgagccaccgcgccactgcggccgccttgctgcgccgctgccctagcgtcgcctccgccgccgctgccttgccgcgcctgccgtgtcgcgccgcctgaccgcgccgtgccaccactgccctagccgcagccggccgcagcccttgccgcctgccgcgtccgctgtcgctgccgaccatcttgccgtcgcgtgccggcccatatcggcgaggcggccttgcctcgccgtgccacgtcttgccgcatgccatgtagtgtattgctgtgtcatcccagttcggtcaagccgagtcggtaaaaccctagagtccttcggttggttccgtgacccacccaagccgccggttttgttcactggttcggtggatcgtttgtgtggtcctgtgccacggtaggtcgattcgttgagtcgttgctccgtggggctcatctaccggggttctattccgttaatcttgtctgcactcgggcattaatgtttaataatggaataaggttaccggttaatagtaattacacagtgcatattgtaaaattcatatctaaatcattcgtgctccgttttaatccattcaagtctcagtaaattcataaaaatgtctagaatccattaaaatggttccttttgttgtctcagttgatttatag

SEQ ID NO: 76332 - DNA, 658 bp, Oryza sativa
agatcgtagaactccagaacatccataaagaaagaagaaaaaggaggacccaacccgcccattgcgaaggggaggaagaagatggaccgccccgggtaatctggtgctgggcgcgcctcgcccagcatcactatctcccggccggtggcagattccggcatgaagcggcgcggcagcccagcctgcctctcgctcacaatgcgggaaggtggtagtacgctaccgtcgagcagagcggagccccgtgccatgtcgtcggagaaagagagggttgagaacgagcgtgtgtggcgaaggtgaggcgcagcaaagagagagtttagggcgcaaacggcgaaggaaaggggaatagtggcgaaaggaagggagcaagtcctttcctcgatggctttatacccttgccatcgctgagtccggctcctcgtttctcgtgcccactatctcgccccctcgttactcgctatctcgctccctcgtttctcgcgcccacgcttccactaattccattcgcccgcttgcggcgcatgaggtggatatgcggttgtggcagtcgagatagatcgtatcgtgtgcgcgttaattacgctcgccgaccgaagcgacgttaccatgtctccagacgaaacgaatctgcacgcccagattcgagcgctgctca

SEQ ID NO: 76333 - DNA, 1009 bp, Oryza sativa
tgcccgccttatataggatgggggacaggattacaagatagaaatcttaaccaatacggcatcgatttcctgaatctactttacaatattatcaaatcaggactttaggccgttctgtaatatataaggaaacgtaatacccaagtcatgatctgtacatattccatagatataagttatctcctataacttgtcggataaccataccgtgtgggtattgggtacccataatctccacagtagcccctgagaccttcacggtcgaaaacataatcttctctcgaatagattactccaaagctgagtgcttcaatcatcttcgccatggtctcccgagtacttttaccaaatctgaagactgtggagggctgaaaaataattaaatgtaaacttaggtgcatcgactaataggtgtaatccccgactatttggttagttgaacaaactaaacatatagtcaaggagtaaataatccaatcaaccgagtggttttcataattgtcgtcaaccaagtgacttaatattaatatgtagcatatgcggtgtgaatccccgaacaacatgatccgagtgatatacctaaagttgtctacatcatggaaaattcgcatagcaaaacaactataaagaagcttgtatgttgtgaataaagaaattttcaaagtattggacatataccatgtgcacactgctttaacaaatgtgcttgagtccctaaaagacacatgttttcaccgcacatggaaatatatggcatatgtggtgtaaaatctgagtaaataaactcataaaggatttaccaaccgcctggaaaatgaccacaatacataatcagcctaaaccataatattggtcaatacaaatgctcacttacgtggcaaaaagcaacgatattatatccaatcaattgctttataaaaccaaacaatgccttgactatataaaaaagtcagcggggcagctatataaagcttcactacgtggcaccttttaaaatgcattgtaccaa

SEQ ID NO: 76334 - DNA, 7457 bp, Oryza sativa
catgaagtaggcgatgtccgcgtgcgtggtcacctgcgtgaccgggtgcgtcatcccgttgccgatggccacgccgcgcaggttaatcctcttcttctccggcaacgtcgggtttgttgctactatgagcgcgccggccgcggggatggtcttgccggcgtagctctcgccggtgaggtacagagggcgggcacggaagctcggctcgagggagtacaaggactggagcgcggcgaggacgtggtcggcgacgacggactggttggtggggatggcggcgggggaaggcgcgacgctgaagccggtgccgagcgggctgtcgatgaagaggagaccaaagcggcggttccacgcgaaggggttgggagacagtgagccgccggcgagaaggtaagggccgatctggaggaagttgctgaggaagccggagcagccggggccgccctccagccagacgagaagcggcgtggtggcgggcggtgtcaccggctcggtggcctcgtagaaggcgaagtagagcgaagcgtttgccggcgggatggggaggtagcccgacttggtcgggatggctcctctgggcaataccgacgccggtgcggcggccgccgaggccgagagcgagacggccgcgaggacgacgaagacgagggacagcggcgaaggaggtgccactgccatggcgcgcccgcgtcggctgtcgcgggctcaacgtggcttatcggctgagtgatgtattgcaaatttgcaattttgcaaggaggtttcgattagtgttgacagctgatcgagccggtgtgcttgggaaatggaggcattcggagagccttaaataggttggcatttggtggtcttaattaaaaaattgtgtacgtaagtatgctccggtagaaattctcggaagcataccttgaacagacgtttcaaacgcatagacttcaattatcatcgacttgtcaaaaagtagtcgtcccaaatcacggcgtcacgtgctgtaaacattgaagccagatgtcttcagctgtgaggagaacgtacttgctttgcgcgtaaacatctctgttgttctagtctctactagtaataactacaagtagcaaggtggaagagtgaaatttctgctgacctgtgtgatgtagtatttgtaatttagcaagaaagagtatgtcgctgggtacatctctgttgtttgtctggtgcacagagaagaaagacaattgtacctagctgatcaggtgaaacaacaagtggaagaggtcaaactgaatcacctctaatagtcgtcctcatccatctgaccatcttccaggcaaacttctccgtttattactggtggctggtaaataattaggagccaatccagcaacgaaatccaatatatgccaatcaatttaggctgttagccactactaatacatccttgaggtgctgatgggtacagcaccaacctttctgttagtaccaacgcctgccgaagtcgcggcagcaacaataccgttaagagatcttgtgtatatgtcagtctgtgttaccattctatctaacgagccgttctttgatcctgctgaatgatggaacgtggatcctctcatgtccagagcaacatcagccgtgactttgctgttcggataagcataggcctgcgtctgtgactgtgaatgcattttataagcatccatggcttgtgattgttcaacacagttcatccttgcaggcacttgatgataaccatatgcttgtgagatttgttgctggggaggataccctgaactcatcactggtccccttggaccataaggatcattggtgcttccagtctcataaggaaatactgacccaacaggtctccctggtgccactgttaagaaggaaatatattagaaatataaacagaacatgtagatatactagtattaataaatgaaacacaagtgcacctggttttgccacttgtgaaacctgagaagaagtgggaatatttccagaaaatcctcccatgacccaggggtttttacaaggttcatcagagacaggcctgctgctcttcaatgaggccgcaagaggttgttccttgggaggaattggagtagagtgaacagtagtagaccttacaaaatgtagttgtagattagcaaaaaaactcaaggtttaactaaatcaaagggtataacattatgaatgcatgctaatcaattctcgtctaatgtcaaaatatctagactgcaaaattcttttgtaacatgactctaactaacgtgcgagttcctttcttcatcatatcatataccaagtcaaacggagaatttggccatctagatagcagttatatgcgccaactctacaacattgacagaaccacaaattcctagagaaatctccatccctgtgcttggtgcaagaccatgcacaagattttgacacacttcaggaataaagcagctgttttctttgaactcatgtgagccccagttacttcagtccaaagttttatataacccagtttgccatctggacaaggaacccctggcctgatctagatgtttctttcatcatttggcaccaaggttgccttgatattgagaaatcttaagatgaccttcaaagcacgcctcaaaaaaaaaaaacacgagatcagaatttgatgccatattacctaggaagcgatgcatgttttctttccattggaattgctgagccacttccattgctttcttcaagattagagaactgcttcttaaactgatcaaccgcactgtataatcatgacgacaagttatcaccgtcaatgagacttgatacagtaaaagaaacgtataaatacatggtacatgcatgtgcaaaagcaccatacgtgtgcaaatacagaaaagctaaaaccttgggtagagaaaggttgctctctctcttccatttctgtagttcttctgcaattgtggatgatattccaatatctcctggaatatcagctcccttatatcttccttagacaattttttctgctcaaattcaaactccagttttctgattggctggcatgatggttctctatcaatcttggaaaggcctttaaagtatggatcagtcaatgcctgacaagttttaagtatcaggagaatgccacaacaatacaaaatacttcacataccaaactaaagttgcaagcaaaatcttaacatataaaagaaattgacatatcagtttatcacagtgacaaaagacaccaaacagttacctcttcagcagttggacggtcctttggatcaaaggctaataaccgttgcaagagttttagtgccaaaggatctgcattaggaaacttttgagagaaggggactggatctttctttctcatgctgctcaagtaccgtcttgctttctcattccgaacctggaaaggaagagaacaataagacaaatgttgggggtcactgaagtctcctcccaggaggacctacaaaaaacttttacctaacagtattatcatacccgggaaattgtatccatggaaggtgttcctagaagatcagtcatcaagtctaactgatggacaacatttttaccaggaaacaaaggcttccctgtcaacacctcagcaaagatgcacccaatgctccaaatgtcaatagctggtgtatactgcagtgaaatgataatgcaaaacacattaagatgctgcatataaccacacccttgaaaaattatgataagcataaaagcagcacattagttcaccaggcatgtgaattttttttaaaaaagcttgtactgttctaagttgctttttttttacagtaatctgaattgttgtaaacgttgctattcagcaggatattggtccatatttgcgtaaaacatggaattgatgggaaataataataagtccttgaattaaaatacaaaacagaacaaaaaaatgatatcagaacaagattgaacggatataaatctagcaaaaatggataaacagtatcaaagaaacacaaagatgaattgtatatgctttataaaaacatataaaagagaaaataccaaataaaacataatatgacatcgtcaagtctaacaagcacattgtatttctgtcaggataaacatatgcatgaactgcaaagctcacctttgagaagaaggatccacagagctctggagccctgtaccatcttgttgctacataatcctgcagagcatacgtgttatgtccataaatcatggtggtacttcaaccaaatcagttggtgttgggtttgtgcttcgtactaacataccgtccagaagacagttgttggggtatcattgaatgcaactcgtgctagtccgaaatcacatattttcagtttgcagttagaatttgctaaaatgttcttgggcttcagatcacggtgataaacactagctacagttatataaactcagtgttagcacacattatggcaatagaaaaataaaagaataatatgcaattgagtcataagattttacacagggtgtcaataaggtagaaaaacaacagggcatggttgatgtgtttttagcagtggccagtggcaagtcaatacctatgacaattattggacaagaatcccctcaagcaatcagactgtgtccttatcagagtagatactacataaatgtaatgaggaaaatgacaagagtgctaaataagtcacaaagcttccatgaacttacagtcaggtcttataccttgactgttacaattaagtataatttactttcatggtaattttagaaggcgtgtgggctaaaagaaagctactagtttgaacaaactaaaaggacgcagactgatatgtaaatggatatgttaagtggacatattaaaatatagagggatagtaacaggtatcatggttggaccagctagcacaaagcaaggaaccagattaataataggtaaaattataatctacagaaatcatacacaaacccattggttaacttggttttacatcataaaggggaaagcccctgctgctaaattggtttgcaaaaatatggtgatttattatctgcatttgattgactgcactccaagcaacctttggtaaataaaaatattctcacattcactgtagattatctagacatggtcaccgaggaagccataactaccccattacttcactttcttttataattatactgaagcacaaacacatggggagagtggttgaagggcatgatgagtaggtgacttccctctatgcaatgaatatgcaatacatataagactaaccacagaatgctgcattgtgaaatgagatcaaagggggtaactaatatacagactacagatgcacactatctaaaagggggaaatggaactagagctgaaggagttaatgtttcctaccagtatgaatgtatttgagggcccggagtaattgataaaggaaaaattggtagtgctcttttgttaagtcatcattagcctttataacttggtggagatcagattccataagctcaaaaacaacataaatatctttgaagtcccttcttgacggaggtagcataatgtgcttgatctcaacaatgtccggatgccttaggagtctcagaagcttgatctcacggagaatacgcgcagcatccgagacatgctcaaaaatattgtgcaccttcttgatcgccaccttctgtctagtgtgcaaatcaatggcagagcacacaaccccatagcttcccttaccaatgacttcttggatcctgtaccggttcgcatcaccatactctgtaaaaaactcctccgcagagctctgaaaaaaaaaagaaatttcacacaccgaatcaacagcccatcactgaagattgcaatgaacttcatataatcaatctcataaaaaaaacggcaccatattgttgaggtcacaaaattattgcaattcgaaaccgaacattgagaagcttccatcttccaccagcattaaatcatggacacagcaacgaactgttgttttcgttttaccaccgagatgggtttgcttgtgggcattaccgaagccgggagccccacacgagtacacgaggtaagggaaaagctttttcccaccgacagggcaaagcagcagcatgcggcgttgtttagttcggcgcagaagcatctcgcagcgacacggtaatggtcaactttggcatgtgaaggatgagctgttcgtaactcaccgttcggtgcacatcgcatttggccttttcaaccacatactccagattgctagctggatcgcacatttcgtccatgatgaacaacgcaataactaaatccattagaacatgtaaaaaaaagtaaaaaaaaaatctcaaaaaagtttatgtaaaaatggcgatggggagttaaaaaactagcctatttgcaaatcgcgcgctagaactgaaatgaacagcaacaccagaacgccattagacaatccacaacttataaagaacaaaataacaagacaaaaacatcgaaggacaccgaggcgattcgcgcatcgcaccaacatcaacgggcacccatatacgttccagagagctacacagagaaacacgaggggggaagaggggcgagagatcgccggaacccgggaaacccaccttcttccgctgctcctgctgcattccgctcccttacagatctctccccccagaccaactcccacagcgcccccctcgaatccgcctcgcgacaaccccaaacgcgccgccactcgaatcccccctgccccccacaaatccacaccgcgcgagtcgcgagcaccgccgctgccggcgcgcggtcggtgatggtgaaggcgatggcgatggccgatggcctctcccgccgcgtccgcctcctcccgatctcgcggcgtccgcctgagaggagcacgagagagaggaaggggaaagaggaagaggaggagaggagtaacggggggaaaggctcgaaatcaaaaggaggggagcggattaatttcgcgagagatggtgtgtgtggattcgtggtgccgtaaatcaaatactgcaaggatggttttgtatgtgcgctccgggccacatgcggcgggtgggatgcggacctcagcaataccctgctggattgctcttcgccgtccgatccgcatcttgacggccatccttctttggaacgtatcaacctcccacaccctccttttattacagttttttttactttttttttaagtgtgaaattgggtggagtacagtaaaaacatattattcatgtatcatatttcgtatttttcttccaagtcagacccgggtgcgggtgcagctagtgccgacaatatatcactcatcatgtaccaaaatttttctttctcagaattagattcaaaacggatatctagttgtgtccctaatccataaataaatatcaaagtaagggatacaattcaattaaagtgttaaaaaaagttcaataatatatatatatatatatatatatatatatatatata

SEQ ID NO: 76335 - DNA, 743 bp, Oryza sativa
ccacgaaccaaactcatactagaagtcctaaacaccttatgaaaccttctagtacaacaaacaaactttacataaccaatcataccaaatttggactccttccaaattcgactccgcatcccatacgcacacaatacctccatcgtatgccatatagaatctccatcaaccacgtgcatcaactctagcctaagtatcccgcatgatctctgaccaccacggacgtcgtcttatccccaagccgactcccggtccatcaccgcaaatactctcccgaggcatcgagtcacctacacatgaaataaacaaagaaaccatattccgagaccaagctatctccaacttgactcattagtagcaagcaacagtattacatacgtatagtatccatctagaagccataatcatgaaataaacacggatatccaaacaaacaacccgaaaccgaaaccaacacagcgtcggccggtcagaccgcaggctagccagtctgaccgcgcacatatagccggtctgaccggcaaccactgcccggtctgaccggtcacataaaatcacagcacctgcaattcacctgtaaatccaatcatctccaaaaccacttcgtaaataaattccaaataacaaaaccaataatctccaatgccaattgttcatcacagaataataatcaaaaacacctttgatgattttacaagatggacatggggtaaggtgctatctttctacagtggtgaagccag

SEQ ID NO: 76336 - DNA, 2596 bp, Oryza sativa
cttttgtaatgtaaaagaaaattgttcttcattgcctacctgccaaaaaaacatcaccttccttcctgcatcaagcagcctaatcttttaataagatgtactacaaagcgacagctccacatcacatgttaggattacaggagacgcgtccatcgatcttacggcacgcaccgacacacacggtgcctcctctgccacaattaattaacaagtaaaacatgctttgacactagtagtgaactcctgcatgatgggagagtttctgtgcgttacaatgtccatctcgctattcatatcgcattagatgtgtccattgactagcgtcatcacaagttgttccaggacactgtccatgctctgaaaattagtgatagcgatcactgattacaggcttacagtaccattcaagtgcacagacggagacatgatggaatctcgtagcagtatcacgttattccagaatctaaatgctgttttccaataatcgataggtgcccatgtgactcgcagtgtgctggctataaagtataatcatgttaattaattcatagtcgttctccaatgacaaatgaaatggcagaaaggggaggggaaaaaaatactatttcgtgtatcaagaagctgaaactactatgaaatatacactatgcttccttagttcctttatctgccttgtagttacataaactgcaaaataggatgctatgatacatgttggtggtggatccacaacaaaaagttgctgcttgtaatcatcttcccaagatcgacattattctagcaagatgaacttctttgggagctactaacccacatgggtgcgagcatcttatattcagagaaatcaagtgattcagaggaatcaagtgaatccatcagtcaatcctctgaagattatatttcaccacgttctcaagggtacttctgaactggctcttgggaaggcactgcaaattttggagagccaagtcacctttctcctttgcaagctcctgcgcccttcttattccaccacttctgtgaaccaagtcgattgcagtagccaatgaatcactttcactgaactcagaatcgattatctcccttagtttgggttcatcttgcaaagcgaatatgactggagctgtcaggtttccctttgctaagtcactccctgctggtttcccaagttgctcagctgattgggtaaagtcaagaatatcatctactacctggaacgagagcccgagattcctgccgtattcatacatttgttcgcatatagtggtgcttacaccactgaatattgcagcagatcttgtgcttgaggcgagcaacgaagcggttttataatagctcttgagcaagtaatcatcaagggtgacgtcgcagtcaaaaagagtagatgcttgttttatctcaccactggcaaagtccttgatcacctgtgaacacatcatctataagcaaacaatgcaggagcacagtcttaatgaagagatggaagtttgctcttcattcattacctggctgatgagcttaataacttcgatgttttctaagttcgctaggaaccaagaagattgtgcaaacataaaatcaccagcaagtacggccacccgtgttccatatagctgatgaatagtttctttccctgaatataatcagatgcgtttcagaataaattggtcaattggttcttaccaatgtccaaagtacatgaaccacccaaaaaggcaaaaagcaaaagaaacccacacattctgccaggcataaagaatatgtataaattgtttctaagaagctatgaaccaaaatgaaaaggaaagaaacagcgatatttattgacagcgacttgtttgtaatagaatgatatgtacctctcctcatgccactatcatctatgacatcatcatgtattaaacttgctgtgtgaatcatctctatgatctctgccaggcgttgatgctctgtagtaagctccctgaattgcaaaaaaaacaaaaggattgagtgcataattgcaaaacacctaattataagtagtagagctgcaacacgagtaacttacaacaaaccagctaattcagcagttgctctggacaccagaaaaactaatgctggtcttaacctttttccaccagcaccgaaaatttgttctgccgcagaaactaaaactggattttctgcaccaacaagctattaaaattatgtcagctagttgctgcggtagcctggtaggtaggaaaaacacaaagaactagcctagcaaatttttctctactcaagtgctcacacactatatgaagcaaattagtgaagatatatgtattcaatatgtaatgctctgaagtatgctctcttaattatacaaaaaaatgatgatctgtggatggagtacaaacaagaaactgttgtagtttttgagggagaatcgtgtgttgtgcagaaccacaaaaaatatgtatattttggtcggagtaggaagactagtagcaaactagcaattcaacaacacgcgagccattcaaaagtattatggagcctacagatataggaaataagagccagaaaaatctgtccgcgtactcctggtgatgctaagtccaagtcatca

SEQ ID NO: 76337 - DNA, 1547 bp, Oryza sativa
aaaatatcccagtcgattttttataaaactggtagacccattacttatatcccattagacatctaacgactttctatcaacttagttatttttttctcagcgtgtatacaaaagctatttacccatacgttttgatattgatgcttttatcaataaatgatcattttaggagataaataaataatcttaagatgatcgtagcgtctaaattatatatatgatctatgaagtcatgtggccagttgaacaacatactgatcgtactaagcatgttggttgcaccaaggaatcttaagagtgaaacaacctgatgtcgcctcagcaatatataacccaattccatataggaatttaaagaccgtatccatttactttttggtaaaacttgctgcagtacatcgtgaatttgtgacatatagcatggaacaatctacaaacgtgtgattcttacctgacgctccagtttagcggtaatttgctaagaaaatactatggcctctatattaattttttttacataattggagcgagataatttagaattatggatgcctttacaccatgccaagttgtaggatcaacccacttatattgagatcaaagcatttcaaagatgcttcatatagtggatttgtccaaaaaaaatgaagataaaatgaaatgaaaattaaacaaaatttatctaattttaaaattctttttgttgggtttataacccattctagatagaaatattcaaacattttagtaggaccaaaaaatgaaaatatttaaaatttcaaataaaatctaacaaaagaattggacattcataggaaacacatcaattgtttcgttacaaaattttctcatgaattaaaaacaacacggtttgatgtaattttagttcacaatttatatgttgcaagtaaccaacgttcaaagcatgttaaataagttcaattttagtttatgataatgtaaaataatattttggatagaaaaccatctacacatggacattcgtaataaaattttacgcacatgcccgcgcatatgcgcgggctatcttcctagtttaaaaataataataaaaactgatagcaccattttcatccagctgccactgcatggcagcaccaaccttgcgctcttctctctcatcactctccagcttcccccagccaaagccaaagcaggggaacacgccgcgtctcccctctctctcctgctctctgctgctgctggtggcggtggaagagagagaaacgaagagcacgtgatgcaccacgcgcttctcacactccagaggtggaggggaagaagagcagagcatcgcgcttgctttcctcttcctccggttgcttccccgcgtcgccattgccgccacctccaccctcctcatctgtccttcccctttttcctaatgcgtgcaagccatcctcccccacatcctcaccttccctctttttcccacactactcccccactcattaccattctactataaaaactcaccatcctcccaaatctttcttccgtttcttgattttgtgtgctatcttggc

SEQ ID NO: 76338 - DNA, 42566 bp, Oryza sativa
  unsure (1)..(42566): unsure at all n locations
atattttccttacaactaaatgaaccaagcatagtagcttaagttgttactcatgatactgaactgatcgaactatagtctgtgagcggctttggtatataaggcgcaagtgccaagtatttactagctatcaagatgctggttctgccagtttaagaatcgaaatgagttaactctgatcatagcttcttcctgattagattcttaaatcttaagtagacttgactctccccatgaccgctcagcgggtcacagttgtaaaagttttttcttctgctaatatatcggcatgcaaggctcttgcgcattcgaagaaaaaaaaaaactagacttaactcatttcaaccatgataatgtatcagacgaattcacagaaagagaaactattgagtaagaaatgtatagcctacatgaatgcatctctatttaacgcaattctgagtaaatcaaacaaaagatgtggccttcagaagaagctcaccgatttcagattattgttgagtttcagcaggtcgtcggagacaacctccaaaagtgaagaaacagaaattcgctcagggatcattgttgttgttctcgcactagaaatcgcctctgctggcacatcaactgcagcaaggcctgcgcaaatacgctaagtcgttagctcagctcactccaaaacacagcggctcaacagaccaataggaacaagagctgcaggatgaagaacctggctggctcggtgaggccacgaaacaaacacatggcatgcgccgcctcggcgccacccgcatgccggaccggccagcccaacggcaccggcaggaggccagctgaccgaaatccagcgccttcctgctcatgtacactctcgggcagctcacagacaacatctcccacaatcagtaccgccaatccaagaacccaaagaaccaagaaatgaagctacagcaacttggagctccctagaaccgacaaattctttggacaccaagaacctcttccccggacaatagcagccaagaaattaaacgaatgctagcttgtgattggtttcgtgtgagaatcttgctcaatttggtggctatagattttttttcccctcttcctttttggaaggaaggaagtggcggctccggatggagggacggagggtgtgggggatttaaatatggagcatgcggaggaggagaaagggggatttgtggatccatgagggccatagaacgaaggcgattgtgtgagctcaggagcaaagcagcgtgtgagctagtcagtctatcactttggagtttggactggctctagaagttcatgtaccttttgctctttggtcccgcacatttggctctaattgcagtttaggactattaggacttgtgaacttttttgtaatacgccttggatttctttatctttgttgtattataagaagagagtttgtatattgcattcacatatattgaaaggagaaaaaaaagacaaaatagcaaataataaattccgttaacgtcagaatttggtactgttctttcctggattcggttaaaggaaaaaacggattagatggaaatgtatttagattagggtgagttcaaagagaatcataataccagggcaaggaaatttcatattttcttagtatatcttctaaataggtaggattatttatttttatttttaggaaatcttattcatgttagagtataaatatgtacacccgagatctttgtaagacatctcctcgtattgatacaattgtatttcggcacatcaccaccctagttgtagtttatgtggttcatattctcgagcggggctgtatcggttaaattcgatatttggcgaatggggtaagtcatgtcaccccgtcaattgtactggtatagttaggactttttcgggttccgctcaatattttgactaggctttatggtcatcaatttatcttgttgtaccggcttcgactaaggctgcatcgttttgatttcttagttagatctggtatatccatcacgtttatatagatctattggctaaatagatttttcttattatcttcaatcttatattgttttggttaggttccaatctattagattattgctaataagtttaattctactaagtgtataggtttttatgcagcgtatgttagagttctagctgatgagttatcattactctaaacttcagttatatgatgtattggttagttagcccgtagatatatctacattggacctccagccaatggcggaaatagggaaagggcagctaggacggctgctctactcctaagcataaatattcatgcatttcaaaaactcataacatgaaagataaaggtaaattataatagttactccacttcctttagccgatgtatattttaaccatcggatctgtatctactacactatatattagtcgattggttcatggtttgattatttttatcatcattgttagttgcaggaacaaactaaccggcacattctgaacctgatttttggcatgtcgtgaacccgatttctaggacctgcactagagctaattagtaaactctcaaaccttcgtgtattggataaatttggtgataacatacatagggctatctcttgcgacatactacctccgtttttttaatagatgacgccgntgacttttaaacatatgtttgaccattcgtcttattcaaaaaaaatttatgtaaatgtatagatataaatcatgcttaaaatactttgggtgataaaacaactcacaacaaaataaattataattacgtaaattttttgaataagacgaatggttaatcgtgtgataaaaagtcaacggcgtcatctattaaaaaacggaggtagtagtttataatgtatcgacgcggtggattgttatcctaacttgacggttaacactccagctaaatgcatgaacgcggccttctctgcagcatggcaagtgatattgttgtagcttctgctttggttgttgaaaagacgatggttcccattcttctctttccaaaatggaatcacgctgcgagaattattacggtgtcgaagcctcgtcaatatggcctgttgattaatttgtttccggacacggtttcaccgccaaaagaagtgtaaaatcaaaggtgttgacggagcgtggggctcctcaccgggagaccgcgcaggcccccctttgccggttcggccgggggcgctaagtgaggttcttcgccctcgatctgaggaacgtcagcgagagaggaaatgcacaagacacgggcgacgtagacaggttcgggccgctgagaagcgtaacaccctactcctgtgttttggtggatctgtgtgtgaaggaatacagagagccggagagcgagagagagttcaggctctagaacccattcgccagagtcccaacccctctgcttcctcttcctcttttctctttttctctttttctaggcctgggcctcctttttatctgttccggggtcaccacatgagcctcctgctgcctaagaaaggaaacatgctttttacaatgagggctagtctacagccggaagtgacctctgacaagcagagcacacgcctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggacggggcgaggcatgtgacaggccgcctgttgccacctaacccgcgatctctgaccggtcacacaccgcgaccggtcacggaccggataagcgtgcgctgcgccgcattaaatgcggcgtggcgcgctcgtccaacctgctataaatgcggttaggtgagcccggtgggctcacctaacccacacacgtggcgccaaaaccacagggggtcggggcgccccagccctcggggccgaaacgggagcggcccgacccttcggggagacagagggaggggtggccacgtcaccctcgggcccgacccccctgagggggtcaggccacgtgggtgaccgcggctacccaagcctctagtcacgataccctcggccccatgtcaccgacagtagcccctggcgttacgccagggcgatcgccccccttgagggaagcgctcgggcgtgacgccactccttaggcccggtgacaggtggggccggtccctacaggcgggcagaaacccagcggtcgcaaatcgcgcgcatcggcaagggaaaaccggccgacaataatgagcggcctcttcaagaccgctacattactcgagcagcgcgcgaatcgggacgagccggttcgtttcgccagggaggtggaggaggagcgggagactgccctcatcgccaccgccgtgctcgacgaggcgcgggacgacctccgcctccaatacgggagccgggcggcggagctagaggagaagctcgacgccgcccgggaagtccttgacgccgccgctgcccgggaacggcgggcggcggagaacgaggcggcgtcccggcagcgcgaagaggcccttgaggctcgcgccacggcgctggaggagcgcccccacgccctggacgcgaaggagagagacctggcggaccgcgaggccgccgtcgccacccgggaggcaacactggcgacgcacgaggccgcctgcgccgaagaggagtccgcactccgcctccgcgaggacgcgctcaccgagcgggggcgagctctcgaggaggccgaggccgcgacgcagcggctggcggacagcctgttcctccgcgaggcagcgcgggaggagcaggcacgccgcaatctggaaggcgcccgcgccgagagggccgcactggatcagcgggccactgagctcgaggcgcgggcgaaggagctggacgcgagagcgcacagtggcggggcggccgcgggccacggcgacctagccgcccgcctcgcagccgccgaacacaccatcgccgagctgcagggcgcgctggactcgtccgccggggaggtcgaggccctccgcttggcgagcgaggtagggcctggcatgcttcgggacgccgtctcccgtctagaccgcgccgggcggcaggcgggcctctggggcgggcggtacgcgaagtacgccgccaaccaggggggcctcgcccagcgcctctcagagatggccggggccctcgagcggctccccgaggagctcgaggagacgatcaagtcatcctcgagggacctcgcccggggtgcagtggagctcgtactggcaagctaccaggccagggaccctgacttctccccgtgggcagcgctggaagagttccctctcggaaccgaggacggcgcgcgcgcgcaggtccgggacgccgccgaccacatcgtccacagcttcgagggtacggcccctcggctcgcgttcgcgctcgactccgacgaggagggcggtgacgacggtgcggacgacagcgacgacgaggccgacgacccgggcgcgtcggagtgagcccccaggcccccgccaatcttaataacttttccttcttcttccgaggccttcgggcccccttcttgtatagactgatttaatctgcaatcaagtaaagaggaaatttctgcgtcagttctgtttgttgtgtgtatgagacgaggatggtctgtgccgcggtccttctgtgtcttggcttgaacaagggctcgtgcccaggtcccagcctcaaacggcgcgggtcggggcctgcgttaccccgatacgctgatacggatacggatacgcgatacggtgttaccgggatacaccgtcttcctaaaaacatggatacggggatacgcgaatatatacatatatacaatttaaaaatacaaaaaaactaagtgtgaaatatggacttaaaaaataggaatcacaacacatgtgttcttcaaatagatggtagataaaattgttcacatagtagataaatcaacagtagagcatcaccacagcgctaaactaattagaattaattaacttgtccttgacttcaaattcaactcaataactagattgcaagactagataaattgattgttgatttcatccattggaaccgaagtggatgaaggcccgttatcgccttgtatgtccaatgcaccaagatcttccagtagtctctcaaggtcaggctcatcaagtgtcagttcagcttgttgaagaaaatcagcaccaccatcaaacaactcatatctatctcctgcaacatcccacattattgatgggccactgtagtattcttcagatctcctagaaagaagacgcatattttggtgcacaaacaccaaatcctcagcacgtgcaggcctaagactaaaaaaaatgcaattgtgttaatttcatgcattactaacatacaggaaactaaataagtaagagaaggaactaaacttgtttctcattgaactatggatgaaaccataagtgctccagtttctttcggcacaagaagatgatgttggctgtccgtaattttagtgccaactttttaagctcaggtgcagagttaccatagattccccaccattgctttgcattcatatgggctctatcctcaattgagtcaaaggaattaaacccactgccaaacaatgagaaatatgcaaattgttgtttgatctttctcaagtcatccccagagaaatatcttctaaaacacttatttctcatatctgaaatctcctcatccatatgaggggcttggcggtttggagcctcctccaaccaagtctcatagtagtacctacatgttgtaaaaaagattattgagctgctagcaacaattataaattatgcacataaaaattgaaaagaggtagaacatcattactttgggtttagtgaatgtgctaagcaatgcaagggggtagtactttttgcccatcggaagtgtaagatctcattcacatgaaagaaaaaagaacattgctcatctagttctttcccttcatgacgatagatgattttttttcaccttatctatcatggaatcccacatctcatagatcaaatggaggcatggtttgtcagtgtcagcagcacgaatcatagagtagataggctcacagaaatcaatgatatatttcactttatcccaccataaatcatttaaaatcttctccttgacatgttgtgcttgaacttgattgtcctccctataggcattccatttttcactagccaccatcaagattaagttctctttgatagcacgaaacctcttaagcatcacaatagtagatgcaaatctagtatcagcaatggcaagaaatttcagcttactaaaatcattgaacatggagagcctcattgagtgattcataatgaaattctttatggcagatgcatctgcagccacttcactaatccattggaattctagaaaagcatccccactagagtttttggcagcacatatactcttcaaggctaagttcaaagtatggacaacacatggtgtccagaaaatgtggctgtacttttgttcaaccatcaatccagcagccctacaattagatgcattatcagtaataacttgcacgacattatttgggccaacctcttcaatgatggcaaacattttctcagcaatatattccttcctcttgatttctccttcagtatagattgcttttaaaaacattggtccatcttctgtcactgcaagaaaattcaagattggtcgcctttgagcatcagaccatccatcagatacaatactcacacctttcgtagaccatgttgacttgacagcattcagcaagcgctcaacatttgtcctctcttgaacaagaagtgttgttcttaatttgttgaaatttggaggggtataaccaccaagttggttgttgcaagcaaactggaaagccttcctgaaatatggatttcttgcaacattgaaaggaatacctgcaaaccaaatgcacacatataattagttgcacgtcataaacaaaacaaaattgataatgttagaactgaaaaaaaaacatgctatattctgacctgatgtatagaacatcctcgcaatcaaagcatcaagcttggcacgagcatctaaattgaagcttgactcaatagctgaaacagcccttctcttccccctactcacactctctgttggtagtgggatgtccttaggcaaattccttgcagagattgcttcagctctagtcatttcatcttgaagttgcccaagtatatctactgtcacctttttgcatgtagccacaccaattgttccaattttcaagagatgtgctttaactcttgagtaactcccatggataacttggttacaaaactgcatctgaaccttgcattccctccttgacctttccctgtcttttccagcagctcaacatacctccacaagggcttcttttcatcatcattgggtggaatcacacgagcagcattcaaaatgctccttgcatgccctcccattgttgaaccactcccactagatggtctcgatgcatcaaaaccagtattaccactaggattgctagcactaccactatcatttgagcttccacttctaaaatccattgaatctaccaaagatgacagcaattatactaagaaaaattgaaccggaacactacgcacagtgcagatcaaacttggaggggatattcacttacctaaggatcctcagcgtcgtcggaggccgggatcgaaggaagccaacacggtgctgggcgccggttggaggcttggagcgggcggcgcggcaccttgtggaggaggagtcgcggaggagagcgcagaggagggggcgctgtgccggccgtaggcggcagcgcggcgcctgccgctggcggcggcgaggcggcgcagcgacggcgtaggcggcggcgctgagatggggatcggggaagcgaggagagaggggcagcgtgagttgtgacttgtgagagcgaggggcggcgcgggtggaggaggagagcatgttttgttcctgtgcgatgcgatttagggttaccccgtatcaggtccgtatcccaccgtatcgggagaatatccatatttattttaattatctaaaaataagaaaaatgagggatacgtatgggatacgtatccggacgtatcccgcacgtatccgtatccggaggcgtatcagatactgatacgacggtaatctaccgtatcagggtaacgtaggtcggggctagtgcctggggagatcctcgtgtcgagactggccaggccgggagcgcggtgaccgagggttatggatgacccgattgtgggcctttgccgattcccccccggagttcaccacgccccggggcacggctcggttctgggccccgtttggcgattttagccggcccaggccactgagggcagggtcgagcacgagcgtgctaattcaagccaagattcttcaaaaggaaacgatggcacagacacagtcctcaggaaatcgaaaatgcttttattgaaatacggaagagaaaaaaaggtaagtatatgcatgtggtagcccccggccaaccctgcacgcccggggggggtgcggggttggcccgagcccgagacatgacacccgacccccactaggggtagaagcggcaaaggtgttcgatgttccacgggttaggcagctctgtgccgtcgcccgtggccagccgaacggagcccggtcgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcgttggcgcgctccacttggccattgcttctggggtgggtgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccacccggggcccgcctgaacggacccaaggatatcgagcccccagacagcaaacggccacgaaagaggtatggtctgcagggcctgggccggctgatgggtttgcctggcgtggaactggcacgccctgcaccgccggaccagatcgaccgcatcgttgagagccgtcggccaatagaaaccctggcgaaaggccttgccaaccaaggtgcgtgagacggagtgggctccgcactcaccttcatggacatcggcgagaagctcgacgccttgttcccgaggaatgcacttcaggaggactccgttagccgcgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctggaagcgctcccctcgggtcccgaggcctagactccgacgggcctcgggggccgttcaggcgcgtccgtctctcctagggggtcgggtcgcgccgacggctgggcaagcctttcttcaaaggcgcccggtggggtctgggctcgcgaggaagcaagccttgagagttcgtcggcgaccgcgttatcccgtctgggcacgtgccgaagctctatcctgtcgaaatggcgctccatacgccgcacctggcgcacgtaagcgtccatctgcgggtcagagcactggtactccttacagacctggttaacgaccaactgggagtcgcctaacaccaggaggcggcggatccccagtccagctgccactctgagtcccgcaaggagtccctcgtactccgccatattgttggtcgcccgaaagtcgaggcggaccaggtatctgaggacgtctccgctcggcgaggtcaacgtgacccccgcaccggcgccctgaagagacagggagccatcgaactgcatcacccagtaggcggtgtgaggcagctgcgtggggcccgagctggcctcgggggcggagacgggctcgggagctggggtccactccgccacaaagtcggcgagggcctggctcttgatcgcgtggcgtggttcaaagcgcaaatcgaattcagagagttcgattgcccatctcaccacccgtccagtaccctctcggttatgcaagatttggccgagggggtaagacgtaactaccgtgacccgatgcgcctggaaataatggcgtaacttcctcgaagccatcagaatagcgtaaagcatcttctgggcctgagggtatcgggtcttggcgtcccggagggcctcgctaacgaagtagacaggccgctgcacctttcggcggggccgatcctcttcgccaggggccgcatttccagggcgctcttcgcccgagaggccacacggggcgcactcggcttctgtgccgacgacctcggggtcagagagcgacaggcgcggccttcccgcagtggccctggggccgtcctgggggtcggggacgcctggcaccgtcggacaagcaggcggagggccagctccggccgtcgggggccttgggccgccgttcggctcgggggcctctcctccctgctctctcccgggtcgagtcgacacagggtggggatgcgcggagtgagggttgtcctcgtcgcgctccacgaccaacgccgctttgaggtcgccatggacggtgatggggccaccggggcccggcatcttcatctggagataggcgtagtggaccgccgccatgaacttcaccaacgcgggcctccccaggaccgcgttgtagggcagactgaggtccgccacatcgaagtccacccgctctgtgcggaagttggcggaaccaccgaaggtgaccgggaggtcgatatgacccagcggccaggtgtgccccggcgtcacaccgatgatcggctgggacggccggagcaccatccccggggccttgatggcgtcaaaggctgcgggggaaaggatgttgagggctgctcccccgtctatgaggacacgccccaacttcacattgcaaacggtgggggaaaccaccatcgcgatctgtcctccccgggcaacgcacgacgggtggtcggtctggtcgaaggtgagggcaacctccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgtcgatgtcctcggcggtggccttctgcttggcctcacctcgccggttgccggcgggagccgccggggtcttgccctcacggcgctcctgcctcttctcctcctcccacttcctcgtccgctcagccaaacttttgaccgcgcggcagtccacgagatcgtggagggaggtgttgtgcacggtacaccacttgccggtcgggcgctccctgctgggagcgccggcctccttctttttgtcgctcgcaggcctcccctttcggggagcccgcgaagcgccctcgacggcgaggacatgaccctcgtcgtcggaacgggccgatcccttcttcctcctcctgtcccgccgccctgaccgagcggcggacccgggggcagccggagctgccacaccagaaccggaggagttccaggtccaggcctcctctttgtgagccacacggtccgcgagctcaaaaagctgcgcggtggtctgggactccttggaggcgatcttctcgagcatgcggttgtgccgcacgccccccctgaacgcgtagatcaccgcgtgtgcggggatgcacggtatggtgttgcggacttgacagaaccgctgaatgtacgagcgaagagactcatcgtcccttcgctataccacatgcaagtccgcttcttcgcctgggtgcggatatatgccctggaagttcgtggtgaactgctggcacaaatcctcccaagagtggaccgacgcgggtggcaagttcattagccaaccccgcgcctgacccttcagggccatggggaagaaattcgccatgaccctgtcgtcacccccggcggcctcgatcccggtcgtgtagatctggagaaactcggcggggttgacgcttccgtcgtattttttggtgatggtgggccggaaccttgggggccaacggacgttccgaaggctcgccacaaaggctcgacagccggcaccgccaaccggggacacggggggccggcccccgtgcccggaccgaagtggcgctccggacgaggaagcgccctccgttgcgtaggcggcgcgacgagtgtcgtgccggcgctcgatatcgaggcgggcatccggccccccacgcacatcttcttgggttggaggcgttgacgagggaatggcagacgaacggcgggtaacggccgccgctcgccgcgccctccgcctcgacgacatggagccggtggcggcagcgccagaggcctcggtggcggaggaccgcccgccggcgcctaggcgctgctgcgccgtcatgaccaagtcggccacgtcatccagccaacgtcgggctggagtctctggatcggggacgacgggcgggtgacgcaggagcgcgcccgcagcctggagcgcgccctggggcgtgccgccatcgccgtagacgaggcggcgacgcgccccgtcccgccgtcctcccccgtcgcccgcgggcggcgaagtcgcggatccttcgacctccccgagcgcctccccccgcccaagatttcggtgagagggggacggtggggtgcgagcccgacggcgcgggttctgctccccgtcgtcaccactagcgttcggagggaggctgtgcgccactgcccgttcggccattgggctgagcgggagaagcttggcgcacacgaaagaggacgagggcttcgaaagacacgcgcgccctctacctggcgcgccagatgacggagcgtggggctcctcaccgggagaccgcgcaggcccccctttgccggttcggccgggggcgctaagtgaggttcttcgccctcgatctgaggaacgtcagcgagagaggaaatgcacaagatacgggcgacgtatacaggttcgggccgctgagaagcgtaacaccctactcctgtgttctggtggatctgtgtgtgaaggaatacagagagccggagagcgagagagagttcaggctctagaacccattcgccagagtcccaacccctctgcttcctcttcctcttttctctttttctctttttctaggcctgggcctcctttttatctgttccggggtcaccacatgggcctcctgctgcctaagaaaggaaacatgctttttacaatgagggctagtctacagccggaagtgacctctgacaagcagagcacacgcctcctgccccgctcgcccgcttttccggtggacgcccatttcaaccttcatttaatggccaaagacttccttgccatacttgcgctgaagcctggaatggatctgaccgggactgacataccaactccaggagttagcacgccggctccggctagggacgagagccaggaagctctcatcattccgacgggacggggcgaggcatgtgacaggccgcctgttgccacctaacccgcaatctgaccggtctgtgaccggtcacacaccgcgaccggtcacggaccggataagcatgcgctgcgccgcattaaatgcggcgtggcgcgctcgtccaacctgctataaatgcggttaggtgagcccgctgtgctcacctaacccacacacgtggcgccaaaaccacagggggtcggggcgccccagccctcggggccgaaacgggagcggcccgacccttcggggagacagagggaggggtggccacgtcaccctcgggcccgacccccccgagggggtcaggccacgtgggtgaccgcggctacccaagcctctagtcacgatacccccagccccatgtcaccgacaggtgtttttgattattattctatgataaataattgggcattggagattattggttttgttatttagattttattcacgaagtggttttggagatgatcggatttacaggtgatcgcaggatctatcattttatgtggactggtcagaccgggctctggtagccggtcagaccggtgtgtatcgcgcggtcagaccggcgcagcccgcggtctgaccggccgacactgtgtcggtttcggtttcgggttgtttatttggatatccgagtttatttcatgattatgacttctagatggatactatacgtatgtaatactattgtttgctactaatgagtcaaattggagatagcttggtctcggaatatggtttctttgtttgttccatgtgtaggtgactcgatgtctcgggagagtatttgcggtgatggaccgggagtcggcttggggataagacgacgtctgtggtggtcagagatcatgcgggatacttaggctagagttgatgcacgtgattgatggagattccatatggcatacgatggagttattgtgtgcgtatgggatgcggagtcgaatttggaaggagtccaaatttggtacgattgattatgtaaagtttctttcttgtactagtggatttcctagggtgtttaggactcctagtatgagtttggttcgtggctttaggctgcctacctcatgtataaatagagggggagcgtgaggcttcccggtatcgctttagagagcaattgagttgagttttgagttagggtttcgagtttagtcgaaattttcgtaaggagtgctgttggtgcactttgtaaacacatagagaatcaataaagtcgtcatctactttaagagttcttcgatttgtgtttcaccgggtttcggcggtctaaccggcaactcaccggtggtcagaccggcggcattgcggcggtcagaccggcgggagcacggcggtcagaccggcggcggcgacagcgagcggcagctgatctcggcggtcagaccggagatctaatctcggtcagaccgacggcaaccaggcggtcagaccggcagcgagggtaacttttagttccgctaaaagttttcggtttttgggtataccaaccattcacccccctctggttggcttagttcttgtgattcaatcctacaattggtatcagagcctggctaggttaacatctctggcccgatggacacttgtgaaggcctgatggaccgtgggtgcctgcgggacccgtatacctgatggaccgtaggccagtgggggcccggatacggtgaaggggcggtgaagggctgaggaacaccaatgtgtgaagggggagattgttgaatagtcccacattggttatggaagtgcaaaggatctaagatataagtgggggagcccctcacttcaatggctagcttttggggtgggaaatgtcctttacgattctataagaaggactgcgctggaagggaaccactatatgtttggccgatgacaccaaggacgagccaccaaaattagagtgattccggggagccaaccagaaagtggtctagcgtctcttcgtgtttatcatagaagggcacacttcgccgaggtgagggcaaagccctgctcgctgagaaggggaccacctatacatttgtcgacaaattttctactaaaaatttgacagatgtaattatagtacaatcgtagtgtaattacaatgtaacttgtatgtaattacactgtaacttgcatgtaactacagtgtaacttgtatgtaagtttcacgtaattttgaatcgttagatctattacaagatttgttctatggaggaagaaaaaaatcacatcacacacatatatgaaagaatttgttcccacgacctctattttactgaaataacatgttaccgagagattcttgaaagttacatacaagttacattatagttacagtgtaattacatgcaagttacagtgtaattacactacgattgtactgtaattacatctgacaaatattagggggagaaatttaatgacaaatatctagcaaaatcgtgctggaaatgcgtatattaattgtctactggccatgagcaggccagctgcgcgtgctgtgagcagagtctgcaacagaaatggatccaaatggccaacggaacggcgacgacagtagtgaaggaaggaacgtgtgctgggagaaggaccgacgtggacaaacgcggatggctagcgaggaagtgacttgggggccgatattcatccccgcctagcctatcacgtcgctgccgtggcccgtcgccttcggcttcggccggcagcaggcaggctactgtagtttggccttggaaacttggaaattggccgcacccgcacgtacgccgggcgcgcggtagtggacgttctcctatgtaataatcgctctcatgcgatgcgacactagagtggcgttggtgccaaaactctcttccgagtcgttcgttccggccaagtcgtcgtatgccgatctaccgcaatgctatgctagcgaggctgcatgcgccgtggttgcaagcccgcacgccgcacgccgtggctgccggagcattactggagtgatgaccaactgagccaatggcaaattgacgtggtgcatgcaccgacaacgacggacattagcaatgacgcaacgcgagcatcgcgatttttcaatttgttaatcttctcagcatcaaatccggcagtgacataaataagctgctctggccctctagatgatgcatgaacgctgtcgcaaagaaacgagcttaatttcagttgactccatcgatatttttttttctgggcgtgcgtacgtggttgggtgcacgtatcatgcatacggacggcatgtgtcggaggctcggagcatgtactgacgtacggacgggcgctgtagtttatgggcctagcgcatgatgggctattatgggcctgatcgaaaagcccagtttaggacaaaacgaggttaactgcaaagctcacacgaatttaatccaaaattaatcatgttaaaataaatctaactaaaaataatgagaaagtccgagaagtattattgacaatctcacaaattccaaaaaataccatcgataagtacgagttccatgaaataccattatgccagaaatgttattgctgttggggttccgttagcagcacttcgttaagtgttgtaagataactttaacgacgttggatgaatggaatcctatcaataataatatttctgggaaccggcaaatcacaccaatcaagatgtaacgcccaaaagagaggcaagcggtaacacacggttgagacaaatagacaaatggtccacagaggctctaccgctctagaggtgtgattttaattttgaggcagcacaaatggaagaaaccgtttagtgaaaatttacactatcataaaatatatcctaacagcagcatgtcacattctccaccttccctaaatccttgagagcaaactttcggttacagaatgctttttccttttccaccaagccacaaaattaaaatcacaccttcccaatcatacctcttcctcccgtactaacccaccaacaccacaaaggcagaaacagtcccccaataatcgaccaacaaaaccgagtccaaaagaaatcaaatccagaatcatttattcattcaccttttgtgcaccagcagttcatgaatccccctgactcggtatatgtgacactgtgattgtaccaagggaaaaaaagaccgagcacgacacgacacgacggggtcccggtccaaaccaaaccaagccaaactatataaagggtctgttcagatcccaccttaaaattttacaccctatcacatattaaagacctactctcctcgttcttaaaaaaaaaaaagtgaatctaggactgaatgtgatatattatagtacaacgaatctggacagatgtatgtctagattcgttctgtccagatttattatactaggatgtatcacatcaagcactagattggttttttatgggacggatggagtatatgaaatattaaatatagaaaaaaaataacttatgactaatttgcaagacggatcttttaagtataattgcaaatgatttaacaatgtgtttgctacagtaaccattttctaataacggattaattaggcttaataaattcatttcacagcttactgacggattatataattaacttttttattagtaccaaacatcttatacgacactctctatagtaatattcgatgtgacacgtgagtacgtgacgcctgatctaaacaccccaaagaaaaagaggcgaaacgaagggaaaaaggagccccatccccaccaaacgcaacaaccaccacatcccgtcaaccgatgcaaccaaccgcttcgcgtctcctccccgtcattctcctgctgcgcctgcctctgccgccgactccccgctccgctccggcctccctcccgtcccgaccgcgaccagccaccgcccccgtccctcccgcgcgcgcggttgcttcagatctcctcttcccccctccctcacccgccgccaacccctcccgccattacgtagcagtatataaagtcctatccccatcaccctcccatttcgctgcttctccctccctacccgcgccatggcctgctgattgctgctgctgctgctgctgttgactcgtctcccgtggatctggatcttgatccccgcgagaggaatggaggtcttcggccccgtcacgcccggccaagtaagcgcgtgcatcccatcccccgccgcgagaattttgattttcgctttgctgtttcttctaccccgtttcggtttcctccgagcgaattccggcgagggtgcgtgcagtgttcgttcggtgcactacagtagtatattcctgtggcggcaagccggcggcaacggagtgcggcatgtgtatcacgagcaatttggtgaaggttcttatggaatttttcttttttaaggtttctccttcctggattcgtgagagaattgcgtgcctaatacggcgcgcttgtcacatgagcgctcacctaaccgctgtcctggccttccgtcccctcggaggtgtcttagcttccaagctagtactaatttagttttaacttcgcatgtttagccaaattgaatcagatttttgatgcccaataaaaaagttatgacttagtgaatgttgtgaaggggaatagaattcttgtgtctgtatgagtgatctgtaagtcgccgtggttgccatttctacttccattcttatatgacacttcgactgacgtttacaatctgaatttttaggcttagtgatgatacttaaattaaacaaacatcgctgcaagttaagctcactgtctggctctaccatggatgaacataactccatgttttcatttcttgcaggtttcgtttttgctgggtcttttccctgtcctcattggatggatctacgccgaaatcttagaatacaggaaatctttgttgtatgggaaagtgtaagatttctttctgaatactataattttatttagctttaggaacttagagttggttgttgatatgcatatattcgaagtcaactgcccaccattgctcctaataattgaatcatgtaaccagagttttcgtgatgaaactggcatgacatatcttacttcatgcaaatgttgaaaaatccatggtctaatctcctcctatccgggcattcttttcatctgcagtcactcggatgctaatttggagaatgagactatgaaggaagatgataaggctgtattacttgaaggagggcagtcaaaatcgccatctacaaagctccgaaacatgtctacaaaagcaaatttaatacggtactgtttgaatgcataatgcacagtttttaggattttagcaaattctattgcagttaagtgatgtctcgatgtggctgtgagttgcaggtttataacaatggacgagtcttttctgcttgaaaaccgtgctgtgctaagagcaatgtaagactattcagagctaattttttccactctagaatttcgtgctaagacgcacaccctttaactttcttgcagggccgaagtgggcattattctggtctacttttacatttgtgaccggacaaatatatttccagaaactaagaaggtaaccatattgctccttttcttactcttgacactctcaatgatgtactatatggagtagatgtaaactgcaacatgtagcttttggctaaattgtaactgtagcttgttccacatccctggggatagttcttactgttttttataatctaccatatcttgtttcttaattgttcttcctgcaattaattcttgcaagttatagggacttttctgccttagtttcagtgtaggcttatctctaaaacaagatagagaccgtgagttagggctaagtaggtgacatatctgttccttatctagttatctgactggcttaagctttctgccatctcatacagacagaactcatagccaatggatgtgagcatgtggcttgtagaaaggggataggttataagtcggggatcggggtcttgttggccaacttttctcgttgatctaataagctagaatttagggatttacctcaattaggccaaaaaagcattatatgatgttcatttctgcagtatatagtaatctttgtgttgttttgacagagctacaaccgcgacctgtttctgtttctgtacattcttcttatcatagcatcggcacttacttcacttaagaagcacaatgaaaaatcagctttcactggaaagtcaatactctatcttaatcgtcaccaaactgaggaatggaaagggtggatgcaggttagtgactttacttcactgcttctgttcttttagtaaatgtgatttcagttatttctgtactgagtttttatagcgcatggttatcatccttcctgttttgtacacgcaagcaatgtactttgatgtttgttcaccaggcattgagttagaaaaaaaaactctgggtattcttatccaaatcgtgctctcagttttatgtcatgcactgtttttatttggacaagccctatgttacagccatttcatgcctcagaaatttccaactactgtcgtagcacttttatattctttctcgctgttgtattatgcaatccttttagtacttgtatgttggctttaagtgtgctataattattttatctgcctttccaggtcttgtttctgatgtaccactatttcgctgccacagaaatatacaatgcaattcgggtgttcattgctgcctatgtctggatgactggattcgggaatttctcatattattatatcaagaaagattttagcattgcaagatttgcacaggtttccatcctagcccaattatccaatgttgtttcttaccccttgatttgttgtaaccatcttagaaatactaaagaccatcttttaaatgcagatgatgtggaggctaaatttctttgtggccttctgttgcattgtccttgacaatgattacatgctgtattatatatgtccaatgcacacactttttactctgatggtatacggatcacttggtctgttcaacaagtacaatgagaaaccatctgtcatggctattaagattgcttgctgcttcttgactgtcattttgatatgggaaattcctggggtatttgaatttttatgggccccctttacatttcttctaggtgagttatgcatgttttctgtcttagcattattctcattaaccatggataggattttacaccattttcctttcatgtacaggatataaggatccagagccttccaaggcaaacttacccctgctacatgagtggcatttccgatctggccttgatcgatacatatggattattggaatgatctatgcttacttccaccctaatgtaagtaattcggttatggatccacatttcctccctttggaactgcatgagtgagcagtacatataccgtgttcctttcatacatttcttcctagggagttctctcttattttaagaatatgttccttgtttatactatatattaatgtagcatggaatccgctatctgaaataggttgaacgttggatggagaagttggaggaatctgagactaaggttagactgtttatcaagggagccattgtcactctttctttgacggtaagttgcatccatcttttaccaatgcacagactttctatattgtcaagatgacatacttgtttgctttaccaactagatttgcttttgttttaaaccatgatgctgtattgatttcaaatgctgtactaactaggacttctgttcctcattttaggctggttacctatggtatgaatatatctacaggctagacaaaattacatacaacaagtaccatccctacacgtcatggattcctatcacgtacgtataaaaaacactaccatgattatatggcatgtggtaaattgtttctttaattgaatagacactttcagcaaaaagaaaacattgaattgacacaacaccgttgttttacagtgtttatatctgcctacgcaactgcacccagcagttgaggagtgcctccttggctcttttcgcgtaagcacctaatataatgatgtttctttttctttattggctttattttttactaagattttaacctgttttttcaatagctggcttggcaagatcacactagagacatacatttcccagattcacatttggctcaggtatggtatcaatttttttcagcatgtgttactgttgttttaattacttaatgcatgaccgttcaaaaaaaaaatttacgcatgaccagtccagtaatcagctctgcatctgatgtcaaatgtatgaacagaactacgaatgaaaataaacaagcaatttgacgggttgtgtattcagctgcgttgacttaacctacttggtgtaacacctacagctatcataagaactatgatagatttagatttattgatgctaacattgaaaatatattttctactttcaaagagaattcggaattcaaattcaagaaaaacacaagaaatgaagatttctggattagaatacatgtcaaaatttctttctaatatgaaatacgtctaggatttgttggcattgtccactctattgtgtccagtgtttttaattttaagaactggaaccacggtgctgattcttattttacaggtctagcacgccaaatgggcagccaaaatggctcctatcttttgtaccagattatccattgcttaacttcatgcttactacagcaatctatcttcttgtaagtgaacctgcccagggtgcattttcattcaaaaattataatcatcgaagttattaattccatgatgtatactgcagctatcataccgggtgtttgagatcacaggtgtactgaagggagcttttattcccagtagagacaacaatcggctatatcaaaattttattgcagggattgccatatctgcatgcctgtatttctgctcacttattcttgtgaaaattactattgtataggtaaacagctggaacctactatagatacttacggctttcacatagtctgtctctatatatcccagtttcctcagtattggttccacgtgattacaggtagaattgccaagtaaatgaccttgatagaaggtcgttcctgaaaattgtgtgcttggtatctggtggtaagatattcagctcaggcctcaattccattttgcatttggaggtaaagatacagttcccatgaaggacctgccgatcttctagttgggaattgaattgccagaggatgtaggtatagaagtcaaattttgatttatcatttcccccatttaaaacactgtacacagttagcgaagttgtgcattctttgggagttgtagatgctttcctaagttgatacaacagtgtaagaatttcctcccctcaaagcactgtaacatgtggtgtactatacagaatgatactacaaggaagggtttcccttttgtaaaacgaaatataaagggcaagccccaatctttctttctttctttctccttctccatatgcatgcagcatggtacttttggtttatccattggaccaccctcgtactcgttcaccggagcttcagctacttgaggcgctaattgattgatgacctgtgcttttggacctgatcctgcgctttttggaccagctaaaacgatcatgctgggaagtgggagctgcttgggagtacagatccagctctgcaagtctctgaaatttttggagctttctttcagttgacaaggaaataaccgttaaccgacaggagccgtacgtggagactcgctggatgcatgtgcagaactctcgtggattattggcagaatgccatcatccgccaaggccaaaaggccaccgtgcacaggcagccgcacagtctcagccgctagttttgagggaccgatcgagacgagagaccaccaccgcgccgtgcgccgccgcgccgcgccgcgcgacgccgtggcgtggcgtggcggggactacaggcttggcgcaccagaaggcagggccgcaagcgcaaagggtggtggtgtgcatggcgttggcgcccacgccgcccaccggttgttgcccaacttccaggtaggaggtgcgcggcggcgcggtttttctccagcacaggctggctgcgcgccaaacaattaggatatgggtattagctgctgcaatctgacactgaggtaaacgtttgtttgtgcataaacaaaacttgtgtggtctatcaatattaggcacatacaaataacatttcaatatgatttaataagataaaaaaatatgttattgatttcgattctttgaacatgtgttagaggacgtatccatgggagtatgatgtggcatatatagtggtgtatgcgtaaatcgtttattctaaaaaaacaatttgtgtatccatcaaactggttaaaatactctccaataaaaattggataaaattttagatacttgtgacacgttttttaagatgctaaacggtgtatttcactctaaaatattaaattaatatgtttttcaagtttataataattaaaactcaattaatcatatgttaataccatcttgttttgtgtaaaatacttaatcttcgtcatttttaggagaaaagagcatcacctagtctagtctaacatatttgagccaatgtgtttgcgaggaaaatatcatggaagatgtgagttttttagaggtggaagccgaggattacaaggtagtcactggtcagattagcggcttgagttgtgtgatactgtgatgaaatggccggtgatttctgtggtggtagtagtggcttgtgggtccaaatcaataaatcatcatcatgggacaaaataaactagagatcgccagaaaacaggagaaaaatgaccatactccccctgcgctgcgcagccccgcgcgaacatctgcaagctgacgaaatgaagcatcaaacacctaacccaaaaactaatcgcttccgacgttaagcttctccattaaataacgcgcgaaaaatctcaaatctccctcacttacaatcaccaagcttgcttgcctcgctggccttccttgtctccttccacccaccaatggaggctcctctccacctccccctcgccaccgcctcctcctcctcctccggcgccaccgccgacgagtcttcctcctcgccttccaccgccagcatcgtcgcccgcgtcgtggccgtcctcgccgtcgcttctgtctcactgttcgcgcggcacgaggcctctaaaggcttccacgtcgacatcgtcaacgccgcgccgcgcgacaccgtcgccggccggcggttcgacctcttcttcgtgtccaatggcaaggcggagcgcatcctccactacgccaaccgcggcgtggaggcggcgctgttcccggacgcgtcgttcccgcgcaagcaggtcacacgtgtcaccgtcaggatggccgggcacaacctcaccgacgacgacgacgcgacggtgatcgccgccggtgtggctcccggggagtacgtcatttctctgagccccaggctcatgcaccccgccagcgacaaggccgccgacgccgtggcgaacgcggtgcgccgcgccgtggcgcgcatgtggctgtgggacggccgcggcgccgctccggcgcgcgtcacggaggccatggtggactacctctcctccggcgccgacgccgtcgaggcctcgccggctaacgacgacgacgacgacgacgccccgcactgcatgtcggcgcggttcctggggcacctggagcgccgccgcggcgggttcgtcgcgcggctgaaccgggcaatgagggaccggtggagcgacgccgccatggacgccgcgctcggcgtgcccgcccggccggtctgcgccgcgtaccgcgcggcggcggcggcggcggcgctgactcagcagcaaccaccggccgcgctggctggctccacgtcagccggcgacgggtccagggtggcaatgtgaggcagcaagcaaggcaagggcagtttgggtatcacgcatccacgcgcgtcgcttcccatgtaattaatccactattagcgacgataattaagtatggggtgggtcattacctcgcctctaatcgtggttgaaggcgaattaccggtcgctgtccaagctattttgtatgtcattactgtgggttaatcagattaaattaaccctgtcctttgtgcatccgaattaaattatagtgtatgaatgtatgatgttaattactagcagattttttctgtttaggtgggagcatggtgatcggtaatgatacgagaagcttcgagaggttaataatctaagacccccctagccaaaaaaatatatataaatgaaaaaaatctgagaccaacccaacacgagggcccacctgttggtgacctagttatcgtttcattcaacatcgctttcgtccattcgcagtttcatggacgaacaggtgaagaagatatcttgagatgacatgaaaacaatcagatcaaagctgaggctgcagtgttttttggctgtcttgttcattgtggtagcccatggccatgacccatctggacagatggacggcatggaatgggagtggctactgttgcatctgcttgtccagcagcagcagcagaagattttgtttaggggtgacaggcttgcctaaagcggtgaaacgtgcacatacttttgtgagaaagagaatgttgcgtattcaaattttcagcatgtgagtttgtttgtagtttgcactcaaaaaccagtaacatgggttgctcttttttctgcaacttgcctttgaattgttccatctcgtgcagcacgcagctgacattccaataatactcctcaatatatataacaaaacaaagacaccgcagattctgaagaagaaaaggtcaaatcttggcaaaaaatgatatagatgagcaaagtgtttgtcaagtcatgaactcatgtgaggagtgtatttccagaccaaaactcagtgatggagatttctgaagctaacgatgtgaaatctctaatatgttgatgtgcaatactttcacgcgttcgtgaaaaaaaaggtgaaatatgtggaaattaccacgggtcactcactaatgcactttgtcttcctctagctgccacagaaaactgacggctgccattgtcttccagagacgaatcctgactacttctcaccacaagtccacaagtagtaaaagcaatggatctcaccacaagtacgggtccaatttattttcatcaatcagtgaggcagttacctgtctggctggaagattgttgggcccttgtacatcttggatcacaaaacccatacttaactgtctgcagcttcatcatagctacaatgtctgtcaacaattgcttggtttccttatttatattctggtgttgattttgattcggtcgtcgtcgggtctttcatctttgcttgtggacatggcttttgtgtccttaatatatatttatttttgacgtggtttttgtgtccatgattcagtaatggaagctacagaagtagtacagagaattaagatattggaattattgtgttaggacgatgggattaacgaaatgaattattgagttggaagctacagagaattattccattgcataaaaaaactaggaagaatttaagatattggcattattgcaaactgacagaagtctcgctggaaattcttgaatttagaagtactagccaggtagacctgatagcagtcgagctcatttcggcgctttctttgaaattcttttctgaacgaaccgttcttcagaattcagaaccagatggccgatagaactggccgcttacctttccagaatttcaattcccagatcgatttttcacgaacgtgcaaaaaatatatatagtcaatatatattagaagaaagcagagttttgattacacaacgcaaacggttagaaggccattgccggggcgggaattcccggatcgatttgtgaatgacccttggaagaattcaaattcaaattggatggaagggacataagtgaccgaatctctaatctcttcttcctgctcatctcacgtatgtagattgaagagttttgggccttgggacatacagcctttctcaattcttatccgagaagttcgttgtggattcagcccaaagcctcaaatgtgtcgtcgtcgtcgttgtcatatatttctttctcattttcaaatatctcaagctgtcatgcaaaaagtggcatccacggtttagcagcgggccatcaccattaccctcaagcaatcatcgtctccatccattgtttggcatggctttttttttgaaacctaattgtttggcatggtttcatgttagttaaaaacaaaaatgagatttggagggagaaacacgggacctcataattgaaaccaaacattctttaccactgtaactatcagatacagagactctagggttcatctgcaaatataccggaccgctcggaataatagcggaccggaagagggtcttatgtgcaaaatatgggccggtagcaatgaaaaggatctaagcagggactcccatatcactgttcaaacagtgttctctgcatttactgcagaggacctgcatccgatgtttgttgtttgcaagtaaaatttcaggatcttagatggatcgtgccgtccattgtgccttgtccgctttctgcaaccatgcggcggagctccggcgatccacagtgcattggtcgtcgaatcaccgggccgttgccagcggtcatccgccgcgttcttggcttattgccgggcactgtcgagaccggcgggttcggaaatcggaatgccacattctccggtgatctcttcgcagcctcctctgtcctgtgcctaatgtactatctccttggacggcatagctgagtgccaagtgccaaagcagggccatttttctccggcaaaggtcagagctagctccatcagtttcaggcacaaatcgggtgggttcagatggttcatgaattatgacatcgtgtcttcgtcttgtcttgctcatatcctgttccttctccatatctagcgtaaagtattcttttgtcttattcaagatttttgtcaaatatgcaataatataagtcatgattaagtatctttaatgataaaacaagtcacaatacttccatatttttattagtaagactaatgatcagacctcatatctaaaagtaaatggcatcatatatttaaaaattgaggtagtatatagctgtggctatgtggcatatccaagagagtactgaattccatattggaatatcttaagcaagccacatcaaatgtgtaaagaatctgccttgttagtgctttcagatttattattattattattctgcacagcagataatttgaaatacaatgtttcatgattgatagaccggttcaagagaaacaataaatccagtatttgtccaaccacatggcagagccttgtgatgacataagagcagttagaggcctagtgaacaaaattgaatgcacatgactttttttttaatcatctggtaatcaactggcgaggatgaattctagatcaaagcaattgatagtagaataattaggaggcggctgcggtgtcttgttagcatgtagattgatctttcaaacttttcctttttactgaagttcaatttttttttgtaacaggatgaagataacattatatgaggtgctactgattagtttgtatgtttgttggacccatgattgctatcgctaattgaccatgattgccactgggtactggcaaagtccactataacaagaggaatcatgagggttcagttccatttccattggttctacatcttccaatcttacttgtttagttgtaaatgaatgtctaaaaattgccaagcaaaatgagtcacatctaaggaccttcattattctaatgttcagaagtttcagcaccaaactttgcacctgaaagtccatgagaacaatgaccagtgcccagtgggttaagtagctaatcagatggcactatacattccttgcctttagaccagcttgctagtgtgattctgcatagagccgaggcagaggcactattggtactaggtttgttcagtgctatactaatttggctgggagttcagaaatgcaagcacgttcatcgacggcgcctagagcgcaacaccaattcgaggggacaaaaagcaaatctacgagctttttctacgatctgtgcagctgctcgaggagcccaaaaggagatgcaaagtttggaagctggacgcgattcagaccgagcttgctccaggtgacccaacttttccatttccatgcattctttgatcatcaagtgatcatcttgcactgtaaaaaaatataaaaaggagaggcaggcagcatcggctaaaaagtgcatgttctgctattcaaaacatcgaaaccggtgaacctgtcaaagaattcctgtattcaatttgaaagggaaatattttacattcgtataccataccatgactgaattttgaaggggttctgactgaatatctgaatacttttgtgttctggcagtataagtactgcgtaaacctgatactagaatacataattagcgtgcgaatctgaaaatattcgctctaatcccggtgcgcccggctgcgtgccaaatggaaaatccatggatcatcatagcaaagccatcatgaaagcaccccacagagaacaaatttctcttctttcacctcccaactcacccaacctttcttttttactttcctgccacttttgcttaatctattgcatgctgctcacaattatctcgaaattgcgtgatcctgcaaagctcttagcctcccggcccaagtttcctcttattcccctgacccctccactcggggaagaaaagaaaaaacctcgagattattctctcaagacatgcttatgctgatgcttatcagcatcaggagatgcacttgctacaagagtgaggcagcagctagctcgctttaacgctttcctgaatcagcacactcctacttgcagctagagctgagcaagccaaagctttttatcactcttggtggtgttcttagtagagcttttcgcaaagattgtgccatggatctttggcgagttcattgcttgggttggctccttgttctactcctcttcagccatggtgagtttagttactgaccaagtttgcgtctttgtgtagctttctgtcttgttgttttaggatttgaggtgatggtgttactactgctgattctgcttggaagaaattttttgctaggttagaatgaataaattgtttgtttgtttaattccgtttagttaaatcagttactagttgaagctgacgaacagagtgtcatgtcacagcaacagacaaacacatgcttttatcacagattagtaaacacaagtgtcaagtgtgcttttgcttaatttaacaaaaataaatatggaaatatgaagtgaaaactactcacaatgagctatgctttggttgaagaagctgcagggggaggaggagcagagcaggtagcaacacaagcgcatcacgacgcgtcgcggcggctctccgcgcaggtggcgcacggcacgccggagcgggacgtgacctcgccgctcgccactgtcccggtggataacccggcggcgaaccccaccgtgacgtcgacgacgaacccggcggcaatgccggggacgcagacgacgccgtcgctggcgaacccggtggccgcgggcggcggcggcggcggcggaggcgggagctggtgcgtggcgagcccgagcgcgagcacggcggcgctgcaggtggcgctggactacgcgtgcgggcagggcggcgtggactgctccgccatccagtccggcggcggctgcttcaaccccaacaccgttcgcgaccacgcgtcgttcgccttcaacagctactaccagaagaaccccgtccagaccagctgcgacttcgccggcaccgccatcctcaccagcaccgatcccagtaagcaaccaaatttcccttctctagcagagcaagagcatgatcagtgacaactcgtacaagttgaatttgaacatgcatgttggtggagtgatatattatatattgatctatcttgtcgatttttttaaaaaaatttcgtagccatttagttgatatgcaataaacggatggatgcctactcgagctattagaatccatctcctgactgacagatccattcacctctcgttgcaattctgcaggctcctcatcgtgcaagtacccatcgacgaggtaaaatcctagcaactcaaagtctgaaacaaataaacaagaaagaagcagcatgtgaatttcgctgaaaattctttttgcttctcttgttttctttgtgcgatcgaatcggcagcaccggtgcttcggttctgaacacgtcgacgccgacgaacccagctttcggtggctacgacaactctcctcctggattcggcaacaactcccctccgctgtacgggtccatgtcgcctccgggttacaacgacaacatcggcgccgccgcggccatggccggcagcaaggaaacactcctgtcgctggcgtgcgtcgtcgcaacggtttctctgaacctgtacaagtgagaatccaagctgctgtttcacgattcaaatctgtagaaactgcacggctttggtggatgttttggtactcgcacagttgccctgatgcaagcagaaagcagagaaatgaatgtgcagaatatgttttggtcagatgagctaggagaagcaggccggcaagattgatagatagatcgacttctcctagctgtagaaatagtagcatgtggtgctgtatgtagttactagtagtaatcagtaagaacattgagctgaacttttgcgttcacctacatatagaaacaattcctctactcagacgaacacagacacaggaaggaaactactccctccgtccctaaatataagggattttggttagatgtgacgtataatgatacaattaatctggacataaaacatgtccagattcgttgtactaagatatatcacatccaaccaaaaacacttatatttaaaaacagggggagtatttcagtgcaaagagatgattctggaagagcaaccaaccgagatgctggtgtgagtggcgccgccgaggccgaggccgccacagcgccactggtcgccactgccggtcatgggaacgcgacggcgaccacgccgtgcaggttaccacttaccggcgaagaattcctgcagaacgatggcatccaccgcctctgcctcccccattttcctcgtctgcatgcgccggcgccgaccagatctcaccggctacgaggccggagagaccgtcggagattaaatctcggaccccttggttgctcgtgaccgttcgatcagatatgggcggcggggagcgaggagtggccgagtcgttcaaattcttgttttactttaaaagtgggttcaaattcttgttccacgacaaccgttaagattgaacatgagggccagagtcgttcggagtccaaaaatccgaaccacctgggttgcttgtaatcgttagatttaacatatgcggttcagattaaacccttaaaccttaaacattaggggtggttcaaaacaattacagtcacaatggagcagcgctggtagccacatcacgatttcacgacccgtcgcggcagctcgccggcgtggagtcggtgaacgacatgctggaacgagacgtgacctcgccgctcgcctccgtcctggtggataacccggccacgaaccccactatacgtcgatgaacccgtcgctggcgaacccggtggccgcgggagctggtgcatggcgagcacggcggcgctgctctgccatccagtccggcgagaccgtccagacaagctgcgacttcgtcgtcaccggcagcagcagaacactgcaccggatccaaatcccaagctctggcatcagtggcggagccaccatgattcccgggtattcccgggaatacccaacattttttatcaaaaaataagtatacttctagtatatatacatgtacacatatttgtacacctaaatcctcaactcttttatccaaacacagcctaattggtctcttgcgatgcctccaaccaacccgacccactccgtcatgacccatcagacatcagttgacccacttagccaccactcttccagacagccccctctcgctctccctccatgacccatcccaccctggctcggctccctcgcgccactccccatttgcaaaccctaggtggcggcgcagcgagacggcaatcggcggcgggagctggaccgtgctaccgtgcagggggaggccattgccacggcgggcggcgcccgacactccgccaagctaaggcggtcaggtcggttgggtggccggcggccgcgaggggcaggggcgggcaacagcttaacgcttagacgggaatacccaactttaaaatcctggctccgccactgtctggcatgcctcctcgtggcaacggtgtctttgaggatccaagcttctgtttcaagatcaaatcagtacaagcttggtgtagtagtattttggtacttgtactgatgcaacaaccagaaagcagagacggctctgcaaaattaatgcgcataatatgttttgggctgtgtttagttcagtgcaaagtttggattttggttgaaattggagatgatgtgactgaaaagttatgtgtgtatgacaggttgatgtgatgaaaaaggactgaagtttggatccaaactttggatctaaacacagccttggtcagaagagctaggagaagcaggctgacaccaatcccatgaccatgggcactgggtatagggcctgcttggggagcttctggcagctagagagatttttcttaaaactaccactgtcaaaagccctccaaacaatccagatatttactcaaattttaagaagctgcaattgtaaaatttagaaaataaactagaaaccagaagccgtgttcccctgcttctctaaattctcaccagttacttttcataattttaagcttcccaaacagcgccataagcattttgccaaaaaaaaaaagaaaaaaaaagcaaaggaggctggtggagttcggagtatgagaatgtgttgtttctgaccgattggacatatgccatgcaggttaaacacttattaacggatgttaaacatttcattatggttaaagcaattacaggcaaaggatattattgcattcattctacttcccttatcgaatcaccaccaattagttacagcttatgacacgccattgccgataataaacgaaacaaggggaaaaaagaagcaaaagcacgcaacacaggtgatacaaagctagctcatcctttgcttccttgaaattcattcatggtgctgctttgttagatatctcagttttattgtttacatgatatgtaaacggaagaacaaaacaaactgagaaagaacggtcctttctatcagaatataaataaatagagctacagttttaggccatcctagaaaatgctaagggtagtagaacatgatgatcaaacatacatctcctctgcctctccaaaatgtcgacatagcaactcatatacacagttgctattcaggcgcctgaatcaggccaaaagcattgcatggcatctctgacgtagcacgcaccacaacaggaccacacactcaaaagggtttcaaaggctgggtcagtaactatttggccacatttggttagcctgagcggcagcggcagcagagcttaagttgccgtcactagggttccggtgctcatggcccaggccgggctgtgtcggtgcaagtggagcaccaaactgtgaaggcagctgcccctgccgaaggccgccctggtgaccctgctgcccttgataatacaaggcatttgctgcaagaggtggcattgttcgcgaactggcaccatgcatccacatcgcagcgttctcgctctgcaagaaatttacggaagttagattgctattgaattcatgcttgtacaaatttaagtgccatggtagttacctgctgaagagatacaaattgattcccttctttgtattgcgcgggcactgttccatcaaacccaggagcagcggttgctgatggtgtgctttggttcagggcaaaatttcctggcatgctgcttgcagctccaaagcccccaacatagcttgagagcagtgaggcttgctggggtaagctcgcaagggaaacattgcctttgtactgtggcaaaggatattttacactggaattgggaactgcagctgctgcttggtggaataggccactgttcatgtatggttgctgaaaggcaggaggcgggagatatgtataacttggggctagagatgggtagccaatcatgcttgcatacccaagaggaagagttgcttgagcataagggtgaagcgtgagatgctgagggagtggaggaccagaagcaatgctggtgctggtgcttggctgagattgattcaattgagggttggatgaagcacctggattcacaatctgcaagagccgacaccacaagaacaatgatacacaggtaaacaatccaaaagaaaattaaggcagaaaatatattcacaaatcacaagataaacctcaataaaatgaggataaaaaagtacagcttgatgaggtatgcgtttactattgcgagaaaatgatgagccaaaggttgaagcgtgacttttgtagtaagtatgtacagttttgacagcaaagcaggcttaaaaaaaaaacataacaaaacaaatgctatgcaaatggaacttcgccaaatgatgtgaccaaacttaaccaaatttcgattagttactgcctggtctctggcttattaatagtgccttcacgacaaagttaacaaaagaaacagttgcatagcatgaagctatacaggttagttgcatcatgaagccatcaagcgaaatcatcagcaaaaccatgcaacgaggagaaatacccggtcttgattaaactcatcaaaccacaggtttaagttcatcaataaccataaatgccgtttatcagaacaaatatgtatgctactatgtctattcaagagtaaagctagtttatgaattgattctatgacccaaaagatagcatggaagtatgaagtagataaaaagtccaattattcaatgagctgttccacacctcttgtggttgtgtagaaacagtagttgcattgcccatggacgatgatgttgtgccatgaaccatcgtagccaatggtgggttagtaagtaataatgagaaagcaggatcaaagtcacgcaaaggtggaagtgctggtggcaatagtccattcgggatatttccttgctgcaaagataagtaaaataagcttctcagtgaagaaaagataggtgttaatggttataatatatcatcaacagtgaaacagaaatgcgcccacagatttcttcatcagtgaagtaatgtatctctatctagatggagttaattccattattttagagaacatgcactgggggatgcactgacagatatgcttgcagaaactaaattaaatggggcttatacaaaataaaaacacaattccgaattttttatgtagataattccatatggaaactactaataaggtatcaatgtaaaattatttaataaaacaaaaagaagccaataccataaagctagagagaggggaaatgttttgcaattgtcgatgttcttgcagataaatgtgtgcggaagaatctggttgcactgcacttggagttgcataatcggaggttgataaattattgtacatggtgttgtttggaacatctattaaatcggctgttctcaattcaggctgttgtacaggtgcaacatcaacattctccgtgtcactttttgttgaagaggcaacatgttcgtcagctgcaggtgctactgtatccttattttcgtactcatggattctgaaaaatggaaatagatgttacatgatgtttgaaaagaagtgaagaatgcgacagacaaatacatacctgacatctgactgatcaatcgaatggttatcagaaactgctgcaacctcctcatcaccattggcagttttcaaggagactggcgcatcaagtgttccagacacaaaactaccaaatgtcaagtgtgcacaatcagcatttgaaacctgaagatgatcaggaattattacagccgggttatcttcagatgattttgattttttttcctcatgtagaatcaactgttcaaactgtttgtcagtagcagacatatttccctctgaatctgcaactaaggaaatagattatcataaacaattagaaaggaggctcgtaacttccaacagaaaagccaattagaaaatatatagtgtaaaaatgtaatataaaaaggcacatgcagaaccttcacaggccgtggtgctgcactaagatataataaaaaggtcctggtaagaacgtaaaatatgaaaagttgtagtttcagtagagattggataaaaaggtaataatagtgaatagctggagccatacgaacaaataaaatatatcaaactttctactggtccattctcgggtaaatgagcaacaaccttaaaaggtactccctccgtcccaaaatataacaacttttagcccttaggatttgtcccaaaatataacaacttctctaccaacattctcttcccaaccaatcacaaccctccaccattcacttttctcacctacctccactattcatccaattacaaccctccaccactcacttctacctactttcttaataatcgtgtccaaccctaaaacttgttatattctggaacggagggagaatttgattcaaaataaataatttgtattgaactcattactcatcatgaggatttgatttatagtctcatgctaaagtcaagatgttgatggagacagtggttccagtcctaagtagtactagtagttatataagcaaacgcaaaaatttaagacagtattgtatcggatttagacttgcagtagctagtagaaagaaacgggcttagtgctggatatgggaacttgcttaagatccatgtcagacagtaacaccaacacataagccaaatgacaaataggcagagatcaagccgccagcaaaaataaaatcagattgcttccgattcaatgtaataacaatggcttgatgggtattctggttactatagacaaaactataccatgccgaaacacgaaatctatgttctagatttctagaatatatattcgcatttggtgtaggcatacatatgaagtcataaaaaaggtgggggcaattttagatgacctaccacggttattctcaaatgcattgccatcagactgagagtcctctgtttccactatcaagtcattgtgatgggtggcaatttgagtatgttctgagtgtacttctttgctagatgcaggatatggtcctgaagatgttcgatcgtctgcattgcttgcactcatatccttatttttatcagaatccatgtcttcttcaacttcatctttgtaaacatctgcagttgacgatccaggtttaactgtggcgacagattctggcacctccaacccctctctgggaggtaatacatcaatagaggagtcattagatgcaggggagacctcattggtaccatttggtattctatcagttgcaacagagttcacttgtgaaggcaaaactaggtcttgtgaatcttttgaagtatgatttgttgcattggaaatgactgaaccaccaatggttggcatcccggtattacatgcaacagatctcacaggtttagcttggggtttgcccatcttgacaatatcagccatggaagggcgccctggcatcccaccccaaccatgcttcacttgagaagggggctggagaggagtggactttgcatcagcttggccacttgataaaataagactgtcattgatagtagcatggctgaaaaatgagtataaaaggttaggaggtctacaaaaatgaaaagtgcatgataaagagagaagaaaatttctggaacactacacatgatgtctcccagacaacaaactactctgccaagacattagtagttgtataattttaggtcataaactcattaacatatatggagaaatcctgactccattatgtacaaactagatattccgataaatccaccttctagaaagtattacaaaacagacaccgttaagacactgcagttggtaagtctcatgtttacctacgggagctgaataaatcatccaaactattacacatagataaacaaaaatagaattgtagactgttggatggtcatgcatcatactactgggaagacagctaacaaagatctaattaaaatataatgttacatcagacaaaacatgcactgtaatttctgtagtgcttccattagcaaaaggaagagtgaacaaaatgtcgagcatcaatcaacaataccgaaggataacatatacaaaaatagaaaccaggcacat

SEQ ID NO: 76339 - DNA, 4147 bp, Oryza sativa
tcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggttttacggaataaattgttgtctaccgtcattattgctttccttccgagagttccctttccccgtagtctcccttcatggcgtgattcaggtaccccaattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgatgagacattgcaccactttattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcataagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgtgatgtttaggcttcgtacggtggtcggccttatgttcgaagtgcttgcctttcttccgtaccgggtggtttgctgcaaggaattgtcacgtcctgataaattcatcccgaaataaaaataattttctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaaatttcagagcacaaataataattattaagaaataaacaaagttaaaaaggttttataaaaagaaaaaccctaaaaagtctttttcccccccttcccctcttgggccggctcggcccacctccctccctctctctcctctcccccgcggcccatcggcctccccccgcgcgcgcgccgctgacgggcgggcccgcccgccaccctcgttgacgggtggggcccacccgtcatcccctacctcgcgccgcacccgccgcctcgcccgtgccctagcgccgccgccgccgcggattccgccgcatcccgccgtccccgcgcgcaataaagagggggaaatcactccctgtgattccctctaccatttacccgctttcccctctctatatccttgggattcgtccggattcatcccgtaatcctcgacggcgtcatcaatggtggccgagatctccgcggacgtttactccctctcaggccaccctctgtccctaccggcgctatataattgctccccgtgcctctctcctccgtttccgccgttcgccgcttgctctcgccgtcggattcgtgctcgcgacgtccacctctctctccgccgtcgccgccgacctccggtccgccgccgtcgtcgctccggacttcctcccgactcggcgtcacctccttcggcttcgccacgtcgtcgtcgaccccgtccgccccttcgcttcgcccgccgaccgccggagctccgtcgccctcgtcgtcccgaaccgcgccgccgccttcctccgcttcggtcgccgttcccgtcgtcgtcgtcgaccggggtgagccgtggaccgtccctttcgcttccctctctcctccgctctctcgggcgccgctccgccgcgccggtggtcgccggcggtgaccatcggggcgcgggcgcgccgcctcccgtcggccgtgccggcgaggccgccttcgggcgcgccccgcggctgccatgtggggcccggccgtcagccgcccgcgccctcgggtgcggctgacgcgtgggacccacggcgccggccggcgcaagccgcatgcacccggtccaccgtggaccgtgaggctgccgcgtgggccccactcccgtggacccggtccgcgcgcccctcccctcggctgacgcaataaatccgattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctacttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaactatgttgatttaaattattgcattatcgctttatttaaattcccgcgttatcactgttttatctagccatgcctatttacctttgttatgaccttattattgttattgttattattaccttgttcaccctaggataaacaaaaccccaactagtgggtactctattcatggttccactagtatgaatttaggtagatgcttcgctgattaaataggataacattaggtggttttacaactctagactttgggaatattcatatcacctggacactttggaatggttggcttatggtggaattggacatacacctctcttcctctttcaaaacccctaaaacctgttttccggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctgggggctcattcctgcctacctgtcccggaggttccggccgtaggtggggttgggtcggtactcttgtttatggctaggatgggttgggaactatgtcacgtcttccgttcgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttg

SEQ ID NO: 76340 - DNA, 7791 bp, Oryza sativa
  unsure (1)..(7791): unsure at all n locations
ttcaaatggccataacttggccatttgaactcggaattggaccgttcaagtctctaatttttccttaagaagtcaagaacccatttttgtgctttgttctgctattatgtggagtttattagagttaaagcctttttcttttccgttggtcgtgtagacgctgcagcttcggaagatccgctcttcgtggaagttgaagccgacgtttgggaaagcgagcaaggcaagacacatcatcttgatcatattgaatcccagtttataaaattatgttgatttaaattattgcattatcgctttatttaaattcccgcgttatcactgttttatttagccatgcctatttacctttgttatgaccttattattattgtttttgttattaataccttgttcaccctagattaagcaaaaccccaactagtggacactctactcatagtaccactagtataattttaggtagatgcttcgcaatttaattaggtaacattaggtggttttataactttagacttgggaaactttcatatcacctggacacttcggaattgttggtttattgtggaattggattcacaccatcccctttattcaaaatccccaaaatggttttaggctgggctcggggagcatggttttgatagtagctcctcggccgtataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaatagcacagggttggtgccctgctgctaggggctcagttccgtctgcctgtcccgggggttccggccgtaggcgggattgggtcggtactcttgtctatggctaggatgggttggaaactatgtcacgtctttcgtctgtataccgtggtggtatgtggcacgtggttgcacatgagaaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataacactgtatagctctaggatcgtctttataaaatggctttgggcaactaagtgacttttaaatgctgtttactgcaaaacctaacccctattattatccccttgtacccccttgcattaatcatgcatctgccggtgtgacttgctgagtactgtggttgtactcattcttgctcaatcttttcccccttcagtaagagaagctttggagaagatgtcttaggtggagtcctggcttataccccagttgagcgcctgtgaagatggagccgtaggcccgctagtccgctgctgtttatttttgattgccaagcctgaagcgcctctgtaataatgtaaatactatcgatataataaagatgtgtcttttatatcatgtttgtatggtgtaccccggcttttcctgggacggggattaatacactagcgttcgggaaaatgcaattttctcggtcgcgacaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtatgttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcataccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcttggatcgtcccatctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttataggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgacgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtatgcaaaacataggtgcaaatgtagtatgacaaaaaaaacattggaggatgaatttgcaaaccttttaggcacctccgatttgtatgtaattaccaaaataaattcaatagaaattttggcatgacctcccctcttttttaaagaaattttgaagcttgctcgggcagctggaggaggaagaagacatatatataggggtgggactttagtcccggttggtagcaccaaccggggctaaagatcaccgggatctttagtcccggttggtaaagttacgactttagtcccggtgatcccgggggggcctgacatgacctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgatagcagtctgcttctgtgagaaggaacaactagtttgtagtatttttatggtgcggactactgaatttaaaagatggttgtaagaagtatggtccctactgcatgatcacttcaatttcatcattgagacaagattggtgtgtgtgagtggatgtcacacttcaactttcttcagagatatcatctaaatgattggaataaattattggccttcttggctgaacttttgagaactgcaccaaaagattgatgacattcaggatacaacttttgagacctttacatgcatgtcttgtagttgggttgtcaccgtagcataacaattgtagtgtaattaaatttattcccgttgcagcgcaagccatttggccaatataaaaagtatcatttaggttccttcttatatttaccttagaaaagtgtacagagtaccaaatagacttattatgacaaacattacccaaatctcacatctaaatagctgaaaatatatgcaacagcactcaaatagacttattttgaagttctctattgtgctgtatacattataattttttggtattcacatatctaatttatattgctggttgctaaaaatatgagaaactttgctgagatctgacttataaacagtacatacatcatacatgtacaggaacaatgactgtagatgtgcagtacactatctttgtcaattagcggtaccattcatttataaatccatatagtccatgattaatgaaattttgaagtacatgcactggttaggccaatttctgattcaagtccacatccattctttattattcctttgggatatcaaacatttgacatgtgaaatactgtgttcgtttgtgatatcattcattattcgtttgggatagagttttgaaggaattaaattcaagattgtgttctcaatggaaatggacatgaactcataacttaacatattggttttctaataaacatacttttatattagattgctactcaaataaaaggtgaggagaccgatcgatgggatctggcagtcttaacctgtgattgattgagcgagtcttgttctctgatcctgacgacctactctgctccagattggaaggaatgcggcaccctcacctttacacaccgttagacctgcaccttccaaacttcgttcctctgtgattgtcacaaggggaaatcatcgtgccctacctgggaacctccatctttatcgtctttgccatctggttcatctctggtacgcgactctccttctacctactgtctatcgtatcatctgtatcccctacttcctttccaatcccgcatttgtctccaaaattgttttttttcagagtccagaaatcattcctttgacctcctttgtgcaaagttgggatctttaactacatatcactatgcttattgtttgctttggcagttattggcatgcttctaagtctctaaagaccaagacccaatgactataaacactaccagttagcagcaatctccatcagtggcgtagccaggaacttttcgccgggtagtcctactttggaagtttacatcacatacgaaaattttatcgcaaaccccacatataagtataaatttgggtaaaaggtgatacaaatatagcaataataatatcttaattgactaaaggagctgcgtactggtgaaggccgaaaggagctgcggctccatcctcacaactctagcgcctggccgcctgatctagttgggttcttgggcttgtgttgttgggccagttgggtctgattttttttagggttgggggatctggtctgtgggccaaaatcgaggtagtcacgagcccatcgggactacccctgctacgcccctgatctccatgccattgcttctgcttttacctttgcaggaagatgtggaggcaagctgtccaagactccaagaccgatcgtttgctcatgtgctggtgggccttcaccggtctcgctcacataatggagggaacctatgccttcgcgagctcatgagaagaaggttaaagtcctcttcagcaatcaaaacccctctttctccgatgaagtttgtatgtcgtccctgctgcttacttgccctgcccttgccatcgtttattcaccttggaggtaacaggtatatatggcctctgcatttgttcagggaaagagtacagcaaaggcgactccagatatgtcgccagagacccagcaaccgttacagttgaagcaattacagccgtgttggaaggccctggtttactcctttctgtgtatggtttctctcatcttgtgttctgattcaggatagacagcttactttatttcattttccggttataaatattcagcgcaattaactttgaccatccatcttatttaaaaattatgtaaatattatttattttgttgtggcttgttttattattaaatgcattttaaacgtgacttatatttttgcatatttacactaaataagatgaatggtcaaatttcatggtcaaagtctatttcctcaaatatttatgactgaacagagtaagagtatattcctcttaccttgaatttcattcgttaagtgtacagcactactgatgtacatcttgcattccatgtagttcagaatatagccttttgttttctagtctctagctgacaaaaggtctccctgcttgcagctatgccatcgcacgccagaagtctgacagccatatcctccagttcactgtctgtcttggtcatctctaggaataagttcaccggaggtccctcaacttaacagcgaaattttttgaggccccttaaccacaaaaccagaaatgtttacccctgaacttactcaaaccgttcaccggaggtccctcggcagtatttttgcccggttttgctgacatggcatcctagtcagcaaaaaaaaattaaaaaggtacgtgaggcccatatgtcagctgcacatatttttttcttctcttttcttcttctcttctcttttctcttctctcctctctcttctccttcaggctggcggcgggcgcagccgcgatggctgagcgcggcagcagagcggtggcgggctgtgggcggagcggacggcgggcgagcccggcggtggagcggaggcagcggaggctacgggcggagcagccgcgtgccgtggccgccgtcgtcgtcggctccccatcgtcgtcgtcgccgtgggcgaggctacacggcgcggccgttcggcggcatcggccaggcgtcgcagtggccgtgcataggtggctcgaagtgccggctgacgatgcaccccagtcgctcacgctcctcctgtgccgcggctgcggcagtggtggcggcggcagcgtcgccggcctgatcccatggtcctcccggatgcccagctcgcgcagctgcagcaggagcgtgtccacgctcggcgtgccatcggcgtcgtggacggtggtcggcgcgggcgcggtancctcgtcgtcttcgttgacgtcgcggtagcacttgacgtcgtagctcatacgcatatattccgggtacagacggccgcatgtacatgcgtcttcgtacgagcatatatatgcatgcatggagacgaccagctatagcctagctagcttcttgttggtttgccgcccgataacatgcagacgtatatattagccaagcatgtgtatatggctgagcacactcacatgttatatgcaattacgtgcagcggaggagcgcggatgcgggggtgcag

SEQ ID NO: 76341 - DNA, 869 bp, Oryza sativa
  unsure (1)..(869): unsure at all n locations
aaaatgaccggaagttcctgccctgtaagacaggaactttcaaacattttgtcaagaagttccaaacttctaataagcacaaagaactaaccaacaacttccaaatataatacaaagaannnnccgcaaggatcttactatgattcatatgtaatttccaaaaattcacagggcaaaatggctgcttattttaatgggaattacaatgatgagtaccgcacttgtgtgggggtgccaaaggctttggtaactaacatcaagggacccaaacttagacaagtttgggttcctaaatcccaagcttgatttcttttgtaggcatactcctccggtggctcaatttgggttgtggacagtggctgcaccaattatatgatgggagagaggagtatgtttacaagtcttgatgaggagggtggaagtcgtgaaaatattgtctttggagataatggtaagggaaaggtaatgggtctcggtaagattgccatttccaagaatcaatctctatctaacgttctccttgtcaattctctaagctacaatttattatctgtgtctcaattgtgtatgttaggatttaattgcttgtttaccgatgttgatatgaccgtttttaagcgagatgactcttccatagcattaaaggtgtgttaaagggtgatctctatctcgttgattttgacgtcgatagagtgaatccggaggcatgcttgattgctaaatcctctatgcgttggctatggcanntangtagcccatgttggaatgaggaatttggcatctcttctaaaaggggaacacattattggtctatctaatgtttcttttgagaaggatcgtgtctgaccgagattgatctgtccgtctga

SEQ ID NO: 76342 - DNA, 621 bp, Oryza sativa
cgcccttccccacgctagcggtggtggtgacgccatccccgcccgcccccctcccctcgcgcgcgcacaagcggcagcggcgacagtgccctccccaccaccggcagcaacggtgacgccttcccccaccgcgagcggcagcggtggagatggagatggtgggcgaatcgcacgggagccgctccggtcggccacccgctccaccccgtcctcctctccatgttgcggaggttcccttcgccggcagcggtcatggcctcctcctctatccccctcttccggcgttaggcgtactagcaggcggctgttgaagctggcgcggtggcggacacgacatcaacgagcgcggtcgggggtggcggtggtgggcacgctgggctcctccatccccctcataaatttctttttgtgatgaatgtttgaaagaaatttccttttgcacttttttttctctttttgattcgattttcgccttccttatgattgaatcttgtggagaatcggatgtgaatccgtgggtggtttctctcttctttttttgcaattttttccatcacttttgtgtaacgctccgcttttcgtgagtcgttaaaaactaattcggcaaaatcctaattgcga

SEQ ID NO: 76343 - DNA, 554 bp, Oryza sativa
ctattagcccctaacaaacttatctagcttgatcatctatctcgttgattaagacacagtttccacctggggaccgtgtgatcgacggagtcctgaaatttgttactgaagcagtcaagcagaggatgtaatactgtgctgtaaccagatcttcacgttgttcgctagaccggcaaaccggcattactacatatggtctgattggaatttgatcagttcgtctgttcgtggccatgggtgatgatgggcctcgcaagactctttggtttttatatggggacctagagcttgccaccaggcgaagtctacacgccgctgttcagtcttcagtgcaccggaggtgtggcggcttggcccggcacggcacggtgcgagcttatacggttttgctgttgcagtgggcttagtatgttgggccttgtctcggccggccgcgcggtgggcctggccccggaagggaagcaaagcgaccaggttaggagttagtaggagtgttggacaaagaggcgggggacgcctgacaaaaaaacgaaagaagagcgaggaggtgcccg

SEQ ID NO: 76344 - DNA, 615 bp, Oryza sativa
  unsure (1)..(615): unsure at all n locations
ttctttttactcctacttcttttagcatgtattttttattgaattaaatcaaattcgacgtcattgcggttgcttgttagtgaggttgactagttctatttgttttttgtattatttcctgcatgctttgttggctttcagtttcgtaggttgtgcagagacgttgtagaaagtgataggagacaagagatcctgatgtcttattttctgtttggacccccaaaccgcaaaatatgggtctgtgtcatgttttttgctcgtatcccagtgtaacctgngccctcattttcttcgatacactcaaaactgaagtcaaatgtacatgaataggatcttgagcatttgcttcaatatagtattaaactgatcaattcgatcaaaccgtcatattatttggttacggcgatttaacattatgaaccattttaagtttttaaccaagacaatgttttgctcttgaaatgcagggatttgtcacacaataatctcacagggtcaatccctagcaccgtaggcaatctgaccagtcttgaggtggttgatctatcaaagaacaagctgaatgggaccctaccagtggagctatctaatctgccagcttgcgcatttttgatg

SEQ ID NO: 76345 - DNA, 13045 bp, Oryza sativa
  unsure (1)..(13045): unsure at all n locations
cgaaccttgttcgggaggaccaaaccctactaggagtttccagggaacaacgaatagcaccagaagctcctcatgaagaaggcgggtaaagcatggcccagtgtcacatcataaagtacttccggttgggaggtgcaccggctttgttacccaaaaacattgctggcgctcacaaataaacgcccatcctcttcctttgcaacgagtccggggcaggttcattcgttgaccgagttccacccctcccccaaggcggcctgtaggtcctcgtgaaccacgttaggcgcggaagcccgcgcgttgatccttttacggccgcccgcccacagctcctcccccggccgcccgggcgccgttccttccccagcagcggcgttgtccgtcgccagtagccgacaccctccccctctcccgtcgccagtcgcagagaacggagagagaaagagatgaggattggagagatgagagaaagagagagagaaggatgatgcggcaatgctaacatgtggggcccacgtgggtcccacgctgactcagccgacatgtaggataaaaccagggtcaaaaccaccggaggatctaaagtgaacggttttgttagttgagagatgtccggtatctggttttgcagttgggggacgattttgtaactcgatgacaagttgagggaccttcggtatactttttcctttaggaaattcaagtagggccagcatatgtgggctggccactacctgcctgatcaggtgggcggtaacactagctgcacaacgctgctcttctctctatcttccccccccccctcctgtttctctattttgctttcacagattcatcaggataaaggagtaatacagtactcggtatatgattttaaaactgagtgaagtacttaaatgaatcgattaatctgtaatatataaattaactttgctcatgattgcttgagtagttgttgtcggaaaaatgttttaagtattctggtagtgatgagtacgtcactttatcagatacgctcataatttcacacgttacaatgataatttcaagtttaagtccagttcagcctccggagacagcactgacttcaaatggacctagcgtcttcatgccaactccgatttgggtgatcttggacttcgtggaaagcttatctcgctacctttcaaacgcatctggtctcgtgtccaaattcatctcgagtcaacgggaatcgccaaaataagacagtgctgttgctgaaaccgaacttgggccttagccttgtaatagactaggcccatctcggaagtgtctccctccacctccacgaattagcacttaaccctaactttattttcctctataaatagctttgtacattctcaaaaacatttgggttttgtttagttgaattttgccaagtgccattcaccttgtatttagtcctcgctcgattagtcggcgactattgattcagagcctccaatagttggtgtgttgatttgccgggtcgattagatctaccacttcaatcgcaactatttctttgtgcttaatcacctattcgcaatatttagattgcatcttatcttgttcttgtagtgttctctcgtttgcattgcagggatcatcaaccgcgcgtcacggttggtacgacatcgtttgtggtgtagcgattgcacggcgttctggacttgttctggttggtagccacgtcgcaaacgtcacactcgatcaaagcgagggttatcccctcaccagaagattgggccacgagagagagcatcatcagttggtatcagagcttcagtagtctggtgaggattttagttttgtaatttttttcccatcattcactatacagccgcaccactttttcctttaccaaacattagttttgagccttgcaattttcattcaattttgctttattgagttttggtccactgtcgtatcaagatctggtcttagccctagtttcatcttggtttgggtttgcatctggttgtctcatcggttagttttgttgcggtcatctcggttgtgtttgtagagtttgagaaaagaaaaaaaaagtatccgagtttcctatttaagtcaaagattgacctccaattttattgcgcatgcatatgcatgtgtaatggtgtaatttccatccacgacttgctgattccttgcgcatgcagatcgcgggccactttaattttccgtgaaaatttcctgtgtgcgcatgcagcctagcaggttccgttgagttagttggtatcggtaatctttttttttacccagttttttttttcgtctgttagccactgtttgataaagaaaaagagagataaaaaaaaagaaaaagccagcgtggtgcaaaaacagaaaaaaaaggccgcaccaaaaaaaatagaaaagaaagaaaaaaatcaaaaaaaaagagaaaaatatcagaaaaagaaaacagtgtggcattttctttggttttttttttgagagagttgtgtgataaaatcagttgtttctagtccgagtgttaagcatttgtttgcttgagctaggattgagtctaggcaaggccagcaacgttgaccagtactttggactattattcaatttcacaaatctgtttgattttttctattccttgtgatatagttaaacctaccaagatccacatattactaacctttacaggtccggccttgcaatcgctccactcatcaagcatgtcattgtgccacgaaccagccacggtgattgacctgttttgcattctttgaggatattataataatttggtatatgcttaagtgttgagtgccttcaaaagctccacatatctatagattgttaggaactgacactttcttgtgagtttcttttgcttgataacgatgtcaggtacaagttccgacgaaccaacactggagaatctagcgcataaactgaagggcatggaaaattggtatgaagagttgatgcgtaatagtaaatcatacaaggaaagcacagataaacatttaaaaaccttaagtgaaagcctggtaaaagtagtggatcaaattgagaaaatgaatcaatcccataaacaattaactgaaaacattcagaatatgaatattggacatgaaaatattgtgtgacgcattggtttacttgaggctgcaggtgaagaaggtgcaggtgccactgctcatcgacaccaaagatatgacgatgaagacgaagagcaatctgttgctgatgatgaggaggaagacgagagtgttggaaataaaagacaatgtcgagttagggacaaagatgatcctttatctaaggtaaaatttactatgccttcttttaatggtaagtttgagccttctgtttatctagattggaagttagctgttgagcaaaaattctcttgctatgattttcctgataataagaaagttaaagctgccagtagtgaatttacctcctttgcatctctatggtggaatgatatatgtggtagaggacttagacctagaacatgggatgatatgaaacgtacaatgaggtctagatttgttccttcttactatgctcgtgacatgttaaataaactacaacttttaagacaaggtcccaattctgtagaaacatactatcaagagatgatgtttgctttgtcacgctgtgatttgcaagaaactgaggatgctagaatttctaggttctatggaggtcttaatagagagattcgggatattcttgaatataaataatacaataccatgaatagattattccattttgcttgcaaagctgaaagagaagtgcagggacgcaacaagcataggagttcttttgcaggtgctacttctacatgacagtcaataccacgtcaatctactactgccgttcgtccagcttcttccacaccacctacctccacgccatcccatgctcaagaaacaagcaaaaatgcttcagttgagactccagccaagagtgaaacttcagtagtttccactagacgtacctgtgatactacatgtcataggtgccatggcattggacacattgcacgtgactgtccaaatcggcgagctctatttgtgaatgttgatggtgagtatacttctgctagtgattgtgatgatgaatatgctttagctgccactgaccacgcatgaggacaagataatgatgacatcgaggaagtccatttgcatccagagtcgctagatcagtatcctagcctaattgtcaagctagcacttagtgctaaagagaagtgtgaagagcaaaaccaacgtcacaatttgttccaaagcaaagttcttgtgaaaggccataccgtcaaaatgattattgatagcgggagttgcaacaatttagcaagtgaagagatggtcaagaagcttggcttgactacccatccacatccacatccctatcatattcagtggtttaatacatgtggtaagatgaaggtaacccgcttggttaaaatacctttttctataggctcctaccatgatcaaattgaatgtgatgttgtgcatatgcaagcttgttctgttattttggggcgaccatggcaatatgatagagaagttgtttcttatggtaggactaatacatataaatttatgttcgatggtaaaagagttgttttgcattctatgactccagccgctgctttcaaagatgatcttgcaagacttgaatgtgaaaagaaagcgaaaagtgaaaatcagattattgctaaacatcctgcttcaactagtaaaatagaaccaagtaccacaaagaatgaaattaagttgaagggtgctttgttggcttctaaatataatatatgtgcactagatgagctagattcttgttgctatgctctattttgcaaagatcctatactcacattggctactgctcctagtactttatattctttgccacccgttgttactaaccttttgcagtaatatgaggatgtttttcacgatgagacacctccaaggatggccactggacgagagagtgcacacaatcaagaaaacgggattgagtcgaggacgactccaattcaagaaggggaggatgatgaggatatcactttgtcggatacgctcataacttcacacgttccaatgataattccaagtccaagtccagttcggcatccggagacagcactgacttcaaacggacctagcgccttcatgccaactccgatttgggtgatcttagacttcatggaaagcttatctcgctacctttcaaacgcatccggtctcgtgtccaaattcatctcgagtcaatgggaatcgccaaaataagacaatgttgttgctaaaaccgaacttgggccttgggccttataatagactaggcccatctcgaaagtgtctccctccacctccaaacttaaccctagctttatttccctctataaatagctttgtacatcctcaaaaacatttgggttttgtttagttgaattttgccaagtgccattcaccttgtctttagtcctcgctcgattagttggcgactattgattcagagcccgcaatagttggtgtgttgatttgtcgggtctattagatctaccacttcaatcgcaactatttctttgtgcttaatcacctattcgcaatatttagattgcatcttatcttgttcttgcagtgttctctcgtttgcattgcagggatcatcaaccgcgcgtcacggttggtacgacattgtttgtggtgtagcgattgcccggcatcctggacttcatttggttggtagccacgtcgcaaacgtcacactcgatcaaaatgagagttatcccctcaccagaagattgggccacgagagagagcatcatcaggtagttaaatgatacttattattaaaaggttggagagtaaattttgaaagatgtaatatgaatgatccgctacagtgtcaagaaatatagcggggaatctttggatgaccctccatatgaaatgaagatatggaggcttgcatttggatattccgaaggatcacattgctccactaaatttgggtgcgtcaatgccatctcttccctcaattcaccccaccccttaaaaaagagacggactatatttacgacgccacttccatataaacattcaaaatcaattttacactgtaaaattatatccatttatattataattacactgtataagatttaaaacttacattatagttacactattaagttcgttataacttttctaatacacactatgtaaaaaaatcatgattaaaagtaattgattaactacttaaaagaggagatataagagatataaacatacttaaaaaagcaccaccttgctatgaaaatgcaagtaattaaatgcaagcacttagtcataatgactaactgcttctctgtaactaagtgtaaatgcaagttggatatagaagaacctaaatcttgatgcaagattacataagaaaaatcgaaagataggagccaaaaatctgttgcaagtgaaatagtgaattcgaatatttatattttggaatggatgaagtacatgctatgttccgttgaacccaaaatgccctccaacaatttcgacgaaatttgctgcaacctcgacttcagtttctagttcctcttcgtttgggcagcaatgctccatagacaaacctctcttctatcatctccatcctgctcaaaccttcccaccttgtgatccagaaagtttttgatgatatgttctaccttgaccaacacccccctctcaatgtttttctgtcaacatgaagtcaaaacttcacattcatttcatactcagtacattcattcaactaaaaaaattgtatttttgaatcgccatgcattcccccatgtactccataaggctattcacaatatagtgaggtggcgtttgtcctcagtgcactacatttaaccattcacatgcgtttggcacatgtttgtgtccctagtgattgagttgctcgtccctgttaagacctagtgtcctcgtaagggagaagcaaaaaggcggcatggaaaacaaaaggcaagaaagaggggtagaaagcaggagagaaaggggaaggcatcgatgacccggaagtgtcattgacaacgaggctagctgctgccatgaagctacatgtccattgcctagtgtggccggctcgtcgttgatctcgccggccgaagtcgcctttagtaggaaggggcctcgatgactagatctatatatgaagaagttcctagacccaatggggatacagtgcactatggaggtgtgtggctctactttttttgttacgtaaagattgtgagcctggtttggtgtgccatgcgctgtgagtgccataaaagcagcagataatcatatcagacattggggagggcgcaatgtggtgatggagaagggtgcaatgtgcatcggtaaaccatatcatgtactctctccctccatcccaaaataaacaaacttctagagtttattttttttctaaaatagatcaacatctacatttttatttaccattggtccacaaatcaaaacattttatccctcatcacctacgcacccactaatatacctttactactaattatagagatattttggtcttttatctccctccttaactctatctcggaaatctaggattggagtatttttgggatggacggagtacacggtttctcttgcagtaaacggcatcgcagattaaggctgagtgaacacacaacatcacatcagggttcaccaaaccgttttggattagattatcatcaccctacggtaaggcagttatcgcggggattactgttgtttaaaaactgaggatgttatcgtacggggtaactgtgtgataactgcatggttttgcataccgtgcgtcacatacataggcctatccaactcggagcaatcgtcgtacgttacagggacatcgatctcacctttgcagatgtagggggccagcagaggaattaaattccccggtttcctctcaatcgttacagactcgtgacgtgaatggtttcagttcacctttactactcgcgcccgtacgtacttgcccagtacacattgtggtaccacccaaaaaaaaaaaaagaagctttgcttgccctctcctcgtccgtcccgactccccgtgccgcaaataatcgggacgccaacatgggacgaacaggacaccgcaccacctcggttgcagtcgcagccagccttgcaggcttgcagccgcagcgccgtcgagtcgagacttgacgacgatgtgagaaccaaatagcaccctggcctagtcgcctcgcctcgcgttgccaatcgcgtcgcctgcagccagcgcagcggccggcagggcatctccaacaagtgcgcgtacggcttggccggctgggccaaaaggcaaaagcccaaaggggtcgcaactcgcaaaggcgcacgcacgcgctgcacagtgcgcgcgcagaagcagacctcagagtcggacatgggaggaaaaaaaagaaagggcaacagcgcctcgtcctcgctatacgctcccgtagtatagacaataattgggacaacggccacccctgcgcgcgctgtgggctgcgctagctgcggctgggacacggccacggccaggggccagctagcacagcacagcgcgcgacgagacgacgacgacgcaacgggcgggcgatgatggggcgagccagccgagcgcccgagccggcccccgcgcgggcgcggtgcgagcgggcaaaacgacacacgcaggccagcgggtggcgcgggccggggaggggaagcaggcagagaggcaggcagtgggcggcaggcggcagcgcgtaccacaggcggggcaggcgtgcaggccgcgtggttataataaattgtgtgtggggggcacacgcgccgcgcgcggcaacgggagaagctagagcgcgcccaccccacttgccgatcgagcgggcgtcgcggcatgcatgcaggtacgtacgtagtacgtgaggtgagagtgcgtaccaccggccaccgggcgtcgcggaagatccaatgggcgcggcggtgggcctgcgcccgtcgcctcccgccgctttgctcgcctcctttatggcaaagcgtttttaccttacctgcgtgcagtgatatgcttccactgctagctactgccaagccagctgtgaatgtgatggatacctggatggagtatagtgtcatgtgctacctatggttcttcttgaggtcttggaatgtttaaagtagtttacaatccacatttttaatctaaaattttaacaagccataaaacatccttttgtctagtaatccagctttctaatgaacaagagtcctcactactgctttgtgttttcggccacgagcccacaaaggagaccactggatcggcatcaaacgcgggagagagagagaaccttttgctctacatgcattattcatgcaattagcacatgatataagattgcatacggtctagtgctgctgctcattacatgccaattcaagttgtagagaaacataaagttgtaaacttgatttacatatgcttacgagtgcttataccgagcatacatatatagaagcttgtcgtgctacattttaagcacggcatgcatattgctcgccaagaggttagcaaatgaaatgaaataaagcctggttccagttcggcaggtccgatattacatcaacacttagaatcgaattaaacacacttcgatgattcgatccaacgaaaagcaacaaaggatcgatccggaggaaattgagtcacacttagaacgacggccggccaatgctcacacggctatagctagcttcttttcctcttcaagccagccgccgcggccgtggcctcgccgtcgacctgatccccgtcgccgccctcaaccgccgccgctgccgctgccgccgcctccgtcagcttggtcagtagttcgccggcgttgtcggcgaggacgaagatgttccgcgccgcggcgtcgatgaacccttcctcgacgcccttgtcgaacagcgagagtaagttgttgtagtagccgtccacattgagcagccccacctaacgaaaacaacaccaacaatatttatatatgtttgttactactactagtttattcattgggagatcatgtcgaaaatgattaggccatgaagcatgacggcctagctataagctaagctaagctaagcgctatccatcaatctagctagctaatccctatccaccggccaaggacaataagattatagaatgcaaatggcagttaaatacgacaaactaagttaagctaatagtattaagctactggagtagcttttagtaccggtttgttgtggatccccagctgcgcccacgctatgatctccaacagttcttcgattgtcccgtaaccacctgcgcatcacgcggcaattaagttgttaattaagctaagatcactcctaggccctactagctaactactattagccaattaattctcgtttgtgtttgcatcagtgtcattgtgtcaatgtgtgtgtgtgtgtgagagagagagagagagagagggggggggggggttgacaagtcggctaacagctcacctggcagggcgatgaaagcgtcggcgtgtttcgccatttctgacttgcgctcatgcatgtccctgaccactttcgcctctcccaacgtctcccctgacacctaggaaaggcttgcacaaaatcatagtagtaccaccaaggtaaaataaacacgttccatatgtatgcgtgtgtgcagtaaaagatcttttaggaagtgatagacaatagaccaatcgtatactggctactccagctccacacaagagattcgcttgttatacctcttcaggtaggagagcactagggatgaccctgcatgcatttacagatgcatcgacgtgatcagcagatggatcgatcagcaggcacagttaagtcagtgactgtgtatgtgcgtcgtcgtgcgtacccgaggacgtggcggccgccgtcgtggacggtcttggagacgaggcccatcaggccgccgctgccgccgccgtagaccagatcgagctccctctcgacctgcgtggatcaatggaggccttcgtgggtgaggctaggagagggtaaagaccgagagcgaaagggagggggaataagcttgggggcgtcgtcagagctagacagtgtagaactatacccaagtgagcaggacacatcttctccatggacaatggcattggaagctgaagcttttggatggatggctagctagtagctagctaatactatcgattaattgctcaagacgcgacgagactcaccagctgctttccgaggtcgagagcggcagcgctgaaggacggccggtttccccgcctgctgccgcagaagacgcagatcgtccgcaccggtccccggcccccgcggctgccgctctccacaaccttgtcgtggttagcatccatgtgtgtgtaatggggaggacggagcgagagagagagagagagaggatgcaggggcttgtgtaagacttttcccggctcttccctgtgaagacctatttatccacactccagcaagcactccacacaagagtacaagacgtttgcttaatttgcatgctatgtaaacttagctcgcaattgattatctagttgctagttaaatgatgctctgggccctggccctctcgatatcgttttgatttctagctgcagaaaccatatactatacggttattggtttagtcatatcacatgcatgttttacgtacatatgcagagacgaagtggtaattgactatatatacggtacagtggaggtatgtgcacgtaagcatatctgaaacaaattcccatcaaaattcagaagccagtcagacagattataactactccctccgtaccattttaagtgcagtcatagtttttcgtatccaactttgaccttccgtcttatttatttttttaaaaaaaacaaaataaaagcataagtcacaagtaaagtactattcatattttatcatctcataacaacaaaaatactaattatataattttttcaaataaaacggacgatcaaagttggacgcgaaaacttacttatggttacacttaaaatgggatggagggagtatcacatatcctaaaaatctaaccaaaggttcgtgtctccctgtgtcctccaacacatttgcccatcagcccaccaggccaggtgccatcttcttttgtctatgtcaccagatcagtatgcctggatgcagtggcggagctaggaaattttttaagctcagacaaatttaaatatatctagtatttgctataatattttcaactttaatcctttcaaaacaataaaagttcaatggtgtatttgacggcgagcccggacggctgcccgtgcaagccgagcggtggctctgcccgtgcttggatgcaggggcggatccaacgtgggtgcaggggcngctgtnnnnatnnncacttttatattngtacaactaaaaccctaaaaatattaagtatttattcaaacaaagttttaaaaaatacacactatttcacctcaatagtcacatataggatctatgaatattacctgaaatcggcgtctgaatccggcagggcttgtccccttcttctttttccttcccctttttttttttttttaacggaattgaaggggaaggaattaagtctggggctggtaacaagctttttttaacaatcaggctttctgccataccaagggcggtaaggggccgcttgcaaaatggccggcccaaattggtttttttgatttcgggcccttgcgggaaagggtttattgaaaaaaacttttttttttacacaccctgcctctccgttttgccaataagattttttccaaaattgggggggggggtctattttttaaattttttcccccataaattattttttaaatatttttaaaaaattctaaaataaaaaaatatttttagaaaaaaaccgtgccgtcctttcttcaggaagttttccttccttaattcaggaaaaaggtctcaacattggaattatctccccaggacc

SEQ ID NO: 76346 - DNA, 820 bp, Oryza sativa
ctaaaggagcccaaacgaacggatggctgctgaagcctggagaaagaacaacgttaggtaggggataatgttcccttttgcaagtggcgcctagtacttcctcagtccaagaaaaaaaggtaaatcctagattttcgtgtccaacttcaactgtccgtcttatataaaatttttttataatttgtatttttattgttgttagataataaaacataattaatattttatgcatgacttgtctttttaattttttttcataaattttttaaataagacggacggtcaaacgttagacacgaaaaccacggtttgtctttttttttttttatagatggagggagtagacagtagcctctgaacggtgttccgatgacgcgttcgaggtacgcacgacacgatgatagcgagaaccgccacaaaagcgcagtgccagcctctctctctgcccatccgcgacgggttcgcaccagcagcaacttgtatagctgactctgttttttttttaacgccacttgcatagctgactctggcttccaacaattttcagcgaaccaattggcatcgttccatgagaagctgtgtaaactaagaactggtcgactgttttatcgggcaatcgatcgagggaggaaaagtcgaacggcagctctcgtccacaagagaggcaagattttcgtccatcctgtgtcatctgacgccgacgagtcgacgaacttcagtatcttgtattcttgtccgctcatcatagcagggaattttttgcctcttattttccagcccagacatcaccaaatcgtgcttacataccacctccatgacg

SEQ ID NO: 76347 - DNA, 613 bp, Oryza sativa
aatatacatccgaggaacgtacatttcactgtcagtaaccaccggtgttccctgcgaacctgtaattactgttaacctcttcttttaggcagttgcaattactgttaaatttaccaggcaactgaagtcagactatctgtcagcaacagaagggtcgatggcacatcacaccggaacgatgagccgtggtccatggaaacactgaagcttggctggccttccaatggaatgcctccagagatgcagaaaccatacaggtttgtactggagcgaactcctacgttgcattcggggggctgcgggggttttttcttcccgaaactgccttgcgtcggtgcgtcccccgccgtctgattcctcgcaataattgtacggttatgttgctgtcaggaaacggacgagagagagagagaccttagtcggcggacagatgcaaacattgatgaggacgctggatggagtgagtctgcccaagagcagagcagtttgagttctctcgtgcaagcggacaacaaattgcttcgatcagtttgagctagaaaattctttgaaacaaatttgagcaagaaaattttggcatatggtttagcatgcggcacgtcgaacacgagtt

SEQ ID NO: 76348 - DNA, 942 bp, Oryza sativa
agttcacgtgcaatccaatgcgtctgaaggtgaatcacgttgtttgcgtggatggaaaaaatatgttgctccgccttatcgtagacggacgtgctgtctgtccaggttcaatacacttgcctataaagtataaactccattctctcatgtgcaattcgaaataaactagtgatagtagtactgaataaacaagtcgtcgacactgcagcattatagtactgtactacatttctgaaccggaaacggctggtatactcgattgtaggaaccaaatcgaccaatacattccatgctctcaaatgggatggatatatcaaccttcgtctttctgctcgagcagttgaaccgaacgcgagccaccaccggttcttgagaaatatcaggcctgaacatcgacccaagtccccgacatgaatacatgattgatgattgagtatgggtcactttactgaagatacgcaatgcggtggctgtttacagttcagctccggccagcttatcaatgatggcagagcaaatttctattactttctccgttttatattataagattttctagtattacccacattaatatatatgttaataaatctagatatatatattaacatttatataaatagataatactaaatagtcttataatctgaaacggaataggtacattacatatatgccgtttcaagaagtatatgaaagcaaagcccgtaccatgccatattgccatacacctagacgaacagtccatcaccatggttaatcaaggagcacgcatcagcgaaaagcagcacacgtatgatatgggtggtgcgcattagcgtcaagtatgatgagaatggagcatcaatgaaagcatcggcatgatgtaacgccacgaaaacatatgcgacgtggacgtgtcgagagtagcacgaacgcagacgctgttcctgattggatatt

SEQ ID NO: 76349 - DNA, 667 bp, Oryza sativa
atgaatggatgtcagttcacgattgtactatcaattgaaatccgacgtctcactaatcctgaaatgtaacaaccaataatgttagtaaggaggatcacggtgataaaagaagtgctccaaatcattctcacatcaaaatggtacaaagcgatcaactggaatcgtcaaaacttgtggatgtcacaaaactactgatcaacgaaatggcacacttagctactgatgaatagtgagcgaatacaacgctagagtagatgccacgaattttcacaggctccttgtttcaagccaatactcctatagtctgtcatcaacacatcttcacgttgttacctgggttgatgccgtcagaaggagcttcatgatggtacagagttggagctcggctgcttgggactgtagtaccacagagggccggaggtggagggacaagtcgaacggacgaagcggcgtccccgacccttcatttcatgttatataatgtctgtagcaacaaatatattatcacatgagaaaaatctgatatggcaagagagttaacgagggcagaggtaaaaagatgaagaaaaaatttcttatgcaagaaaccatttctacccaaggattaagaatgaaaacaagaggataggtagataaaaaaaaaagataaaggagatgattagatgat

SEQ ID NO: 76350 - DNA, 551 bp, Oryza sativa
ttttggtagacaaaaactagaaataaaaaagacagaaaaagactatccttgaagtttttggagatatttgacttggcagatgtggagtatggatcaattgatagccctctttgcttgatataagtactcacaaggagccaaaactcgccgcccaaagtttaatagtagtaatactaatagggtgattaccgataaggctttcatgattaaattaggcatgatggtggtattttatcctaacacaaggaaggggggaattctgatctcaaacttttttgcaagcctattgtagatttaaaagaaaacaggacgagaggaagcagctagcacacctctgttgtttacaacttttaatatgctaaagaagtgaaaacaatacgggaaccaaaattataaagctgccagataatatttaaggtgaaaacaaccagagaattcagacctagagtaccatcatatgatgctttttctaacctttcacatgaccttcaagcacccttccaagccaacaagctcccccacttggctgaggtctggggacaatacaaaaa

SEQ ID NO: 76351 - DNA, 4080 bp, Oryza sativa
  unsure (1)..(4080): unsure at all n locations
tgttccttaacaccgtccccaccttcatagcagcctctcccgcccgctaccgccaccgctcccgcccgttaccgccaccgctccctaccgccatccccaccgaagagaaaggccgagggagagagagagataagggagggagagggaggaaggaggaagaagggaaggagagggaggatgacatgtgggtcccacaagtcagttggtcccgcaatgctttatttgtgtgaatgacatgtaggtcccacatattcctttttattttttgttcttattctaatgccacgtaagcgtcacgtgggacaaagactcggtcaagaccgccacgtcggcgccatgtcctccaaaaccacacagggtcattttttgcatcggttttgatagttagaggagtcgatatacccggttttgtgttggaggacataaatcatactcgagtgatagttgagggagtcaaagtatactttttcctaccaactctcatcgccataaggagctggaagaagatttttgcggcacttgagtttgaaaaggtgaaggctaaatatgcatagggtgtaccttagtcacagtttggctggaataaatacccacctgtactgtggacaatatcatttgttcctgccaatgttttaaatagcaggataaggcatttagcggttagcttctcaaacagctatagtgggctaaatggtgctataacggctaaattgtacatgagagcaaatagctagaactcttctcaaacagctatagcgggggatttaaaaccctggttcctgctatggaaacccttgtgttactgaaaaaaaattgccttgtataccctttgggcaaacaagcaaacatcactgttaaaatggtggtgactttgtgctgctatgtcttgctgtaaaaataaagttttatatctcgatcatcaatcaggtttgcatgcagttgtcctccttgaagaaataaaatggtagggtttgcccattggaaaagcctgcatgtcctgctacaagcagcacttcagtttgcccgattgaacacaataacactccctgtttgagtgtggacactaatacccatcctatgtgatgctattttgcttccccttttcttgtttggattaagtctacataacccccaacctattgttaggagattacttaacctcctcaccttacaaactaggtatttaaccccctaatcttactaaaaccgtttaattaaccccttatggtggttttgctccctggttttgccttgctggcatgccatgttggacagatggattaacaggcatgctgtgagggtcacttgattttctccggcaaagccttgtcctctatccctctatttacattgaaaatctgtaccatttttatggttcctgacattgccattgaagttggaattgcatacaagtgcaagaattcagtagcacgaacaaaataagaggcggaatataaatttttagacaaaccatttacacacacaaatatgctccacaatctttcatgaaacaagtagaaaaaaaactaagtagcaatcaggtctgacaaaacagggtagcaagtgtctctcacaaaacaagagacatgtagtaggatgcatttaattcctgataaaaaagacaaatatctcatctttccccaacacacatctttggttatagttccatatgatggagtaaaacagtaggtgggcaagtctcgaagtgtttcaagctggtctagccctcttcctgcacttctgttgcacaagtggaacagagcttggagtagcaacacttggaggcagagagcttctgctaatgctctgttgggtgcccacatcaccctacaagatgaaaaaaaacatactttagataggttaagccaatgagcaaaacaatagaaaatctgagaataacaattttataagaccatggtgaatgaggtagcagcagcagaccccactttgcttccgttttcttgtagcatccctcctgatataaccattcttcttactcccagcttctttattccgagcacaggtccggctgttatgagtagtttggtggcacaatttacatctcatcttgatgccaaccttgcttagcttagctcccttaggtttctcagttggctctcttgttctctgagttttgggcctcctgagcattttaacataagcaagtggatgtggctttggcatgtcagaaactggccatttgtccttcccttcaactggctacaagcaatgttggtatgtcttcatgtactctaagatagagaaacttgatgctatgtagtcatccaattgttttgatgccttgtatattgcactgatagcatgacaacatggtagtcctgatagttgccaataactgcagctgcatgttttctgttctaagttgatcgtgtacttcctcttctctttctcttgaacctcaaatccatgctgtccatttcacaacacataacactggccagatctctcaatgttgactttcagcttcttgaatatgtttgggcatattgtaccttgccacttatctgcctttgtcctcattcatagagatgactgganagaaccttgaatccatgatagagttgttgaaagactcacacatgttgttattaacggattcacaattggaccctagctgaaagaatgccctctccaatgttcaagtgcggtggtcatcatgtccttagctccttgaggggtgtcttgtgctagctttgctctattgtagttgaaaagctccctacaagatgactttgtacagttccaaaactttttctgaagcttctgattagtgtaccttttcctccagtttgcatatatatgccttgcacatatcctatgttctactctagggataagctcagccgctgcccttaagagtccctacaagacaaaattcaaaatatttattacaacttatgacccattgcacattttgttaaaagataaacagttaaaaagcatatcttttgctggtcagaaattatcacccatccttcacctccatcatttatattgagatctttttgtagcaacccaataaaccaatacatcaagttgttcagcttgagatcaagtttgcatcatcaagtatctctacagcctggttgctatgcactcctagcttccttgccctgatgtttctcttgatttcctttgcaaatttccaaagttgttcagcttcctcatcattatcagagctattttgctctataggctgcctataatcagagtctgaactatcagatacttgcccttcagggttgctcttattttcaggcccatctacatctttaggcttctctagaatttgagatgatgctcttcttggtttcaattttcccttcttatctgtacatagaacaacagtaagatgtagctctgcctctgaatctgatttcgcttcatcgttagcttctgccatgtcatagccccaatcagcaatctaattatcatcttgcccctcatcaattgctatatgctcaacataaatttctgcaacttgaccattattagacatatgatttgccatttctatgcaagcattgtcatcaagcaaaaaccttagcccatctgacaactgctttccaggatacagccaatgcaagtgtaataaaccactaactggcatgtggtcaccgaagaaacctataatctcaggtaaagatatcttgtcaagctctatgtatgacaatgcagtacgctctgccacataatgcaattgccccctagaaaacatgaattccccactatagtgaaacctgaccggaagaaaatccgatggatccattcctgcaaaaataagaaaaaaaattaatcctaacttttgatgagattaaattactacaaccaccaagatcgtacagtatatattatttgaggtttctagcctccgttattcttaaaaaaaaaagcaagatcatacacaaacaaagcaaatttatgtgtcctctggtaccaacataggagcaaatttctgtgttcataagccctaaaccccaaaatcatcaagcagtaaaattaccgagaaattcacaaaaagtgatgagaatttaactgcctacaatatagcactatcca

SEQ ID NO: 76352 - DNA, 13659 bp, Oryza sativa
atgaatgaatattgcaagaatgagcatatgacatactcaacaagccacacagcaaatatgcaagtgcacaggataacaaaggatggcataatatagctcatttgcagaaaatagcatttaataaatatttaagagaatagtaaaacagttgtataattaatcaatattaaataaacaccatacaacacacccgtgttgcataggcccaaccacatttgaacaaccaaccccagttgaacaaattgaacctccaaaccaggaattaaccattccaaaccaggaattaaattaattaacacattattaccattaatgagtagtgtgagactaatcacgaaaaacattgctcaactcacccataaccgcgggtacggctattcgaatagattaaactctgatcagaggtgtaccactgtacccacaagacacaaccccacatcatgtcaccatgtgcctcaataccaccacggtatctcggaaaggaattgtgacaataccccttgtacaatgtcacgcccggaaattcactagtaatttccgaactaatttgtgcattaaatcctcgtccaggaatcagccgaggtacacaaactgacaatttaatatacagattcatcaaattaactaaaacgataaatacttacttaagaggcacttaatcctcaccaagaagaaaactgcagcggaaaataaaatctagcgaagctccggctccactcccacaggcagctcaactggggtataagccaaacgtcttctccttctggatcctttttcttcaactgaggttgattgattattgcaagaatgagcacatgacatactcaacaagccacacagcaaatatgcaagtgcacaaagattccaaaggatggcataatataggctcatttgcgaaagcagcatttagcaaaacatttaagataagtaaaacagtagagtagttaatcatcgattttaatcaacactgaacagcacacccatgctgcacaggcccaaccattctgaacaaccatacccggctgaacagatctaactccaaaccaggagctaagcaaattattaccagatataacatccataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatcacccccttataaacaaggcatggactccccagcgacccctatggacttctcgccacttctcagtctggcgcactataataaatcatgctatacaaaggataaagccgttgcccacgctggcttgtggttggcacgataaatgtttcacaacagtagctcgcgaaccggtccttaattgccatgagcacgaccttcaaaaccatgtgctcacaacccaccattaatcatattttaattaccaattaattttcataacacgattaaccatcgtgagctaccattaaatataaccataaatattaatgtagtatatatgattcatcccattagtgagctaatgtttctaagcattgctaagcaattatatatatacataacatttagctgaaccaaaccaatacataaggttcaagctaatcaattttattaccccaaggtatcaaggaatagggcattcaatgcaaattggccataacaaaggaataggttcacaccacccgatgacattcgaaaataaatgcacagttgaaacaaatagagaatttaaatataggatcaacatgctcaaaggattgtgtttaggatctgtgtgacttgccttgcaataatcggtcttcaattaatcttcttgatcacttccgacgcactcacgaaccttcgcaacgacggaaacgacaagctaacacgcaaaacgaagaaaaaaactaataaaaaccaaataaacagtacataaaaagtaaacaaacacgtagatcataattttagatgaattatgagacttgaacggccttatttcgacttcaaatgaatttattatgaattttacaagatcaaatctaattaaagcccatttaaaaagaattaaataaatttaattcaatttatggacaattttaatatgtagatctttattttagaaaaatttagcaactcgaaccacctgaaacggatctacggttatttagttatgattttccgaagatttaatctattagaaaaacgggaaaaagaaaaactgatgacgtcatcgacggcagccacgacatgggtggcgacctcgccggagctagagaggtcggccgggctattggagggcatgtacacgtagaggacgacgagacgaacccgatggtactcaccgaagcgacgaacgacgacggatgacggccggcgacgaagaagcgacggcggcgacggcttgcacggtggcgacggctctacgggtcacgggagaggacgggagagggggcaaacgaaagaggaggactagggggtcctatttatagccttggattgaagagatcggactcctcccgcaagaaatcgatccgggaaaatcaaaactcggttttggagataaactcgaaaacgagtttgattcggataaaatacccaacgatttgctccgattcttgggggaaaagatagaggaggatgagaggatcaaacccctcaaaaatccggaagaaacggggtcggattggagcggatttagaggaggaaggcggcgcggcgcgcggctcgggctcagctaggcagccggctggaggttagggacgacactgtagcagggaggcaaactagacttttctgtgtggtttcctatgctaggcccgattgaaggagggaggcaaaacagactttgacagagagaagggcggctcggctgcagctgggccgattgggccggttcggccgcgcggagagagaaagagttgggccgaaatcggcccaacgacttagggaaggatttaaaaactttttccaattaaaataatcacttaaatgatctttcaattgttaaaaatacttccaatgctcaaataattccaagaaaaatcctgaaaatacttggacactaaaagtacttaacaaaattataattagaccatttaatgattaatttaatatgtgggtaattactgaaatgctctttgtatgattaaaattaataattgagctccaaaaaatccgagaaaattccagagagtataattaaccatggagaatttaataaaaattaaatccatccatgctttatatttaggaaattttatttcccacatttaacttcacttgtaaattgatgaacatttaatataaattctattaataatttattaaataatttataaatcctaagacgaaaatcagggtgtgacatacaacataacccattacagcgcacctttcctggatcataatcacccccttataaacaaggcatggactccccagcgacccccgtggacttctcgccacttctcagtctggcgcactataacgaatcacgctatacaaaagataaagccgttgcctacgctggcttgtggttggcacgataaatgtttcacaacagtagctcgcgaaccggtccttaattgtcatgagcacaaccatcaaaaccatatgctcacaacccaccttagtcagatcttaattatcaattaattaacatcacacgacttaccatcgtgagctaccatataaaataaccattattcataataattatgtaatataatttatatttaaccccttttagttggctaatgtttctaagcatggctaagcaaacctatatatagcatttagctgaaccaatccaatatataaggttcatgctaatcaaattataacccataggaaaataaagtcatcttcggccattaattaatagggaaaggctcaccacccgatgacattcgaaaacaatgcacagttgaaataaaataatagctttaaatgggatcaacatgctcaaagggttgtttgggaactgtgtgacttgccttgagcttccgcaaacgcttcggaaccttcctcaacggaaacgctctcctccggaacgtcggaaactaaagcaaataaacaaaatcaataaaacagtacaaaaacaagcataaacagtacatgtggatatttttaacatgtagatcttgattttagaagaatttagaaacttgaaccacctaaaacggatctacggttatttagttatgattttccgaagttttaatctattagaaaatcgggaaaagaaaaagaaaaggaaacgatgacgtcagccctaatgatgacgtcagccctggtgatgacgtcatgctgacgtcatgctgacgtcgcaatgacggccggctcgggttggagagctcgccggagctagagaggtcggccgcggaatcggagggcatctacgcgtagagggcatcgagacgaacccgatggtactcaccactacgagaaacgatgcacgacggcggccggcgacgagaagaagcggcgcggcggctcgggtcgacggcggcggaggggctccggtggtcggcggcgaaagaggaggggcagccgaggttcctctcaccacggcgcacctaacggcgatgacggcaagcggcggcgacggcggagacggcgcggcgacgtgaccgaagacggccggcggcggcggcggacttggagcgcgtcgcggcggcgctaggaggcacgggagagctcgggagagggggcaaacggaataggacgacgaggggaagctttatatagcattggattgaagagatcgagctccaaacgagaggaatcgattcgggaagaaatcaaactcgattttagggataaaatcaaaacgaattcgattcggagagaatactcaacgattcgctttgatttttgggggaaaagaaagaggagaacgagaggaacaaaacccctcaaaaacccggaggaatcggggtcggattgaggcggatttgagaggagaaaggaggcggctcgggcggcttgcgaggcggcggccggaggttgaagacggccctgacatgtgggccccacatgtcagcggctggaggaggagggggcgggcggctcggcttgggccggcatgggccggttcggccgcgcggagagagagggagtattgggccgaattcggcccaacgaccaaagaaggggttttttgaacttttttaaataaaacaatttgtgaaatgttgtttcaactattaaaaatacttcccttgctcaaataattcccagaaaattctagaaaatagaggagcaagcatagtatttaataaaattttatctagcctacttttatgttgaaaattttcctagaaaattagggtttagcttgtaggcttttaaaacaatttctaaaaattccaattaaacaacaatttatatatttaagatttttagggcgtgacaagcagcttgttcgcctcgtcggagttgtgctcgcgcgaatgagagagagagagaggaggtgccaaggagaacgatgagagaaccgctcgtgtttttattcacgccatcctccacacacgcgttgatccaccgtggccggctggtcaagtgtggcctggggttaattaaaggggttttggactatttgccactctcccggatggcgtgttctcaaatgctactctcccggatgacttcgctattccgcaaggcgccacgtcactcgatctgaggacaaaatgaccgtcttgcccttcttcttcatttccccttctgtctctttcatccccttccttcgctccggcgaggttcttgggctccggtgagctccccacctcgcactcctccctccttcgctctgctccttacctccccggcccctgctccattctgctgcggccaacaccggcccctgccttttcttttgtggcatcgccggttcctcaccccatcaccgccgacttcgtcttcctcctctcagcttttctacactctcccccgatgtcggcggctgtgccaggtccacccttagggcttttcctaccttgtcgttcttcacccagcaccaggaggtcggttcggcggtggtggtggtggtgtcaccggctcacatgcagggaggaaggttagagaagagggacctgagctagaggaagaagaaggacaagacaatcattttgccctcggatcgggtgacgtggcgcattgcgggctaaaaaatagcacacaagcaagaaatcttctctctccgatggcaaaatagcgaagtcatccgggagaatggcatttgagaacacgccatctgggagaatggcaaatagtccaaaaccccttaattaaatggttttagtaaggttagggggttaaatacctggtttgttaggtgaggggttaagtaatcacctggtaataggttcgggggttacgtagatttattccttcttgtttctttaggaattaggacggttgtgtataattcaatgatgcagccatgcaggtattactcagatcaacagctataccagcttaaattttctgatccatgagaacatgtacttagcaatttctggctagtttaacacgagtctgcttcgaataaaattgcaaaatacaactcaatcaagatcaattgcaccgataaggtggcctcggcttcggccacggctgaggaggatgatgggccggtgttaacggcaggctagctaattgggcctagagaccggccagtgtcgtggctgtgatcagaacctttcaaaactcgaacacatgcattcagcattcggaatgttcatcgcatgaattcttacgcggtggtccaaataatcagctcgatctatttcgggcaaacaaagctacagagacttgcttgcagcttaattacttaattccaaataaaaactggccacaccatcaaagattattatttttagtgaaaatcagtccttgtccacctgcctcgttggagacttggaatggatcaaggatcgatcggtcgtcatcaccgagttccttttcttgaataataactacagatgcatatgcatgcatcgaatcaggacttgagaagtaaccaaatgattaggtccctgcttaataaaatagttaagagatgtggacagtataattcatttgttccgacgatatatgtatcgatcaaaatctagcgcgcgcccgtccagtggcgactggcgatgtatatatcctttgatcaattcattgatgcatagtgcaagtgtacgatgtgtgacctctgaattatttgacaacattgggttggtacgtgacaacttgttactaatatactagtatttgagtgttacacgttttgttttgttttgtaacttttgattgcttacgttttttctctcctttcccatttttcgtcttgttggcgacctcgtcacgagttgccgccaagtgagcacgagctttgccctgttgcagaccaggaccccgtcgtcgtgcgctctcgtattctcccgagcacgagcgcgcgcgcagcttggggacacgccacgcccacgcgtgaactagccatctatataacgcaaacgattcgctgcatgcttcgtactcatcatccaccacaacatctcctccaatcagcagcagcagcagcagagctgatcaccatcacttcggagcttgtcagcacaaggctaattattaagctagggctcgatcgatctgatcgtgatctgatctgatctgaccatcagcagccatgtcgtttaggtgtaagggcggcgtcgcttgggttgctctgctcgtcgctgtcgcggctctcgcctccgccgctcagggatttccaaatcccttcggtcacgaggagttcacggagagttactacgacgagacgtgccccaacgcgcagagcatcgtgcgctcggtcatggagcgccacgccgccgccaacccccgcacggcgccggccatcctccgcctcttcttccacgactgctttgtcaacgtaagtacaccaatctctccatcgtacgaggaggccaccattagaagcataacgaatgcatttgtctaacaatcatcggtgacatttgcagggttgtgatgcctccatccttctgaacgctacggactccatggagagcgagaaggatgccgagcccaacgccaccctcgccggcttcgacgtgatcgacggcatcaagtccgagctcgagcgcagctgcccggccaccgtctcctgcgccgatgttctcgcgctcgccgcccgcgacgccgtcgccatgctcggtgggcccagctggggcgtgctcctcggccgcaaggactccctcaccgccagcatagacatggccaaagaggatctcccgaacccgaaagacagcctggccgaactcatcaggatgttcaaggagcacgacctcgacgagcgtgacctcaccgcgctctccggtgcacacaccgtcggcatggcacatgactgcaagaactacgacgaccgcatctacagtcgcgtcggccagggcggcgacagcatcgacccatccttcgcggcgctgcgcaggcaggagtgcgagcagaagcacgacaaggccacggcaccgttcgacgagcggacgccagccaagtttgacaacgcctactacgtcgacctgctcgcgaggcgggggctcctcacctctgaccaggagctctacacccagggctgccagaccggcgacctggtgaagacgtacgccatgaacggcgacgtgttcttcgccgacttcacaagagcgatggtgaagatggggaacatacgcccaaagcattggtggactccggcggaggtcaggctcaagtgctcggtggccaacacacattattgatgctcatactgttgagtacaacacaattatgttgcactcatttataagtgtgatatttcctttcgatttaattgtgcattaaactgtaagatgtatttttcttttgtacctcaatttttttattcatttttttataatgtatgggagatcactttgccttgaatgttcaaccactcatgcacaatgcaacatcacatcaataaataatttttttaaagagtactcatttttaaataatgttttctttcaaattacttctgtattctatgagcggatcacatcaataaattctgtgtaattaaatctttttataacaagaccacacttgtagtaattagttttttagtttatttcttttaatgtgttttatttaaatgtttcagttgatatcttatgatatttcaatactagttaatttgtaaatgttgtatgatattattcgaattttatagtaagtattttataatgtttcaatatttaatgttttgaatatgatattaaaacttttcaacattatcatgtttttgcaaaatatggtatttttatatgttttttttgtatgttttgctcgttggcaattagtgtttcatatagttgttgttagtgctgcagttagtatctttgaatgttttatttttctcatacattttacattgtgagttgaaacgttttgacaaagggggaacaaatttccagtgaaacaacgttaattttttaatcaaagtataatcatgtgagatcgtgttataaatatttaattataaggaatacaatgatataattgaatcgtaaattagataattaattgaaccatttgattcacaggaagataatagaaaatttcattgaaatgcattcctatgaaggttatgggtaccgggaatctacatggcctacatatttgactacagaggttggatccatttaatatataatagagtaggactcggtcactatgttgtcttgtatccttaaacagggcataaagccccggctgaatactaccatttatatattaggaaactgaagtagtatccggctaacttttcctctctataaccttctccccaacatataaggtaggtagggggctccctcaagggcaaccagataaaaacctaatatcacatgattaatacaatctgacaaattcaatccaccaaactggataggagtagaggacaacctctcatcgagagggtctgaacctgtctaagcccttgtcttccacatccgtccacttttaggtcttatatccattcacttttaggtctcgtatacttcttgctgatataaaacatcgacaattcctatggtcaattgcataggaaaataagcaacatgttaaatctcttgtgaaacttccgtttgtgttatggttatggataaggcatatctcctaccctacaacttatagaatatacgagtatggtataccttcacgtacacgggttgtttccgtatgcgttgtaggaatctgtcacgaattatggaaaatatctctacggattaggtgatatacaaagtcctaatcggagaggatagagttaacatcaatctccatgccattgcttctgcttttaccttcgcaggaagatctggaggcaagttgtccaagaccgatcgcttgcaagcactgtaagtcttccatggtttcccatgaactggtccttaattgccatgggtgcgactagcaaaaccatgcacccacagcccaccattcagtcgaattttagttggataattacgacctatgaaacatggtcgggtgtctcgaacacgcagctcgtcatgatactaaaaggtctaacactataattatcccattatgtgagctagtggtaattaagcatggctaagcatatataattctagctagatcaacataagtatcacgagctagataaattatcacctagggttgataaaggacgggtaacaactaaacatagcacaagcaagcagataggttataccctgatcccatgtaattagcaaaacatgcatatttatttgcaaatggtaaatcatttataaatcgggatcaacatgctcaaggggaatgtgtgacttgccttgcatcttcacttcgatctggggaggggttcgcggcagaggggtggttgcagtggcgatctggggaagcaaagcggatgctggggtggtgctcggcacggtgatgtcgacgacagcctcagtgctgtgcggggtggttaggggtggtggcaaggtgcggatggacgcgacgggaggtggtggagctcgggttcatggtgaaggggtgattgcggtggtgattcggggaaataaaggggcggccgttgtgtggggaggggctgcggagctagtggtggcggcggcgcagagtggcgatgaccagggcggcagtggcgcgcagctggagtcggcggtagcggcggagagaggtggtgcgcgtggcggcggcgtttcggaggtggagagggagaatggagtatgggccggggtggagcttggcacagcgatgccgatggtggcagcggtggagtgcgggcgtagctagagcagtggtggcgggcggccagagggcgccggcaagcgacggcgatggggattggcacaggaagagtggtggaaggcgcggggagctcgggaaaactgggaaaatgggagagggtggtgcgaggagcatttttataggctcggggaggggagaacgtggccggacggggcggcaacgggcggcggcgtgggactctggtgatgtgggtgagtggatcggctcatcgccgattttctcggggagagtgggggatttgagtggaggagtggaggggatccgatccctctcggtttgggcgcgatggcgcgagcgggagggctggaatcggcggctatgtgggcggctcgggcggccatggcggttgctggcccgggctggaggttggggaagaagctgacatgtcaggtcccacatgtcggccagagggggagaagggaggggggttatgtgacctttggaggggaggggagcgagctgggccggcctgaatgagggaggagagaggagggaggccggcccgacagggaggaaggactgggccaagcccaaagggaggaggggaggggttttgtttggtttttctttttatttaaattgattaaacaaactttgtaactttaaaaatattacttcctgagctccgaaaattcgcgggaaatttcagagagtattttagggcataaagaatattataaaatattcccggccatgatttttaaaggaaatttttaatttcctctataattcacttgattaaattgctttaacttttaatataatttctagaaaatgcattatttaataatttttaatcccgaacgaaaatcggggtgttacagtgaggaggcagtggagctcagcccgggcgccgccgctgtcaccgctccagtgcctgctgccgccactccctcgtctctgcctctcgcaggccacaacaccatgcccgcgcctccgccacttgccgccgtctccgcccgccgtgctccggccctcaccgcccgccgcgtgagagagagaggagcggcaaggagggaggggacagagagaagggacacgtgagtcccacaatttctttttatgtgtcaatgacaaatgggccccacacatatttttttattctacatgccacctaaacacgacgtcaaccccacgtgtaagggagatccggtgaataccgccacatgggcgccacgtcatcaaaaccacctccaaaaccgtaaggggaattaaattgcaccggttttaagtgtttggggttgaaatatccggttttgtggtctaggatcacggattagatttcgatcacttttgagggtcacaaagtgaacttattccgaatatgaatccatgtacgaattcatcacagtaactgtgtgaccgtgatcagaacctttcaaaactcaaacacaggcattcagcattcggaatgttcatcgcatgaattcttacgcggtggtccaaataatcagctcgatctatttcggacaaagaaagctacagatacgtgcttgcagcttaatttattaatataattccaaataagaactcgcctcaccatcaaagattattattttttagtgaaaaccagtccttgtccacctgcctcgttggagacttggaatagatcaaggatcgatcggtcatcaccgcgcgagttccttttcttgaataataactacagatgatgcatgcatcgaatcagaacttgagaagtcaccaaatgattaggtccctgcttaacaaaataattaagagatgtggacagtataattcatatattccgacgatatatgtttcgatcaaaatctagcacgcgtccgtccagtggcgatgtcactaatataaaaaggcaaataggtgtcgccactatacgtgccgacacaccaaaaaccggcacctataatgccttttccacccatgcacccacccccacgcgctaaatattcaaaaccgacacctttatgttcaaataggtgctggtttttaaataaaaccgcacctaaaacttgtgttagtgaaaggtgccagttctagacccaaaaccagcacctttaatcttctccctcccacactagccgttggtgggccctatacataggtgctggtttttttttatgacaagacaaatgtgccggttctcgacaaaaaatcggcacctttatttcaatagtgctttttaagtctgatggtgggccctacacataggtgccg

SEQ ID NO: 76353 - DNA, 9371 bp, Oryza sativa
ggcacctattaggaccatataagtatcggttttgacctcaaaacatgttctagaaccggcaccgatgacaagtatcatcagtgccgtctctcgatcgtatgaggaggccaccattagaagaatcacgaatgcttaatttgtctaacaatcatcggtgacatgcattgcagggttgtgatgcctccatccttctgaacgctacggactccatggagagcgagaaggatgccgagcccaacgccaccctcgccggcttcgacgtgatcgacggcatcaagtccgagctcgagcgcagctgcccggccaccgtctcctgcgccgatgttctcgcgctcgccgcccgcgacgccgtcgcgatgctcagcgggcccagctggggcgtgctcctcggccgcaaggactccctcaccgccagcatagacatggccaacaaggatctcccgaacccgaaagacagcctggccgaactcatcaggatgttcgagaagaacggcctcgacgaacgcgacctcaccgcgctctccggtgcgcacaccgtcggcatggcacatgactgcaagaactacgacgaccgcatctacagccgcgtcggccagggcggcgacagcatcgacccatccttcgcggcgcaacgccggcaggaatgcgagcagaagcacggcaacgccactgcgccgttcgacgagcggacgccggccaagttcgacaacgcctactacatcgacttgcttgcgaggcgcgggctcctcacatccgaccaggagctctacacccaggggtgcgagaccggcgacctggtgaagacgtacgccatgaacggcgacgtgttcttcgccgacttcgtgagggccatggttaagatggggaacatacgcccaaagcattggtggactccggcggaggtcaggctcaagtgctcggtggccaacacccattattgatgcccatactattaagtacaacacaactattttggaatcatttgtaagtgtgaaattcctttcgatttaattgtacaacaaactgtaagctgtattattcttttgtacttcatctgtttattcatttttttatgatgtatgggagatcactttgccctggaagttcaatcactcgcatacatgcacaatgcccgctctaggtcgcccgctctgatactatgtcggatattatagggaagacatgaatactgtaaatatttgacaaatatacatgagtacatagagatcgaggagataaggaatgattacagatatggaagtaatccacacaaatcaatcatatcctaatataactctaactaccatatactctaacactgaccaccacaacacccgccacctgccgtcgcctactcgccaaaatccatcagctctttcttcattgccatcacttacttcattgcaactgattttatttttatttgctcacgatttaaaaggtatgataggatttggaatctatggttcatagaggtagaaggaggggatcgttctggcttgtggttaggtcgggacctagggccgggaggacataaacttaaccaagggcaaaacagtcttatcaagttgctttgtatttccattaaattaattatttttgtcctattaattgcatcagtttggacggcagtggcaaacagaagcacagaaaatcaacttcagttttaaatttgcagtttgtgtttttataatggctatttcgaattaggggttgaaagtagtggcatatttgcaattctccctaaaatataatatctggtcagccaaggagagaaagctatgcaaaatgtctatattgccctcctcttctaaagcctctataagtgatgaatatgttggtgcatctgtaggtgaggtacagcaggcttgaaaccatctataggtgcacctagacacatctgtcccattcatgtaaaaaatacaaagtatatggggcccactgtacaaaatacactggatgcaatctctcctcctccggagaaaattttggtgccatactgaatataaactccaggcactgcaactcggccacgctgaatgacgcttggacaaccgacctaccggacacatgcaagaagacgtttgttgcctcggctccaggtgcagcgcgatgacgaaacccgcggctcagctcgggtccacgcgctgacgcagtcgcgcgcgactcccatcttgatctcctcgctcaccgccgcccctctcgttcaattctgtgccgactgccatcttcggttgttgacggctgagtgatgcagtgccaacggcgtccacgccagcatggcgaagcgccagaaatgtcgcaagtgttgccgccgaccccacatgcatgatcgtcaccttcattgcccaagttttgtcaatttcatgtgtttctctctccattaaacacagaagtaataaaataatcgttgcggcgtctttcaacaaataaccaagctttttgggtgtcctatagctaattcacgttttagcggtgtctaccagcaaaggccacaaactttggatgtcatatagcaaattttgccattccgttgtatggtggctggaaaaaacttgtcaatagacaaacatttatcagcaatgttagtacaaaatacttcaattttctgcatgttctatcaaagttatgcaaattctggcaccatactcccctcgaccacaggggtgataacggcacatgcgacagctgtgcaggcgctgtcctgttgcctattgccctggtcacacactaggtttttatgcgttgcctcatatctaatacaaggcttacttggttggtgacaactacatcatgccgtatcccatcacggtcaatgtgctgcctctacctcgagcaacccttggggcccgagcttgtgggaaggtggcagccgcatatcaagctcagggcccaacctactctcgtaggaatgatgccgagctcaagatacctggccatatggatgacccagagttcaccggccccctgctaggtcgcgggcatatgatattgttctgtttctcctcaggtgcatcttagtcattttgcttagggcggattgctagttgtgtggtccaccaaatctgatggcgtgtccctaggcaccctgagcatccggtggtaggggtcttggtacccatttcactgatagtagtccctggcctcgaccccgggcaccggcacggagcaaatgggaccaaggtcaagatcctccttgttgatatgttaataacttcattgttaactgggtcgttccctcgctcacttgcaacctaggttgggtgctccacatgctcgggagcaggaggaagccccaaagccactaccagaaacaatattacctctgacggctaaaacccgtcaggaataaatgaaaaactgtcaggaaaataggtcctgacgtgtcaacgtcagaaaaataccgtcagaactagcttgtcggggaaaaaataatttgcctgacgtttgtccgtcaggaaaactattcctgacgtgagcgcacgtcaggattaattttcctgacgtgaattgcacagtcagtgatattcccccatcatagataggtttgatagtcaaagagatttttgtgacgggtagaaccgtcaggaaaattattcatccattttttttagtaatatacaatatacagggatgatccatatgtacacaatatctaatagtaaatatggtcattctgatattcatcacacagcacgtaaactgctcaaattcaatattgcattccaaaaatagaaaggtcaaatccatcatcatcatacatagttctagttcactatttcaacataacacacaagcatgaacttctgaagtttgcctggcctaagacacctaatagtaactttcagagtctcaccctccatctatatggttagaaccatatatacaaaatatccaaaagcattagcatatgccgcaactccacattggtatgtccaaaaaccttagtccatctcgcatgacatgtactgcaacagcatcaaggagaggcattcaaacaaccagtacaattgttgctggtgttgttactgccaccattgctggaagcaatatcacatccatcatttttgtggcagccattgcagtcaacttgctgtgagcttacatggggaagaatcagttccttgcaacgattcgaaaagtttatgattaattcatccaattctaattagtaacaaaaaagcatgcccatgcagcaactaaaataacaataatgcatagttatccaatccctgcagcaggtcttgagcttttattttctcaagtaacttatccggtaactcacatgattcttggatacatttggtcacacggctatggtcatcatcctaggtcaatgaacgttactaagtatatatatacatatatatgaggaaataagattaaagtacacaaggtagagagaacatacaaagcattttagggcccttttcctactggttgctgaactactacaagtgcaaggtcatttttcaaaccaggtttcatgacatagatgtagaacaaaattcgccttaccttccaaatcagctatctaaatatataattcaagaatgcaaaagcttaacttaggaaataagcaagcaagtacaaggtatgaaaattgttataccacatcgcgatatatattttctgttcttattagttggagcaacagtccaatcacttttggagcctctaatgcactgcattgagaaaataaaaaaaacgtatgtgaatgaaacagtgttattattataaaatgaaaataaagtgtttactaaagtgtttctggtagtgagcgtgcgatcccaggctaatgactgtggtccctagacatcggcagtgcctagagtgtaatagtctagaccgagcatcacatcctgtcgccgactcgccatagtctaagctggcctgaccttggggttcgcttgaggccccgggacttcggcaatggttggggcgcagtacacgttctggatacttgtcctctgtatacaagtctaagttgcctcaaggtcatacaacaaaattacacagcagttaaaatgtaacttttaagttatgtattaatacttttactttaaattaggaaatatatataatgtagtccaataatctacaatataagtactttatatatacttggagctctctagtactgttagaaatgtgtttaaaaaatatgacttatttggttaggagtctcgggtgatttgtttttaatgaagctacttattgttttaatctagttaattacttttatttgtctcatattgttcgtatattctaatgtgaagatatatattatgcatggttaaaaatctgtgtaattttctcttgaaattgtgtgaatgagcaataactagtcccgaggttgaatatgaatccatcaacgaacttctcacagcaactgtgtgattgatcagaacctttccaaacataaaaacatgcatcggattcatagcatcaattcttacgcggttgtccaaatagttaatcagctcgattgtctatttgcgacaagaaaagctacagagacgtcagcagcttcattaattaataccagttactaataaactataatcaattaatcagaaaatcagtccttgtccatcttccccattggagacttggaatggatcaaggatccatgggtcatcaagttatttttcttgaatattaccccctccatccaataatacgaggcgcgcacgtatattaagattcaacctttgaaatgtttgaccaacatacactttgtataatatgaaataaatttactccatccatcccaaaatgtaagtatttttagctatgaatttggacaactgtgtgcagggtcggtcctgggtttttaggccccagggcgaaaacttatatggaggcccccatatatatacataaactaatatatatatttatagtcttataaacacaccacttaatattcgatgtgataaaattatctatatatatttagagtcttcagctgtggctgtgcctgtgcgagaggcaagagctctcaacctagcaggtagcgttgcgtctgcactctgcagcagtagctatgctgtgcagcgatcagcggcatcggccagcggcgtgatgccgtgatccagcctccaggcgagtaggcgacgcaggcagcaggtcggcaggtggcgtgatcgagggccgaggcgatgggaatcgggaacgggagttagatagatcgcttcgacttcgacgcttcgattttccttcgctcggtcgctcctcttcgtgttccgtcttcacacgatacaggcctgcgaagtagcatacatgggggtgccgtgggccatgggccatgggccatgggggcccctggattttgggggcctcgagcgcgcgcacgggctgacaccccctaggggcggccctgactgtgtccagattcatagccaaaagttgttaattatattttaggatggatgtagtatttgttaaaattatatcattagattgagatttaaatttattttcatatggttatcattttgttgctacaaaccttataatgtatgagaaattataagctaaaaattagttttggagaccataccaactttaaccattcattatattatggggtagagggagtaacagatgcatgcatgcaggcatcgaatcaataattgagaagtcaccaattgattaggttcgtgctaaatagaataatgaagacatgtgaacagtagtttatacatatgttaatccgaccatgcaataatgatcaaagtctagcccgtccagcagcgatgaatatatcctttgatcaattcatttgctgcaaccctgcaagtgtacgatgtgaccactacccgtagagagacacgttttgttttggttcgtttccttacttttcttttctctatactttcccatttttttctcttgttggtgacctcgtcacgagttgccgcacgagctttgctgggtcttgcgcttgcagagaccagggaccccgtcgtgcgcacgttcgccacgcgttaactggccatctatataacgcatgcttcctactcatcatcatccaccacaacatctgcaatcagcagcagccagcagcagcagagctcaccatcacttcggagtttgtcagtaccaaggcgaagctaatcattaagctaggggcctagggctcgatcgatctctcgtttcggagctttgtcgatcgtgatcgatctctcgaggccggagggagaccatcagccatggcgtttaggtgtaagggcggcgtcgcttgggttgctctgctcgtcgctgtcgcggctctcgcctccgccgctcagggatttccaaatcccttcggtcacgaggagttcacggagagttactacgacgagacgtgccccaacgcgcagagcatcgtgcgctcggtcatggagcgccacgccgccgccaacccccgcacggcgccggccatcctccgcctcttcttccacgactgcttcgtcaacgtaagtacaccacaatctctcgatcgtacgaggaggccaccattagagcatcacgaaatgcatttgtctaacaatcatcggtgacatttgcagggttgtgatgcctccatccttctgaacgctacggactccatggagagcgagaaggacgccaagcccaacgcctccgtcgtcgggtacgacgtgatcgaagacatcaagtcggaactcgagcgcagctgcccggccaccgtctcctgcgctgatgttctcgcgctcgccgcccgcgacgccgtcgccatgctcggcgggcccagctggggcgtgctcctcggccgcaaggactccctcgccgcccgcatggacatggccaacaaggatctcccgagaccgacagacagcctagccgagctcatcaggatgttcaaggagaacaacctcgacgagcgcgacctcaccgcgctctccggcgcgcacaccgtcggcaggacgcacagctgcgagcactacgaggaacgcatctacagcctcgttggccagggcggcgacagcatcgacccctcattcgcggcgcaacgcaggcaggagtgcgagcagaagcacggcaacgccacggcgccgttcgatgagcggacgccagccaagttcgacaacgcctactacgtcgacttgcttgcgaggcgcgggctcctcacatccgaccaggagctctacacccaggggtgcgagaccggcgacctggtgaagacgtacgccatgaacggcgatgtgttcttcgccgacttcgcgagggccatggttaagatggggaacatacggccgaagcattggtggactccgacggaggtcaggctcaagtgctcggtggccaacacccattattgatgctcctcttgttaattatactgtcgagtacaacacaaatatgttggatactcatttgtaagtgtgaaattcctttcgatttgattgtgcaataaactgtaagctgtattattcttttatacttcatttgtttattcatttctataatgtatgggagattaccactactacaaatcacctaatagattatggctcgtacgtaccggtcttactgtctcccaccttgcatgaggaaaaatctacataaaaaccggcacctatgaggagtttgaaatcaacactgatgaggctttctgcagtaatgtactttgccccaaaagtcctgtcactctcactctaatgcatgcatcttgcagcatcacccataacatgcaaacatacctccctcttaatataatttttaaatacttatttcttgcaaattacttttttattcaatgatccgattacaccattaaatttgttgtgatcaaatctttataaaggaaacacacatagcacatggttatattccgatgaaaaaatatttagctttttaaaattttatttgttttaaacattgcgtgtggttttatttaaatgtttcagctagtattttatgctatttcactactagttaatttgtaaatgttacatggtgttatttgaatgttttagtgagtattttataatgtttcaatatttacaacttaatgtttcggacataatataaaaatgtttcaacatcatcaagtttctgcaaatacatgttaacttttaattatatgattttttttctatgtttcactcgttagtaatcaatgtttcttatagttgttatcagtgttgcagttagtattgttgaatattatatgtttctaaaatatatttaatattatattgcaagaattatacactggagtgaaggataaatgcggcggcatgcaaaaccgatgaatcacgtgagagcacacactacactggccaaggtcacctgtcacggacccaaaccatcatctttgacggcttcacgcatggtcagtgatcagtggtcactggtgagtc

SEQ ID NO: 76354 - DNA, 1044 bp, Oryza sativa
ctatctagcaatatgcaggctcattttgctgggagaaaatcgcgagctataaatatgcatgcaatgcagcgttttctcttgcaagagctgcttagacaggagtagttgctacgagtacttgctaggaagaaactgcagtgtgctctgttccaaagagtagtgatggcttctgcctcttctcttggcctattactgatgctcgcggcgctggtctccacggccaccgcgcatttgtcgccgacgttctacgacacgtcgtgcccccgagccatgtccatcatcaagagcaccgtgacggccgccgtgaacaacgagccacgcatgggcgcgtctctgctcaggctgcacttccacgactgcttcgtccaagcacgtttccatctcacaaaccaccctgttttttttttttactttgatttaaggccgaaaagtagctaacaggtttgcctgtctgtcagactacgtgagttagcagcgttgcaagaaaataatcgtggcttaatttttgtctgaatcaacacagggctgtgacgcctcaattttgctggccggaaacgagaggaatgcagccccaaacttttctgtcagaggctacgacgtcatcgacagcatcaagacgcagatcgaggccgtgtgcaagcagaccgtctcctgcgccgacatcctcaccgtcgccgcccgcgactctgtcgtcgcggtaaccatgcatgcatatatcaacgacacaagatatcgagctcgcgattacgaattctgtgatgctgaattgctttatttggtttttaatttggcatgcagcttggaggtccgtcatggagtgttccgctagggagaagggactccaccggagccgctaccgcggcccaggtgattagcagccttgctccttctacagatagcctcgcacagctcatcagcgcgtacgcgagcaagggacttagcgccactgacttggttgctctctcaggtgcacacaatatatataactcctcgatcgatctcctaatcaaccatggaagtgtagtaaacaacagcttgtgttga

SEQ ID NO: 76355 - DNA, 1224 bp, Oryza sativa
ttgaactaatctagattctgaacggtgaagttttacctgtatattgaaaattctccaaaaaaaattgacaacattcacaacatatatatgaactactctaaaaaaaatcaagtaaagactcaactcacacattgagaaatgaaattaaaaaacaaatccagcattaattggtactattcacatatgaatttgtctttttatttctcaatgcgcggatcaaatttgaatataatttttggtagaatggtatatgctgtttatactctacattagtaattttttaaataattttacaactatttatattaaatataaaagaaaaggttatacgcgttgatattctctcgggggattagaatccctcttccgtgaaagtaacttacaacttcagattcttctgaatctttgctgatcaactagtataatgtacgggtgtacagattctgattaatcacaaacagatactgagagcagaagaaatatcaatatattgtcattacaacttaattcagtactggccttgattggctgcgattgctgctacagacgctgtggctgaggtagttgaaccgttgcaagctacagccattttgaactgccgcaataacggctgttatggtagcaatcacatccgaacatgcccacgtatgtgatagatcgaaatggcaatggagttcggccccagcttaactgaaatgaactctgcttgattgcatggcagacaaactcattatcatggatgcgagagctgaacattcaactgttacatggtttaaggcgaggcgtggtgtcctaactgttaggacattctcttggatcagtgtcacaacagttactgttctggtgctacctacagtagtagtgcactgtactgttatttgtttcctacgagtatatactggtagcccaaagactgtttagtgaaatggatgaccagggatggtggctgttctgttctcctcactccgttttttaatagatgacaccgttgactttttatcacacgtttaatcattcgtcttattcaaaaattttatacaaatgtataagatataaatcacacttaaaatactatgagtgataaaacaactcataacaaaataaattataattacgtaaattttttgaataagacaaatggtcaaacatgtaagaaaagaaagtcaacggcgtcatctatttaaaaaacggatgtagtattccacacttttccactcacttgct

SEQ ID NO: 76356 - DNA, 683 bp, Oryza sativa
tcgagagctatcattcatttgaacccgcaagagctggaatgacaatatataccgtccataggccctggaaggtttagaactgatatttgggtccggcacatctgatgatctgaaggtttctgaagcaagcagattcaacattaatagtcaaactgtatgtcgtccgaagaacaccaatgcaaattttggaccatctcagcactagcagtaacatcgttcagacaatacaaattcgagcctgagatccaggaggcgacatacatacactgtacaggatgaacaaaaccgaggcaacgccaaatatatgtacaacgactaaggagcatttgtgcatccacgaacaccactactcatctcatctcaagagaaaataaaaaagaaaaagaaacgacacgcaacttccaagtgtcctatatccagatgcgacagtatttggtcaaatctggagtgaaggggcattcaacatctgtatgatgtattcctgtgttcaggtattagaatatcaacgagaaactcttgctttaacagtcaaagaatgggcgactttctttcaagaacacgatgtgaaacatgcccagtccaaagaatgagcgatgctttctgcgaccagaaacatacaataaacatgaggaccaaaacaacccaaccagaatcaatccaaaacttattctagaaattatgaa

SEQ ID NO: 76357 - DNA, 1141 bp, Oryza sativa
ccttcgtggtgctttcacctgaagcaagcaactaggcctagaataaacaaacataaaggatccataaatatatctgaagttatgagaagctcgggaattgataccatcatgattgatcaaaaaacaagagggaaaataaattagtcttgtaccaaaacaaccattttatactcgctcgttagatagagaatatgatggagcattacacaactctccatattgcgctactaactccataattgttgtttttcaatgctccctttgtcgcaagagctcttgtgctctcaagcagctagtaactggagcaggcttctactagtctattcggctattccatcaccgcatgttcagttcagctgcataatgcaatgcaaagacaacgagaagttgtcttgtacttcgactcagcaccaatctgccatttgatgggaaattctttcatcctaacaacttctaatcatgcactgttcaagggtgcctaacttaattgtcatagttgtattaaagtacatacaggattcttcagaacatcgagcacttggaaagccctgggactcttcttttaaacaatgtaagagtaaaaacaagtcagaaagaagtaaaacatatgttgtggacaaaattcttaaggttccatgtttcgcaatttgttgcatctgtaaccctttgtttggagtgaactacaaaataaatgatacatatactaaagttagagaggtgtgcacttgtacaatcaaaatactcacctcctatcgtgccaaaatttctaatctcaatgcaatcaaacaagcagctgtactgctattcttgttctgaacaaaagttgttctcactcaaaaattactgtcaggttaactccagcaagggattcaatcagaatatcgctgatcttaaaattagaacataatgctacggcacatgagcagttacggaaacaaggaacgattctcatcgaaggaccaaggggatagagattagtaaccttatcgaggcggaattcaaagcagaacgaaccccggaagcctcgcctgcatcgtttctactagggcatatatgctctggcgctcatagaacacagaattcagatccagatggagaggacggctcgattagatgaaaatcgcaacgtatttttttctca

SEQ ID NO: 76358 - DNA, 610 bp, Oryza sativa
atatctgggtggtttcacgtggcatcctagtcagaaaaaaagaattaaaaaagtatatggggtccacatgtcagctgcacatatctctctcttctcttttcttctccctcccttctcttttctctcttctctcttctcttctttggccagggaggccgggggccggcgagcggagcgacgatgggcgggcagcgggcggagcggcgctgggccacgggcgggcggtgggctctgcggccacgaccacggcagttcctacagcggcggcaaccatggcctcgacgggaggagagaaatgtgagaggggaggcggccggcggaagatggggaggggagaggcgtcgccttcctccagacgggccgacgctgtccgtcgtcgtgcacgacgccgcagccgcgtcgaaactccacctccacaattttactcggataccatgataagagcagaagtaaatttcacatggacattcggcacagctctggatacagacacctcaattaacaaaccaaaatgtacacatttagattccgataccaattaaccgatcaaagagcaaacatatgaactaaaaaacatcgattaaccaatcaaagactgaaaattcagatt

SEQ ID NO: 76359 - DNA, 682 bp, Oryza sativa
gccaatttcatgtatgggacacgttgatatacgggtagtacaaagacggtgaggaccggaagtgatcgcgattcgcgagtttcctttgcatcgatccgtaacgtactccacagggccgaaaatgatcgtgattcggaattcgcaacagctcgttgcggtgacaaaccggactacataactgagttgccattgattgcgtattttgcgtcgtagatctctgtttcctcgcaattcgcaagataggtactctactccttacatccaaaaacttcttcatttctcattatctttatcctaaaatagtttcatctttcaaaagtcattccattgttgtttgtaaaggtgaaggataaatataccgaggctagataaaattgcattgagatttcttactttgatgataaacaaaattattttggttttaaaaaaaaataaacaaagctattttgaaatggaggtagtagcattgttgatgataaagcggtgacacaataggcagtaatatgttgctcctccactgtttcccgcgagagtgtgccattgtgcaagttatttaattacggatgacattttggacacgccatttttcttcatttccccccttctccctactgcactttacctgttaattgtaatgataaggagaaaaaggaaaagaaatcacagttatataggctctgtt

SEQ ID NO: 76360 - DNA, 1039 bp, Oryza sativa
atgatcgatcaataattgatcaacttacatatctatgttagctagcaagctgaacggattgaacggattgtaagaggcttccatgtagcgtgaaagctgtctcgtttatatttgcctattttttttctctagctagctaactacagcttaagaatttgtatatctgtactttgttcgaagcatcatagtttttgcagactatttaaaaaactattagctcgttattaccatcctaaacgtcctctcttctgtgtactctaaaagttaaaaaaaatgccaaagtgaaccccacatttaaatgtgtggcagacagttttcggcatttgaaatgttccgtcataggaaatgttcaccgtaggcccaatggcccataagtgcggctcgtcattcggaactgatgaattggactggtctgaataaagcagacctggtccagggctaagtaggccttggagatgtcttatgcaggaaaaagtctactgtggctccctcaaattaggtaggatttgactggtatacctccataaaaaaaaaccgagtgtatcgctcatctcaactattaaaatcaatataaaataattggggcctagctatccatcgcgccacagatttttgggtccaaatcacacagattttagatagttggattaggctcatttgatcacttgattagaagagtttatatatgtatcaacatatattaattatatatattgcatatattttatttattagatctttacttcgcaaaaaaaatatcaccaactcatctactaaaagttactgtgtaattacactatagttacagtgtaactacactatagttacactgtaactatagtatacttacagtgtaactatactgtaactatagtgtagttacagtgtaaatatagtgtaattacagtgcacttacatatcatatcaactgaacttacaaatgtaattttagttatataggactgtaattttatattttagtttcaaatgtgaatacagtatgattatatgtaattacattgtcatttgcacgtaactg

SEQ ID NO: 76361 - DNA, 526 bp, Oryza sativa
attagcctgatttgcaataatccctagaaatcgtacggggatcgatcacaaattttgaacgacttagtgggatagagggaaccggaatattactgtcagcttgacactaatattttcctattccattatctaacaaaattagtgtcagtctgacttagctcaatgattttaacacgcgctttggccagtaaaaccatgaagcccttggtaattaccagccaagaaagtgacgctactcaaaagtaagactggtgttgtttcagctgtctgcttgtgccatatgtaccatgtcaaatgtagcgtctttgaattcgtccaattgtccagctgatgccgacttaacgatcgagccacggccatgcatgtacggaagaaacggcgagatgatggtcggcaggtcattgatttggcaattatcgtgtttcttaaaccaacttggtgaggttcttctgtgaccagccagacgcccaaagtccccagaccaacgttgccagcgttcagtttctgtgatacgacatgccatgca

SEQ ID NO: 76362 - DNA, 571 bp, Oryza sativa
ccgaggcgcaactaggtggttacaagggaacatggtataacaattacaatggaagggtcaaatgcaacaagttaggtaggtccgccaatctgccttgcagacgggacaagtagattaagtgcgatcctagcaatgcataatatttttcaagcaacataattaagttcaaatataggctcaagatgttcaaaggtggcttgccttgctcgatatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgagaaattttagaagttgaacggagtcaaacggacttacggttgggaagatattgaatttctaagattattggatttttggtctaaaggaaaaggatttatttaaatcctttttgaaaaagaaaagaaaagaaaagaagaagggaggggaattagactttcctcgggcggctagggcgcgacccgagagaaggggtggctccgccgagcttaatggg

SEQ ID NO: 76363 - DNA, 81189 bp, Oryza sativa
ccctacccctaatataccattagagcccccataatattcctaaaattctaatctatatatttatactatgtattagaaatatagccaatttatatgagacatgtttcaatttttattggccactttggtttagccccgctataattttattctggctccgccacagtcaacaagccatgtaagatgaaactgcctccaaaactccttttgcaccagtttcactaattggaagcatgaaatacctggttttatggttggggaacattaatcttacccgggctatagttaagggagacaaaatatactttctggaatggtattctaaggcccatcttgtcttcctagttcctacccttctgccagaaaggaaaatgatgaatttatttttacccattaatgcaattgggcagctactggtacgagtgctaccaccaaatcccgtccgtaattatgagtgatcacggcctgaatcattaattttttcagaccgtaattgaatgaataccgggaccgccaacaacactcactcactactcccctctcctcccctcccgactcgacgaggatcctcccgtccccacgtcggctggcgattttgactcgcccgccgccgcctgcgccgatctccctccgacgactggcggcggcatcttcttccgccgctgcattgagcacccacgcgtgaggcatcctctttctcatctctctttctacacggtcctaaccttttttttccctgtttaaattaacctctgcatctcctctggatctggaagcttttttcttttttcctcctttgccttaacctgtctaggaatagtagcactttgtttcccaaaagatataataatcataataataataatattggggagccccacgttaggtccgtccctggccttttgatgcgtattgcgtagaaagtgcgtttaaatgcaatagttgggtgggtctatgtgtatcttgaggactttgttatggtatgcattatccattatgggatattattattattttgatgatattattattattttttttgttctagtactactgatttaattgaattgctttaggcaagaaatattggcgttgtacttggagatctagtgcgctctatgttcttgggacagtttgttgtgttgtgatttgtgatgttcagttcagcacaagatgctctctgcgagcattcattagttaagggaaaatttatgcgcatttattagttttctctctgtatagaagtatagaacccccataactttataaatgttccatgaatatgtgtaggcagaagttctcttcacctgtgggatgatgtagcaacattttatctcaactgatcctccatacagtaatctccaagatggaacagatttcagtgagttaattctttctctttcattgtattgctcttgcgatgaaatgtcaaaagtaaagattgagaaatatgtatccttttttgtttttaataacttttgtagcttgagcatcggtacaaggagtgcaggccacgaagaaataacagctgtccaaccaaaacacttgtcgggaaggatcagttgaaggaattggagcacaggagaccatcacctagtgtgattgcaaaactgatgggacttgatgtgttgccacctgcttatgtagcccacaatcagcaccaggaattcaaggatgtattcgaagtgtcagaggaaccacaagaggccgtcacgaaagagagatcacataatttccctaaagggttgccaagcttgaagcgaagtgcattaaagctaagaaagcttatgccatcaaagtctccctacggcgatgaaacatttgataacaatgtagtgaaccaagatggttttgatcgcttgaactcgctagagataaataatcctttgtttgagaagcacccctatgatgtgaattgttccccaaattatcgatatgagaaagatagtacttcaagtactttcaggaagtaccctgttggtttaggtaactcttcacttaaagaaattgttgttctggagctaggcttaggggaagtccaacattcaggtaatgccttttctacaccagaaccctctgatgtcaataagaatttcaggagaaagatgaagcaggctgagttttctactacgaacaggggttcgcaaaatcttttaggcactaaagatattaatgtgcctagaataaaaggagaaagacacttgactagcaatgctgtagattcactgttaaagcgacaagattcatcacttgatcaatataacacagtggatacggataacactggatcatctcagaagtgtgttagcagtgaagttaactccagaaaaagcaacaggtcatcatcaaatagctcaccctggaaaatccgccgcaagtatgaggaaggtgccattggttcaaaaactcttgcagagatgtttgctttatctgattcagagaggttgaagagggattcagactcacatgtgcagattcaagacaataaacttaaccggggcaacaacaatgacaaggaaggatgctttatagtgttgccaaagcatgcacctcgattgcctcctcacagtttgttggacaagaattcttcctgtgaaaggtcccctcacgatatttttttctcaaatacatcaattagtcacaacagtggtcagtttcacttcgattctttctgggataaaccaacacggcagcaaatttcaagtcccacccaagatgacttgaggaatgcttcttgtgcaagatatcacaccttggagcaacatagatcttctttcccttcttatgataataccagaaacaactcatggcatttaactgatgacttttcaacttttgcctgcataaatgagaaagtacttttcacaacagatgaagacttgttgagaaaacctactgaaacagtgcattcttcgtttggatcacgattatctggggaacaaaaggtcagtaggcccttacatttcagtaatccaaaacagaaagagagttagttgggggaaatttgcttcaatctggcgtactttcatggtatttttcttatttcaaggatcatgaattttctgaaatgacaagaatgctctactatgaagttattaataaacttaaacatttatttttactctaattttaattttaaaaagggttcaattgctgttcctgtatcatttcttatttccttttttttgtttaacattagatcgcttctttcttatgtttttcaaagcagtaagcacttaagaaagtacactctactgtgaacccagaaacatagacattgctcttttcttaatttttcttctttatcaatagtatggcttctttgtttaagtttttcttgagtgcggacatgtgctattctagtatggtactaagtacttggtttgtgtacatactgcaataccttacttagccttcattttgtccaatataatgatgaactgggagttaaccaattttcatttgttgacatctttggagccttaaaacgtctggtgttgtcatactatatgcataaatttgtggttaccactcacccagtgctccccctttcaggtttcagcatcgcctttccattgcggtgtatatgaagccataactatttctgatcatacttgtgcggcaaagtctcgtagaagcttgaaagaggttgaccgaccaagcccagtgtctattcttgagcctccaactgatgaagacagttgttgttctggatacttaaaaaatgactcgcaagtcatgcctagtaagtgagacagaccagcaccatttggaacaaagaaacattcccttcttcataaaagaattttattgcttcaaaggagaagtctgtactgcgtttatcagctatcctaacaatgttgaagttgatacaaatatttatgaaattaagctaaaccatttctgtagtctatagcacatgactggagcatcattcgtgattaacatactctagaaaggcatttgctatctagtaaatatgactagttaactaactaatgataaatttcttttgtagtatcactgagttaaaagttggaaagttcaaagttcagccctttaatttaactagtttgtaattagcatacactgaaaaggattttagtttaactaatttagtttgtaattaacatactcttaaaaaggaattttctacccagttgaatgttttactagttatgaaatgttcattgcctctgatcaatgaactttcagagcactaaattgattgttgaatcttttatgttggcctcaggcatcgataaacaaatatatggctgtgagctccgatatgagcaagaagtatccttgtccagcgacaatgacaatgattcttctgaccagtctcttgaagcatttgaagttgaggaggaaaaggaattctcttatctacttgacatacttataagctccggtgtgatagtcgcggactcacagctcttgttcaagtcatggcaatcttctggttaccttgttggtcctcatgtcttcgacaagcttgaggggaagtacagcaaggttgctacatggccaagaccacaaaggaggcttctgtttgatcttgcgaattctgttctttctgagatcctcgcaccatgcatcgacacgcatccgtgggcaaagttgagtagaaattgctgccctgtttggggccctgaaggacctgttgaggttgtatggcaaacaatggtcaggcagcaggaagagcttgctgtagcacatcctgatgacaagattcttgatccagaatggctggaattcggtgagggcatcaacatggtgggatggcatatagccaggatgttacatggtgatctcttggatgatgtcatactggaattcctctcaggatttgttgcttcatgaggaaaattaatcaaattagtttgtacttcgtgttattcatcaatactagtaacagtagtcgagtgcaatgacgagccaggattttgcctgaagaaacttgaaccacattgggtggtgtctgtaacagcgtttcaagtgcacatatgttgccttttttctggtccatgatagaggctcagtataacatttcataactctttgaaggccgaagatgtatgcacaacaccataacatgtgtagaaatgtgattctctaggatacctttgcttgttatcggggtttcaaattgtttttgaaaatcttaaggcaaatgtgcagcacattttaaaggaaaccaacatcatatgaatgcttgtaatttatgttcgatacgaaatctgcgatcacaaataaatattttgataccattgacgatacaaacatctcattaattttttatcggccatgtgccttatggcagaggttagggatgaaaacattttaactattttaaaaagaaaatatttatctagtgcctacttggttgggtgataatgaattatagaagttcaattaatattgattttaaggctttttttcagtcatattcgttgttcgcctctcttttcaaaagagaaacaaaaaaaaaccaaatcattctttgagaatcaaattttaaatttcaaaatcgatttctcaaataaaaagggttaaacggtacgtgcattttatgaaaaaaaaactatacataagtttttttaataaataattcgttctttaagtttataataattaatactccccgttccaaaatattatttagattcataactaaaagttgctatacataaattccactatattttccgtgctacttaggtcctctttgtttaggcttataagccaacttataagccaaaatgtctaagcctaaacaaacaagcagctttttcgtttggcttttttgaagccataagccactcttacactattaagccaaaagctaggttggagaagttttttttggcttatatgagatagatgtatgactccaccactaaacttaggatattaaattcactggcttataaatcatataagccaataagctgacttaaaagtctaagccaataagcctaagcctaaacaaagagggccttactaacccaactaagggcttgtttgggggagcttctaactgctacagcttcacctagaatcagaagttcccataaatagtataacttttgatttagattctgagaacctatagttgtacaatccagaaaataaactaaaagtcagaagctggaaaatccagtttttctagattctcagaagctggttatcaatcaactgcttctcaaaatcttaagcccgccccaaacatacctttaagttgcacttgcaaatatagctcgaggatggataaggagatactcttttcatcccaatttgatcatcctctaagatttttttgggtgttaccaaattgatcattatataacttgtgtctataagtttgtatgtgtagaaataaaatactattgtttcatgtctattcgttttgtatgtaggagtaaatgatattgctgtatgtttgttcgcttatctgtgcagtgataaatggcatcattgcatgcctcatattcatgtatagaataacactttgatcaatgatgtttaattttaaaaggaacaatgttttcttgtcttggtcttagcgtcgtttgtaaatataatgattaaattaggataaagggagtatgatataaatgaagttatttaaggatgtaacatagattgtagaaatggaatcctatatatctgtacaagtcatccccactaagtgcaatttcctgagctgtggttaagccacgtcattatttagttctcagccgttcgattacatctcgaggatcctcattgcatctccgtagcgccctcggagcgaccaacgccacaggtggaccccgcctcacggccgcatcgcctcccgtggctccggcgctgtagtcgccacttccccttctccccgcgatgtcgcacccctgtgccgcagctgccttcccgcgcccccaagcacccgcctcccaacctcttcgcctcctaggcgtgtgcatgaagaaacggaagcatcagtggccgcacagggcaagaaactgaattaaactgcccgaagaaattagtcccgtctattcatcttcaattcttcatgttttcaaacggtcgcttgcattactccggcctttctttcccatcttatttatgtatgatgatatacacagcagctggatcgatcttctcagccaacaagctggatcgatctgctcgaccagcaagaagcttctcctccatacacagatccctggattgatctgctcggccaacaaaggggttgttccacttccactgcttgctgatctcagatgttccagcgtaagttctttccccattcagctaaatctttttataatacatcttgattgatgctaattgagtagtcacactaatttcttcgattcaattatatatcaattttcaaccgaattcagtatcccaaatcagtccctttttattttccctgtacaacagtatttgcactacatgactacaaataatttttatcactaagcaacatttagtgaatcaatgattttatatacagctcattttgtaaacatgatttatcttgcggacttgagatactaaatgatacttcctccgtttcacaatataagtcattctaacatttcccacattcatagtgatgttaatgaatcaagatagatatatatgtctagattcattaacatcaatattaatgtaggaatactagaatgacttacattataaaacggagggagtaagataaaaaataattgcagataattcccaatatatcaaaaagtatggtgatccttggtcaactctatgagaatacacaggcaactgtatgattcaatgaagcaatgacctagatggagattttttttatcatatatgcaacacggtgctctcattcagagttctttttgtgtgattcttcaggctctggatttggaagttagctcttattgttcttctccttgccccatagatttggaagttagcttttgatcaataataaactgagtttcggaatagcaagctacagtagttgagaaaaaatacataaaaaaccatttagggcccctttgatttggagaaaaaacatagaattttagggcccctttgatttgtaggaaaatgtaggatttttggaggatttcaatcctatggaaaaaaaatccaatgaagacctttgaaataaaggattgaatactatccaatcttttaaaattcctatggaatgtgtaatcctatgcacattttggaggaaagttagcaagaggtctaacctgttggaacatttcctttgagtctatctctctcatccgattcctgcgtttttcctatggtccaatcaaacggctattcctgtgtttttcctgtgtgtttgtaatcctctgttttacaattgtattcctgttagaatcctgtgtttttcctattcctgtgtttttttcattcctacgattcaaatgggcctttagaggattttaatcctataggaaaatttcttataaagccctttgaaacaaaggattgaatcatatttaatcctttgaaattactatggaatggacaatcctatagagattttggaggaaatttagcaagagcttcaacctcttgctaactttcctttgagtctatatctctcatccaattcctgtgtttctcctgtggttcaatcaaacggtcattcctgtgtttttcttgcgttttgcaatcctctgttttacacttacattcctatcaaaatcctacgtttttcctattcatacgttttctcaatcctacgatttaaaggggccctcaactcttacctctgcaacagataacaagcttgctctttgccattaaccttatcctattttgttcaccgtgcttaaatatgatcctattttctgtcaagcactatggtggtgttttatatgagatctcaaactctcaatgtactcaaagtgaagcattgctattattatattccttgcaaaagttgctacaatatcatccagaattttagcctctatttcccttcttttcttacttttttttatcacacaaagtgtacttgaatttttaaattttattttaatacaaatattccgcagcagcgcggtatcctctaattattttagaatctcatgtcccaaattaagagatatttaaccatttgccacatttagatgtggcaattaactttttgacactggacccacatgtcatagacacatgtggacccacgtgtcattgagataggggtggcaaatagttatttgccaaatctaaaagtggaaaatagttaaaagccccccaaatcaagaaccccaccttaaaatgtttcaactaatttcaagcaactatgactgtgtttagttcagcgtaaagtttagattttggttgaaattaaagatgatgtgactgaaaagttgtgtgtatgacaggttgatgtgatggaaaagaactgaagtttggatacaaactttggatctaaaaacagcatattactcctactactacgtatacatagacgcaagagtaacgtgatcctctcccgtaaaccgccaccctgacataagaggacagttgggcccacatgtcagcggcatccacgacctacacaagaaaatgtgaaagcaagaaagaaagtcacgtcacgccgttccccctccctaaacgtggcccccacaaaacgagccccacaccccgacgaagcaaagcatcccaccaaacaaaccaacatttcggcggagcaaggaaatacccaaccccgagcgccaaaaccctctcctctcctcgccttgccgcgcccgcgcattcccgcaaacacctcgccggcggagcgcccccgagatgaagggttccgacctcccgcccggcggctccggccagaagccaccgggcggcccgccggggaacaggaagggcaagcgcggcgctgaggcgcctccggctacctcgtcgtcgacgccgacaaccgcgaggcggagtaagcgcctcgctggtgcgcctccggatcaccccgcggaagcagggccatcgtcgacgaacgcgaggcggagcagtcgcctcgctggtgcgcctcctgctacccccggggctgcggcggcagcgccgacctcgtcgtcgccgacagccgcaaggcggagcaatcgcctcgctggtgcgcctccggatccccccgcggctgtggcagcaccgccgacctcgtcgtcgccgacaaccgcgatgcggagcaatcgcctcgctggtgcgccttcggatccccccgcggctgcgacagcagggccgacctcgccatcgccgacaactgcgaggcggagcaatcgcctcgctggtgcgcctccggatcccccggcggctgcgacagcagggccgacctcgaaaaccgcgagacggagcaagcgcctcgctggtgaggctccggagacccccgtggaagcagggcagacctcgccgtcgtcgacaaccgcgaggcagagcaagcgcagcgctggtaagtctccggctatccccaagggatcggggcaaccctcgtcggccgagaagagcaagcgcaccgctgatgcgtctcggctgaccccgcggaagcaaggccgtcgtcgctgtcgcccacaaccgcgccggtcaggactacggccgtgtcggtgtcggtgaggaaggcggccgaggggcagcggcggaccaccacctcggggcgcgggaccaccacctcggggcgcggggacgctgcggagcaggaggcgatgcgggaggcggtcctgtacgtgcgccgagagctctccgtcgtcgcgccggatgacctcacctcgccgcacaactagccgagggtggccgcggccatggcgctgagttgggcgcggagcgcgggcgcaggggggctgtggaacacccgggggcgcgcgcgcgcccacgtgcagccgatgcgggaagtgatcctgggtgcgcgccgagagcgcaccgtcctcgccgccgatgaccccgcctcgccgtacaacgagccgagggtggccgcggctaccacgctgagttgggtgcggagcgcgggtgcaggggcgctgtggtacaccccggagcgcgaagacgatgcgggaagcggtcctgcaggcgccggcccatgaccccgcctcgccgtacctggaggtgagcttttcggcacgcgtccagttctggttcggcacatttgagttcttgggatgctgttgttgattacgcagtttcttggtggtcttgatcggaccttttgcctatgttaatcttggatgaatctaacgtagaattgaggcaacatattggtgtctcgtactcgccacctttgcatgggtttgccctgttagggaattgcagttgcttatatgtttcttcatgtgggattccttcctattcattagtttgctgctcatgtcttgcatgctaggacgacctgtctttgtttcatgggctaagatttttgtagctgtagaaatcggtgtctcttttgttagtttcgacagcttttcgtactttagtctgtgacttcttgggtacgatgtttgtgacgattgagtgagatatgcagtttttagcttccaatatcaccttccgttgtgtcatgattttcttaggacatattgttgtttatgaaaggttatcaactggaattccactgatcagtatgttaaattgttgcttgcatcttctgtttttactgcattgttatatctgtactttttcacaattttcagggtcaacacttatgatagtgtcacgtgtataaagtaacgagctgattgtaattagtattctagaatgctgcgttgtttagttttacagttttgctgccattttcatatgatgactgcgcagaacggagtccgccataatttaggatgttgaatgtggttttgttttgacggtcttgctgtggtcggtcttcattagttatgtaatagtggagcttatgctcacgtggacaaggcattgttcctattgtgcttattttcattatttattttctgtctagctttcttatggttgtgtagagatgaactctatggagtagggatggacgcgagtcactttatggatagccgtcgatctagtctaattcaacaagattaactaaaatgcaatgtttttctaatgcatcctatgtattttagtttatttggttgaactagagtggattgacgagtatcgataagaatatctgttgtttttactgcttgttttgggatatggcttccacatgctttttttttttatcttagtctagtactttattttctcctttgacatatctgtaagaaaaaagttactcgagcttgcatctaattcacttactataaacagcagaagccctagaagaagaagagctcgggatctttgaaaaggttagaaaaagaaaatacattctgaatattgttctacttgtggtttctgtgacctgtcaacagagggattcttggctcccttgtaacagcaatggaattttaggaaaccaataatgttgggcactggctattgcttttaattaatccaagagttcatagtttccttaaaaaaatatatcaaagggtccattggtggatggtcactgtagctattgctgtaccagtacttttgaacttcttggaaaatgactgtcacatttttgcacaatgctggatgcgtgtgcacgttaattgttaacatatgtacttcttgtcagaaagttcttttaaatagaaacagtagttcattgtgaaagttcagaattgttctttttccgctgcaattttaatccttgttgatctttttattattgctagtgtgataattatattttaccactgttttctttgacaggtccaggaagtagaagtatcaaaagaatttggatggtgggtcattttttgtagcagaggaagtagaaaattcagagaagagtttgatgtctaattcgacgtggttcttttcttttcagtactcagtagtagtcggctattgcagattacatatctgactagatacagtcacggttctccagtgatcctggatgtaggtttcaccaccacccgaggaaaaaatacaagccgagatgaattagtctactgaagtaaatgacagagaccttgtgtagttgcgtgatgtattcatgagttttgcttcgcttttgagagagaagtgcataatacgaaagagaatgaaagatgtgggaaattggtacagaactggccagatgtattggtcatcattttggaatcattttgacatagcacttatatcttaaattcaaatattgctgaagcataagtgtcctggggaattttcaatttggctcggtatcattcttgcagggattgctacctgcatgttgttccaaactgatttatgaaattttgtcctggtgatggtactttgcggtatttatcattgctggattgagggttatctcatcataaaccgttggcaatttggcatatgtcaataacttgtatctctggtgatgttgtatgcaaagagtaaagaaacgttgttcttcgagtaattcctggttatggataattcaatccaatcaatgaaccaaacccaaattaaagaaagctatggcggcctcaagaggagcgcgtcctcacgcatgacatgcatgcgcgggtgtgcctatataagcagcagatcagccatggaagcagacggatgcaggtttctgaagaaatttcaaagacaaggaaacgtcaagtagtactgtactaatacctcttcaggctcatgcaaagcgtccttgtttgatcgactggatataggaaaacaatggatgagcgctacaaaaataatcgaagcaatcagaaatgtcttttgataaatacttttacgtctctattcctaaccgtttgaatatgaaaactgtagtagaaaataaggaaaattaatttttaaattgaaatttcagcagacgaatgaacaaaaacttcttttatcacaagacctcttgttactatgtaaaaagttgtcggtagctagcagaacgaacttggctagtgtttagttccacgccaaaattgaaagtttacgtcaaaattagaagtttgaagaaattagaacgatgtaacggaaaagttgaaagtttgtatgtgtaggaaagttcgatgtgacgaaaaagttataagtttgaagaaaaaagttggaatctaaacaaggctttgttcttgtttcagctaccaaattttgatcttttattatggtactcctataacagtagtacaaggtatcatttggagttctgctgagttgttgtcaacgacacgtaggtacaatattgtactccctccgttttttaatagataacgccgttgactttttctcatatgtttgaccattcgtcttattcaaaaaatttacataattataatttattttgttatgagttattttatcactcatagtactttaagtgtgatttatatcttatacatttgcataaaaattttgaataagacgaatggtcaaacatgtgagaaaaagttaatggcgtcatctattaaaaaacggaggtagtactatttatttttccttgcatcacgaaatccaagtcatacattcctatcctaaactgattgatcctagataacaatattcaatttcatctgcatgctccctccgtccaaaaaaaagacaaactctggtttccgtgtccaacgtttgaccgtccgtcttatttgaaaaaattatgaaaaaaaattaaaaagacaagtcacgcataaaatattaatcatgttttatcatctaacaacaatgaaaatacgaattataaaaaaaattcatataagacggacaatcaaagttggacacggaaacccagggtttgtctttttttgggacggagcgagtagaccgctaataatctgaccaattctggcacctaaatctttaccaatcacaccatgacatcacagaaagtcctccacttcttcccgtcttcctgtatgaacttgtgatgccacggaccagatgtgaacccttccaggaacagcaacctaacttcaatagttcaattaaaaagttacaattctggaaccaatatactttatcgtcataattcatacgattacacaactatacagaaaacaattatatcactttttagataatggaaaacagttatcactatatataccgtccaaccagatcaacaattaaagaattgggaagcgacatagtagcgacctgcaggtcgtcggagcacaccgttgacctagctccaggacagcaacatcacgctcagcaaaggcttgtgccattgaacggcaccaagtcatcgtccccatatttatgcatccaaaggaaaaacgatgaagcaataatcagaccaagaaatttttcctctcgatcttcttgccatggaattgcctgcagccaagaggcagttcagcaccaccagccagggcaaagaagtttcagggatcagttcttgcaagcctacttaccagagataccaatcatgccctcctgaggtctaccgtcgtcaggcttcctcttacagcgttccatcttcagagatcagcaggagctcggttcgcagcagcggctcgttcagggcggcggcgcagagtctcgccggagttttcagttgctttgtgcccaggaagtccagaaatgaggatgaacttgagatttctcggacgacgatttctcaagggagcagaagtacaggttaccaagtctcgattgatccaggtaagaactattcctctatcgaggaatttgcccagcaattctgccttctggtgccttccaattcttcagttcttggttgttttgctggttaagtagagtaaatttaattgcagattaactgtacttaggtcacctgttaaaaggggaaatatcaagcagcaaacaattagtgtgaaaaactgcaatttacttttattttagcactagataaacatgaatatcccccaccgtgtgaaaatcagaatggagaaatgacaaatttaagtgcagcagggacagggtatccccaagaaagcacagagctcacagttgcagagatatttaaggcaacctcaaacttcagtgacaagaacataataaagcagggaagttatagcagcatctacagagggaagctcagggatgggtctgaaattgccatcaaatgtgccagaaaggtatggaaacaaagggaatacgcatattcagcaatttttcatgaggtatgtaggttggagattggtacttggtaataagtagtaaccatgtcttctgttgcaacagttaaacagtcagtatgcatcagctgagcttcggagagagcttgaaattcttcagaaaattgatcataagaatctagtgaggttcctaggattctttgagcgcgaagatgagagcctgaccgtcgttgagtatgtcagcaatggttccttaagggaacacttagatggtacgttttgcccctgatcgattcattcagttgcagtaaactacaatgccaagaagattctagtctgtaatagtaccactgttactatctattcgaaataattctagtacctagtaggaggaattgatcaggatttgtgcaaatgcaacacactgcagaatcctgtggaaatggtttagaacttgcgcaacggctcaacatcgcgatcgacgtagctcatgctatcacatacctgcacgaattcaaaggtaagtgacatatattctctgaaatttcagagatatgaagatgatatgagaagtggaagtctgaattctaaactgaaactcgccgtttgcagagcagcggatcatccaccggaacgtccggtcatcgaacgtgctcctgacggacacgctgacggcgaagctggccggcgtcgggctggcgcggatggccggcggcgagagctcggagtcggaggacacgcaggggaagagcgccgccgggtacgtggacccggagtacctgagcacgtacgagctcaccgacaagagcgacgtctactccttcggcgtcctcctcgtcgagctcgtcaccggccgcccgcccatcgagcgccgccgcgacctcgatccccgccccaccacgaaatgggtaagaaaccaagccaaaccaatccaatccaatcgcacgcgcaagcacgaacacaccgcaagagatggaaaactcacagcgatgcgatgagattgcaggcgttgcagaggttcaggggaggggaggtggtggtggccatggaccccaggatcaggaggagcccggcgtcggtggcgacggtggagaaggtgatggagctcgccgagcagtgcgtcgcgccggcgaggaaggagcggccgtcgatgcggcggtgcacggaggcgctgtggtcggtcaggagggaataccaccgccggcaggacgcgcccgccgccgccgccgccgtcgccgcggcgccgactcaagacaggagctccgattgggttaaggtagtttagcatgcaacgatgtgatcctaagttcctacttaggttgagattttgagatgaattaattattgttggtaattaatttatcatctttaagctaccatgccgccatgctttgtgaatacaaaatatgaggggttgggtctaacaatctttcttatgaaagttagaaagattgttctgtactataggttgattatattatgtaagaacatttgtaatttgtaaagttaacttgaaaattctcagttcttggaaggcttgcatctatcatgttatgtacctatgttcaatgatctcaggttgagttcaatcacaatcatagcaagctgatcactgccaattactccctccgtcccattttaagtgcagttgtgggtttccgtatgtaacgtttatccctccgtcccattttaagtgcagtcgtgggtttccgtatgtaacgtttaaccgttcatctaatttaaaaaatttataaaataattaaaaaaataagtcatgcataaagtactattcatattttatcatctaacaatagtacaagtattaatcataaaaaaatcaaaaaagatagacggtcaatcgttgaacaaagaaacccataactgcacttaaaatggaatgaagggagtagtacatagcagtagagcatagcatcttccaggagtcaggatgatggtgcaagaaagattgatagcatatctggggctaaaattctcaagatgttaaaccaggatcagacagctgccagttccttgtgtaaatatcataagttagaaaacaatctcaagtgtgacaaaattctttttgcatgactaaaagctgtacttcccgaactagctaactgatgggatgcagcatcgtgaggggttttttctgtgcagattgagctccccgatgcagtatgatgtggacaagctccttcatgggtgattggatatcctgctaatatcttgttctgcttatctgcttctatgaggacctgacgtttcactgtgcaaatcactaatcaatattccttgaaaatgatggcaacggagcgccttcttgtggccgcaggatgacaagaacgctaaacatcccaagcattggaagaagcacgagccatttcagaagcttgtaataatgcatgtggaaggtgagcgagaactcgtcagagaagtagaacccgtttttgtcaaccatttccacaagcacagttcctgtggttctcacaggaactgtgggaagcttcatccgctgcttgcctggttcattataagctgcattaaccacaatgcgcctttctccttgataattcccagggacaagtagagtaacctgaaatccaatggtaagcgagggtagttggaagttaaataaaaatatttggaatatccatcagacaagccattgggttgacaaaatgtaccgtcacgttataaggagcttggttcccataaggaaccctgtacttgtccacaatctcaaactctacccagaaatgcttgccctcttcgtcacggaatgttctggaaccgtgtttaacataaataccttcacggttgtaacgatatgcagcattgtttcttccctggtttgatgatctccattcctaccattaaattggaaggaattatattgttatcctactgtcagcagtacttccactatcttgtttaaacatccatgaataaatagaaggtttaaaggaaatatgcaactctcagccaaaccagattaaacataagttacggaggattcaccaaaaaatctactgacttgagttaaattatgagtaaattgcacaaaatcacgtgattttgttatcctattgtcagcagtacttccactatcttgtttcaacatccataaaaaatataaggtttaaaggaaatatgcaactctcagccaaaccagattaaacataagttacggaggattcacaaaaaaatctactgacttgagttaaattatgagtatgcacaaaatcacgtgagttttgacacgtggcacgtaaccatgggtattatggtgttagtgtttcacaaaaccatgcaattgaccaatttgacccaaatctgaacatgatttgacccaaatctgacgtgggattatgagttctttcatccaccgtggttctatgagcatataaaagtttcatcccacatgtcaaatttaagaaaaatttggcaattgtgtggttttctgaaacattggtaacataacaataggggttctatgccacgtgccaaaactcctgtggttttgtgtaacttggacacaatacctatggttttgtgtaatttactctaaattattgacataaaaaaacatgctatgtaccttaagtggatggtgcggagagggagtggagaagcagaagacattgccattcatggtagtaacaataagatcgaggtcatctccaccatcaacattatcagccaaaaccatactgtacctgtcaatatgcaaagaagtgagccactttgttgaatccagaaattgtacagagtacagaattgcaaagcagacaagaaatgtcatacgaggtctctccaatgtcaacaacatctgcacagccacttgagccctcaatcaaatacaagtaaccatcaaaggatgtagtagcaagggtgaggcctttagacttttcatcatgtttgctcatgtcaagcaatagaacaggactcatgatccttccatgcgttctatatgggaaaggctgaatttttgagccatcctttccactaagaacatatatgtttcctgacacggttgggaccacaacttcagtgcgaccatctccattaacatcaccaacagtagggcgctgtcatcatatgacaatggcaaatcagagggtatgaaaagcatagcccaaataaaactgaatgcaccagtgaagacagtgaaagcatatagtaatactaaaccaagttatgatattctgatttctgactcggtaaaaaggtaatagaacaagatggaaataaattgtgacaatctgacaagaaagattccatagtattctaccgagctaaacaagcaagcagcttcaggacatatagcaatttgcagtccatagactgccaaaggtaagggtatgtttagatatagatagacaaccaaaaatatatacacaatcagttagaacccacaaaagaaacgggtttgaacttgcctgtgggataagactcttaagatgaacctcccagatttcttctccctctgcagtccatgctgctacattgccatggacatcagcagtgaccatctcgattttcccatcatcattgatatctgctgcaatgactggtgcatgaatctccgccatctcaagtgggaacttgttcctaaccttacctagattgataaaatcaacagcacttatggtgagaatatattgtatttgtgaggattttcagtgaacatgtcctaattatccaaacgaagcaaagagaagcatgctgaaacatattgatgaaagcaacagaactgaaagtgagattttattgtatttgtgaggattttcagtgaacatgtccttattgtccaaacaaagcaaagaaaagcatgctgaaacatactgttacttctacactaacatattctgttgttctagaaaaaaaaaactttatgctacgggagctagatatacacagcatagaaaacaataagtcagcttaaagctgtttatggattcagaattgatattatgaggttaagaatttaccacgatgatcgataacataaaacaagccaaaggaagttccaacaagaatatccaaatttccatcaccatccaaatcaaccacggtcggcgaagaatatgcatgggcagtaaaatttccactatctgtactcaaatcaagttctgcagtccatttgacttgtcttgtgtcaaggttaaaaacaactatactgcttgcaatatatttgccaatgtcaatccctcctaactcctttagatgttctggtttatcataatacctgtcagtaaaagacaagttactagtgactgtctgaaacaccaacacaacaacacaggaattaggcaagaaatcattaagtcatattatggtcacaagttttgcattgagagagtatttcaatcataaccaatagacagaagggaaattacaagcaaacaccttaggtcggcatattttgattcattgttggaacctaactgagaagtgaaaactgtcataaagcaccaccacataccaaccgacccaaaatcagggagaataaaaggattctggttttaaaaaagtaacctaaactacataacaacaaatgtcatcacatgataacataaataaccagtatattttgttatgttatcaaaatgcacttgtagcagagaaagcagccttactcgtggtcaaagaagtaagatacagaaatcaccatttcttgtatgccatctctgtcaatatctgcaatcacctgtagtggaaaataattcatgaatatttatagaatgaacaagcagaaatagccaaaacgaaacagaaggtacactcactggggtggacaagatgtgagcatctatgctcacataatcttctgccttttcatgttgttgttctttccagtcctcgtctccccacatggtttcatcaacgtagtcatcataatcgtaattgtactcatcaggcagatcttctacatcccgaaacaaattaaatgatgcatcagcatcagcctctagaggctcgctattttcaacagtagctgcttttgctgttccggtatcacttgcatcagtttctgagcttcctgcttgattacttttctcatctgtttgaagcaaccttctctgaacatgtgatgcattctctgttgtagtacttaaactagagttgttcccagcatctgtgctgtttagattgtttaacacatccatattctcctgtcctcgggtagaattaggtttactttcaactggctcttccttagacgcatgtttcatggaatcaactcctcgtgttgttgagtcatttgtgctccctacagtgataaacaaataaaactataatgcatctcttgtaaatgatcttatagactacacacggagtgtggattctctgttactaaaatcagagtactggagtagcataatcgttactacgtgcatgcaccactctctttagagcattttccatcctctggttggtaacatcacataatctagttataatatccaggctccactgtattatctatatatctaaggacagcctacaaatatgttcaacaaacatcaatattgaactaatgatcctaaagtaccatttaacctaaacagcgcgcagagccacagactttcaaggtagagcatgtaaaatactagtgactagagaataagcattgcagccaaactactaaagcaacagatgaaaagaagggattcttatgattgaccagtgaatagtgtgattatagcttataagataacttacgtgactgggattccttagaagattcattcacaactggcttgtcctgaatatttgggtgagattcttcagaagcagctttctttgcaattgagctgtcatgaacatctggatgggagcggtcaacgggatctgtattcagcccaacataccagtctttgtgtaccttcctacgaggtacttctagcttgtccatcatcatataacctgataccctacataacaaacaaataaattaccatgtcaaacaaactcaacaaataattttacatgttcagtgaaaacataagaagatatgcaccaagttccttacctgaagaaattcactacaccattgtaagttgccaaaactatttcccgtgtcccgtccttgtcaatatcatatagaagtggacttgaatgaacatttgactggtgaaatgcaggccatcctggaatcaatttcacaacaatatatattaataaataaacaacattaaaccaattcttttgttaattatagcacaaactttcaggacctttaaaatgtggtagaacatcttagacctattcattcaattgatggttttccagaatttatagcaaagagctaatgatgaccactataacatgctaatcggtaatgtgaaaccacacacctggcaatttgtccccatcagagccttcaagaacttccaggtaatgaacaaatgatggcaccactacttccaactttccatcgctaatacaccaaaagattatcattaaagtgtgcccagagcagactaaagaagaaattaagacaataactagaaaaaagtcatccacgtttaaaaatccaaagcaaacatgcatatgatatttcacagtgtccatagtttgaagcacaaaatcatacagaggaaaaaaaattcagtttatggcaatgatgtacttatttgattttgaacataatctatagtaactaacagaaggtttattcagaagtggatgctgttccagagcatagaacaatagatttatctttatacaagcaaataatgatggaaacatgaagtcaaatagaagaagataatgagaaggatatctgacaaagattaacatgtcctaaagccaaaaaaaagccaaatcatttcccaggatattttacctgttgatatcagcgatcaacggagttgcataaatgctggaactaacttcagtctgccatctcagctctacatgttttggacacttggtcttcaataaagcatcttcatcactgcggagaatatatagttattacatcgatgaatgcatctatccgtacagatgatcaacattatttgtctaggtaactttcaaagatgtagtgtccacaatagtaaaatctttcatatgtccccctgaacaaattgaaaacacggggatcatggtagctaactgaattaataaacttgctccataagttgtggcattttgcaggtgctcagttgaaattagtggtatggataaatgcattatgctttaggctgtgatttttctctgagaaactacaatactacagtataacaatttgatgatccacatgttgtaacagccaatcttactcttaatctcttaatcctttttgcagatgaaaacatcaataagaatttatatttaacaggaatgcttttttgccccctgtatggctgactaatatatcatatatatttgtgcagatattttaagaattagcacgccaatgaaattcaggttgacagtgaaatggtatcaaagattcaagtaatgattgatcatatacctgcttttagattgaaattgaggatttacccttcagtctacatgtcagtgaccttagatgaccctatatgtcagtggcacaggaggtttaatactctttttttttatctaaagagaggatatatgatcaaatctatttcaaaggacactaagattaactctgaagggaacacatctgaagagctgtttgcgcttttacagcactcgcaaaaacaacagaactacaataactgatctagaaacctcaagcgatgtacagattttacatccatttttacctacagaaccaattataaatgtagattttattgtatgtgggtggtggaggggatcagtgagtactaattcttttaagatacaagagaatataataataatttcacactacaaagaatcaactgaatgaacaaatctgccaggcatagtatggttggtcacaaatacgctaatcccaataaggcctattacttaatgcagggtatcaatcaccacatgtatcatatgtgcccattaaatggaacaaaaattaagcgatccaagttttttaaaaagaagagtaaatcttcacactctagaaattgcatatattcttcttttttgtgacattagcctgcatgacagttgaaacaaatccagattatgaaacacaagcctgcataacagttgaaacaaatccagattatgaaacactagattgggtgacctaaatgaaaagaaggacgaaatcaccatttccatattcaaattaactattccataaaatgagttaattgctttgtgtaatccctgatacatcaatgctcgaatgaagtagaagtattttccaatgcaaaaaaaaaagtgtagaggttttaacagattctgcacatcgtgtcattctgagcataaattgaacactcctacagaaataataaggtgattaaggtcgttaactactaagaaattacgaggagccacagaaaacaaccaaccatctaagatcgcttccagtcccaaggatctagcagcagttcagttccaaatcgaaagcgacaggagaacccatgtgaaggagagaggcaagcggtgactcacaggtgggggtatccaagcatgtcgtcggtggcctcgcgctgccggaacttgttcgccttctcctcctccgcggccgccggcgctgcggcagccacgagaagggcgcataccgccgcgaaggcgaggaggggacgcatctgagtacaaaaccctagaccccgagggcctcgccgcgccgcggcggtcgccggcggtggagagggaaggagatctcggcgtggaggcgccggtgtgggaagtggtcggagactcgtcgggtggggaatccgaaatggcgaaagagacgaggggttttctgtgaaactgcgggtcagatcgtctcagcgctcgctgacgagtgggttcaggatgggatggatggcgtgcttgcttacatgtggggcccgcatgtcggatcgaacgccagcggggcaggcagacgagggtgacgtggactctctgtagcatcaatgggactcatcttttcgtctagacgtttatgtttatcaactaaatttaaatttttaactttagatttgaagttgattttgaggtttttttttcagagtttattttttagtgttttcttttagatcattaaaaacacgtatataaaaattttatttataaattatttttcacttgcaaatatgccgtttcgcacggtggctccgaaaatcatcaacgatttagatagctcgttgtgattttcaaacttgtatttttcagattaaaacaactgcaaagatctcataatatggaacaacaaatcgttgcagcagtaatgccagatttttcttttctttctggaatcagggtagttcgggacccgggatcgtgcacagtctcggcatcgcgtgggtgttgtgccgggcaacgccgcgatagtctgattccaaaaacaaaagatcggtacgtgtcctatctacttgtcctcttttcttctactccaagttgaattcgaaaaatcgaaaactatatttgtgctcaatatataaattctgcctcaccgaaggacgagtgccgtctcaacctcgatcctcgctcttgctctgccaactcgtccctcaggagccttcgtctacgcctcccagtgatctaccgtatccaggattttacgtacgtatacgtatcttgattcctaatttctttttccggattatgatgtttttcccgtacagaggttgatatataattaatcaatctaagaaagacatatataatcaatcaaccaagctgagtttattcaattctaatttttgtcgttctactaatcaggttggtctagctatagctgttgcacatatataactgatgcctcgagtaggggatcagcacgcatactctggagatagagtcggaaccgagctggtatatctttcctgcgtcatcggaggatgctatcttcatcgagtgagacgatcatgggggcttcttacttatggagcggcgattggacagtacgcaatagtgttctattgttatcagattagcttttatcaattagtacttgatacaatcaattcgcctaatgcacggcctgaccggagggatcctgataggatccccctagaatttttatttaaaatacccgtgcgttgcaacgggtgaagttattttaatcctattattgttatatggtttagttatggtgaaattcactgtcttaaattcgcttggatatataccttgttagaaaatcatgagatgtaattaggagtccgatcatctcaaattaacatgcgagttttttttaaagagatttcttatacgactccttctgtatttgcaaaagcaaacgaacttaaaaaccgactcaaacactgatctatattttcaaaagcaaatgaacttaaaaaccgacttaaatatggaggacgtaccaaaataccggtaaaaacatctttaatttttataatagtagagatggtaaatatcaaatactattgtttctctccgattctttttgttgttgttcgtggctctcatcttcttattattctattggatctactactcgttggtgctgccatctgattggcatggatgacgatccagagatgtgctgtttgtgacgctccaatcgcaagaggcgagaccgcgagagcaacaagtacaccatgcgccggcgctcttctcttctcatcctgtgttactccagcccagatgtgagcatgtggcccgtgcagaaaaagaaaaacagatgaaaggccacgctagggccgtgccggtgaaggaaaggagagatgggctgagccagctggttcgctagggccgaaaaaggagagaggaaaagcgggccgtcgaagaaagagatgattcagcacatcatttgtattttctactagtgtgctttttttttttggaaaatatctgaacgtatttggatttgaattcaaaaaattagttggaactaaggaaagattttaacgaaaatatcaggaaatctatttttgtactttaacccctctctccatctatttcttctcctcctatggcgttaggtgttgctactcgccattgtctcatcacgctccgccttatctatggggccttcctcgctggtacggtgctctatctgccggtgcccatcatcaccatactgggtgaaaacctacattcattcgcatctggctggtctgcatgtttcgcagagcaaatggtctcgattagtacattacaacaagtgcttttcacggttggaaaggtcaaaagaggttaagctatccacttgcccagaccaagcaggcgtctggtagatgaatgcattgatcacatgctcagccgcataatccgggctaccataacactaaagaaaagaaagtcataccacattatcacagctcgtaacataaaacttcggttgactcgcactttgatcatggagacatatgatcaaacttacagtgtagcctacatatttactgcagtagtttgcatcaaggaaaccgaagcaatgccccttgctaacacactattccattcgtcccataaaaaatcaacctagtaaagtggcacattctagtacaacaaaaagacatacgtctgtttagatttgttatactggaatatgtcacatctagtcctagattctttttttttaagaacggagggagtacactactactcctatgctgatgtgtgttggtactagaatgctggttttaaagtggagattagtggctcattagcatcgtttgaatggtggttgtttagccgagggaattggtggtgaggttaaatagtattgagcctgagcttcccagctcactgccttgtctgcatctggctgacctccatgtttgcgcagagcatctgtctcccattttgttcgggtgtttggcttggcctcccctcctcttaaattcacacacgccccacctcgtcactcgtctcgtctcgcacagtcgcagctgctgcggctgtttgcccatcaatcaagaaatggcgaacaaggctgtcaccattggcgatctgatccaccgcgtcgccacctcctgcctctccaaccgcctccccggcagctacgcggtcagcgactccggcgacaccgacttcgacgacgacgacgacgacgaccccttcgctgacgccatctcgggggccggtggcgagcggcggcgcactccctcttcttccgaggaggcggaggcggaggcggaggctgatgatgagggggaggatggtggtgagggtggggaggaggaggatgaggagaatctgaagatctgggaggagaagaggaaggtgaaggcggcggcggcggtggcggcgagtggggctgagcgggcgagggaggcggagacgctcatggcggaggtgttcgacgcggtctccggcgtgcgccgcgcgtactctgacctccagggggcacactgcccctgggaccccgacaagatgcggagcgccgacgccgccgtcgtcgccaagctccgccacctcgcgcggctccgcgaccgcttccgccgctccgtcgccacgggggggcacatccccggccccatccccaccgcgccgccgctccgcgaggccgtcgcgccgtacgaggccgcgctcgacgacctccgccgccagctccaagccaagcaggccgaggtcgatggcctcaaggagaagctcgccgtcgcgagcaaccgccgcaactcacgccaccacccctccaagcacaatgcctccggcggcggcggcggcgccccgaccgcggagctgttcgccgcctgcgccgagcaggcccgcgccgcgatccgggcgttcgcggggcacctcctccagctgatgcgcgcggcggggcttgacctcgcggcggcgacccggtccctcaccaagatcccggtgtcctcgccgcagctggccaagcacgcgctcgaggcgcacgtcacccgcgtcctcctcgtcggcttcgagcacgaatccttctacctcgacggctccctctcctcgctgctcgaccccgccgcgttccggcgggagcggtacacgcagttccgcgacatgcggggcatggagcccgccgagctcctgggcctcctcccgacctgccccttcggccgctacgccgcgagcaagttcgcggcgctcctcccgccgcgcgtggagcaggccgtcctcggcgacggcgagcaccggagggcggtggagggcggcgcgcacccgcggacgccattctacggggagttcctgcgcgccgcgaaggcggtgtggatgctgcacctgctggcgttcgcgctcgagacgccgcccagccacttcgaggccggccgcggcgccgagttccacccggattacatggagagcgtcgccggcgggcgcggcggcggcgccgccggcatggtcgtcgggttcgccgtggcgcccggcttccggctgggcaatggcgccgtggtgcgagcccgggtctacctcgtgccgcgcggtggccgaccgtgacaggatacgcaatgcacggatcgcctcttccttagctggagtagttgattggtggaagcaagtgttgtagtagtagctgcttaattacatgtgtaatagacttggattactccagaaatgaaggatgaaccatttagtctacttactgttctatttagcattttagcaacctcttatctgaagtaatccatgggtaagagaattgggtgtatgatcatgttgtactattactattatttagtcaaagtaggggttggtactggagtattagctgggtcatgtgtactatcagtatgatcatcgcaagatgtgggcttgagtatgatggataattaagaaggcactctatcattcagaagatgtggtagtagttgtcacatgacatcaaagaagtactatccttaattggcatttatgatgtgttgctattagtctgttaattgaagaagttgaaggctactagatcattcttgctgggcagaggacaggctagatctgtttagatagattttctgcaatttaaaaacattaggcatggtacacaaggaaagaacagtatgttgctcaatgtatattcatcaaaagaatgaatttgtatcttgttcagatcaaggtattgtgccttttaaaagcatgaaaacatgttgcatgatagagctgttcaggtgaagaaatgcacagtttgtctttcgcaaacagatctccagaaactacagtaaaagaaaaggggaagaagcagatccctttgttctcagaagcttttgcctaaacaatttaataaaagatgaattgggtctttctccaaagtgatctcgtagctaaggaatcaacaaagaaagaagcaaagtggaacacgaagatagcctaatacacatggtgaagtgacactggggatctaaatgctcataagaacaaaacccttgtgcaaagaattgttcttcttttattgaatttattgataaatgtaggtacgaaccaaaattttgaaatgaatagcctatgcatctaaaaataccaacctaaaaagtttgaaccttgttttctacatgactttccttgtccgacaaatctagccctcatgtggtcatgtaactcctgtaaaacattataaatattctttcatcagaaatggaaacgtcaaaacccggtcgcctagtatgaaatactatacttgttagtgaaaagaaaacttacaggtcagttcttgaggtagcccgtatgctaacagttttgtcacggtagttactcaaagttaaatggattcaatcttagctatttcctccaggccccagctgtattgatcaaagctaatgatccgcaagacttctgctcagacaagaaacacaaacttatggaaggaggatataaacccataaaatcagaaacaacctctcctgcggctatagtgtgggggagctaaacagttatcaaaatattctttttgaatggctgttaagaaaaaaggcaaaatattatgccaagaagcaatgtcctatatgatggaaattggagatgtcctaacattttctagagcagtaaatttatgtattgttagtatcgtaactaaacttgatttacttagattgggttgcatgaataattgcagcacaataatagaacataagttctatcctataacctggggactctggagtctgtcacagaaatgataaaatcacatactgtgcatgtaaatcatttctttctcagcccattcgtacatgaaacatatgaaaatctaacttgtatgctaacttcctgcttgctatagaagtactactagtacttcctaagttattgctttcctgaccacctgatgcaaccagaatggcagacgcttaggcatgctcattactcaggagccatgattcttggaaagtattagttcataatgctattgctaggaaaaccagaattcattgggtcagtgatcatactttttttcaccatcaagtatcaactgcctcaatttgatcaaaatctagatccacaaagctctccttcccaaaaagtgtcaactgaagagtggcctgtgggaggtacatatataacatgttcttagataatcaagcaatattggaagaataggtaatggaaaattaccatacaattaattcactgatttttgcgatgttcttagatggaattatcatcagcctaaccttcttatttttgcgattcacttccaggagtgaaccagtgaagccttcaaaaggcccagatagaacatgaacactagcaccaggcgtaaaagcattgtggttgctgccaccttttgagattggtttcttaaactgtctcttgatcttattcattagcatgagttcagaatcttcaacgggtttgttgaaagactcgacaattcctccattttccatttcttcaaactctctgtcaactctctcttgctcctccttttcttccctaataatcgattcaacttcttcaactggaataggtttaggctttttaatctgccttttgctgcattacaaaaatatagcgtgaaggtaggcacaaatgaaaagatgatattagaaagaaggaaatggataatgtactttgctatattctgatcttagactttccatcttctataatttgcacttttacaactacagtcagttattgcctttgaacgaagattgctactttcactctgatgaaatccagataataactaaccaagtagcttatggttttgaggaaacatggtgtgatgcatgtcagtcaccttgtggggttaaaggatgactctcaacttatagatggcaagtaatatttgctttgacatatctgcaacctaaaatttcaactttcaagttaacctaaagaaatccaggatgagatattgaggtagtttttccaaaaaaaaaaaaaacagccataaaatcaaagctaatttcaacaagaataggaacatctaaaaaaatataaatgctaattcagaagctatcaaatgaagaatacccacatagagccaactgtagctccaataaaaccataacaaccttcagtgtccctaatgaagtcatgaacttccttgttcaaggtgcaatacagaaagaccaacccgggatgcaaaggctttgatttggtactgattgaaccatttttcagtctcttcttgacttggatggatggattataaatctgcaaatattttgtcagacatatagtactgaaagcaaggcatgcaaataaatccattcagtagcacaacactgcacattgggggtactaagttaccgaactaaccacagctacagttttacattaacaggaaccggaaaaggttaaatggatataacaaacgactaattttcactaccaacagattaagtttatcatatgcatttcagcaggcatcttatgaccaatcacctacaacacatgatagtgtaacgataagatttttcatgttaaatctaacatttctaacaatgccagtaatttgcgtcctaatgttgctcataatctaatataattggcacatctgacatctaacaacatattgcacagaccaacaagcagatataattcgaatgtacaatgttcagcggaatgcttccgctgcacagaagcaaataatttgttaacttctgagaggagaagaggatagacgagagaccttgaacgagagctccgggtaccgtcgtgagatcgccttggtgaggaggtcgacgtagtcggtgccgggcgccatggagacgcgcacgagccaccactgcgggccgtgctcggcgaggaagtcgaggttgaggttctccctccacgtcctcttgggtggcttcttccgccgccgcgccggctcgtggatgagccgctcctgcacctcctccttccagtcccgcgcccgcagctcccgcctctccccccgctgcttccgcctctccctccccgtcagctccccctcacccccatccacggacatagacaccgatatagtaggcccaggcgacgccctcggcggcgccggcaccgccgccgccgccagcgagcagcggcatgggaggcggaggagcggataagccaagctcatggcctcctccgcgacgagacgagagagaagagtttggattttttttttttttttgacacgagaagagtttggatttctgaaaaaaacttaaaaaacattacccggtgctcacaggtgggcccaagttgtcggtgagtatcattcgggccgtgaggcccatgaggatgcggcccataaaaacgtggctgttttggttcctccgcttgagaacaaaaccctagaattgggggaagggttcatcaggtcttcttctcttctggaggcgcgctgctcttcgcggcatctcaattcccaccgccgcatcgcgagatctccggccttttctccttccgggtaagcttccctcctcttctccttcctcgagcggttcgtttgcctgcaatttgggggtatgggttccttaggtttcctgctttgcagttgaggagcaaagagcagcaattatggcggcgaaacccgagccgacccagttggagaaggagcaggtgtgtgtgcgtccatctttcctctgcattttgtttttcttttttttttgtcgatataaagttcgtggtgcgattgaagtcgtggttctgtggctgggcagatgttcgggatgatggagaaggagatggagtaccgggtcgatcttttcaaccggtgagtgatacactccttgtatgctttgctaattgctactatctgggacttctgatatcacgaatctttcaagaagtaaagcattaaacaaacttagtttctgtcaatctaattacagtgagagtgagatatctttattttttttaagaactagagtgagatattattatctggccaacgatgttaacactgggctattagttttcatccttgtactggcagcgtaatatagaacttccgtggtttatatatcgcatatctgtagttactggcaagttgtacttcctatactatctgttagcacccaatattttcggtgataaatagaagtgatcaattaggttggcattagcaatgttaagtttctgcgggcaggtagttaatatatttttaggcccaggtatattttagcaacgttctcccttgtttgtactgagatgctttgtgcgattctagtatttaagtatcttattgagtggtaattttgattggcccagtagcccacatcactcctggtcatctttttggcactaatttgacgcctttgtgtccttttcctttatgcagacttacacagacttgttttgacaagtgcattgagaaaaggtacatatcgtctggttaagtttcacatagctgagttatccgtttcatgctgttattttctcatccttctgtttggtttcaattagcattctcatacatggttgtgggatgatagactaaaatattgctggtaaagaatatatctatatcaatatatttcaactaaggtgaccaatattgggcatttctattcatcatgtgtcttgttctctagtaactatcatctgttgaattaactgtgcattttcccctgggatttgttctatttcaacaggtataaagaagctgagctcaatatgggtgagaacagttgcattgatcgatgtgtttcgaagtactggcaggcaagttaactgataattatatatttgctgtcatgcttgatgctgattcagatgtctggagtttttatagcaatagttagcttggtggtaacatgctgaatatgtatcatgactgtctttcctactttgtgttgtgaagaaagtcatctttttagtgcatctgatctccatccagagaatttagatcatcttactaaatcatagggttcatccttgaacaaatgtcattgaatatgagttccatagatcttcacgccttgtatagttggacatataggcagtggttgaaatccatgcagagcacatgtttttctatttcgagttttcccctcgtctgaacactgaatactattttcccgattcatttgaaatgactgttgggttaattttgctctatttgtatcaatttatttctatttgtatcaatttatttccatttgtaccaaattaccaacgccactaagtctaactttgggttaaaatctttttcaggtaactaatatggtaggtcagatgctcggtaaccggcctcagatgtgaggcgagaagcagtagaagcattaggccagaccattgtcgctatgtttctccacattggttttagaatgttaccgattgccagaagtacacagcacgagtgagtgtgaccgactaatggattgcccgaaaagaaattgcaatgttcctttccaatggtgtaccttctccctgaatcatgaacaggccacatgcctataataatttggtacagctagacgacgatttttgctgcgaaatgatgctctcttttgttatacttgcctgtctgaatatctgtccgttgagacaatttattctggactgttctaaccttttgctttgtttaagtcatgtttaaagcgaactggaggacccagtgttagtctttgcaatccaaatgcagccatgtgtggttttctggaaaaatcgcaagaaaattttcttacaaacagataaataatcctatatatactaagtgtagttaatgttaattcactctacttatgaagccacatcatcttaattgtttttagcctttgaatgattcatctagaatgtaaattgcatctctttctccaaaagacactatacagcctaatcattaacctttgggtaattgataacagtataaaaatatataaacacatgaaaaaaatagtaattgataaaggtataaaaatatattaacacatggaaaaaatagtatagtaggtaagaaagaaaattgtagaacttgtatctactatctactatactataacataattcttctgtatcaacgcctgggtaaccatctagtttaatactgtttgaactcctgttttaaagaaaattggtaccatatatgactcccctacttttctcagccattaattggctaaaataatgatagcattaagccatagaatgattatttaccggtgctatagcatcaagaatacgttatacgtgttctactaatcagaaaaagaacatcgggtatttgcacagttgcactggaacacgcatgaaaaatggctgattactcacaacagtctttaactcttgacgcctcagaaaagtctgcaagttgtgtatatacatgaattgtgacgaaataacattaaagctttacaatctcacatccacggtttgctatttgaatgctagttgcccattttttgtacttatgaatatattggaggtgtcataacagccaacctaggagttgtaaaaccactggaaataccaatacaagttagggaagaccaaaaaacagccctattggtggcaaagcactggaggacacccaaaatgcaggcgatctaggtacagaagagaggaggcatcacatcatgtttgagggctatacagttcatctctatctagcattcctttcagcttccaaagcggcgccttgcttgagttcttcatgcccttcaggctccattcccatggcgagatatgccatcccttgaaggtagtgtgcagtaggccactcaggagatatgtctgctgctttctttgcatccgcaaggccttcttgcagcttgccgagcaccatgtatacgaaacttcgtcgtgccagcatagtcggagacaccattacaccagtgtcaatgaactgcaaaatgtttaaaaacacagcttagcaacctgaaaatcaatcaggaacacagtttttttaaccataatcttaatttgaggaaaagtaattgttaatgtacaagcagcgaggctatcgaaaacagagtatagatacaggaaagtgaattagattcatggacaacatttgatactctaatacatacccttgagtagcactcaactgcagtcgcaaaatccttggattgaaaagcactgtctccatgtttcttgacaagaatactatcagatacttgttggccagtccaggaatggaaagatacctgttatatacaccaaatttttaaggtatgggtcagatatgaacgggagcagtgcgaaaacatggaaaaccttcacgttaaaaaaacttggaccagccaacatggtgagaagttaagttttgtatgggatatattacaggtcaactgatggatgtataatatatcttcaaaagatacataaatgttctattgtactttcagacctatagagcaataaaaataagcatggtcaaactagttaaaagtttagcctcgagctcaaaagaatggcacttaaaacatgagctaaccattaggtttcattggtcgaagagcatgggcatcaacatagaccatctactttcttcctatcctatgccacaaaatgtgtgggctttcaacatattttgtttcatctacacaattgaaatattccaagatgacaataatgtagtaataagttccggcagtttattcctttttagggaaatggcagcaatgagttagggaaggatctatggtaccaacaagaatatttcattatgataagcttaactgacaaaaagttaatacctcgaatgttgctctttcatcctcacaatatccatcattctccagcatctcatgaacctcatcaaggtctgctctggcataaactttcgctatagcagataacgaaattcgctctgtattttccttatcatgttgtatgcctagtaaagcatgtgaaggagcctgcacagacaattaaacatcgagtaagaaatattaagctggcaggcgcgacacattaataaggagaaagatgagttggcgcatacttcaaaaaaccatttatgctaacataatatcaaatgaaaagcaaaggtagcacgttgacagaagacaaaatagttatcaaacgattgtgtggagtttttttcctgcagctttttcaatattacacaatactgttactagtctagaaagtagcaagaaaaagaaacattacagaagcatctttctggaggtttccaagagcagacaccaccgatttcaggtttggccggtcacgaccttcatactgcaagcaacgggatgctaatcgtatcaactcagttccatcagagctggagacatggccttctaagcaagagtccatcaacaccaggtaattttttcctcttataaggtcaagcgcctacagcaaaaccaagcaaagtgaatacttatcttgggtaagcagaaaagcaggaaggatagataacttacatggcttggtgggatatgttttccacttaggagatcaagcaagatagtaccaaaactgtacaccacactctctggaattactctgcctgcagaaaatgtagtggttagtaaagaaatagagactgtgtctttgatggacaaagtcataagaaaacgaggtagattttgcaacacagaattctgttgcttcactatgagagaggtcgaatgctaaatactatcccttcatgaaaaacaagtccgtgcagcttacgttgttgcctaatgtctgtggttcataaccatggtaccatagctaaaaataaacaaggtgtgaatagctaaaaataaacaatggaaacccagcaataacatttgcatagaatgatttaccccactggggaaaataactagcaaagaacatggacatactcaacaagtgtctaagagttagctcatattacgctcatattacaagtccttacttcatgatcaaacattaacaaataaaattcatgaaatgcataactcacagaaaaaaacttgcttgtatgcacaacacataccagtcttaaggtactcaggaggcgtgaaagccaaattggtactatagctcttcccatccctgctgttcttcatcagaccgaagcacgacagtctggggttaccatcctatgatttatcatcaaaacattacatgccttattactggaagcccaagctaagaagttactaagtagcacaggtactgactcaccacatcaaagagaaccctgtatgcatgcagatcatggtagagagctctccctttgctactgcagtactccaatgcctgagccacatagaatgcagctcgtaccctcattgcccagctcaatggctttgtctcccctgccaaggataaccaccatgagcgcaaaatgtagataatccaaatgcaaagtgtctactcctactgaaaacgttaaatgcaacaggaggcaaaagctctccaatttaccataacccatactaagaaccttagatgcaattgagttggatatatattctagaaaggcaataaataatgaaaacatcttgatgccaactactagtgtagtactccaaacagaacactaataacaagcatttatagaagaataaatgcattaatttctagttaacccagaagaacaaatgtaggaccagacaaaagaaacagcaaaaagagtttgttgaaggaattacttcaaccgtctccaactgaaagcaacaattcaacattagattcaggtgacaaaaacacatccatccttaaataaggggcccaatcttatcatctttgatgcctacatttgtactaccaaatcggaaacaacatttgccaaagcccaatatgtagctgcagctagtatagaacaagaagaaaaaaaaggtgagcaccaaacacatacagtggaagagatgctttgccaaggtctcgtgcggcatgaactccgcgacgagcagccgctcgccattctcgcagcagcagccgatcaggttggccagccggacactccgcagctgcccgacagccctcgcctcctcctgcacacacacacacgcaagaacggagccattcaatcgaagcggcgaaggcaaggcaagcactgatgcagatggagcaaagctgcacgaaccaagaactggcgggagtcgggccaggcagagcggccgaagcgcttgatggccacggtgcggccggtgctgaagagggtgccgcggtagacgacgttgggcgccttctcgccgtgctccgacacgatgcgctcgggagagaacccgtcggtcgccacccgtagctcgtcgaggctgtactcggcgaacaccggcacgccgctgccgtcgtccgcggcggcgccattctctgcacgtcaacaaaaccacacagatagctcggatcagcaccaaaaaagcacgacgcgcgcgtcggaatcaaccacggattctcgcgaagaggtcgcaatgctctcgacgccaagagattaccccactgaatcaaacgcaaccaactccaaacactcgcaagagcaaccgaattcgtcaacccaaccgacaaaaaaaaacaaacaaaaaaaaacatcaaatcagcaacaggttgctagagcgagagagagagtgaaaaaaaaaatgggatcgttgatgagcgttcacacaaaaaccacccactggatcagacccatttcacagcgaattccagcaggatcaacagctccacgaccgcaaaccaaagcaggagaattagagacgcaaaccgagttccccccccccccaaaaaaaaaaaaaagatccccagaaaaaacgcagcaaaaccaggcccaaatgcagggcgccaccgcaacaaccccactccatcatcaacacgcgcacatccgaaaccagcaaccaaatccctcccccccccccccaaacccaacccaatgcgagagcgagagcaccataccaagcagcggcgacttgaagtgcggcggccaccagcacacggagagcttggagcagcgagctcccatggacgcctccctcctagatctcgccctcacctcacagcagcagcaacggctctctctccccggcgtactactactaccaccaccaccacctcctccaccgccaccgtctcggctgcttagctagctactggtaggactcgaatagactaatactactactactactacgcgaggaggggtgggagagaggaggagggggaggggggtggagtggcgtgtgtggggtggggggtgggggtgtttgggttgtggatccaaggaaggtggtgggctttccgctccctgctttctgctgttcttcctcctctccctttctccacctcctcccctttatatattgctcctgttttttaaatccttcctcttgatctaatagcctttagctgtgggttttttcttctccttttattaatgcttttgaatttgacttaaacatggtaaaatgataaaaaaagtctgtaagaaatcatataaaatgcatgtcttgtaaaccagtataatggtgggtccggtatattagagttaaactatgaatgtgcacggtatgttttagtttgaaaccgtttttgttatatgtgcatcatatttttttttagtagagtatttatagttcatttatagctctagaactgctacggtgctacccgtgtttcaatttttatctacacacgactgtttacgttgtcacactttgattgtgtttttttaaccgtgcgtaatgcttttgaataacgtggtttctagttactggtttgccataaccatacaatggtttctcaaattttgctttacatgtgtagaagacgaccaagtaatatgataatcaaattgctgaggataatccctagcccaaatttagatacaaaagtaatactagcttataatatattatcttgacagacgataattctgattaaaaacaactagtatttgtttaggataaatgaggatgattcttggcccaatgtataaattgtttgctttacatagcagaggtaactgcaacttatctatttgaaaaaaaaaaagcagtccaatgatatctgtatatcaatgattactccaaaacaaaacaaacagttagttaggtaactaaattattgataggataacaaatactccagctcatagtcacttcagtcactactcactaaccttttccagtttttcagctagtaacgctaattttctgtttcagatagagtactttcagaaagaattcagaatagctcgtatctgctgaagcaacggcaggatgctacgtagcccaagcgtgataaccttgtataccactgacatgtggccccgctcgtttgacgtggccccacgtgcctttggtgtcaagatgcttcagctcatgttggttgtttttgcagaaaatatttgcgttattagttttgccaggtaattaatttactaataatttataatagtcattgacagtgggaccacctaacttacaattgtcactggttcgtgggaccaccagcagtttggagccagtcttgaacgggaccaccatttactaatatcaaatttaacactaattaaattggttagttgttcatactactaactaaatttcataattgttttaaaaaaaatcgaattggttgtcaaaaattgtccttgttgcaagcggtcatatcatcaaagtggagatagctgaataggctccatctttccccatcacaatttggacatgttcatgtcaacagtttatatacactgttctgtgagtattatgtgagcaggtaatctatccactgtttttgtagtagtagtttttttttttgggtaaggtgagaaacggcggcgagttgggcacatgctgcacagataaagatgcattacgaggaaggtcgctgttaaacaaaagttctcgtccttaattaacagataaacatcacatgctgccctgttaagcaacgatcgatttgaccaggagtaccaagcaaagactttagggaccaacgactcttgcattcacagcgcacagaagaaaatggttccagttttttcaaatgcatgtgttactgaacaacggagtacataaaaacatcatgaacagtgaatattagagaatgtgttattctatggcattatcgccctaggctacaaattattttttaaggaaattaggctacaaaggttaccttaggtagtggacggacaggcttaaagcaggaaagtagatgcataaatgttgactaaacaaacaatgattaaagctcttccaaagggaatccatcctccatcgatctaattgtgatcatataagaaaatatagtaaatattaaacagactgaaaatagtatttattactacctccgttccaaaatgtaagctaaaaatgcttacattttggaacggaggtaataagttacaagcatgtgcttacattttgggacggagataataagttacaagcatgtgcttatattttgggacggaggtaataggttacaagcatgcacctactagttaattcaaatgtaaagccggtaaagagaaagttcctctgaaacgcatggttttaaaaacacataaatagaaaaaatgaactatataggatgtctcaccttgtgaattcatacgggaatgtcgcaaaatagtcatttaattgaatgaaatgcgctcgtagcgcagtggcagggtcgctggcacgcaccccattggcccgggttcgatccttgtcgagcgcccttaccaggggaaatatttacctcttcgttcttaaaaccattgacaccaagtcctttcttggtgtccaacctttttcttttgtcatttaattgaataatgtgcatgaaaaaaataagcataaaaaatcatgaggtaaagacctcggatttgttttcctaccaactccctttagaatggcccattttataagattttcaaaggaaatataaagcattaatctttcgttcctaatctccataggaattttttcgtaaggattcagggtcattttggttgatgccgaaatatgccatactaaattactgtcactttaagtagtacattggctagcatttggtttgctagcaaaggataccaataacacataaattgaaaaaaaaaacattggtgctaccaaaagttaagttttgacattattaaaattttagcacggtaacaaaccaaacaagcccacaaatcctcctaacatcctctttttttttaagggagccatgtccagggtttacgattccgagatggccttccatttcgggctttggcggaatgacggctttcgtgaaatctggtgaaaagccggtagattccgaacaaattttataaaccaaaatttgaatacaaattctctgagtttaccgataagtttgcgaaaaccggtcggttttgacaaaattccgagtgaaatcatcgaaatttcaatcggtaactagaaaaagaggtaattaaattgaaagtgtttttctttttttttcattcgttattcttttcttttctactgtaaatttcagtaaatacacggaatacatcttttttttcgaaattttatgtcctaataggttctatgaatatcatattgtttataagattttattttatttttttgttttttatcaattcaaatttgatcatcgaaatctcaaacggcttctagtttcgagccttgtcaaaacctcgaaaattcgcagaattcgaccgatttccattggaattgtgaaccctggccctgtcacagcttggccctagttgggagaaaaccgggcatttagcttgcttgcctgtagaggggtaaatagcatgagtaaatatataggccaatttaactacatgatatgtatggtagatatctaaaaagctatcacgactgaaagacactataaaagcctgataatttgttggatgccactttcggctcaattggagagaaattttaaaaagacgagaatgcttatagggtcaaaagctttttagctgaagctacaatgaagatgaaaacatgctgtatactaacgatgtatttaggctgatgataaatttagagttgtatgatttctaaatctattatattattaaagtaatagaaaaaggagcctccacgttcgctctcatggcctagaaattctcacattaatcggagaaaaagaaaaggcagagtccatatagaaatacaatttagaaatagccgaaattcggaattaaaaaataaggaatattagaagaggatactagagtccatatagaaatacaattagaaaataactgaaattcagaattaaaaataaggaatattagaagtatagtatagagtccatatagaaatacaattaggaaataatagaaatttagaattaaaaataaggaatattagaagtagagtccatatagaaatacaattaagaaaaaaatagaaattcggaattaaaaaataaggaatattagaagtagagtatagagtccatataggaatttaaaactaactaaaatttggaataaacataataaaattaaaagtagattttttagagtccgtataaaaatacaatttacaaataactaaaattcgaaattaagaaaaacatggaaataagaatttaaagtcaatataggaatacaatttagaagtaactgaaattcgaaattaaaaattaaagaatattgaaagatgagtttagagtccacatagaaatacaattagaaataataaaaattcagaataaaaataaataatattggaagaagagcatagagtctatatagaaatacaatttacagaaaattcggaattaaaaaaaagaaatattaaaagacgagtctagagtccatatatgaatatatataatttacaaataactaaaatttgatattaaaaataattaataactaacacgtatataaaatacaatatgaatattacacattagtagttttgtaaagttattgcaaaatttaaaattatgatgtcattgtaatatatttaaataatataatgagaaaacatatatgctattatatgagagaaaatataatgatgctagccgcgcaatctgcgcgggcaccatgctagtttttataataatattatgtttgaagcatgtggtataaagggcgttctcgttttttttaagaatttatcgttctaattgagacaaaaatatccttcaacaaatcaccaattttttaactatcttttggttgtaacactttctcacgatgtctcaaattgtatagattttgggtgacccgcaacaaaatttgtcaaatataggagtatattgtgaagagcttcgtcttgcttgcacttgcagagagtttcaggcgtacgtacagtctgcaggtctgcattgcctccggcagcaacagaagccgaggaagcgaaagcagccatgggctgtcgcgtcgaggagccctacaaacaaaccgtgcgcccgcggcggcaggcggcggcagcggcagaggcccggccaacacgagcacgggccaccagccacagcaccagtacgtactactagtacaccaccaccaccctacccacccctgcacgaacggcgacacgcaccgcacggccgcacgcacgcaccgcgcgcggcggacaagcaaagcacaagcggcagcacagggccggccagcctcgtgagccctagccagtactagtactcctccagtagccagtagtagtatcatgtccgcccatgcacctccgcatctctgatcacctcgatctcaccatttgctcgagtgagccaggcagcagcgtcgcaccgcacactggacgtcggcacgctctgcaccacaagcagcaccagcagacagatcacacagatgggaaggccgacgtgcagattgtgttgtgtgagagagagctctttcttctccgtgcatgtgcctgaggagaaatcttttgcttgtcactgctgctgtgccacggccacgggagacgggaccgacgcgtatccggcttcaattccatcacgcactggtacgtgtggatggagtcgtcaatcaatatcaaatcaatcagttcgtgcgtgcgtgcttccatacatctcgtccgtcctgcctcacaggacaaacacactgcaatacggagtattcagctcacgaaaaaactgtggtttgctgctgtatgaagaacaaaattaaatacgcccacgtgtgtgtgaaatccgccgctgcagtagtgcagtactcccggccgcaccgcgtacagtacgtactacaggtacgctgcgtgtgtaagtatccatgaatatccgccattggatcctggcgctcgtacccaacgtaccagatgacacgtccctgtgctgctgcgaacatgtgattatgaagcaattccatttccacagtgattatgaaaataatcccattagaaacggaggagaagtccacatggcactgtggatttacgtctacggagtacttcagctagaggtgaggtgaggcggaaaaggagattcaccgaacgaaatgaatcaaccgaggaataacccggcttacgtgcgagcgttccttgcatgcgtgcactggattcggggattcggccgatccgcgagcacggcacgacttgtttcgtcgcgcgcgaggctggcggattcgcgggtcgattcgccggcgcgcacaggagtggagtggagagtaatgtgtcgatcgagtggcctcggaagttggggctacagatagaagagaggggtagcttgcagaaaaccaggacggatttatgcatgcagagcctccgtcacgtcgtcgatcggcaatgcaccattgatgcgaggtgaaggtcgggttggtggcaatcatggccctgtagcaatgggcgccgcagagatcagatggtcggagttgagtgacagatattctttctccgtcgatctctatccatgctgctgctgctgcctgcacgcatgcatacagtgttcgttcctactctcagctctcgtctcctcctgctcatgcatgatgcgcggctatatggctggagtagagtacctaggtatagcacggtgcacagctctagctttagctagcgacatgttggatcgaatctggcctgtttggtttgcagggacttactctctaagtctctttcatatcgaatgtttagaaactaatttaaagtattaaacatacactaattataaaacctatttcataaccttggactaatccgcgagatgaatcttttgagtctaattatgctatgattttgacaatgggatgctacattaaacttttgataattatagattaattaggcttaaaaaattcgtcttgcggattaactctcatttatggaattagtttttttattagtatatatttaatacttcaaattagcatccaaacatctgatgtgacatgggctaaaaagttttagccccatctaaacaccctagctcagctctgacatggaagatcttcccaacagttatcaacgccaacaacagatcgtattctgcgttgcgttgcgtgtgcatgctactcgatgggagtactatatactcctatattaaggctgtgttcagaggcaacatatcctatacacaccggccctcacgtgtacacacgtgcacatcaactaaaaaatgtcaccaaaaaatctagaaaaaatcatacacatactttcaattgtattacacctagggttaaaatcttaacgtcaaattcattatattttagccgtaacaaaaaaacaaaaaatctgacagttttaaggttgcaattttgtcagaattttatcttttttgttattctctatgtagaatgaatttgaagatgcgactttgcacgtagatgtaatactattgaaagtacatgtatgaattttcttagaattttttgtaataatttttagttggtgtacacgacgcgagggcctgtgtgcataggatacgctcccgtgtttagattagaggtgtaaagttttaatgtgttatagcagatatacgaacgcatatttgaaatattaaatatagactaataacaaaacaaattacagaatccgtctgtaaactgcgagatgaatttattaagcctagttaatccgtcattagcaaatatttactgtatcaccacattatcatatcatggagcaattaggcttaaaagattcggctcgcaatttacatgcagtctgtataattaattattatttttatttatatttaatactctatacatatgtctaaacattcgatgcgacagtgtaaaaattttaccaggagatctacacagggcctaaccccagctactgatctgatcagctaaacgaagttgatctccaggctgcttagattagactgttttgtgtttgtatccctctaaagtgcggaggaagtgattccattccgtggatagctaggccttgcgcgcaagcgacgcgaagccgcgaacgaactgaagccaacctggattaagttgagggcagctagaaagcgtcaaggcctgcagcccatcggagaggccagcatacagatgcttatcagattacgccgcctttgtttatgttatgcagatgtgctaatcaattgctccccaaaacaacgaaagcgaaagggagcgagcgagatgagatgctgcatgctcatgcttaattatatactcctactcctaacaagagagggaccatgtaggtacgtacgtacagctgacagttgtttgtacctgctggttgctggattcctttgaggcttaatcaaccagcagggggtgattaaaaataatctgaagtgtccaaagagaaaggaaagaaacaaacatcagtagctgcatagtagcatgtatagcaaggggtagtagaaaggaggagagggagaggcagaaaggagagggaggcaggggaaagcgcggtgtccccgtggcgtcgcgggcgcggggggcacggcggcagcagaacgtgtgcagcgtcgtccccacggccacatgctgtcgtgtcgtgtcgcctcgcatatcgccttcggtcgttcgttcgtcccccacacctccacttttcgatcgacctgcggctggcgcaggatgcagtacgaagcagtccagtccttcctatcctacctcggcgttctactagtgtcgatcaagcatcgaaatggtatactaatactactgcacatgcccatgggccatggcttgatggctagatgatgacatttttatctgcgttgctctcatccacctcagttttttggcgtttttggtgatataataagggcgaaaagcaccttggtatgtataatcggtaatcccagacacctgtgtgtttctttgaactcgacttgtcaattactatgtatctggctcacacctagtggattaacaggtgatgagtgagtggtacatcaaatgatactgcgagacatgtgctgatctagaaaaatcgaaaaaaacggaaggaagaaattaagaagcgagctagacatgacggctcggtgatgatcagggccaaatagcgagcaagaaagtgaaccggaggcataatgggccggcgggcacttagcctgctcggttgcaggccagtagtaacgggcccccgcggtacacgagaagaggcccaataaccatggtttgaccgtcatgggttgccttgcagagtaagttggtgatgaactgttgatcgccgctctctctctctatctcaaagaaaaggagaaagggttggtagaatggtagtggtcgctgatcgagtagttcgtactgtgcactgcatcggcatcgcctgctaccatttttgtcgtcgcgtgactggaaatagaagctggagggcaaaggctgcgcaaccgcgccgcgcggtgagaaagaacacctgtttggcaactgcgcggtgaaaaagaagaaaaagaagaagaagaagcccacatgtttctgttttgttttcttttacgtttgaacgacgctgcgtgtatgtgactggtgtgtgggctccaccacgtacgagctgttgctcgtcagtgggatgaccagccaatgcaacgcaaaagtagagagaggggtttgcgctgctacgacgtcgatctcgtgtatatcatgcaacgctcccctcctcttcttcgtgcaaggacgcaatagctagagccacttctccagagaacgagagagagagagagaaggcttaggttagaatggctcccgttctcctggtggtggtcggctcgtcggcggcggcgtgggccgacgtgcccgccggcagccgggtgcaggtcgtgcaggtagcctgcggcgcgaggcgtccggcgacgacgtcgatggcggtccgctgcgtcggccgcggtggcggcaagacgggtccggtccttggcaagccttccgacgacgacgacgacgacgtacgtgcatgtatggatctcctcctttcccctcctccttctttacaggttttcgcctgcacaaagacggtctatgaagtagtcgaagcgtgttcttttcgtgtcttttcttgtgttctgcttgtgctgttgtgcatgtcggctgtcgcgcgtttcctgcgtcagatcgaaccaagtatttgtttcttgggttcaggcgttaagcaggtgcgtttcttggggttctttcttgtttctccctgtgcatgacgcgttcctgagccagatcgaaccaagtatgtgtttcttgggttcaggcgttgagcaggtgcgtttcttggggttctttcttgtttctccctgtgcatgatgcgtttgctgcgtcagatcggaccaagtgtgtgtttcttgggctcaggcgttaagcaggtgcgattcttggggttctttctcgtttctgcttgtgcgtgttgcgttcttgcatcagaacgtacatcagacgtaccgtgcgcatgacattgttttgtttgcccctgtttgcgttcttgcacgagatcgtgctttgctatgctcttgtttctcgtttctgcttgctcgtgttgcgttcttgcaccaaatcgtgcatgtacgacgtacgcacgttgtttgcttcgctcctctattcctcttctcttgcctatcacgcaggaatctttgatcagttgatttcttgcacgtacacgtacttaccaccggtcagactcagatctgctcgtttaattttgacctgtttatcgacgatccatcacctccgtccttatttttccttgcaagttttgcctgtgcaaagtcggtctgaaaagcagaagcaggtgtgttcttttggagtatttctattttcagctttgctcgtccgcgtagcgtccctgcacgcaccagattcaaggaggtgtgtttcttggggatctttctttttgtttctgcaagtgtatggttcttgcaccaagtcgtgcatgtatgttgttttctttgctcctgttcatcgatatttgggcctttcgtttgctgcgaagcttgcagatttccttctctttttaccgaagctgtggttccttttttttttcagagaagaaattagaaatacaacggattccagttgttcttgtgagatattttttaggattttgtttgtgacgtcctattcgatcttctgatgcaccaaatctcttattaatttccaagctactgcttttgttactgttgaagcttcagtttttttccctttctgaaacggaagcttcagttttctggttgctttgaaactagtaataatagttttgatggctaatttggtctctgtttgcggcaaattgcagacgaagctggtcaagatcgccttcaggatggccgtggtgacggccgttttcttgaggagagttcaggcgaattccaactgcgccgacatgtctctgcaggtgtcgagcctgcaagaggagtgcgcccgtttcctggattcgttcgtggccggggaggagatcgcgggccacgacgcggtccgcatgctcgtcggctgccatgacaagctgaccgtggttctctccgcctacggcggcgccggccgggacgacgtcgacgagggacaggcgccgccggtcgtcgtcccgcccggaggacagatcgacacccacctcctcgacttgttcctcattgggacctccgagctaccaaccaactggtctgacagagtaaggacactgatcgatgatcgatctgttgtagtagtagcttttgttgttggttgagcattactacattacatgtatggattaacttactgaccgactgtctgtgtgcattgatcgatcgcttttgcttgtgaattgtgatagaccctcgttgcccagctgacgtgctctctgtaccgggcaattgaagcagtcaccaagttcatcgccaccacggagaagggggttcctctcgagcaagcagatgcagaggggaggtctcctccacctcctgaagaggaaggagggaaagcgtagatgttactcagtcagcagaaaggaggaaggagtactttttgggaggtcattagaactcagtcagcagtagtaatcatcctaagtacggagaagtagcatttagttcttctgatgttttggaaccttaccatgctgtttagtattcctaattaagtcctactgctactatcatgtagtaacgtgctatccgccgatggttatcaaataacatcatgtgaactttgcaacagctgcttctttttagtaagtaatagttcattcccttttgttaaatcttgatcttctttctctgtggctttgcttaaatttgctcgatttcgtttagaagaaatcagcccaactgattcttttcctaaatacgagagacagatgatcttatctctaagctattttcctggagacgaatcgaagcgaatcctagatcccacgatgatagttagggcacggcaacgatggtatttatagatagggcacgcacgaaacggaggagaccaaaccaaaccaaaccaaaccaaaccaaaccgaggtgaaattgaaccggcgctccctcgtcttccgtcgccatcgccgtcgcgtcgcacccaaggtatctgcttcaattcagccctgcttgctagctaccgcttcacgatctacacagatcgaactgaaacttgatgagatttgttcaatgttcatggctgacaggtgacgggtaatgggggcgtgctactactaccaacccctccggccgccgccgtgcccttccgttccttgcggccaaaaggcacagcggcaacctctctttcgcagcagccatcagagtctgcatgttgcatctaaggcggccgggctgaccagcagcagcagtagatcaaaagatgtgaagttgagggctatcttacatgaggacagtgttactggtgttagaccatggtttagcctgttcggaatgtccttttctgatctttatgatcacttccctgaatctgtctgggacatctgtgaggattcccctgccgaagcttttgagaagaaggtaatagaatttgttttctcctttacaaacttaagtgttcttaaccatcttcttgattcttgagtgcaaatttcattttcattatattgttactgtcagttttcttgtcaataactcaatactcatgtttcaagctaaagcaaagacttcccttttttttttaaaaaaaaagattaattgatcatgattgacaacaacacgggagatctctactgtatacaggtttaatttgtttttggccatatatagggtaattagggtacatttttctacttgcgcatctttactaattctaattctgaggatcaggagcataaggggtggatgcaatttcggagtgaaatgaacagcagatacaacaaagccgtggacataagttttgacgataggtttgctgattccattgtgtttgacaaaacactctacaagtatgcaattttgggttgcaaggtcaatgcggatgggattatgaatcaggtattctcagcatgtgcaatcactcatacttctcccttccgaaaatatactgtttagtcacccattaaatttatttacaccagatgccactgtcttcatgcctaatgatttagtattgaccaacgatttatgataatttgccaaaattgcttcctggatgtgctagtttagggcccgttgctataaatttctctcaagagcaaacaaaacacaagtttcttcgttaagaagaagagaaatgacataccatggtggtgaacaaaccaagcacttaaataacgatgttttttttttgaaaccctaaataacgatgttttgacaaccgcgtagataaaataatgcccctcaaccatggaagatcaatatattagtatacctctatatagtctcgtcaataggccttttatatatgagatatcttacgaaaacatctgttgttgtagggtgttatatctgccagtgaaagaaataaaattatccatgctcttgaaaggatagaaggtgacattgagattggaaagttcaagtggagagatggcgctgatattcatacaagcattgtggaagcacttgctgatatgattggggacaaagcgaaggatcttgcagtggaaagtaaatatgatagttgcctcatgatactggaaacatggtccaaaaactccattgatcatattatgactcaattgaaacaacttcaggtttgttttcttttatctttttagtttcatggtatactctaaaacgttgtttgggaagatatatatgcacttgattgtttaattatgaccctttttcctttgttcactcgctatattagattcatgttagttttagcatacattcgtagtatgtggttcaattaaagctgtatgatgattttctgttgcaggttgctctagttctgttagcaataaaaaatgatggggttatccttggtgagagagagattgagggcaccacatgcctggagagtcttcttctgcgcattgtcaaagtggtaattttccaacatggactcaagtatccttggcagcatagaaccttttcttttctcaaacacgcaagagaattgcgtatcatttcatcaaagaagcttaaaactgtctggtacgtagatgaacataataacaatacttacttatttgggagtcttgggactgcaccaaaaccatagagatgggaatgtgcaaccgaatgtacttcttaacataacaggccatatcacaatgaatctgtgtttgctgctcacataaatatttcattacctatttattgcccatttcgccttgtattgtatctaaaccagttttctgcccttttcattatatagctagactatgatgcttccaaacttcgttcctatcatggaagcatttcttgctcaaatgatggtgtcatgcttctgaggaccaggtttttgctgctactagtttatcatttttacgcccccaatttacatctccagctctcccaccctcttcaatattttgttcacttgcttctattaattatttatgtgaacaggggcatagttctgtatttttaatatgtacttctatactcttttgattgagccaattttatcttccatatatgtgtctctaaacaaagaaatgatatcataggcttgattaattattgcactttttgatgggagattaatctatctattaatttactaaagtaatagaaaaataagcctccacgttagctctcgcgacctagaaattctcatattaatcggagaaaaagaaaaacgtaatacatatacaaatactcctacaatttaaaatagctaaaaattcaaaactaaaaatataaggaatattggaagaggagactagagtcaataccaacatacagtttggaactaatgaaaattagaaattaaaaataagaaaaattaaaagtacaggttagagtatataggagtacaatttagaaataactaaaatccgatattaaaaataattaataactatcatgtatatacgaaatatgaatactacatattggtagtttggtaaagttagtacaaaatttaaaattatgttgtcattttaatatattttaattaaaaaatatatactattttatgatagaaaatatatggatgcttgccacgcaatctgcatgcaggctaccatgctagttattattatactaatggtagtaatcgtccttttttttggtgttgcgttctccacttttaatccgatgttacttcataggaactttgactattctaggggtttttgaaacgcaactatttctaggtgttataaatatttaactatgttgtgcttgttatgcttcataaacttgcccgccaagtgcaatctaagaagttacgcacttctaaattttaatatatagcaagtcatcatgactaatttctaaaaagagggaaaatgtcacattgtttggttcgtaatgtttgctttaaaatttttaaaaaggaaaacctatttttttaaatacttctaataccccatgagccctataatttttttgctcatcttttaccatctaaactatgcagctatccagaaaatcagatgttttccaagctttcttccatggcctcgtttgcagaatcaatcaacaattgcatccccaaccatctaaggcaactgcttgagaaggttttgtccaggaggaatatactgttactcacaccaaatggtgaaacaacgatatatgacacagtcctatccaagtttggttccattgaacagacaaggcatcatggagatgttgctatctcaaaatgtctaaatattggatttcgaaatgtacgtgaatcacctcagacatgtgaaatcgaggtaaaaatgatcttaaatttttgccgggtaaaaatgatcttaaattagcatattcgtaaagcgtgtcatcctacatcatggtatagattggttctaacaaagtgtgttttcttgggataggacgctaagcactatttattttctagcactaaatctgtggtcgaaattctcgatctatccatacaacttgttctaaggatcttgtttggcatggaaaaggcccaaaattccctcccaagaggatatcatgatgttatgaggtttacacatttcctgacaacgaaggtgagagttttgcttttttttttataggtaactccggtatttcattttatttttgccgtatgccttaattagctcgagttcatttgaatcaggcttatcattctttctcacaaaagaaagctaaacatgagtactccattatgatttggaggaataataacgtattagtctcagcctttccatgctctagcaaatggttaatatgttaatggtatttgcaatgagcagggaatcgatttgggcacagcttatgccttggtccatctgtgcttggataaaaagctccaaccttcggagctcattctagacaaacacgagctaaagcagatcgattttcactgtgagcgtgctcattacctcctggaatacaaagggagcatctttggtgattccaccgatctggatgcctgcaagaagatgctgaaatggtgttgcaaacttcgcattgatcctgctgcgaccatctcttcttgattcccacgattcaatgcactcaatagagaattagggatattgtgctatctcgaactcatgtttaattagcaacgaatttggtagtcatcacgtttaattagcaaatgtattctcatatatcaagattgagttagggtcctattatagtctaatggacttgaaagtgcatgaacctgtattcgttgttatggcattagattatgaatgtgcaagttgccagtcacatgataatcttgatccctgtgaagatcatccaatacagcaataattaagtgcacaaaagtaacttaaaatctctgcgccccatcatttcgcttattcgtggaatttaaaaataatctgtgaaaaacttttatatacatattcttagcgatctaaaagcaaaggctaaaaaataaacttcgatgaaaaaaaacccaaaatcaactacaaatttaaggttgaaaaattcaaattttagctgataagcataaacaaaaagatgaggttgctacaacatgtactatttttaaaaagctgaaacacaaccaaatcacctcgtgaaacatttttctataacgtatgaaacaacagttttaaaaaaaaatgggcgtcatttcaccctatataaaaacaatgtttcaacaaatagtgaacgaatgttttaattcactgcaacatttgatccatacatagtaaaacatcacgagtatactttactaaaacattgttggtggaacaaaaaaaataaaacggatttccttaatagaaatgttttcgcaatatacgggtgctttgttgcaacgacgcgtgtggtggggcgcgtggaaggggggggggggacaacgtgggaggcggcgggcacccgacttttttgccgctgattgggcacccgatcgcttgcattttccaaataatatagcttgatcagtttttagagagataacagagaaaatagctacaaattgcaaaaattgaaattaactataaaatcacagcttgattaaaaacctataaaggcagaggttacaacgggcggcacggcccaggcccggccgtgcctgggccgagggtagtcgggccggcacagcccgacctacacaccgggccgtgccgtgccagcccacgggccatacacacggcccaggcacggcccaagatggctcgggccgtgccgggccggcccaaaggcacgacggcccatcgtgcttttccacagaataaatctaatttttctccctcctcttgggctgtgacatatatatagctaaaaaaaagtctattcccccctcttctttgagctgacatataaattgctgaataagtctatttttaggccctatattttggaccgtgacattaatatgtctatttttagtccctatactttgtgtaccgggcctggcctgccggcccatcgtgccgagtcagcccagcgtaccggtggggaggtccaggcacgggcccaacccaagtcgggccgtaccgtgcttgggccgggccgtggtccgggcctcgggccttatggccatccatacctccgtgaaacaaattgaagaggaagctcatcaagatagtaatcaggcttagatgacggcccgtctgctggagagagttcatgcgaggccgctcgggtgcaccgacagcgacaagctggagatgtctctgcagctgacgagcgtgcgcgagcagtgcgcccgtctcctggaggcggtggaggcaggggagatcgccggccacgccgccgcggcccgcctcttcggcagctaccactccaagctgcgcgtgcttctcgccgtccacggcggcggccacctcgacgccgccgccgctcgccgtcccgccgcccggtggacagatcgatcgccgcctcctcgccaagttcggcatctacgccttcgagctgccaaccaactgggttgacaaggtgatgatccattaattaacttttgcttggtggtggagcaaattttctttatgaattctttttttttgaaacgaacttttttctttatgaattcactaattaccttactaacaagtgcgcaaatttgctttgattgtgatgatagtccctcattgcgtccatgatgcgcaccctggagtacgcgatggatgaagcaaaggatttcatgagcgtcacagatgagcaggatgaggcagaggaaggggacgatggtgatgatggaaaggcgtagctgtcagcaagttcttaaccaactggaaggcaattagggctcagtcaagagtagtactagttcttttaagtgtttttggcgcgcattacacctaatctagcttaagatgcttctgctgctgctactactactactatgttatctatctagtactagtactacctgctactactaccatgtaacgcctatgggctatcttgtgaactttgcagcagctatcttgtcttaactatggcttgatctttttcacctgtcttgcttattaaacctgctcaatttcgtctagaaatcagccggttgattttgttcctaaataagttatgatctccccctgtctcgcgtaaattcgctcaaatttgtttagaaatcagcccgactgattttgttcccaagtaaacgagagacggatatatatgatcatgatcttatctaccccttgctattttcctggagatgaatcgatgcgaatcctaggttggttggtcacggcagtatttatagatactgcacgaaacggaggagaccaccaaccaaaccgaaccgaaatagaagcggtttaggtgaattggaagcggccgcgccggcgatctctcgtcttccgccgccgccgccgcggcgtggtaccaaaggtagtatcttctttaattccgccatgcttgctagtagctactagatctacatacatactgagattgaagtgaaacctgagattgttcttgaattgcaactcgagattgttcaattttgatgacctgtttgttgacagttcgaccgtaatgagggcgtgctgctactatcaacctctccggccaccgtgcccttccattcctcttggccataagccccagcagcatcatctctttctcagcagcagatcaaaagatgtcaagttgaggtctatcttagatgaggacaggcttactggtgctagaccatggtatagcctgttcggaatgttcttgagtacggattaattatcttgtcattatattgctaatcatgtttcaaggtacagtaatgacttcttctttgattgatcttgactgacaacagtacggtagatctgtcctgtatataggtttagggcttgttcactttaatgttattttcaaccttaccaagttttggtgaagttgccaaaaaattggctacatttagtttgttgccaaattttagtaactatataagaaattctgctaaaattttggcaagttatcaaaattttggcaactatgtcaaaatttaatttggtaaggtttattttggcatcaaagtgaacatgcccttaattgtttttgcccatataaagggaaattaggatacttttttctagttatatatatgcactaataattctagctctaaagatcaggagcataaggggtggatgcaacttcggaacgcaatgaacaacagatacatcagagccttggacacaaattttgacgagagctttgttgattccattgtgtttgacaaaacactatacaagtatgcaattttgggttgcaaggtcaatgcagatggaattatgaacgaggtattctcaccatgttcaatcactcatacttcctttcgagaatatcctgttcagtcaaccattacatatcttaacaccagttgcctttgaatccagcatcttcataccttatccttcaagctaatattttagtattcatcaaggatttatgacaatttgccaaaactgcgtcctgtatgttctagtttagggttatttactacattttctctaaagagcaaacaaaagcacttccgttaagaagagagaaatactataacatggcggcgaacaaaccaggaacctagataaaaacatctcgacatcccctcagataaaactaaatgaaatcaactgcaactaatgccgttatatgaaatttttctatatgaaaccagacttctagataaaaaaatctctatatgaaatttcttataaaaaacatccaatggtgtagggtattatatcttccagtgaaagaaataaaattatccatgctcttgaaaggatagaagatgacattgagattggaaagttcaagtggagagatggtgcagatgttcatacaagtattgtggaagcacttgctgatatgattggggaccaagcaaagggtcttgccgtagaaagcaaatgtgacagttgcctcatgatactggaaacatggtccaagaactccattgatcatattatgactcaattgaaacaacttcaggttccttttctgctttttttttgtaagttctcaagatatattcttactattcagcattttttatagttttgatggtatattgtgttgttcgggaagatatatactcaagcatttcattgtttaattatgacccttttcctttgttcactctttaacatcggattattgttaattctagcatacattaattcgtagtatgtggttcagttaaagttgcatgaaaattctctgttgcaggctgctctcgttttgttagcaataaaaaatgatgggtttgttcttcctggtgagaaagaaattgagggcaccagtcttcttatgcgcattgtcaaagcggtaattttctatattctaccactgaaccaaaacatacttatgaacatagccagccatatcacaataaatctgtatttgcttaatggtttactatccatataatattacattacccattgccttgtgctgtatctaataccagttttctgtccttttaattatacagctagacagtgatgcttcaaaacttcgtaactgtcttggaggcatttgctctaccgatggtgtcatatttatgaggctcaggtttttgctgatacttgtccactatttttagtttttttttcaccctcaatctcctgatcatctagccctccatgtctccaccctcttctgtatttttctcttggcttattgactatttgtgtaaaacggaatgtgtttttgtattttgaatatgtacttgtatacgcttttgattgagccaattttatcttgcataatattgtgtgtataaacaaagaaatgatacccaagctttgtttaattgttatactagctagtcacagaatacttgttatagtcctttttctggtgttaaattctccatacttttaattcaacattttattgctaagtgaaagctaagaagttacacctaaatcctacttcctccgtttcacagtgtaagactttctatcattgcccatattcatttagatgttaatgaatctagacatagtatgtgtttaaattcattaacatctatatgtatataagcaatgctagaaagtcttacaatatgaaacagagggaatatcttactataaagttatccccactaactccttaagcttaacatgcaaagatgtcacatcattatccactaacaagatgccacatcatcatccattaattaacaagatgtcacatcattatccactaacaatcatcacatttaaacatcatgcaaacatgctatatctttatagtttttatgatttaagagcttttcaaatacaaacatgttaaattatcattcaacataattcacataatgtttcaatgtatatcttcatgcaaagatgccacatcatcatccactaattaacaagataccacatcatcatccactaacaatcatcacatttaaacatcatgcaaacatgctatatctttatagtttttataatttaagagcttttcaaacataaacatgttaaattatcatccaacataattcacataatgtttcaatgtatatcttcatactaaattcccgcagcaatgggcggggtttcacctagtttaacaaatagcaagtcatcatgactatttttcagaaagtggcagaatggtccatttttcggttagcagttttgctttaaaatttttgggaaggataacctgaaatacttcaatatatcttgccccgtaagtctgataaatgctaagtttttttccccatctaaatgatgcagttctcctgaagattacacactttccaagctttcttacattgcctggtttgcaaattcaatcaattatcgtattcccaaccttctaaggcaactgcttgagaaggttttgtccctgagaaacgctgaaacagccatatatgagacaaccctaggaaagttgagttctatcgaacagatgaggcgtcatggagatgttgctatctcaaaatgtctaaatcttagatttggaaaagcatgcggatcagtgcagacttgtgaaatcgaggtaaaaatggtcctatattctttcttacagtgcgtcatggtatagtttttggttctaacaaagtgcgttttccttgataggatgctaagcaccatttattttctagcactaaatcagtggttgaaattctcgacctatctatacaacttgttaaaagcatctcgtttgatatggaaaaggcccaaaattgcctccccagaggctatgatgatattatgaggtttgcgcatttcctgacaacaaaggtgagtaactcctgtatttcgttaaatcaggttttgtcgttctttcccctcttgaaaaagaaaaatcttttctcaatgaaagaaagatcacgctcttatcattcaaaaagaaaattcttttctcaatgaaagaaagatcacgctcttatcagtcaacaagtataggataaaaaggtgtttatatgatcactccagaatgatttggataatctcagctttttcatgctttggcaaatggttaatatgttaatggtatttgcaataagcagggaatcgattcggtaacagcttatgccttggtccatctgtgcttggataaacagctccaaccttcggagctcactctagaaaaacgcgagctaaagcagatcgattttcactgtgagcgtgctcattatctcctggaatacaaagggggcatctttggtgattccactgatctggatgcctgcaagcagatgctgaaatggtgtagcaaacttcggattgatcctgctgcaaccatctgttcttgattcccatgattcaatgcactcatagagaattagggatattgtgctatcttgaactgccaaaacaactactacgtaggaatttggtagtcatgtttacattagcaacttggtagtcatgtttaaattagcaactaggaattctcttatgacttgaagtgcatcagcctgtgtattctttgttatggcgttagattctgtaacatgcaatttgccagtcacatgatagccttgaacttaatttctagttgtacggtttgttctggcgatcaagcagcccacagtatgtcaagcatccaagcacatgataacctttgatcccttcgtaagttatcgtctgctgcagcaataattaagcaaatgaaagcaacttgtagcttaatttcctctgtttcacaatgtaagactttctagcattgtccatatttatttagatgttaataaatctagatatatgtatgtgtttagattcattaacaactatatgtatgtggacgatgctagaaagtcttgcattgtgaaatgtatgtggacaatgctagaaagttttgcattgtgaaattgagggagtactactctaaattacagggacagcatgtgagtgaccattttgacgatggccgtctccgacgagccggccttgccggtgcactccgccgccgccttcttcagctcgcgcgcccgcgccctcatctcgccgccgtcgctctccgccatgagccgccggatggcctcctccaccgcccccctctcgagctcgccgccgaccacctcgaacccggccttccacacgtgctccacgtacctcgcgttccccatctggtcgccgaagcttggccggcacagcatcggcaccccctcggcgaggctctccgtcgtcgagttccacccgttgtgagtccagaacccgcccacggcgcggtggcgcagcacctcctcctgcggcgcccacgccaccaccaccccgcgccgccgcgtcgccgcctcgaacccctccggcagcagccgcgttggctcgcccggcgccgcgcgccggccgcggacgaggcctggccggaccacccagaggaatggcacgccgctgccggcgatcccccacgccgtctcgacgagctcccgcgcgcccatgctcgccaggctaccgaagctcacgtacagcaccgactccgccgtctgcgcgtccagccacgcgaggcagctccggtcctgatgcagcaagctgccatcggcggcgggggagaacctgtggagcggcccgatgtcgaacaccggcacggcgaggtctcgccggagcttggccagctcgtgcgcctcgagcgcgtcgaacgtgttgagtatgagccccgacgagagcttcaccgccgccacggcgcgggccagcagctcgcacatcagctcgtggccgtcccttccgatgtgcatcaggtcgcgcacgcggtacggcggcagctcgctcaccggcatgtcgagctgcgactctgcaaccaaaccatgtcggattaatcgatcgatgagaagcaaatcagttgatagatcgattggattatggcatgccttgcaccgggaggtagcctctgtcgcagaggagtgggtaggcgaggaagctggcaaagcaggcggcgctgccggtgcggagcacgagggtgggcacggcgagccgcctggccacctcgaccatgcgcaggaggtgcgcgtcggcgacgaggcacgcgacagcgtccctggaatactcggccaggacggcggcgaggcggtcccggaacgcggcctcgcacgcggcgttgagcgcgcggatgtgcttgacgacgtcgccgacggagacgggcggcgggcggccggacatgccgtcggggacggcgacgaagcggtgctccgggtggcgcgcggcgtccggggcgttgaagtgggtgtggaagacggtgacggcgaagccgcgggcgcggaggacgccggcgagccggagcatggggttgatgtggccctggtacgggagcgggaacaggaggacgtggcgccggcgtccgccatggccggccgcggccgcgccgccctccactgctggcgaaggtggtggcgtcatggtttggctgggtgcaacttgcaagcaaatgcaaggacgtttcagtgatctaagggacctctgtgccgttgtgcgtatggacgtgccgggttttgtacccatctcttctttgctagtactaattacttctatttttttggctttttctttcatagatgatatcatatatcaatagaaagacatcgagattatgccaacaagttctgaaattcacttcagtcacctacaacaacactaaaccaacagccgttaaatatgcaaatgaggtcattttaggtctatgagtattcgatgaaaagctcttatagttatctttccaaattttctgacctcatatccatatttcatccgagtcaacggaaatcgtacaaataaggtgccacatcgtctagaatggtttttcaggcttgtaactaggtggagcacaaccctagacatccttaggctgtcctcccacctccgtaaatagctaggtatatattctttcagagatttgggggttttgttagatcgaaagttagctaatgctacttcgattgtaattccatgtattggctagaccgcctaattacttgtcttcaaaaccccacctttgtgactaattcatattgtttgtttatatttttgttagttatctgttgcttacgggaacaaatgccttatggttggtcgcacttcgtcaggattatgactcacgagcaaccttgaaattagtgtaacgattgctgaggcacatcgtccctggacagttatagtcgggtggccaacttcttccccatgcatgcaattgacttatcccctcttattgaaagatcgaaatacctgagaacacatcaaatcgtttcacctatagttgattatgggacgcaacatttattagcaactaaaaataatttatgagtaaaactgttacatgtgttaaggaaaacattgaatcgtttgacctatagctgattaagggacgcaacatttattagtaactaaaaacattttagttatggatagattcttttatgtattcttaacaactttagtcaatgctgaaaaataaactaaagaaaacccatcaaaatctattcattaaatttaattcttagttttgagggttataggacggatcgcaggctcgcagcacctggtacacctctaacatgcaaccgttgtttttggatatttttgagtttcatttatggattttgccttgtactgggatatcttggagaatggaaacttattttttttaattaatagctgcccatttaattgatgccttgaaaagatatcttcttcaacagtttccctttagaaaatgttggtatattcccagattgttgtagaaagatttaaaataatttaaattttaatttggtaagcattggtgaaggctacaagaatcaagttgcctctagccctctacacgtgaagaaataataatcaaaaattaaatttaagacaaaaataaaaaataattatttacattcatttttttaaaaaataaagtagtataaaaaagcaccgggtccttgatgaacaggggaattaccgaattagggaggggtgataagacgaagcaaatgatcatgggcccatttgtcatgggccgagccgctggttggcccaccaagcaagcggcgctgctgcctctctcttccatcagaagcccacctcccatggagcccgtggcttcccgtctcatcagagaagactactcgtctgctccggcatcccggcgacgagagagagagagaggggagaaggctgcgcggcggagatggcggtggcggacgtggcgttcaaggcgctgacggcggggctcggggtggcgacgctctacctcgccggaaccttctccgtcaacgtctaccgcggcctctcgtggcactcggagcaatccgtaagcaaaaccctcgcccgcctcgaccaccaaacccttgacttctccccgccgctcgctggggagccgctgattcggggtccttctccgacgatctggtgctactcgctgcatctcccatgtcgaatctccccccttcctttgggcctaggacgagggtttgggtggatatccttcgacctttgttctgttgttttttttttgcatcgacccatgcctgccaaattggaacatgtttggccctttgacttgatgcgagcacatatatttttgcgtgatgctgctgtactgtgcaggagctatcggtgatttcgtgttgctatctaactgctgctgcttatttcactttgattaagttatcattggctaattagctttgtagacgccaagctagtgttgatgtgaattatagtagtgtaatgcagccacttcttgttttgttgtgttgtgcttggaaaggtagtcatggttttaggttacaaacctgttggatgctcaaatacaacaaaacgagtgatatagcattttcgtggtagttctgaattttgacatgtttaaatagaaatggttcataaaactattcatcggcttcaatgtggctgatgaggtactgcgtgcaaaaatgatggtaaaggttaatcattccatcagttttgtgaaaggattgttggcttttggtgaatctaagtcaaacgaaaaatggatcctacaacttttggcatgaatattgcatcccagaacaaccaaatcagttttcctcatcaagaaacttagtgcataagtccatttttatttcagtaaatcatccagtcaactgttgtctgataggaaatcgttgtgatgttaaacccaatggatgctagacttaatctgctgatgttaattcagataacatggaatctggttaatgatttcagataacgaggtaagcatggaatctgggtaatgattttgtggtttatatcactgcttcaattaatcatggtgtgtggttgaaatatgttttgaaatgaactatatggtatcagcttcttgttatctacagtttgaggcggtttccctctttatcttgcaatacgttgttgtggagcttctgagtcgcatgctgacatgttcatttgtgattttcagaagttagaaaaggagaaacgtgaagactgaaaagcatcagaagctagtctagaatgtcagacacaacaaaagaaaacctaaagataaacactcaccttgtgagatgagttgtctttagactagttatgtttcctgggattgtttttgcagacctttcaagatctccagaatgctattttgatttgatgtaagatgcaaagatctcatgattattattcctctttatgcttacgaaaatatttcgaccaacatatgggtgtcattgatgccattttatatgccacagtttccatttaaggttgtgtaggaaattttgtcattgttccttttctctcttgtttgtgtctcgccgttttatttaccgatctgatgaactccagcaggaatgatcatccgcccaaatcaactttccaggggtaacacgtccaaacaaatgcctgatatcctggtgatctcactgaaatcaaataaatcttgcttagttcgtgtacgagtcagaccatgagagtctcgttcatcaaaccatactcattcagatattaaactgggccaagtctcttcttcttcaatgaaaacagttgctcccagtcctctttgaggtttacctaaaaaaagtgtagaacacaagcaaccgtacccaaagctttctctgcagttcatatatagatggtacaattgtgttcttgcccttgctcatgaaagtgtacttacacaccaaatacactgtacgagaacccactggcaagtcagaaaatcagtaattcacgcaactcaaaactgtagatataacaaattgaagttcctctatcacgagttgtgtctgatacagttaagcgcctagcggttttttccctatgtagtgagcagcagataaacaaggcctttcagatactcaactatctcagatccaccaagttttgaagttccaaaaaccctatcgacaaaagttattggaacctgaaaaatataaatcacaattttcagcattcaaagaagcagcatgccaacaatactaccatatagccaggtacaaaaaaaaaacaatacaatcatacaaagagaaatgggaatacataatctacctcttcaatgtgataacctttcctggtagccctaacaatcatttccatttggaaaacatatcccttgctgacacacgaggagattaaatcttctaggacattccgtttatatagcctaggaaatcaggtcgcaatgttgcatcaatttaatagtagttatgtggagcttactctattgtaggaaaaggagacacacctgaatgatccagtcaaatcagaagctccaggctgtagtaatgtttgtgctagaacatttgctcccctgctagtcaacttgcgcatgagattccaaccatggacaccaccgttctgaacataacgggtgccagttacaacatcagcaccagtttccttttgcttcctggtgatgcaaagaggacaattaacccaaagggcaaaggttcttctaagttacttcttatcagtgtagtagccttggtaagagtccaactgtaatggactttgctctaaagtttcagatatttctaacatctgacacaaacaatctttcagcaacactaaagtatttaatacctatacggctataccaattccatttagagttgacaaaagcatattgatgaggaaaatgagctatagcagactatttttgcaaagaaaattctggattgaatacatcttcaaagataagatgcttacctaatgaagcttggcaagtacttcggctgttcagagtaggaaaaaaggcgtcaaccaaaaaggaagaaaacaccagcttaagcatgccaaatatcagatagaagaaaaactgaggaattacatacatggtgagataggtcagcatccatgataacaacgaagtccccagaggcatgctttagtccatgtaaatatgcagtacctgcaccatttccagttgttagttaactcaaatgtgaagactaaattcaccttagacttgaatggaggataggagctcaccaagtcctagcttcctcggtctagctcgcagcagctggtctcatgtcagatcaaacacatatcaggaagccatgataccaagacaaatcatatatatataaagacctagacaaaagggagcactatacaaaaatacttacaacacggttttcaccatatatttgctgcaactgctttacaatgtcttgagttccatcagggcttccatcatccacaactatgatttcaaagttgacatccctgatgaggaaatctaaagtttgagatactataactcgaaagagttcacaaaataaataaaactgccttgtcataaagagacacagggacagggctgcagaacacacgggcataatgagttgaatactgatggaacgctagcagtataaatcgatgatgaaatatatactgtagactgaacataagcatgctgtctggtggcattcttaaataatcactcaattcaaagagttggatggatttctatctgcccatttgacacaagcaacatgcaaagtaacattcttcgcagcattctattagcacaattgagcaagttagctgcactcaggagcaccgatgaagggtgtctaggagagcatagctaaaatctgaaagtgatcaaatcatcacatcgtctcaattgcactggatcaataagtaatcgtcttctatactttccatatgttcttgtgaaatcacaagaggcgcgaattgaatctaaaagaatggctaatccggatctgacaacaaccttctccgatccactgaagagcaacagatcaacagtagatggggggatagagatgggagagatggggggagttacggcaggtgcttgaagatgaggtagacgatgagggcgacgttgaggcgctcgttgtaggtgggcacgatgatgctgtactcgcgcctgccgccgcccgcgtcgtccgccatcgccggcgccccgactcgacctcgcaccagatctctccgccccccgctctctcccgcacgcgatccgacgcgggcgctcggtgacggtgaggccacttagctggggatgaggatgacgcgcgcgcgccgcagatgccgccggcgacgacgagcagggcggccggcgtgaagtctcgtcgaggagttgcttcgccaccgcaaggtccattgagatgtatagggccgcagcgtgggccgtatccagaccatggacgtgtttccatgggccgtgtctagcccatgacaagcaaacgctttgtatgcgcctgtagaagagaaacggtatggtttggcaaagaccaaccatgcaatccaatggagaatggacaggccaatcacaggaagcaccgcatttcgtgccaactccagtctagaccgtttcagtttacataagcaagcattcccattcaaacggtcatcatcgtcatctatatctatactaatataaaaagcacgagttcatcaaatacctatctttactgacctttaaatatattcatccaacgatttatatcaaaagttagatcaacctctgcaattagccatccccacgttcgattagcagcggttatagcgatatagcgatcgatcacgagaaagaagcagaaaagaaaaaaaaaacttctctcccgtgcgctagcccgtcgccgcctcccggagccgctcgctgcctccttgcacgcgcccgccggaccgccgggcgccgccgccaactccgagcgcgcacccgccgcagccgcgccccctaccccgccacctcctcgcgcgtgcccgacgctcgccctaccccgccgctgccgcctcctcgcggccgccggtgagtcaggttcgccgtcggctggcgccttctccaccaccgccgccgcctcctcgcgcgtggcctctggagttttgggatcgccgtcggccggctcctcctcgcgtgcgcccgccggggagctgtggtgggttacggcactacgcagtacagactccaggttaaggtgatgtcctctcttcctaaatcctcaaacaataaagattttgtgcttttattattttggggtcataaaattgtttacctagggtttgggcagggttgcttatgatacggggccccaaatgtttagtcagttggttctctcgtctcgctatgttatttgctcttgtttaggagataattttacttgctatgaattctgcttgctaagcatctcacaagtatcatatcagtcatgcttcctcaggaaatgtctaaaaacatggtggactgccgatcacacaaattaattctacaaagcaattatcagttaattacctaaggacttggctgactgccgattaccgattatagtgtaaacggtaagcatcagttgtggcagtgcacataattgaataaacaaaatgcccaatacccctaattaatctgaaagcaatccatcaatttaataaattaagttgtgggatgcagattgcaattagtgtttggccgtcaggcatctggcattaattagcattcggccatcaggcgtcttgcattctggttgcttgctttgcctatttgattgggttggatcaggtgtccaatgtgatttggtccgggggtcccacactaaaattatacatagcctataggttccacaatgttgttaaccaaagcactcgcccttcccatattcaagtggatccccattgatctaggttggcaaatcttactacactatttcgttacctcgtaagtattaagttcttttatggaacatatttttagatttaattccaatgataggcttgaagatattttgcacttttttacttattggagttgatgtgatggagctaacatcagctggaagtcaccttgaaaatggcacattttgtgtcttgcccattaactgtcaagtatggcacaattattagtgtgttttcccctttctgcggtgcagggagacgcatattacatatgtatccctcttctctggatcaaagagtgcagaggtccttcaattgcattctaaggggatagggttcataattgaattgtttagtgatgtttgcaatctcacaaactcaaatgtcgttagcctctcttgaagacaagaaccattagtctcataaattatcaggtttggattttagcagttttaggttagattataattccagattaaagtgaaaatgatgaaagttatacattaaagattttgagtgaaaacattaccagattttttttctccaatggaatgttaattgttaagtgcaatatatattcttaattaaagttgtgtgcatagatgacctgccaacaatactatcccgtattgttcagtctattgatgattgaactggatgtcaactccatgtcctcattgtcttgccaggcacagggaggcaacaatccaatacaggagagatgggatgggatcctagctcaagggagccctagcggcagctacggtcgggaggacctaagccctacaggcaagttctataatcaacccccttttgcttaccggcgataagtcaaccaacttccagtgatgcaggtactgatcctctcctccctccctctccctccctctttatcatgacattagctgattgatcaccagctttttattccgattgctccagtgaactttgttcacaaaatagtgtttttttcattttctgatgcttgtgcctatcgtgtgactcctccaccgacatgtacattgatatctgcccaactgattgatgaaatgatcgtttacatttttttttgttcaatcaatagtttctgatcagcttggagtggtccgtgccatgttgctgtgataatgctacaggttaatcctcctggctctctgtactgaaacaatttctccggatctctttcccttttgttttggaccttatacaacctgctgttggctaataatgacattcatgaataatagatcatgttaaagctgtttgcatggtctgctgttgtcaaatagttttatgcagtcacaactcttattaaatgatcaggttgacttcaagcattgggctaaaaactaagattatgtaagttaaataacatatatgccgtcatcttcaatttaagtgatattgtgtcaatcttctgatcaactgtttacatcttcggattatatagattcatgtcacatgtgtatgtcttcggaattatctatgtttatgttactgtgtatgtcttcagatttatatatatttaggttacctgtgtatatcttgagatatttcgtaattgcatattattacagatggcaaagatgtttaattctatttttttattggatatccctcagcgatatgccctgcccggccttgtcagctaatatgcaatatcagttttatgcccttgacatggcatacattcctccaggctgcactcacttacgcttttactgtagattgataggttaatgttccattgtcaaggtgaaccaatcagctaatgatggttcatatagttataatttgagtgcaactatgtatccactatgatgtagaattgtgggtatttatagatgcaatttaaaaggtatgccacttaggaatcgacactcaggcacatgcacctaggcttgatgggtaagtctggccaatttacatatggggaacacaaattaatttaatcagttattccaatttattcttctttgtttctatgcactgcaatgccaatttgagtgcgtatcttgtcatgctattcagcataatgtcttggcaggctatgcatatgttcatgcttatatatgcagcattcatataagtaaggattaattggattgcttgctttgtctaatgcagcctcaccatttaatttgtggcgagcaccttaattccatcttgccattatcgagggagtatatcatatgcacctaattctgtatatagagtatttattgactagggtcttggaaatttttgaattgctgtcagatgtaagttcctcagattgatgatttgattactttcacagctaataccattgatcacagctaaacaccacttatagaagtttaatggatttttatctaaaaaagggaaaaaaggaaattaataactgaaactgcatagtagtactatgatctctgaacaaagaaatttgctgagtttcctagcagctgctgggtgcattttcctcttgttatgtgtgcctaaccttgcatccattaaatttcaaaagtgcaaatagagaactattgcatgcattccttttatatcaaagattgggatgaaatttccagcttaatcctgacagccgcaatgtgtcttgagcaaaaggaagcaaggctgcaactgaaacacggtgaatagtaaataaaaatctcgcttttaggaaaaaaaaggtgagtcgtgcacaagtgctgtaatctggttttggcaaatttttatcaagatatacaactccgttgctttgtttacacaataaacctgaactctaggtgtagcagcttgaagcattaaaaaagaagatggcagcaaacagatgtttgctttattggatttaatacttggatattccactgtgcttcccaaattgagctgaataaatagcttgacgaattgttctcttaacatgtctcagttgtcctttgtatcaaatgagcagcataatccattcatggattgttcttttccactggtgatacagatagttacttctaatgtttcatggaaaagttcgagctacaaaaatttcttaagcaagcttacggattgtttctgatgagtttagcaactctatggaaacaagcataagtgcttctcatctgaccagttccaagagagaagtagccaagtaggtagaacaatcccaaaactgcaaacttcttttactgtatatatatatatactttcctttttagcattttctgtaaagtcccagttctgtattgcaattggcatggttgtgttcatcagaatattgaatgtcaaatcgaaaggaggcgccaacctatagctatcaacgacatggacaccatggttcagattcataaatttggggatcatggatgtctaggttcagaaatttttggattttaggcaacaaattttgtagaatttccaatttagaaaaacacattttgcattttgttataatgtaataaaataccaatttacgtttatttgatgaattatcaaagcaacgcttacaatacttttatttttatcggtgcatgtgagctacaatgtatttatatatatcgctgtgcatcaacaatggatgtgtcgttctccagtatacttcgcttagtatatatatcgatgtgccttgcacatgcacgctcactagttaagggtaaagattgacatgagtgtgggagaaaacaatcaaactgctggaagcaaaattttggcagaccatggtggggctgcgaagtttgtgtaaagttcaaagaaacctattagccttttgacaagctagtccggatcaccatgttgttcttcccacgacgatcacgcttaattatcctttggttttgttcagaccatgctgcaaaaacttggaacgatattgctccacaagcgatttatccacacctccttccccagccggctctttctttgtctttggagcctttcctctcctttgctccgaatgactatcttttctgttcttcctcttcgtcggggtgcctgcctgattatgtttacttgacagagtttgctgcaaaagaaaaggtcagtgttaaacaactactttgcttcatcgaaatcaataattttgtagtgccaaaaaaaccaaaagtccaatattacttacattcccatcagcagttggtggtgttgcatcttgtctatctccatccgacgtcttgtttggcttccgtgctctttttgcaggcctttgagcctttcttttatcttcaaccatactctccataatgccactgccaccatctccagctgccgaaagatcctctgcagaccctttaccagagttcgataacttagatgatctatcatgtgtttttctcttgtgccctttgttgaaagcccttgtgttattcgcctgagggccatcagttgcagaatgatctcctagaggtcttgccttatcttgtgcaccttcttgcaacttatcacgacgctccttccaaattttctggagtctcactttctcatattctcaagtgcaaatccacaattgacgacgttctgcacca

SEQ ID NO: 76364 - DNA, 640 bp, Oryza sativa
ctagtactattctaataagatgaaataggtgcaatgcatcaggagttttcagatgtccagaactgctaccaccaaaaaagaagaagaaaatttctgggtgcagaacgaaaagtcgagcaaacaacagtgagaaattacgaaatcagtgaatctgtgctttccttgtttaatctcagtcatacaaactgaattctgaaccctgaactctgaagagatgcattcaagtacagcacagcagacatgcaagtacagtacatcaccagaatcaaacctgcatatctaaatctaaatctaaatgccaacaaaaataaaagagagagagaaaataataatcaaccaacgcagagaaacaaagagcagaagatgctttactcatcgacagccgacttgacctcatccttggtgatcttccccccgagtccagatgcaagatccatggccccagacctcgacatcgcggcgtcgatcaccggagctccacctgcaaccaacagcagcaaagttcctcacggaaatcaggagcatccacctcctcactttcctcccaaatccgaacaaaccacacacatatatattccaaaaaaaattcaaacggtagtgcgaaagggatggatatgatttattttcttcaccctttttt

SEQ ID NO: 76365 - DNA, 604 bp, Oryza sativa
gcatttctagtacaatcacgttaatggatcgtactagagacgtagaaactagtgtcatatatggaggctgcctaatgattgagtgaacataatcatgcgtgatgagtgtgtgagtgacaagttggaaattaaaggatccatcaaatgtcttgaacgagattacatcttcgttaagtgcagtagacgacccaacggtagctgaacatggaggtggtaacacgaacaaacgctaccaatttcacccgtgcagaaacacagcaaagtatagccaagctggtgaacggatttgacccctaatctggtcgattcccaactgtacactgtacagaagaaacacaaaaatgatattccactagtacgcaggttagcaacgacacgtgagcatcacttgtcctctaggatcagggcaagtttccaaagcttcacatgcacatggatggacacacacgacacataggggtggacagaaaaagaccgaaccgaaaagatcgagaccgagaaattcggtcatcaattcgatcttaggcagtgaaataccgaattttgttcagtcaattcggttagtcttcttggttaatcgaatagaccgaataatgaaaaaagg

SEQ ID NO: 76366 - DNA, 1023 bp, Oryza sativa
cacgacgacgcccaccgcgttcgacaacgcctactaccgcaacctgctgtcgaacaaggggctcctgcactccgaccaggagctgttcagcaacggcagcacggacaacacggtcaggagcttcgcgtccagcgcggcggcgttcggcgccgccttcgcgacggccatggtgaagatggggaacatctcgccgctgaccgggacacagggacagatcaggctcatctgctccgccgtcaactcgtgatctgatcgaccggtttgtatatatccagacgctgggcactcgacaacatgattaattaccagtgcacgaatgcatcaaggaaagaattccagttgcaattaattacaggtgaaacatactactccgtcttagaaagaatccaatcctaacaatgaatcttgacacatgttcgttattaggattggatttttttttttttggaacggaggaggtacgctcgtattagcatacgcaattatagtcctttaaaatcgtagagcattcagtgaagatgtcaccgagaatgtcacggggaatgttactgaatctgcgtccgtttattagcaggtttgcatgcttcttgatctgtaccgacttctctctccaatacaaaatccactcctgttacaagttattttttccctctctctttttttttgagagagagaggactcccgctcttgcaatcttgctagacctgttcgtcctccatcttgcagtagcaagattttttgttttctggattgccgtcggccggtgaccacacgcgcgccgccggcgcgagttaagatatctccaccgcctcggcgatattttgctccacgttgcaaaggcccgtgaaggtgacgatttggcccatctatgccggtgagcgtgctacgtggtggatggggcgtgggccggcttattttcgcggcgcaaaggcctactctttacttggcaggctgccactacttcggcccattaaaattcaccagcggcagaaattgaaatgcttttttttggcgggtagaaaa

SEQ ID NO: 76367 - DNA, 619 bp, Oryza sativa
tttctagatctgtatttgttctgcaacgcgaggtgttgtggttgatgcgattcatgcgaaaacttaatctgtcatacatacttggaagggtaaaaaaagaaaaaaataatctcctttctactggagatgcatagcgtgggaattataattagcctcttgttatctgctagcctggttgttgagcgaagctttcggatccaaccttttaattcagggtagctttatgtagtacagaaaactgtgtaactgtattgtgtttcctgttactttcttttaaaacaagttctggttgaaaagcgtagaaacagtcttaactggcatgtcttgttttcatgcatatgtgctgtgcagtagattaatccttttacctagaacttctcaattgagttttatgttagttgattccaactagtagttgtccatgactgaccttattgcatcttcttcttttggcagaattactagacttccaataagaaggaaacaccttagggaatgcagaaagatgtgcttgcatgctagagagctaccttgtgagggaattggcagggtagcaagccatatttctccttccacaactcttcatgacattggaacacaagagtatatacagcgcttg

SEQ ID NO: 76368 - DNA, 535 bp, Oryza sativa
ttctcggtcttgtcaacaaaactggaaaatattaacttacttattttgagaaataaaaattgaaatatggcatgtagcctataggaacaaacatgaacttgcaagatttcagatgatctttttactcttacctgtctacaaaacttttagtcgaagccatcaagtaagtatatatgtagctgaaattgtacagaggaacacagctgcagtagaaaaggatattttgaaatgttaatgttgaaaacgtctataagatgataaacattggtacataaaaaaaattgaaattcaaactacaacataaagacttaaagcatactgactagtggggaatatgatcagaatgtcactctaactctctctaacctatagagatgggtaacactcatcatgggaaactcttcaaggtgagcacccacaagggaaaccaagaaaaggcattcaccgaattatgggatgccttcacagttgcatttttttttctaacattacttatgagaccaagcaaaagcgagagagcttctcaagaaacctt

SEQ ID NO: 76369 - DNA, 1244 bp, Oryza sativa
acttaaaggaatctgcttcctgttactgaaaataagtctggtagatcaccttgctaagccttgatctgcctatcttactcctgtagccctgttctctgtgttggtaagccttttaacctcatgtactgttttcacggttgtgattttggaacagaaacagttaccaatctcttgtgcgattaaaatatgcctttttgcctgccatggtaagcttatgggcttttccaacatgcaggtgaaggaaatttttgaaccaatttttaatgatcatgctagaaagactgcaaaggtcctactggtaaccgccagtgatcattaagcccagcctttgttatcatccttgaaattgcaaaattggaccgtgaccaatgacttgcatggccacttttttaccatatgcaagcaggtatggaaaatatttacagtatgtagtttattgccgaacatcctatttatggggaccaacccagaactgtgccatgcacctaaccttcccttaactttttccagttgaaaactggtccctaagacttggggtttacttgaaaaggaatttgtagtccccccatattcttttgattgagattggctgcttttcttttactttgacaacttacatttctctggattttcttcagtgttgggctgattaatgtccttgtgaaagactgggagaacataacaacggcaaattttgaggacttcgacactgtgttggttgcagacttgcctccttcagttgacgaatacattgaaatcctcgctggtgcaagctgtcatgtgctgtgggggaagtgcattgcatcttttctagcgctgatgctatgcttgcaaaacccttgtctgaagttcttacaagctgtggtcaggtagtgcctgaatttctcaggaaactggcatcctcatagcaggatcggttttctcatggcaatcatcatatagtatacgctaccatatgcatggttcttccagtcactaaacatttttgtcagtttactgttccttatcatgtaattctcacagcataacgaggatcttcagccttgttgtatctctgcaactttgtattttttgaatgcgatcaagtcctagtctgtgagaaccaattgcttttgcattcattaacattacatggtcaatagtcaagtgcaaactactaagttactggttttattattgtgaaggttgaatcagcttatgattgtcaggcaccgacctgctctcctcttttcaaggggagcaaa

SEQ ID NO: 76370 - DNA, 552 bp, Oryza sativa
cactgtgtgctctctgctagtttaaagctggagtttgggttatattatatcggaagcatcttgtgacgtcatcacctaataattatttcttgtgatgtgacctcatcaggccagcttgctagctagccgccatgttcttggattaggttacctaattatgtatacagtacacgaatcttaattaaatcttaatcgtttgttatactgatgattcttcctaaacacgcaggagctactacaggtgcagttaccaccgggagcgcagatgccccgcgcagaagcacgtgcagcagcgcgacggcgacgacgtcccggcgctgcacgtcgtcgtctacacccacgagcacacgtgcctgcagggggcgcccgccgagcttcccgacgcggcgacgaacggtggcgccgccgccgcccgagtcgacggactacttccccgccggcggagagacgccgtcgtcgctgcggcggctccggggcgtaagaggcggaggcctgcagccttagttcgtggaccaccgccccgccatggaggagcgcgagcgccaggtgctc

SEQ ID NO: 76371 - DNA, 652 bp, Oryza sativa
aggattacattagctcggtaggcagtagtgagcagggtttacgattccgacaggcccttctgttcaggtactggcggaatacggaatttcgcaaaatccggtgaaaaaccagtaaattctgaacaaatttcataaaccaaaatttgaatacaaattccctaagtttgccgacaagttctcgaaaaccggtcggttttggcgaaattctgatcgaaatcatcgaaatcagtaaatgttttcctttttttatttccggtcggtttttgcccatgtaagtgttttccttttcttgattatttattcttttctttcctgatgtaagtttcagtaaatacatacaatacatcatttttttcgaaaatttatatcccaataggttctatgaatatcatagtatttataaaattttatttgatttttcttttttatcaattcaaattttaatttggatgaaacttctcgaaatctcagacgatttctactttcgagcctcgtcgaaacgtcgaaatttcacgaaatccggtcggttttcgtcggaaccctggtagtgagtacatgcccaaccaaatgctactattcagcccctttgtagtgagtgcagtttaaactacgtcaagtgaaaaatactacactctccttaactatgagagga

SEQ ID NO: 76372 - DNA, 616 bp, Oryza sativa
gcccccccccccccccaaaaccctagctctgggctgcagccccctcccggggaaggcggccgccgcggagagctagggccccccgtatctgtggctggctgggaggtggaagcagcggttgcggcgatggggggctggtctagggttttgatttgggagggaaggccgccgcggaggaggcaggcggccggtggaaccgggcggggcggggcgaggcgcgggcgacgtggggacgggggaagagagagagagagagagagagagacgggacgggagggacaacgaggagagagagagtgcccacaccggtttgcgcgatattatggaggcgggggagtgggatactggcgtgtggggaccctgtggtttagctgggacccacgtgtaagtgtgtggtccgtacactctgttgaattttttttatttataattttttttattaaaagttttacaaaaataattttccattttgaaaattgacggaaggagtcgcctaccgcctctgggaaaaatcgcctctcagagggcggcgaaaatgacgtggcagacgaccgttcgctctcgggcgacggccgtcaacgaatttgcaggcggcccccttgccgcctccgtaggg

SEQ ID NO: 76373 - DNA, 560 bp, Oryza sativa
ccaaatgagattgataataaccaaaccttttcaggcccttgaccctgcttcgacaaacgctcagcttcaatatcgtactttaagaccctgaagcattccagtctttcctccaaaaacaaaccgtatgtacgaacccatgaagaatagtcccaagctggataaaaagttgtattagaaacaatgggaatttaggaggtgatactaaagaaaattgatgtgctctactaaccaacaggggtggagtcatccttgaagtttgataattgcaaaatccgcactctttgtgtgaaagtaagaaactcttcacggaatgtaggatcaccatcccggagaagcctgtggatcaccacaagtgtcttcagtgcaacctacatagtgcatgaaatgaatgttacattaattggctccagatgtggaccagcgaatacttgcaaatagaacagaacactgaagagtgtctgaagtattgctgatctgctgttgaagtggtggcacgaaaaccataaatcagaaaaacttgtttgggaccaagccgatttactccctccgtttcacaatgt

SEQ ID NO: 76374 - DNA, 2557 bp, Oryza sativa
gttcttatggctacacattatcagcgtctcagtgactagtaacctttgttcatttcattccagatgacctcccttctcagcaaccactcagaatattctaagctccagtgtctccatctttggataaaaagacatgttactgttgtttaaaactatcggttgtcaaaattaagtgctgcttggatcttccacgggtaattaggggcaaatctatatgagaatcatacccttttgtgtataacaagaaggataactaggcgcaaatatgcatagagctagcgatagagccataatcgagcatcagacgggccgatggttagtacctggatggagtacttgagcgcgatgccggggacggtgtccccgcggcggacggtgtgcgagagcgcgaaccgggcgagggacgcggcgcgccagaaggccctcgtctccggctcgccgacgacgcggcgcaccccccagggcgacgcgaaggcggcctccagcacggcgcggtcggaggcgaccccgcgccacagccggcagacgcacgccgccctcgcgaggtcgggcggcggcagcctctgcaggaccgcgcgcaggaggtcccccgggaagtcgttgctccccccctccatcgcagccggggtacgatcggggcaaaggcaaagacggatcggagctcacctcgggcgagaggaggatggctgtggctgggggcgatcgtgcgcggcgccagctccgccgctaccgcggccggtggaggatcggaggagaggagggagatcgcgaggtgaggcggctcgcgtgcggtggcgcggccgtggcggagtctgggatgatatgtggtgtggtgttgacgagtggtgtgcgtgcacggcgcagcagccgccgcgtttgcttaacgatccaatttttatctgaaaaacaaaaaacataaatacgacggtagtagtattttaacggaatagctaacgcgggcctagaaaaccatgactaaatttagtccctctcacatgtttctgtgagagggactaaagtttagccctactttagtccctccaaccaaacaccacctaatagctaatcttataataacagtagtctacttataaataatttgttcgagaagtttaatattttgaaaagcagacggttgacaaatcagcttttgagaatttgaaaaactatgttttcctagctttggacttttagcttatttttaagattctaccattacaacttctcaaaatctaaattaaaggctgaactatttgagaagtttctaattctggaagaaattgaaactagaaatttctacaaaaagatcccgaatcttataactatgattaccacaagtagatcgtaaatcttatacctatgtattgtaccgatactaagggtctgtttagtcggtgaaatgaaaatttttggatgtcacatcagacgtttgaccagatatcggaaggggttttcggacacgaatgaaaaaactaatttcatactccctccgtttcacaatgtaagttattctagcatttctcacattcatattaatgctaatgaatctagacatatcccacattcatattaatgctaatgaatctagacatatatatctatctagattcattaacatcaatacgaatgtgggaaatgctagaatgacttacattgtgaaacggaggaagtaactcgcatggaaaccgcgagacgaatcttttgaacctaattaagccgtcattaacatatgtggattactgtaacacttatggctaatcatggattaattagcctcaaaaaatttgtctcgcgatttacatgcaaagtgtgcaattattttttggggcaattgtgtttcagtccttgatttacaattcaattgtgattttacccttactttttagggtttgtgattttgcccctgcttttatgaaatgaagcacccgtctgcctctggttttgacataagtttggtgggcctgaaatttccgaattaaacgaataaagaaaatgttattattatttgtgaatgaccattctacccttggttcaatgagcaaaatcccgaattcctttactgtccgggttgcaagcgctgggttgcaagtggtggcggcggcgacgcgcggccagcgcgcggcagggaggagaagcggtgcgggccagcgcgcggcggagtcgggcgcgggcagggaggtgcggcggcggcagcgtcgcggctggcgcgcgcgcagggaggtgcggcgctcgcgcggctgcacgcgcagggacggcctttggaggcgccgcgacgaggatgacggcgaggaagaggacattgccgtcgacgagagggactcgctcgggctgccgttgccggtggtgagcaactgctcctcgtcggagtgtgagtacatggccgagtcagaggctgagctggcgaagacggaggagaagtgcgcgtcggcgtcgtcagcgtcggagtacgaaaagacgtcgcagtcgagcacggggagcgtcgccttccatggcgctgccgacgccggaggagacgggcataaggtgagtgttagtgctgcttctattattctgcgtt

SEQ ID NO: 76375 - DNA, 96239 bp, Oryza sativa
  unsure (1)..(96239): unsure at all n locations
tactaaccgggaataaaaatcaaaacacactatataatccatagtaccgatcctcttttcccgtccacacaacaaactcctccctctatctctttttttcctctctaacttcttatctctttccttatctctaactcccctcctctccttccttttttccttcaccacagtgcaggcggtcggcgcggaggcggcgacgcgggggacggcgcggaggcggcctgcgcggcggccggtgcggcagcgcagggggccgcgcggcggcggcggtgggcggccggcgcggcggcgcaggaggccgcgcggcggtgccgggggccgcgcggaggcggcggctgcagtgggcggccgctcggcggcgaccgacgcggcgctggccggccggcgcggatgggaggaggggaggcggcagtggccgccggccggattttttttcttttttttttgagatgtgaatctgtgatgtatttttgtgtgagatgtgaatctgtgatgaatttttagaaccctgtgatgtaatttttttaagagtttgtgatgtatttggagatgatttgtttgaggatttggagatgttctgtaatatgtgatgatttggatatgagaggggatggtgtgaaatcaatattcaatattaaaagcagaaaaaaaaagaaaaaatatctttagtcccggttggtgttatcaaccggaactaaagattctcccatctttagtcccggttggtaacatcaaccgggactaaagattgatttttagtcccggttatttgaaccgggactaaagatagtcccggattcgtagtcccggttggaaaaccgggactaaaaagcatttctccactagtgtatggatgcattcaagaacaagaggaggtgaaacgtgaaatgcattatatccccatcagctcctggctcatttggatatctaccactaaccggcaagaattgccatgaaaatcaccgggactccaggagactgcagcctcgaggttccgacagttatagcttctgtaagaatctttagagaagtcagattaaaaagttctaaaaaaagtcagataaaaaaataatcttaactgaagtcaaacagtttagaattttatctaagaatatatagttatagaattaaaaaagtgggagccctattggttgccctaataaaccaaagtaaaagctaaaatttttattttaaaaaataattttgatgttgattttaatatatgttcaacgtagttttctatattaatttttgagtgaagtacatgggcggtccctaaacttgtgccagtgtgtcatctagatctctgaactcctaaaatgcatttttagatccctgaacttgctatgtgtgttatataggtccaaacaggttctaacccactcgatgtgctgacgtggcaatgccacggtgacgcctacgtgtcagtggaatccacatgtcaagcatatataaaaaataaaattaaaaaccatattttctcctattaggtagacagaaaaaaagataaaaattttaaggtagagagaggagaaaatatatttttctaattatattttttttctatgtgactgatacgtgggtccaactaacacgtatgaactatcgtggcatgccacatcagcgcatggaaggggttggagctcgtttggacttgtatgacaccccaaaacaagttcaaggatccgaaaatgcattttgagagtttagggacctagatgacacacccacacaagtttagagaccgctcgtgcacttcactcttgatttttaaatcactaagaacatatatataaaagttttacctataaattaatttttatactcttttactagtaataagttaatgtgggcaaaggacatgaaatagaatagtccgtagatattgacgggtgacacgggcttatttattacagcgttcttgctccatctctgtgtctacgtttgggtacgtgtagccactagccatggacgatcgatatatcacttggacagtgaggcatggcactgtttgcacacgctgcgcacgtgccagcgtactcgactgccggtggtcggcgtctacgaaacgacgcaaacaggacacccaagtggtcctcgccgtagacgaaacccagcaaacgtttttttttcctttcctccgtacctgagttaatttttctcttctttttactttttaatttttataactagtactagtttattgcccactgtttgcttgcagctctgtactctatccgtcctgaaatgaacctggacattcattcgtccagattcaaaccctagaaattatctgtttttttcgatggagggggtaggtgacaactagctaggataggttgaggataggcctggcttagagcaaatttaatagtatagccaactactagctctaattcatctatagccaatctaatagctcatatatacaatagttacatattacactattaatacctggtcccacctgtcatacacacaatgcgtcttggagtccgtgctacagctggctacaaatctgtagctcgctgctcttctctctcattatttatctccttaaaatatgtttgtagctggcttatagcctgctattgtacctgctcttagggcgtttacaatgcatctttggaatttttttagtttctaatttttttttccaaaaatgtcacatgtaaaatctttgacacatgcatggcgtattaaatatagataaaaataaaaactaattgcacaatttgcatgaaaatcgcgagacgaatcttttgagcataattagtccatgattagccataaaatgctacaggaactcacatgtgctaatggcggcttaattagacacaaaagattcgtctcgcgattttcaagcgagttatgaaattaattttttcattcgagtccgaaaaccctttccgatatccggtcaaatatccgatgtgacacccaaaaaatttctttttgtgaaagacccttatgctctctcattttttgcaagcacatttttaaattgataaatgatgttctcttctaaagataagataattactttataaaatcatattaatatatttatttagttttttaagctaatatttaattaatcatacactaatctgttgctttgtttcacatggtaggaagaaggttctcaacagtcaaccccttttaaaaaaacacacccaagtactccagcacatacacttcacattctaaaaaatatatctaatacgatattgaaatttatagtactcctattaagatgtattatactcgctctatctcataagggcttttgcctggatgtgaacaatgaatctggacggtttttctgtccaactgtctagattcattgtattatctattcagattcattgtactagaatgtgtcacattcaatccaaaatcattatatttagagatagaggaagtactacctctatcccaaaatatactccctccgtttcaggttataagtcgtttgactttggttaaagttgaactattttaagttcgaccaaatttatacacaaatatagtaatatttacattactaaattagttttattaaattgataattaaatatatttttataataaaattatcttgggtcgaaaatattactattttttctataaatttggtcaaactgaagcagtttgactttgaccaaagtcaaaacgacttataacctgaaacgaagagagtagctatttctagcacaacatcttatcccaaaatgaaactatttcttcatctacctcctctcaaccaatcacaaccattctctttcacctaatttatcttttcaatcaatcacacaatttcttcaatcattcttacttacttccttaatacccgtgccaaccttaaaattatttatattttggatggaggaaatattctcttcgtcccattttaagtgcaactataagtttttgtgcccaactttaatcaactatcttatttaaaaattttctataattagtatttttattgttgtgagatgataaaatatggacagtactttactactttatatgtgacttatgtcttttaaatttttcaaaaaaatttcaaataaaactgacggtcaaaattgtacacgaaaaatcatggctgcaattaaaataagggagtatcttatattagatttgtctatttgaaaacaaaaaagatcacgaatagtatgcgaagccccgatcgatctcaattggctgtccttgttctgtctgcttctcatttctgaagggaaggaaaagaaaaaacaagtggaaaaggggcccagagtgtgcacgcactccctgcaggctctagcacaagcttagctagcaacgtgaaatctttgtaggcagttgaagcttatatgtgctgagctcctaccctccaatgccgtccatctccatgtccctctcgccgacgtcgccgtgcacctcgcatcgtcgccgtcaccgtcgccgacgaccagaccagcaacagtgccagcgacggcggctgctgcccaactccaacaactaaactgttcaactccttcagctactacttcacttgggttaatttgtacattgctctctgccatggcggcgccggcagccgttcttgccgtgctccggtggcggcagcggcggtggctggttgagctggtcgctctcctgcttcttcttgctcgaggtggcgctgccgcggttgaccaattcttgtttcccggcttctccggcgacggcgtggccaccagcggcgcggccgccgtcacctccaccggtctactgcagctcaccaacgagacgaaggaggtgttcggccatggcttctaccccaagccggtcagcttgagaaacgcctccaccggcgcggcggcctccttctccaccaccttcgtgttcgccatcgtgcccaagtatcccgacgcgcatggccacggcctcgccttcgcgctggcgccgtcggtggccgtccccggcgccgtcgccggcaagtacctggggctcttcaacacgtccgacagcacgggccagatcaagaacaagatcgtcgccgtcgagctcgacacggcgcgggacgacgagttcgccgacatcgacgacaaccacgtcggcatcgacgacaacagcctgaaatccgtgaactccagcccggcggggtaccacgacgccgccaccggcggcaagctcgccagcgtcaacctgatcggcggcgagcccctgcaggtgtggatcgagtacgacggcgacagcgcgtggctcgaggtgacggtgtcgccggccggcatgctcaggccggccgccccgctggtgtcttgcaccgtcaacctgtcgtccgccgtggccggcgacacgtacgtcgggttctcggcggcgaacggcgccgccgcgagctcgcactacgtcctcggctggagcttccgcctcggcggcggcggccgcgcgcaggacctcgacctcgccaagctcccgcggctcccgtcgccgagcaaacccaagaagacgttgccgccgctgatcatcttgacaattctcctcctctccgtcgtgatcctgctcctggcggcggcggccgtggcggcgctcgtggtgcgaagccggcggtacgccgaggaagaggaggaatgggagatcgagtacgggccacacaggatcagctacaaggacctccacggcgcgaccaaggggttccgcgacgtcatcggcgccggcggcttcggcagcgtgtaccacggcgtgctgccgaggtccggcgtggaggtcgccgtgaagaaggtgtcgcacgactcgcggcaggggctgcgggagttcgtgtcggagatcgccagcatgagccggctgcgccaccgcaacctggtgcagctgctcggctactgccggcgccgcggcgagctggtgctcgtctacgactacatggcgaacggcagcctcgacaagcacctgttcgccggcggcgagcggccggcgctgagctgggagaagcgcggcaagatcgtccgggacgtcgccgccgggctgctgtacctgcacgaggggtgggagcaggtggtggtgcaccgtgacatcaaggccagcaacgtgctcctcgacgccgacatgaacggcaagctcagcgacttcggcctcgcccggctctacgaccacggcgctaacccgcagacgacgcgcatcgtcggcacgctcggctacctcgcgccggagctgagcaagaccggcaaggccaccacgagcaccgacgtcttcgccttcggcgccttcttgctcgaggtggcgtgcggccggaggcccatggagttcaccgtcgacgacgactcgccggggctcgtcgagctcgtcctcgagcactggaaggccggcgagatcacggcggcgagggaccccaggatcggcgactgtgacgaggacgatctcgaggtcgtcctcaagctcgggcttctctgctcgcaccctgacccgcgccgccggccgagcatgaggcaggtggtgcagatcttggaaggcgccgcgccggcgccggagacgttgccggaggacctagaatgcggcgtggggcagttctacgacgagtcattcgacgagttcgtcaccggcttcccgtccacgtcggagatcaccacgtcgacgacgcagtccaccgacgagcagcagcggctggttggctgtgttcagttgagcactgccgattttctgaagacaacttaaaatgtaaaaatgtcagtgagcaaatacttgcagcattaggtgattgtttgggctttggatcttctggagttagtaacatagggatactgtcaatcattttcagatatgatcatatagaggttttgatcaaagattagtacagcattcagcttagaagttaccttgttgcagtttcagaagaatgtacacctgcaagaaggcaagaaccgtgtaagaaattttgcaagggaagaaaaaaaaatatggatcccctttttttttttgtagctgcatctttcttggggcagtttgctgttgagccagatcagaatattagccaatagactgatcactgatgtcgattctgtcatgcagaaaacatgcgatatataatatgacatattggcaccttgctcaaaaggaaccaaagatattgcagcctgcttctcatcatgggaaaaagacaatgaaaacctaaaaaaatgctgtcctaatgttctgcttttacaacaaaagatgaacatgacaaatattagcaaggtatcaaacaaaaagatgacaacaaatggagacagttcaggccatggttctagggattcttctgattcatacgagaactgaacgggctttcttgtgttccaaacagaggacattagattggttgccgaggaaaaaagaactacttgcaaaatgttgacaactgacaagcaatgccagattgtgtccatggctccatgcaacattagtttacatcctatccaagctaaaactagcatccctactacccaatcgtaatgactccacctataagcacaggtgacggctctcttcctcagagttattcatcatcctcctgagttccccgagaagcaccttggatcattttgtcatcaactcctgcgattaagttcagagcttttaatatcaaatttcaacattaacataagataaactggaagcaaggtaatgtataaggatttaccttcaatgaaggactcgaattcatcatcatcacttggacccattgatgtgatattgttgactggttggttaatctccgtccagtttgactgctctgcctggccagatataagtgcagatctatccacaacccaatcgtcgactatgtcaatgttgtcgactgagacaggatcaaatgctttggtcttgtgttgttgcctatgacagttattaatcagatcgctcaccatcatcaatcatttactagctaatgaaactcggtatatttaacataaggatttgattacctgtgttgtagccttagattgtactgaacaaatgtgagatgatgcattcgctggcgttcaaaaagattcattctttggtcatgaatttgttcgaaagaaatgtgtctccggtcacatcctttagcactgcaggtttgactgagaatgcgaactgctaaacgcgtcaaatttgggcaagctcctccatacgtataccaccattcagctgcaaaatagaatctataaggctcaccaaacaatttccgtaatcatatctaagtgtctaacaataacctatatctgggggaaattaattatgtctatcaaacgaaatagtaacacagctctagttttgtgaaaggtcggtgctgaaaatgcatttcatgtttttaggacaacataatttgtcaattgagtaagctagttcacaacggaaattgtatagtactaaccaggaggtaaagtgtgcctggctcggatagccatttgcctacgaaaatccccagctgcctcactccggtatacattgagctccttttggattttatcttggattttcacatcagaaaccaacctttctacgcagtctagcatacctgagaatatctcacttgatgttccacctcgaacaccatcgaaaaataatgggttcaggaaaaaaccagctaaatgaagtggtcgtggtgcatccttgttccatctccagtcaataatatcccagtaagccatgtagtcgttcttcctcaccagctctttcttgattgctgctttggcctgatacaatccagcgtaaacataccccatagatggcctcttattgctaccgactaacttaagaagatgcacaagtggttcggtgatgcgaaccactgcagcacacgaagaccaaaactgcaaattgccaataagattggtcacttcaaccccaccaggtttctttggcagcaagtagtgaatccattcatctgagctaatcatggcttccaaagaatcctttagattgtacatgttcttcagtgtgacaaagttcatagcagcacgagtttctgcaggaactagcagatctttcccatgaagatgccttttcatcaagttaaatgcaaatgcgctgttatagataaatcccgtaatgacctttgcattacatatgatctcattgattgcccccaccttactgaaatcttcaagcatcccatcgatgcactggaaagagcattgagaccagaacaatgtaggaaaagtttcgcatagcctctttcctgccaccgcatgaatctcagaattgtttgtgattacttggacaacatttttctcaccaacttcctcaaccacattcttcagcaactcatacagcggatctgacgacacgacaatgtcagttgcatcgactgacttcagaaacatagtaccttccgggcaatacacagagaagtttattaatgttctgcctctgtcagtagtccactcatcggccaacaatgtgcaccctgtccgggtccatgatcccttgtagaactccaactgagcagtcacttcatccagcgacttcttcaatatggaaccacggaagtcgtgatacgagaacgcctcaggcttccctcctgctgaggcaacagcttcaagcataggctgaaagtaaacggaatttactgcctccagtgacacaccagcgtcatacaagaacctcccaattgccatataaacctgctccttgttcgagccgggctggtcaaaatgcatcagttgcgatgcagccgaatcaaacgccacgaccatctgatgaaaaggctgggtcagaccagcaggagtagactgaagaggctgctgattctgatgagcaaggggcgccgtggaggcttgcctcgcagccaatttctttctcttcttgctaatactccccttcatctccctggtctccggtggtgtctcctcgagtggaacggagcccaagtcgagcacctcgttgagcgggatcatgtggatggggctctccatctcggcggcatcggccggagccggcggagaggcggaggcggcggcggcgggagccgagtgggtgattcgcctgatgccctcggccagcgattgcttccgtttcttcttcgccgcgacggcgtcgaggctgtggagcatcgtctcctgcacctcgcggggcaccttggggcagcagcacgcgttgccggggcggttcgcgaggtgctccttgaagcggtggatgccgccgccgaggaagtgcttgtggcagtagacgcacttgagcctcacgcgccccgccgacctcaccatctggcagtgcttccacgccgggtcgtgcttctgcgcgccgatcggcagcaccacctccggccccgccgccacctccgcctccgcctccgacgccatctccgccgcgagcaaccaccctctcctgcatcgcaatacccatcaccacacccacactgttactaccatttccccgccattgccgcaaaaattcctaccatatgagcccaaccaactgcgaattcacacggattttacaccaacaaacttccattgaaacggcacagcccactccgaatcaaaacctcaaaccatttccagagacagagccacataatctcgtatcagaaggtgattttcctctcgagcaataccccccaaaacccacaaacccaaaggaagatggggacacgacaccctctcgcgtcaaatcaaatccctagtaatccccgattagccgacgacgccatcgcagaaaataaaccgaccaaaaccaagcaaaccagggcgaaccagatatgaaggggagagagagtgagattggggagaggcgagactcacccggcttttttttcgtgaaggcgaagcggccgccaccaaatcggaggggaccggagacggagccggaggcgaagcggatgaggaggagaaaaaaccaggaggcgacgcgagagaaaccagaggagagagagagagtgtgtgtggtggttagcctgtgagtgggagtggagccggtccggtcggtccggtggcccgttatacgtggatcccgggggttggggaaccggcccagccggttttggcgcgggtttggtccgggttagggtgaggctctgggctcagacactggaatcgggagttgtgggccgtgaacactttctgggcccgaacgggaatgcaacttacgtgcagcccatatagcagcataattacacaagcactgcatattaattcattcatgtaagattcatcatcgaaatgtcaaaattaaacccattttggccgcacgaaatgacaacatacactgtgtaacaggatatcatcttttactcccaaaaatttcacaagtgcagaacacacccaagacaccacaaacatcttataaagaggctggatgccctgaacttgtgagctgtatcacctaaactaacaatatctgagctaccatcaccttctgaagacaagaatgggtacatcaaatacctgcacacagacaaccaagcaggttgcgatggctataggtatcatgcatccaagaacatttgagtataagaaataacttcgtaagaacaccaagtcagttgcagatggctatagacctatagttgcagcagtatgatatgctatgctatcggtatcaaatggctcagctgagcccaagttccttcttcagcttctccaaagcagcctctatctcagatacgctatcatcaaagctacttgtcgatgtattaacatcttgcttgtttttgcctccagactgtgtgtacggatcatttgcattgtcttccgcatcacttgagtcatcgatcttgagttcgttctccagaaactcaacaaattcttcaccaatggcctgattgaccagaatgtaatagaattaatgggagattaccaccaatgaccataggcatgattagaagttgcagtatttatgtactattgattagtgttcactcccaacagtagatgtttacaataatacagtggaaaagacaggtaaagaacttactgccaactcttcccacaagcttttaggtttctgttctgaattcagaccggcttcccagttctgaaattctgcttgaagatctctaaggaaatcccctgcagatccatgaccacagtataatgtcaaataatggaacatttttagttcaactatctagtaactacacaccctagagttccatttatctactgaagtttcaaaatacaaggattatgatgtgatctaatctaccagttgtttcttagcagaaaggatctctcttgaaacttcattttactcatcactagcacgaaattcctaaccacagaaaccataatatagctcactaatgcagaagagaaggtattccagtaccaaagccatagaatggctcttcttcatcagctgaagtagtgctgctcttcccgtatgtcctggacgaataatatgtgttgctgctagtgctcgcgtacttggaccggctctctgaattcatgagcgtgttgtacgcatgcttgatccgcagaaatttctcttgcgcgttgggctacgttgacacaacatcaaacacaaataatcagtgaaacgcaaggaggtgacaaggtttgggggcggctgtggcacgcacctccttgttgacgtccgggtggaacttgagagcaagccgccggtacgcgcgcttgatctcttcgggcggcgccgacggaggcacgccgagcacgtcgtacggggactccccccggccgcctctgcccgcgccggcgcgggccctcacgctcgcacgccgccggcggcgaggcggcgcgggcgcaggagaggagaggcgcgtggaggggccatcgcgggaggaagctacggcgcggagaacgagaggcgacggcggagcagcgaagcggcggcgtgaggagcggagaggaagagggggatgcggagtggcggcctgaagctgcagcgccatggcgcaacgcaaccggagtccggaggtggatggggttgaaagaaaaaattgcttttgaatggctcgcagcgagccttcaactggagcagacagcatcaccaccgttcagatcacgcggccctggtggagcagtgaggatcggacggccatccttagctcacaataaataggcaaagccatgtgagaactgattaatccccagtcagccagtctacagattaccgacacatattatacaaagattgaattcacagagactcaaaatcaaatcgtggaagagataagtatctttcatcttcgtattttaatagcatcacagattacagatatccaaaaacctcaatacatccaagagctcaggacaggattaaaatgcagagaatttcagcagattgcaaatatgtaggatctttttaaggttaagtctagagaattgcataagcgaaaaactaagcaatcccaacaagtctaggaagacggtccagggcctagcagcaatggtggatccttcttggcgctctcagactctgaatcttctttgggaggtggccttgatgctgcccaagcgcgaagcggcggctcaaacatgctgccaacgacatccggtggtggctgttgaggtgcatcctctccaggaagcacaacaagacccttctccctgagagacgacggctcgttgtaacactccttccagagggagtccacaagctgtcgctcctcacgatgtgcggagagatcgtcggcatccattgtgctgatgccttcgattcggctcttaaggacatctttcagcttgtcttggtcaggtagcacgtttccagcaccggatgtattgtcccgcgccagctcgagaagaccacctaaggcagcctcccggactccagaatcatcactcgatgccaggtgcatcatcagctttggaagaccaagctctgtagcaacactcctatcagccttgttgtcgtgcagtaggtactgtaggagatggagagctttcctggaattaataaagcagaaatgttatgaaaattgcaggtttgcattgcattgtttaactgcagcaaaaaataagtcatgtgaatgagatcaaaaaaaaaatcagtactacaggtaggcgcagccaaatagttacttcacttattggaaaaatgttgtgggctaagtttagaagtaaatatgtgctaggctatgctatcatatatggctaagctatcaaggccacgcatagtcctattgttcaacaagtataaataccatgaagaaagaacatagtgcaatgttagtgtcctactagctcccctgattatcatacaacatacctctgaagtctagcatcatcagaaccaagagcgtctctcagtgcagagtagccatttcccaggcggaatgcagcaactcctggctggttatgacgaattagagctgcaagacagtagtagaaacctctagttagcatatgtaattgaagcaattatgttctaggtcatggcaaagcaccaggtttattacagaagcaaatgacttacatgatattgctccaagagcttttgtgcgtgaattcgtgcttgcatcggaactgaagtttgtcaacagtggctccaggccattagattccatgacaagttgctggctcttggggttattttgcacaatcgtgctcacaacctctgcagcctttgctctgatgccagcatgtgaatttttcaagtaaccaagtaggggatctaatccaccaatagagtgcagatctggtggggtaatgcaatcatgttaaaattctttgcagtcaagagaataacatctacaaatgcagaagtacagtaaccatgattcttaccatttgccatgtcaatggattcaacatgctcctgtaactcatccaacatatctgaaaacaaagtaataattcattgatcagtgaaactgagaaaatctatcaatcccattctagggagggttttatatgttaatgttgaactgttaaggataatatgaaatgaaaagtgaaaactgtaggaaataggcaaaacaaaaacggaattcataattgcattgtccctaaaggaaccttacgtgtgagaatcagccactacaaatttacgttactagttatgtgtacgccagcccccacaataagcatatctaatgcacaataatagaaatatgattacttgcagatgctaccaaaaaaaatacttaacaaaaattactagccatgattttgtaaactttcttcagctagtgtttccgcactcctacaatcccaaaaattctacaagttgtataaatatgaaggaaatgctacaaggtggccaataaataatgaagagtgctgagcgtatatgaaattcattgttcacgtctacaacaagcaggtaattttagaaaatgaaaacactcaaaatgataccttcgatgttctctggagtcacaccttgagactgtagtacatcatctggagttttcatcacttgggtgatctccttcatcctcttaacaacatccattgtattagcttgcattgcctccataaaccatttcttgtcctcctcactgcaacccaaacaaatcatgataacagtgaacaatatgaacatgttttggcatgccacagatcgattgcacattccaaccactgcacataggtatcatttgcgcaaatttctgacatgacagctaacatgtcagtgttaataaaggagtaatttagcaggaaatatgagatgattcatcataatttaacgagcgaatttgcacatgaattagcagtctacaagtgatattgtgctagcgcatgtatacctgcagactacagtagaacaaacaccctatctcaaacctaaactaaactaaacacgcctaattccagagtacctagaagcacatcgatctagcgccccccgccagaacaaccccacagcttaacgcagccccttactcgaactgaaaggagatctcgctcgagcgggagcagcatacctgagcgagcgcggcttggcggtgccgtcgccatgggcgaggctccacttgagcaggccgttccagtcgggccctcctccgtccttggccatctcctcctctaccaactccggcgagggttcacggcgagacagttggttcaggcgtcggtgcgcggcggcgggaaaagacgaagcagcacaagcctcctcctcttcctcgccctcgtcctcccccttttatgggagggagaggtctcctcctctcgtcagtcgaggcgtcgtcgagagagacgggggacgcggcggcggaggagtccggagtgttcctgaacctacgcttcgcctcctcaggtggaaaaggcgtcttgggccgggccgtcttttggttccccacgtcgtcattgggcccacctagtcagatcctttctttggtgggcccggattacgaaaaggaaataagttcatcaaaggtcccttagcttatcaacgaatcatatttttgtccttcaaccgaaaactagatacaacaagtcccttaattgtcaaaaccggtggtcccatggcggtttgaacaacgatttaagctgacgtgacgtctacatggcaaatttgattcggtcttcatttaatgtggcggtcacgtgacactggaagcaaaaatatgataaataattttattttacaattgtggggcccacatgtcggtaagacaaatgataaaaattagtgatccccgttctcctctctatctccagcgacacctcattccccttctcccccttttcactggccgcttcgtcctcgactacttctttctagctgtggcaccggctgctacgagaaggcggcggtgtggaggcttcaacgaccagtcggaagccatgatggcctcgaggtcggtggccatggtgcgctcggccctgaggatggggtcggcagcagggatgaaaattagttggaaaaagtacaccgaaggtcccttaacttgtcatcgagttacaaaatcgtccctcgaccacaaaaccagataccggacgttccctcaactaacaaaaccgttcactttagatcctcctatgattttgacccgttcacttcagatcctcctgtgattttgaccctggttttgtcctacatgacggcttagtcagcgttgaacccaggtgggccccatatgtcagcattaccacatcagccttctctctcttttcttctcttctctcccatcctcatctctctctctctccgttctctgcggcaatgcgaggcgggagaggaggaggccgtcggcgaccggcgacctgcagccggagaccggcgacgcagcgacgggcgacgcggcggcgggggaaggggcggcgcgcgggcggccgggagaggcgcggcgcgcgggtggcaggggaaggagcggcacgcgggctcccccgccggccaccacccatgaggcccacgaggcggcggcgggggacgagctgcgggcgggcggcgggagaggaggagcacgaggcaacctcctcgtgaaatacatactctccatcacgcgtgacatacgtactctgcatctgattctgtacatgatggggtagcaaaataactagctctgaaaattttgttcagaacatgtagtggtgcttgtggtcgatcttggtgttgcttctccggcggtggtgggaagagctagagatagaagaagcagtagggtcggggaagccgatgtcgtggacggcgccaacggtgttgaagaagaggcgcttgttgagctcctccaccagcgtcctgtgcagcagctggctccgcatgtccaccatcgacctgttccgactcatcctcccccgccgctgctcctcctctccgccaccctctcgctgccgcggccgtccggcgtgccctcctcctccgtcttcagatgcagaggctggccctctctcgccggccgcgcgccgccccttcccgccgcccgcccgcagctcgtcccccgccgccgcctcgtgggccgcggccggcgggggagcccgcgcgccgccccttccctcgccgccacgtctcccgtcgccggccgtcggtcggcgacgccctcctcctctcccgtctcgcattgctgtagagaacggagagagagagatgaggatgggagagaagagaggaaaagagagaaggttgatgtggcaaatgctgacatgtgggtcccacgttgacttagccgccatgtaagataaaaccagggtcaaaaccaccggacaaccgaacaacctaaagtgaacggttttagttgagggatgtccggtatttttgcggttgggggacgattttgtaactcgatgacaagttgagggaccttcggtgtgattttttcaagttagtttcggcgtaaagttaagggttctcaaatgaaccaattccttacgaaaacaataggcccattattgagttagtacattgaggcccaaatttgtagtgaacatctttatgggctgatcaatcgattgttcgcgaccttttggagtcttttggagttttgggcaaggacgcgcgctgggcgctgctggctgtggcacctgggacgttcgtgaaacctgcacgaaagcagctcgccgctcaacgcttttgatgcgatttcgacacgaaaacaacgaagcgtcgggagaaatcggcacgtcccatagtttaagcagatgaactagcgaaccatagaatcgaagatgccgcactttgcagttccgtttcatacaacatcacatagcagaaggtagtgttagcacaagtcacatttcagaagttcaggaacatttttttcccattttctgaacttggaataacatgtacatagatacatagggtttttttccccctgctaaattaacaggatttcacacgcagggcggtagatagatacagctacttcccatcacaaaagcagaacagcaaatgcacatccatcttgctccacaaaaaaaaccaccaaacaagatgcaactgcagagttagcagcaatccctacacaaaaggctaaagctgtactagtaacactactataatgtaggagtagcagcaaccaacacactgtgcgtgctgctgcacggagactgggcgcagcagcactacgcgcagctggacgcctgcctccgcggcggcgcgagcacgaagagcgactcgaggtccggcggctggaagtacccgcccttgggcggctcccgccgctccttccccagctccggcagcgccaccggcctcttcctcggcggcgccgggcactgcggcggcaccaccgggatgcggcactcctccctcctcggcgtctcccacccctgcagctcctcctcctccatcgccgccgccacctcctctccgtgccccatctccacctccattgcctctctcgatcgctactcctaagcaaagatttgaaatggcgaagctatgcaagcaaagcaagcaaccacgcttaagctaatatagaagtgagtgccaccgcggtgggtggtgatgtgcagcaacgaagcgacgaggagagtggagtggagtccagcggcgttgcgggtggcgggaagggacgcgccccgcggaatctactcgtttaccgaatgactagtgggaccaggtcatgtagggacccacttgtcagtgggaaaggtgtgaggtcgctggtggtgggaggggggttgggagagttacgtggcaccgactcgcgaatgcgcgggaaccgcgtcggtcgaaagtggcggaatggtctagagctccgccgcggattctctgtgccaaacccgcacgaacgccgcaggttgagcttgagctttcaggtcactgcacttgggagcctctctttgaagcccaacagttctcaattcctatatactccaacagtagtacggtttaattcaaaaaacaaaaactcggtagctgaaagtactcttgacacaatgctgccgactgtcttttagcttaaagtaactatatgttgctttaaaaaattggctatggcatttattaaaaaaaaagaacaaaaaaactgttagtttagcggcgatcattgcacatctgggacctgcaagtccaactgcctggccctcgaacgctcctacgctacgctcctaccctaccaatggggcaaccacagttttgcatgtccaatatcgtggttgcagtggatccagctttagctcagtagttcaaactcagcctcaaacattgattactcaggacgaaccatggataggctagaaaaatggtctgcaatggaaatatggaatggtagtggagcatatctcttcggaaagtgggctccatctctcctctcgccggagtacgaccaagctgtgggcggcggcgtgacacgtggagcccgtcccgtacgtcgccgggccatgagaaagtggatgccagcgtggcgcgaccgagaagccgcggcctgcaccggcggagcacacgccatgcatgaccggatgatgattaaactgggccacaagcccacgagtactagataagttcactgttttttcagatggaatagttcaatgtgatctggaaaaagattcgaacttttcaaagggggtcctaattcatttgcatttccttcacacagaacaaagctaaaagcaaaactttactttgatgcctaaatcaactaatataggttgctcactttgatgtctaaatcaacattaccaaattttggtagtaacaaattttggcattaccaatgtttgataaggataagggtgtgtttatagttctttggatgtaaaaactttgaaatatgcgaacacacatttgaagtattaaacatagactaataacaaaacaaattacagattcccgcctgtaaactgcgagacgaatttattgcctaattaattcatcattagcaaatgtttactgtagcatcacattgtcaaatgtaatcagacacaaaagaattgtctcgcaatttacatgcaaattgtacaattgttttttttccaacatttaatgctccatgcatgtgtccaaacattagatgtggcatttttggccaaaatttttttggaatctgataaggccaaagaagagtaagttgtgcgaaaagattctagaattatgaaaatttggtaatggaggcaacttttggcattgtttagattgttaccttgccaaaacttggtaaggttagtttcggcaacaaagggaacactgcatcaatgattgttcatgaacgggcttcatgcttttctatttagcaaatggcctttcttgaaaagattaccggaaaagtatacactgcttgcctgataccaaggcctgaaagtgtggcgacaggggtgcacaagaaaaattgctaatcaaatcagttcaacaaagattcaaatgtgtcagcactgcttcttcattctattatttctaccgtaaaccttcacagaccatgaaaatctccctcgaactagatcttgtcgccttgggtctcaataaggacactttcttgaacttctctttgcaaaatttgccaaaacctacaaagttaacagtttaatgaataataagttatacttggtgtcttgttaggatttttttaaaaaagaatagctagcatatagaagatgattgctggtcataacctggtatatcctcattctcaagaaacttaattacaaggctgcctccacgacggagaatgccatcttcatcaggatctggctcagtggagctctgaaacttctctaaaattgcaatgcaatctgaatcttttgctttcatcttaccaactgccaatgaaagagcacgcatgcccagctcgcaagatatagccgcatctttggttgtaattccagaaactactgggcacatgtctgacaatattacagagaatcctcgttcctgtaaaataagggaatcaaataaccaatggcgattacagggcaatacaattggtaatccttgcttcagcctttctaaccataggaaataagatattcagatgaagcgagcttggtagtgggaagattgatgaaaccatgtttcgtagtctatcagcgtgcgtactaaagtaaactcagcttttctcaagttacaaccttatgtggtagtgttcccagttgacaaattgatatttggaggcaaaactgaataaatacacgtttacctccacaactggtggcatcatattttatttagctagtagcagaaccactttatcaggttccatcgtgcctaccgacaaatagggtacataccttttatctttgaaagaaaggaatttcatgggaatttttggtacctagctcttcccaaggaatgaaaaggaggcatgcattttctggtaaaacattagtagcatctgtcatttgtacaaactaatactccctctatcccagaatataaggattgaatggtgaagggttgtgattggtttgataagagaatattggtgaagaagttattatattttgggacaaatctagagaactgaaagttgtaatattttgggacgaggggagtagttcacttgtcgcaagtaccactagtcaccaataatcctcggtgcgaaccttccaagactgttttcctttgcaaagatcatgagtctcaatcgaatacatatggagttcagttagtactaagatttcacaaattagaataaaccaaactagattgcagcctcggatcaaacgaaactaatttgtataacttcgtaccattccttccacgaactaagccagggaaatcggtagtaaaagctgaatcatatcatgatcattagcaagctatcgaacctgtggcgacattgcccgagcttgctgcttcatcagagccatcacatcggcgcaaacggtcctgaccctcgagtcacagtgcgcagatggaaccttcaccttctgctctgcaacaaccgagcatcgaatcaggccaaccattccgtcggcaaaatcagcctcactaacgaacggcaactcgatcgccactgaccttgacatcgacgccgacgatcaccccgcccttctcgagcggacccaggttctggcacgccacctacacaatgcaacaccgagctaaatcgaaatcgcgctgatgagaggagaggaggggatccaacgtcacctggagccacgcgccgggggcgcagccgaggtcgaggacggcggcgccgggggcgatgagcttgtgctgcttctgtatctggatcagctgcgacgggcagagcaagcggctcctcgcgtgagacgggagcagttggcaaaccgtacgagcgagaggggtgaggaggaaggcgctgaccttgaacgcggagcgggcgacgtagccgaggcgctgcgcctcgcggtagaagaagtcggcggtgccgcccgcgccgctcatggcttcctctccggccggcggcggcggcggtgacggtggcgaaggtgaagacgacggaggcggaggggattgctagggttttagcccgtcttcgcggcccaacacacaagtgaaacccaagcagcttgtttgctgggccggacgaggcgagcaaagcgtgacgtggccaccttccccgccgcgcgcactcttggcatgcgcgagcgcgacccctccccctcgaaccgccgcgaccttctcgatgcttcccaaatcctcctcctcgtgaactcgtcgccttcgtcttcgtctcgatctccatggcggactcgagcgcggcccgccccaccgtcctcgtcaccggcgccggcggccgcacaggtgggtactcctccgtcctccctgtggcctccgactgcgatatgaatcccagtagcgcgctctccagtacttctttttttttttgggggggggggggggggggtattggagcaaactgatgacagcggaatttggaatttgcctgttgtgcaaggttcgtgcgatctacagtacatgcttgttatatgatggggaattttggatccagtagagcgttctgaaaaggaattttggtcggaatgggattcatgtaatgtgttgcagtatcttgatcttctctaggataagagactttgtatcgcatggctgctagtcatatgatgagttgaatttgcaaggtttgtaaaattcacctagggcttaggcacgagtggggcttcttgggtactgattaacccattctagtttagctcaatgaactgaatatactatttggacttggaaaactgaaatttagtcgattaattgaagtgggtcaatgggtatccacagagcaacccacgccaaacccggaattcacccaatatgagtgcatgtgcctaagattttttgcaactatatggatgtatactgactgctcgacactatgtagtctgtactaatcctcaagggttactccttgtaacttgtcaggaaacattgtctacaacaagctcaaggaaaggtctgaccagtttgttgtgagaggtttagtgagaacagaggaaagcaaacaaaagattggtggaggcaatgatgtttacattgccgacataagggacagagatcatcttgtgcctgctgttcaaggtgtcgatgcgctcataatcctcacgagtgctgtgccaaagatgaaacctggttttgaccctagcaaaggtgggaggcctgagttttactatgaagatggaatgtatcctgagcaggttggctgattgaaacccctctagttaatatatagaatgtgattgtaaacttctgagctcatgctaatacttgctgtggtctgttaggtggattggattggccaaaagaatcagattgacactggtaaggttgttgcttattcttcttcatcattcatgtatcagtttgtaaatgtttgttaagtgaacattgcttgttttaacagccaaagctgctggagtgaagcatatcgtgcttgtgggatccatgggaggaacaaatcctaaccatccactgaacagcctaggcaatggcaatatactggtaagctgatggagtttgctagttctttttctataataagtcatacagcaaactttttggttcaagctttcaatagaactggtagattgtttccctctatcttaataacatttggatgacctccttcggtcatcccggcaaatagagtggtagattggtagaaaatgatctggccaccttaaatggttagcaagggaaaaccaaaaatacgagtgccaaactgtatgatattatcttacaaatgaactttccacattgctgatatcaccttattggatattccttgatatggccttatttatttgttataggtttggaagcgcaagtcagaacagtatttggcagacagtggagtcccttatacaataataaggtaccacctgcataagacaagaagccatacgtaatagcctgactaattggtccggttggcttaattcgctttgttcttgaaacttaggaaatgtttgattttccaccacaataggcctgatttgctacttcattgtcaatgatactaagccaattcgtatatgtgaaaaatataatatgttgtgtgtatcttccatcacttccatgtaggcctggtggtctgcaagacaaagacgggggagtgagggagttgattgttggcaatgacgatgaacttctccagacagacacgaagtcaattccaagagctgatgttgctgaagtttgtgttcaggtatgatctttgtggtcaatacagtgatagtttatctttgagtttacttagctaagttttccggcgatgaagcattgatgcatcggccatacgtttctactttctgtcaacaagcaccgtgaaaaaatatggatagtcacatggtgaacttaccattctgattgcaaacttttccccttataataggccctgcagtatgaagagacaaagttcaaggcatttgatttggcttcaaagcctgaaggcacaggcacaccaacaaaagacttcaaatcgttgttctcccaggttacagcccgattttgagccatcttgaggagcaatctcatctcggtttccttgtgtattggatatttggatgtatatcttcgtggttagtgaggtgtgaagttgtagtttgctgtaattcgtcatcgtttcctgaaaactcctattgaaatcagtgaattgttcagacaagacacaaattgatattattcaaggacatgatgtctttttaaaatgaaatccttgcgctgttataaacttctggcatggactgtggagtcagcctgcaaagggggcggatcgggccgacccatcccctataccctctgaccctatctatcttggtgcctgagttcgccccgtctctggtggaagtggagccggcccgttaggttcgtggccgacccaccgtagccgcgggccggatgcactaagcgtctgagccaccgtgtccagtgaatggttgactggctgtgttaatgtgttatcagtgaaccattaaagcaagtagctatacgtcaattcaattatacaagattcaaaaataatatgaacaatcattttatattaaactgatatcatttttgtactatactaattttatataagtcagatatcaagtgaaataaggaaacaaaaacacatacactagcatgatatctgaacacatactaacatactagaaatttcggttgtgcgaagcaaatcaacagcactacagcaaaataaataaataatcaaaaaccataccagaacacactgtatacccaatgcaaacattccgaaatgacttaatcttttgcattcaaaagtacaaacatcaatcactgggtactggcacccagttcaattaaaactaagtacatgcatgtactcatatcattcacaaaaatcgatttgaacaacccaaatatccggttcattatattgagatcaaacaaaatgcagccttccaagatcaaagtgggcatcatttggcattccctagcttgcactgttcgttgaatcacccaggtccagattctgcaggttaacatgatggagagatcgaatgatcatggtataataacaggaagaaaatatacaataattgttttaaaaaggtaataacctgcaatatctctcagaaaaagaaatggtgcatttatgttttatgggcaacaactgaatcaaagacatgagcatatgcagacagacagaggaatcaacgcagtaggtgttctaagcatttgagtatttgacatataaaacatgcttgaaaaacagaagtaatctgcagtcactcaatagtattcacaatcagagattaaggaatacaagaatcatctaacaagtgctacacaaattttgcagattttactaattttcttcatttatctagcagtagtgcagtacagtctatttttaggctatcgttttatttcagaaagcagagcattgcaataccagaaatgaggtttattccttttgtacatctagagcttctcatatgttgtacaagagttgaactagctcagattataaatagtataatacaagttcatgatagattactaaccatcaatatccagatcctttgtttgggcattcacaagcttccaccatcctgtccatccatggaatcctccaggtccaggttctatagataaagatgaatacatgatagagacattgaaacttcatattccaattttacagaaagctagcaagtaggacaacaaacccatataggcattgttcaatactggataaatagaaagagaaaagctggaagagatcttgcaagcaatcaagcaaatactgaataaatagacatctttctctttcagaaaattaaatagacagatgataagaagagcacaagcaatttactaaccacaaaattatcactgtagttgatttcatttactgagctcacatttatgttaggacctagcaatcaaaacataaaaataaattagttttagcaagataaatactagaagtaaatgaacgagggcagtcgtgtataccggcagaagctcgaaaccaatcttggaggcagataagcgcctcaactgaatccattgtaaggctacatctgaaatcgctgatcactctagatcctgtgctgaatgcggactcagatgcaactgttgaagcaggccatgctagcacatcctgtgctatgcaagcgagagttggatactttgagtgattggtcttccaccaatttagaatgtcaaatttgttcccaaattcctgaataggattctctttgaggtagatatccaattcagtatcaacttgctcacttcattgttcagagatgtgttgaacccaatcagccataggatcattttcagagatagccatcacatgttcagcttggcgcagtgggttagcattgctatccttgagtttatcagagtactccttaaacaacatgttcattctcttcttaactttgtcaatcctctctttagcattttcaccaaaggcttgcccaagccgaaattccacaaaattgaatttgaatcttgggtcaaaaatgacaggaatgcacagatatttgtaagacttaagccaatacttgtcaaatttgtccttcatcttttgaaccatacttgccacttcagtgtcattgttagagtgttccttgtccaagaccaatttgattttccacatctcatggaaataaaggtttgatgttggatataaagatccagacaccaccatagttgcatcataaagcaccttcaaaattccagagactatggttgatctttcccactgatcaggagagggtgcatatttgtaatttttgtcttgaacagccaatgaagcataagccctcatgaaagggaaggctgcattgagcattagatatgtggagttccaacgagtacatacatccacagtgggatgcaactcgcatgtgatcccttcttgggcaatgatctcctcaaacttttctttgcgagatagggaattatccctgtacttcacactttcacggatgttgcaaacaatagaatcaataaccttcaacccatctttggctatgagattgatgacatgtgttgcacatcggttgtgaagtagcttccctcctgctggtatagttttcttagctttcaaattgcactttaacaacttagccattgaatcattggctgaagcataatccaaagtaacactgaatattttgtctgcgatattccaatcttgaatgcagctgagcatagcattgaacatctgcactccagtatgaggtgtctttactccaaagaactttataatcctcttctgtactctccaatctgtgtcaatgaaatgacatgtcacacacatgtatcccattgtttggttcgaagtccacatatctgcagtcaatgagaacctacaatttgcacccttgaacatgtccttcattgctaacttttgctctttaaaagcagcgatgcaatcattccttatagttgttctcgaaataatcttgaagtaggggttaagactagcagcaaaacttctaaatccatcatactccacaaactggaagggcaactcatgtaatacaatcattcgcatgagctcttttctagaaacttcaggatcaaagctccaattctttaaccttacactattaggagacataagtgtagagtcaagatttcccacaatcttaagagcactaattcgcttcttgcatcttgtcaaatgcttcctcaatgaacttgttcccgctccacgctttgcacggatctctgtatcacagtgcttacattttcctgcaccaacttcattatcaatgagtatcggcacaaactctttccaagcctcagatctgaatttccttgttaaagcttgtattactggattcacatgctcatctacaggaccaacttgttcagagtcactatcaccatcacccatctcaatatcttcaccactgttagtgccaagtccaaaaaatgcgttgggtgtccgcatttcctcacttgaaacaaagcaacgaacaacacaaatgtatcatttgccatctaaaataattttctatcacataatgtatggaaaggaaattttggtgtaaaaatctgcacaacagcatgttgtcagaagcatgcaaaaatgctacttattcagtgtttcgttcagtatatcctgaatattgagaaaatccaggttatatagagacaaagtaaaagaccatctattttacacaaggcagtaggaaactttaaattagcagtaactgaaactttctcctgaatggcatgaaagcaaaatgaaactttttcctggcatacaaatctgggcctagcaaaatggcatgaaagcctagctataacagtcactgaaactttctcctgaatgagacactatatatacaaatcaaaccaaaaccgagcaagacagatgaacaagacagggttcatggaggaaatcatacttgtgctcacgagttagagaaacccagctggaagaaggtggcgatgtggccgggtgtcctccgaaaccctcgccgttgctgccggtggagtgtcctccggagcacctcgccggttggccaccaagcaggtagccgccgcccgccggtgcctccatccgccgccgaaagaaggaactgcatagaagaggaactaaagaatcaagaaccaaagaaaataaaaagaaaatcaagaaccaaagaatccgttgctagttgctatgatgtgaaccacagtaccagtcttggggggagttggagatgggaggaggactgaaggagcacgcccagccgccgccgcctcaacccgcggtggagcacaccgcgaagccgaagctgccgccgccgccacctcgatccgcggtggagctgcgccgacaccgctgccgcctccgctgggagccaccgccgccggctcgatccgccgtggagccgcaccgccgcaggccgggagccctaaagccgccgccgccatttgaacgcgagcaagtggagcgctcgaacaaggccgacccaaaaacccctagggtcaactgactcctggacccattatcacctaagaaaatatgggccggcccgaaaacctattggtgccacaaatttaggttcgggccacggacctaacgggtcgacccgccccacttgcaggctgtgtggagtggtcatgtgtgcattggacagaaatgaagtcggaatatgtcctgtttttcattgcaagtattgtactacagaaggaagaaaaatcattttggcatcgcctcgtgtagataggccttcacacagtcacgcagcccacagcccaaggcccgcacaacgccgggtcatcatgcccatgtcacaagtcaacagtcacgagctactcacattaaggatgaaaatgttttaagacgatatcatttctactgaaacgattcttgctcggtcaaaaaatttcatacatacgaattttgctattttaacagtgatgaaacttatatataactagaatctttgcgggtcaggaaatttttacgtcacagttttcatgtacccttggtggttcgatgcttggaagataggtcaagtgacgtttgctggttccggccggcgacgacgaccttagcgtttgtcccttgcccgaccgcttttcgtctcgatcggcaggggtaccaaccactcaaccagtcgtcactcgtcagaacgcaagccgcagatcgatcaaaaccttgctgcttgagctgcgtgctgtactgcactgcagctcatcgggtcaaagcaaactatctcgctgcggtcacggcggtgatctggcctgatcagatcatattgccgccgtgtccacgccggtcaattcctactccccatgagatgataagatgatgagatgagatgagatgagatgagatgagctaggccgcgcgcgctgcctgcgacgagatggcaacaagtgcgtcgcgccaaatgctcccgttcggctacctcctcctgatactaattactactactccagctagctgcaggcagcatatgtatcagtgacacgtacgccaacttgcaacccgccaggtagagtagaaccagtgacacagcttcgcctggaccaaacatcaaggcaaaatggtactgcttgcacattggagaatttggacacacctacctagtcccacacggattcatcctaaaacaaacaaactttcttcaattcagattcgtaatactgtaatatattgcatcttaaatttatatttcatataaaatttgtttattcaaatttatatttcatactaaatctgtttattttcaaacaaagagaaaacttactagtaatagcacgatagaagaagatagaggaagacaacagcctgcacttgatgacagtttgatcattcgcatataataacagtatcacacaatcgctcatgttacaccattagtcaagtcaacgcgcccccattttcaaaataagatggtgtttgaaactcatgtggataaagattaagtattttacataaaacggggtgctatattaattaaattgtaattattataaacttgaaaaatatgtttatgatattttgaagcagcttttatatagaagttttttacacgaaacgtaccgtttaacagtttaaaaaacatggcacgaatatctaaatttttatccaacttttattagagaaaagaacggggcctagacagttctctctttcacttgatccacaccctgttgccggttattttcccctgaactgcatgccctagtgtctgaacccatgaccctcaagtctcacggcatgcatgtgctctgctctgcatccaggcacaagaataatcatcagtcataagaagcaaacacaagctagctcagggcaaaacacctaacacgtactcccaatcctactactgcaggcgcgacttaaattgcagacaagcaaacaggtcaaccccttaccaatctgtccaggcacgcagcgtccggcggtgctaggctgctagctaattacagtcatcaaggaaccgtgacctaacacaatcttattagtggacacaaaattaagaggccagctgcatgctgcagcctctgcatacatcatcctgcaggagatagccatatggaaagtatcatgaattcatgagagctcgatgatgcgcagccaaagcagatccggcacatggcctgggctcaaggcttgctgcagtgtgcagtagtaaggtttcagagtttcaccgaaacaacaacgttagtcaatgctcgatcgataaacttgcagtctcttgcagagtgcagactcgatccatctctgctttgacgaccatcaacgccctatccgtcagttccagatatgctaacatactactactgatattaattttctaccggacatctcagtgtgatccaagcatcgcaatacaatactctctgtgtgcacggcacgcgacctatgttaatactatgtggaaacagctctgaattgttccgaattaatggtcaccattgacatgctcaatgaagaggtctgaccatcagggatagatcgatcgacgcagtgtgaaatgtatgaagaaatgagaaacacagatgcgtcggtgccaacgcatttgtcagtttcacaacaagttgaatcgaaatgaatgctacctgaacactaatgcattacagctttgatatactcctatagtgttgtactcgtactatatgagtacttgtactacttcctcaaaaggtcgcgtaaaagctatactagctgcgtcttcttcttcgcatttgcttgccgtgatcgggcgggaatttttttatcagtttccctttgttctcatcgtggatcggaaaagcgacggcatgatcgatccacaactactactgctgcgatagtacgtacatgagtcgggttccgaggcgagagaaaggcgaaagtagcacgtacgttctccgcttcttccttttgattggaacttcgcttgcccttctgtttggctttatctactccctctgtcaaaaaaatataaatcatgggtttttttgtccaacgtttgaccatccgtcttatttaaaaaaagtatgaaaaaaattaaaaagacaagtcacgcataaagtattaatcatgttttatcatctaacaataatgaaaatactaattataaaaatattttatataagacgaatagacaaacgttggacacgaagaacgaagaaccatagtttgttttttaggacggagggagtatatcttcgagtcatatcatctactactgcgtcttttatatgggaaatacttccccatctataaatatactctctcaatttcatattataaatcatttgattttttttctaattaaattttattaagtttaaccaaatttatagataaatttaacaacatctaaaaaattaaattaatttcattaaatttaatattaaatatattttgatggtatgtttattttgtgttaaaaatactactatattttttttataaatttaatcaaacttaaagaaatttaactaagaaaaagttaaacaacttataatatgaaacgagtggagtagtatgttcatcctaaaataattttactttttatttatcccatacatatcattacaatatgtgctataataccatttcctttaccaaattctaatgcatttatctcctactttatatatatgcttctaatgtatttatctcgtacttttaaaaactctaatacaacaattgcttggaattaagatgaacttaatttaggatggagggagtagcaatttaattaagatcggatagaatacatctcaatacttttaattaaatttatagtaatatgatgcgtcctacttttagattactgtatgttgggaaaggagtatgcacgtaatcctatagcaaacgagaacgactagtactcttctttcagctacgtcgtctacgtgatgtgatgaaatgaagaagatatgggatggttaggccgcaattcttgtagctagagtcgtcaacttgtcagacaactagtatgtccatatgcatgtttgctcggttacctagaggccaacccccaccttgatctgtccaacaaatagccgaaaagttcagagttagggtttgttcacatccatctactagctccttactgccgtctccttttactgtgctgccacaagtctacaacactacaatcgtcaggtcaaatcgttccaactttgccaaggaaaactccaaaagcaaggtacttaaggccatatttttttcagcttaagattattataatccagattattgagagtaagctgaaagaaacagacaacttattgaagtagcttattataatctggagcccagcttattattatttgataagctcatttaggtgagctttttccagattattaagtgaaaaattacccaccatgccaccccactccctttttagacttgcaaacccaataatctaggctctaataattcaggaaagaaacaactaaccacttattctactataaattataacaatctagcttatagtaatctgagtcaataatctagattataataatcctaaactgaaagaaacagtggcctaaatcctactactgatttggtcccattagccgcggcgaaggcggagttcatatatcaaaagtgaaagaagagttttgtgtgcagtgcagtggcttccgtttattcgaccaacagcacgagattgccatcacatggctagttgatctaccagaagaggagtcctagtagaagatatggcctactcctagtacaacaacaacaccttaacctttcacgaggctgcaaccaaccaccctgggtggctggtgctgtagtagcctagtagagctgaccaacggcggcagcaatgattgacgacgagtaaagtaaatcgccgtacaactctacgtactatgagctcagagttgacttgttttcttgccggtaaaacgcacccaaccctgcatcgcgttgcatctgatcgagtgggcatcaccagcgagctgaggctgcaaatgagatcaaccgaagcgtagatgcaaagcaaccacacatatatatcagactatcagtagtggtacatacatagactgtagtagtagatggagatgggcataataaactcggtggccggatgcgaccaaggaaacggttagagatggtgcgggttttgctcggtcaccagccacatgcgcccgcgtacgtggccgagacagcgcggcgggcgtacgctagctgcgttagtacgtgtgccccgcccccgcgcgtcgccatcgcattcacgcgccgatcgatcgagccacggggggttctcgcgctcgcgcacgtacagtctacttaccaaaccccagccaagacgccccgtcgcgttgcgcccatcgcgccgcgtcgggaggtgcgggcgcgcaccggccgcctgtctcgcgcgcgcgcgcacatcgcgacgtacgttacgttggtgcgatacgtacgtggcccgcggagggcgaccgcgacggctcacttgccgggctctcgctcgatcgggcgccgtcttgtgctggccttggcctgatagctactccagtcgcgacttggtaggtggatttgtacgtactactacttcgttcgtagtggtgtcgtcagcaaagtgcaaaatgcagctactgaaatttacagaggatgcacaaatgcaagggaaaaaaacgtgagcacttttcgtcgcggttgtgattaaaagagagggcgtgtcacgcactcacgtctcacggcacgcacccaccgcgagaggctagcggagaggaagacgtatcccgtttggggtgacccatgcgtacctacctaatccctccgtctaaaaaaactcaattcttaagttgccgtgtacaacatttaactatttatcttatatgaattttttctataattagtatttttattgttgttagatgataaaacatggataatattttttgtgtgacttatttttaatattttttaaaaataatacggacgttcaaacgctagacacgaaaatccaaaaattgagttttttttagagggaggatatgcgagacccatcgaccgtaccatttatatacgcaggcgtgcgtcacgcatacgcagtaaataggcatggaggctcactgctttgaagtgcgggtggaagagggaggagggaggctcgatggatggatgggtgtttgttcaggcgcgcggcgggaccgggcgcggcgcgggcgggcgtgccatgtgtgcggggagatcaattctggtgcggtttcgaggctcgaggtgggggcacaccggcgtggaagggtgggtgtgtacgggcaaagtcaccaaaccgaacaagggctccatcccgcgcacgcggaggaatccgagggcgccgtctgtgcctgtgcccctgcgcgtcctccactgtctacgatgtgcatggggcgcacctcatcgtgttgaaatgcaaggctgcattatccacggtttcaaccgtagcaatgagggtttacccttgtattggctcttccactttacatcccgtacgtgcatgcgctagtagcggtaggtagcaggaataggtggttgatcttataaaatctagatttcaaaaataactaactatgggctttggcatataaaacgatcctgacaaactagcacaatttgatgatcaatagtaggttcgactaatcgacatgtggtgttggattattgagatcaactgctgacgtctagtgagaatggatatggttgctttacattgctaccgtcgaacatgttcttggaatacgagtattttggtcatagttagtaatagaggttgtgtttacttcacactaaaattgaaagtttggtttaaattaaaaggatgtgatggaaaagttggaggtttgtgtgtaggaaagttttgatgtgatgaaaaagttagaagtttaaagaaaaactttagaactaaacacggcgagagttggacagaaatagtgttcaaaataaccttacaaacttcaaatagtattagagttcgctttaatttttttgggacatttaagaaaccttactaatctaatgaaaccatttttttcaaaataaataaataaatgaaacaagcatttttagtgtatggaaccaaaaaaacgggaagcttgtctgtagattacatgctacaggcaattcaggcctcttttagttcccaatttttatcacaaaaagatcacgtcgaaactttagacatatgcatagagcatcaaatatagataaaaataaaaactaattgcacagtttgtatgaaaatcgtgagacgaatcttttgagcctaattagtcaatgattagccataagtgctacaataacccacatgtgataatgacgacttaattaggctcaaaagattcgtctcgcggtttccagtcaagttataaaattagatttttcattcgtgtccaaaaactctttccgacatacagacaaacatctgatgtgacacataaatattttcttttcgcgaactaaacacaccttcagtccgatgctccatccgtgatactgcaaccatgacatcgatggatgagtggcaacccacatctacacagtgcaactgtttacggctgcctgcatgatcaaattagttcttttgccggagctattttgccaatttggcccaccctagatgtttttttatcgatttagagggtgtggtgccaactcacatgtttctatggagtcatagagtaacatctactcctacaaacagagcacgcatgtgctgcaattgaaacacagttctaatcatagttgatgtctatccttgtgcaacagtatatgtgtacatacagtacaattcggtaggtcgtatgtgttagagtaggatgtacgttctctgcttgtagaataaacgaaaactattcgctgattgctgtttacaatgccgtacgaaatgtaggaaatgaagtggatttcgagacaggtacggtgtagaacacaggcgtcggtgaaatgtccaaacgtgcagggacagagtttcctctgttccaagatgtcgcgtttcttctgtttcacctggtggttttcctgccgttttgaacttgaggttttttaaaagtttaaaactcaacaccactgcaaatccaggttgtacagtcggctagaatggattttcgcatatagtttgagtgatcacctataacaaaaggcctataaaaatagtttgattttccacataaatgtccggttcttcgagaggttcgtatgcgaaaaacaattttcacatatgacagtccaaacaacccctcttgtgcggatgtattttagcaaaaaaaaaaaagtaaatttagatccaatttaacttgcagaggatcacaaattccacaaagccctagccacaattgtctttgtagttgttgagtcgaaggcctcgcagcggccaccatgaagaattccattgtggatcgttgtggcattggtcgattgctgttcttttagggcggtttgatttgaagtaaaaacttaccctaccaagatattggcaaattaaacaatagtagcctggtaatatttggtttgctaccaatacttacttatatcacacagatgctaccaaaaatatttagggccaatttggtttgatgtcaaaatatgcactaccaaattgttggcattttgaatagtagtttggctagtgtttggtttgctaccaaaatgtgccaataagacacataagttgctaaagtatttggcattaccaaaatttgcctatgatttggtattgccaatattttgacatggtagcaaaccaaacaagcacttatatttgacaaaaggatgcccttgatttggtattgtcaacattttgctatggtagcaaatcaaaccatcccatagttacctcggcagaagagtgtccttgtggcctattatggcatccattagtcctgtaaagcttgcaccttatccattgtgtcatgtaaagcttgcatgcgtctttgaacttgaagagtgacagcatgatggtcggctggtcgccatagttgggtctaaccttacccagcacagctatgttcaacaaaagcatgctacattgctacttgcacagtgtggtactaccaagatcattcttgagcactcatcattcttttgagtcgcgggctgcatacagttcaatatcacaacatggatggcacaaatgcatgcatacatcgtgtttagttccaaaatttttcttcaaacttctaacttttccatcacatcaaaactttcatacaccacaaacttctaatttttccgtcacatagttacaatttcaactaaacttttaattttgatgtgaaaacacacccatacatacatacattcaagtggtcaaggaaggttcacgaggccgcggcggcagatggggggcttccctccatattttccggcgccttttgttcaaacatggcattggcatcgaaactttaaaccaccaccaccgtatcgtatcgtctagcctgctatgctacgtactcgtcctactaccccagcagagcagcagcagctgatcgatgcggtagaagaggtgaaaccgcgcgcaaagcaaaagcagtggccaaaacgaaaaggagaagccccacacaaacgcaggagaacgtcaagccgtcaacctgcacaggccaccggccatccagagccacagccgcggctggccggccggcagcgagagagaggtgcagtggatggaaatcggaatggcacaacttgcgatggaagcaaagcgaaaggcgagccaatcaacgccccagccgtttgctccgtgtccacgaacacgcgccagtggccgcgccgcttttggtctcccctttccctccgctgccgccgctccgtgtcatcgcggccgtccatttagaacgaaggggatgacacatctgccactggcgtgtggggtccccgctgtttacaccggctgcgcgaaaggctggagcgcgaatgatagggccaaaatctggccgtgccaatgccattggcgaattcgcgttacgtctacgaaaatgtggtgttgaacttcttttttttgttcgagatgacagttacgaattccaaacggatcgttggagattgtcgtgttggtgtttgatgggcaaagatttatgactcgtgggctcataccaggatcctgtacgatcttgcagccgattccgccgtgcatcatgcgatcggatcacaacttcacaagcaatgcaaggcaagaggtaattggccgtggaatccaatacgatccgagttactcaattccggatccactgccctggcttccaacagattaatcaccaccaatcggtgaaaagagaacaaacacttcgcatgcatgcatgcacgcaaagattaatctgctcatgcttttgctttagttcgaaccaagccaaaaaaaaaagaaagaaaaaggagaatgaatagttccaactgccccgcggtgcacgagatgacggccgcagcgaggaggcaaaatcacagctgtggcagtagtacttgtacgtacacacacagtagtagtagtgtactactgctattgctactactaccacgcagcgggtgacacacacacacacaaaaagtcacaaatctctacgttttttttcctcgcgaggcgtagggcgcgcatacgcgacgcgcgccattatttggtccgcctcgtgcctccataaataccgcctccgtcccgtccgcctcctcccccacactccactccactccactctcgccgctcgccgttgccactcgcactcacaatgtcgccggcgccgcgggtgttggtgttggtggtggccacagtggtggcgctgcaggtgtcgccggcggcggggcggatcccgggggcgtacgggggcggggagtggcagagcgcgcacgcaacgttctacgggggcagcgacgcgtcagggacgatgggcggggcgtgcgggtacgggaacctgtacagccaggggtacggggtgaacaacgcggcgctgagcacggcgctgttcaactccgggcagagctgcggcgcgtgcttcgagatcaagtgcgtgaaccagcccgggtgggagtggtgccacccggggagcccctccatcctcatcaccgccaccaacttctgcccgcccaactacgccctcccctccgacaacggcggctggtgcaaccctcctcgcccccacttcgacctcgccatgcccatgttcctccacatcgccgagtaccgcgccggcatcgtccccgtctcctaccgccggtaaatataatctctcaccaccattcttgctgctagtactgcatttcttggtgacgacattcgccttggttagaggagcaggaacagtagtacttctaggcttgttttcttggtccaatggaagcttttgttttgttttgttttcatttcatttcgcgtcttttgagacggcgtggggctgctgctgctgctgcttctgcttctgcagcgttttggactccagccacttctgcttccgcactgctttattactgtagtaaataaatttgatacggtatactccagcgcgtagtggctgcacggccaggtgagtaatattttccgagtgggatggaaatgtgcaccgacggcgcggctttaaaagcggaggagcgtgatagtagcggctagaaacgctgctcactgcccgtaaaaagttggcttggtacgtagctataaatggggtgtcccgtgttcgctttgcccttgtgcatgtactcgtgtaccggcgctacgcaccgtggctcgcattgagccgagcccaaactctgcttagcgcttaatcactgccaattttttttccatacatttgcttgtagtagatctcatgctagtggttacattcccatgctttaattaacagtacagtagaaaggaggagtagatttttgggagcattggcctgaataattgtaccactacaccataaagggacacaaaagatgtacagggaaaaaacagcactgttactgtgcaaatgtgtgtagtgtaagaccactgggcgcactggcagcagcgagaggcccagagaaacatccaacgcgagtcaagcgtgtagttgggaggagtagtagaattccgtagggccaaggcgcacaggcaaaacgcgcacacgcgcttttgacctttttcgctttccgctgtgttgtcctggcccggttgggtggttgggttggtgccgccccgtgatcccgctccgtacccgcgcctccctcgcttcgctctccgcaaccttggcgtggcgtctcgccgtctcccatgccctggcgggaaagacgacggtgtgaggtgatgaggtgaaatggcaggtctgcccctccgttccttctgtggctggtcccctactgcaggggccttcccgtcctttcgtcctgccggcacaacgttactacgcgtgaggaggctgtgtggccccatctctgcatgaacgactgcactctcttcctggtcatatgtccttgcctccttttggctccttgctacctatagttacagcgaaataatatttgctcctactactagtattgttctgttgatcttgattttaatgtgataataatgcgtggttaatgagtgatgaaaatgttggcgtgtgtgtggtttgcagggtgccgtgcaggaagaagggaggggttcggttcacgataaacgggttcaggtacttcaacctggtgctgatcacgaacgtggccggggccggggacatcgtgagggcgagcgtgaaggggacgagcaccgggtggatgcccatgtcgcggaactggggccagaactggcagtccaactccgtcctcgtcggccaggcgctctcgttccgcgtcaccggcagcgaccgccgcacctccacatcctggaacgccgcacccgccggatggcacttcggccagaccttcgagggcaagaacttccgggtctgaattgaatgaagcaaaactgcaatataccctcttatttactcatctagtaattactgtcattatagcgagcaggtgtgttttttaccttggttaagtttgggttcttcttcggttggtggccttgtcaaagtgaggggccgggggaaaacaggtggtaaagactagtactagtgtcaattagggttaaactggtaaattgctagtactgctgttactcatcatcatcatcgctagtggtcactgctagtagtagttgtgctagtgcatgtatggttatggatactgcatcatgttggttggtgatggattttgtccatgttttgccaaggggtttggtttggagttgggggtgatggggaggatttgtgctcaaagagtggctgaagtggctgcaaagctgcagctgaatttgggggtggtgagtgtagcccgcagccgcttgtgccgtgtcatttgtctctatggcacttgatgtttatcatggacttgatttatcattatggtgattggagcttgtaagaagattaattgcctctgttcctctcgctctgtgtgtgtgttttatgtgatgttctggttgagcatttcagctttgtagtgctggaatgatgattcttgccggcttctttccgtgaatgcattctctgtgttctccgtgagttgctcgatgggggagtgccgaaattacgtgaaagggataaaggtgaaagcaaaagtgcgatgcgagtagaccgctttgggaatgattttgcctgttccgttgcctcagttcagatgcaagaatggttcatgattgcgatggcgtgatcggccattccattcctaagcacggcttgcagcatcatgcattcatgctggccttgcaattgccatcggagggctacttcaggattgggagttatcagtctgcatcatcatgggatggaagaaccaaatgcgcaacctctcttccttaaagtcaacatgctggatagccatcatcaggtgtgttggggccgaaatcaatggctttgacagggaggttagcatttgacagtgtggctatagcccatagctatttgataaattgttatccatctcgccggagatttcggcccaaaccacttcagcatgacaccatcagaccactgaacacaacagtagacaccactcagtatgatccaatgatgtgttgatgacaatgtacctatggtgcatgctgatcgatgagctaccaggaaagcttgaacccattgagacagccacgccagatttgtaacatgagctctactttaatgccatgagtttcgacatacaacagcatctagttagctgaagttaagaagctcatgataatgcacaaaaaggacttgttgccaaaagactgatgacaacaaggaatatgcacaacatatttacaaactaccaaataccaactaatgacactcacattctgccttgctaatgggagcggaccaatgctgttggattcggaccaatcttttcccgagtttctcccaagcttttccgacgaggcttaccgctgttcttgctagcatttgcagtaggggcttttttgcctgtacctgtggtggattcttgacgcctctctgctgctggtttcctgtccacatggctggattcttgaagctcttcaagaatagtgaccacagcttccatagaaggcctcatcttagcttcgtacgacaggcactcaagagcaagggtggcaactgtttgtgctccaacgtgagagtattgaccttctagcctggtatccaggacacggaatatcttgcgcttatgtgtgaggtatggtcgggcccattccacaagattgtgttcaccctggggccggttcttgtcaatggcacgacgacctgacatcatctccagcagcaccaccccaaagctataaacatcactcttcgcagttaaatggcctgaaagtattgatacaataaaacaaagctcaaggcatattgtacatgcacttctggtacatcgttctaaaaataacacggtgatgtaaatcactaaatgcacataattgcaacaggtccacagtaaataaaagctcacaacgtatggcaaacaatgatttgtttcccaacatccttccatgtacattttgcaattgagattaaactaaacatcaagccatatatatcattccccaaggagtgcgcatgcagaaaaggtgtatatgaaattcatggaaagcaatacattggagtgttcatatgttcatgcttagatgagttagattctaagctagatcacattcccaaagtcaacaatgcaaagaatgtcataaaatgacatttccgatgtggaggatgcgtaaaaaacaattccacgttattaatatgcttatagctataacaattcatgtaatttactgtagacaactacctggcctgccaatgtatgaattttctaatccaagatcagaaaacatggagaaaactgaataccaaaaactacacttcacaggttacctgttgaaagatattctggagcagcataaccatatgttcccatcaccctcgtggatacatggctcttctcaccaacaggaccatcctttgccaatccaaaatcagatagctttgcagaatagtcctgaacagtaatataatacattcctttcagcagggatacatgcgcactgaagtgaagttggttatcaaagatttactttcacttactgtgtcaagcagaatattggaagtcttgaaatctcgataaataacttttgcctctgaactgtgaaggtaagctagtccttttgcagctccaagtgcaaccttcattcttaggttccatgaaagaggctggaaatgcgaacctcctgcaacatgattcagatagcaatttatgataaaaggaacacgtggcaatagtgtatgcaatatgaaaagaatgcccccagatgagcagtggaacaggtcttgttttaacttactcctaaacagatgattttccaagctcccacgtggcatgaactcatacactagcagtcgatgctcatcctctaagcaatacccaaatagcttcacaaggttgggatggcaaaactgacctaggtaattaacttctgcctacatattgaatatttatacatcaaagttagaaaatatccaagtaacctttcaaaaggataaaaaaaacaagtatatgattgacaaaagctgtatccaatggtatacttaaaacaagcatggatttgaaggcaacacaacatagaatagcagtcatactcaccaaccattctcggtgcccttgcaaactctcctggttgagtcttttcacagcaacagcaattccagtgccaggcttgcaagcagataatgtattctcatcaatccatcctttatagacagatccaaaccctccttcaccaagtacactgtcaggacggaagttccttgtggctatcctgagatcactaaaactgaagatcttcacattggctgactgcagtatctcacattcagttttcgcagttggaggcatggaagctgaagaggctcgactactgcagccactaagcctactcccatctttagcaccactccttgagaacatccctgcatacatttggtacagttataatgagtagaaagcacatgactgcatttagctgtaatctagaagttctctagaaaaaagtcccagtactaatctttcccaggtccatagtatgatagcacagtaataatgtatataatgttctgaatgttcaattctatttttaaaaggaagctttgcacattaattaggaatcaactaaatcaatcatcagttgatccttcgctaaaatttggtatgagtcctgacagatgaaggatttgctatcagccaattgccacgcgcctacatgtagcactactagatatactagatttgctatcagcttacgaatgatgatgtgctctggtttaaaataacaaaatgacgattttgcatagagtagtagccatgaatataatgggaacagggggagttcccacccaaccagaaactggaaacaatcatatgcgctagtaaccttattccatcagaagtacatccgctaccatgcggctctccagaaagctcatatttatctactctatctttagtaataatacatttcttaagtagccgttatgatatgaatcaactaagttcaaatcaaaatgaagcacctgacatagaagtgagctatagtctttgtaattacatagaactttaatgaggcatacacggtcattttcatatattcagattactgaatactaagcaaataatcgatcttgatacaaccaaaaagtgtatgttgtaactggaaaagagaaaaggtttgtgatgttatgtctaaccgcctcaagccatgtaaagtacataatcaattattgacagaacattgctaaatctgggcggcaaaccaaattaaatagacaggacgagtaaaaaacacacacgatccaatctcataccatagcatcaaattcaaactaaataagaatctaagatttttcctcattctatcaataatttatgaactaacaacacataaaaaaaatcaattgcaatagagaaacaactaatctaacagtattgtttttcttaacaagctgtcccataaattcttttgagacattttgcaacaagaacatataatatgtcaactgcaaatattcacaacagaatgccataaaaaggttactatacgcattactagcagacttgcttcaatcaaatgttacctttcgtcgtcaacacaatatattatagacatcgtcatgccaattacgagctgccatggttggaggaatccagtactgggtctatccagtagatggtagtacaacattactacacatggtactagttaacgatatcaagcaatgaatgaagcctggatatccccatcaatacacataagaatgtaccccctcacctaataatttaaggccttagctccaatggcacaaccacctacagagccttacaggcacagcacagccgaagcttgaactaaacttctctaaaaaaaaagtgattgtaaagtcttacgttggcacatagcttaacatattgaggatgccacggtgtagctaaagggttgaaatcatctagtcaaattaacaattggatcatcaggagtatgcctatctaacaagccaaatcatccaaacaagatcgaagtagcttattcacctgtactgtggaaatcaaaatttctagaagaaaataacccgaatgctaatgttcatacgattgcaacacaagctaaattctgcgcagcaacaaagactccacggcttcgaaactccaccggaatcaccataaactaatcgaacatgccatcacatctcgtggcataaacaatccgagtaaaatggaaacggactgaaggaatcatgcatctacgcgattgaagccggcaacccatcgaatcatgaaacaaaacagcaccataaccaggcaaagcaagcacgcacgcaggcagcaagagagagagagagaggaaggatcgcgaagcataccagaggctcccggttgcgggctcccatccttgatccgcgcgccccacccacagcaattccccatccccctccaacaagcgactcgcccgcggcgccgagcccagtcaggatcgaaccaaccctcccgccgtcccgacccggcggcgccgcatggggtgaggggggaggagagctccacctagggttttgggggacaccaagcgcgaggcggaggcggaggcggaggcgttggctatatagcgacgaggacgaggtgcgctcgctggcgagagatgtggcgtgcggcgcgtgaggtgaggcgagcgagtgaggagttaatggcgggggcaagggaagcggccaagcggagagggagagggagcgaggcggcccgcgcagccacgccgctgctgctggctgctgctgcttcccgcgtggcttcttccggggaaaagggtggttggtgacggggagcgtggggaggaggagaggcgtcgtggtgcttggtgtgtgacgctgccgcgcggggaccaccgggcctccgggtgcgacgattttttatctttttaccgcttcacctctccgagttactgcgcgactctgtgagtgaagttacagtgacgtgagactctgtgggctttggcccggtaggcccactaattttattatgggctcgacttattatgcgtgagcatggcccaaataaaattgtttacacgcctgggaacacctgtaacttgccctccaacttatcaaccgcggcaaaaattaaattttacaacttcattttagagtaaagtttgatgttttttgatcggtgtttattttttaagtatttgcttttaagttgttacaaacacatataaatgttttacgtataacttttttttgttgctaacaagtgttacgacatctaattagttgtaggtgaaatgtacagattattttttgatgttgtcgtaatagatttctgtcggcaaaacgtgcaaatatcaaaggaagttttatgtaagggtggagctaatgtatttccgccaaaaaattgccctatgaagtacctttggtgcaattttaataccaacaatacaacatataacgatctctttcatttggattgcgatattcctttttcctccaaattaaattcctctgttgtaaagtgggctttcatgcctagtgtagtgtatggaaatatcttgatttcttgagcacaaatataaaaagtacgtacatattgtatgtgacaaagtgtacagatcctttgaaacacaaaaatcgggatctcaaaacacatagtatggatttgcgcctttgaatggtctatccaattgttcagtgctacagaacatctatttagcgatgtattaggattcattccccttgaactctgtctttattaataaaagtttatgagttttttttaaaaaaagaatggtctatccaattgttcaaaaggaatttagggagaaaaatatcctaaaaattatgacagtttaatcttagaaaaactgatgtggcacattgtgattcaatcttgatttttataactatccactaattaaatctgacggttgagattcttttgtgtgtaagaatttagcgtatagcatcaaattcgtacatgttgatgggtgagagggtataactacataatatgcctcactattttgtgtggggatactgtaatcccaattgtaagatcggataccgtaataaactggtaaaactagacaaaaactatcaaatatggagtttttgttttaagttttttttaatctaatctgtttctgagctattaacgttaccaaaaccttgttagtacggtaaatcatgttgcacactctgaaccgatcttgcttgatcatgactaaatacgaatattaaaccttcgtgatacaatcatctcattttttaaattcgagtaatttggtatatgatgcatttgttctactccaagtaccttctaaccgatttgaaaatgcttaccttaaactccactactcaacaactactagcgtggttgtttctcttttgacaacccgttcaaacaaaaagagatgggaaaaaaaaaaccggcctacaacctttgggccgggcgtgttgaacccttcggacccaggcagatctccccatctccgggacgggacccggcgcgcacgcgacccgacgcgacgacgcaagcagcagtggtgggtaagggtggactcgactccggccgtcgcgatggcggccgccggctggccgctctcctcctccgtcgccgacctcctccccgcctccctctcgctcaccctcctcctcgcctccctcgtacaccctctccccccctctgcccccttcctcctccgcctcctcgcgctacttatcccttctccccgcccctcccgtgcgcaggtggtcgtcgtggtgctggccgccgccgccttcttcttcgagcacatccgcaagatcggatgcacgcactcgtaagcgattctgtgactccccccaatcctgtcgttgtttttgctcatggcgatctgcgtgcgtgcggttgtttgactggtgtgttgtttctggatctcggccgcctgcaggctggagaggactgaagtctcggccgctttcttcgaggaccccaactcgctcaacaaggtaagcgagggattctgtttacccacttcaaactgagtatccttttcccgctatttgtttccggttgctcggactgtgaatgttgtgcgcgttaggtgtttgttcatttgctcctgtaaactgtgctaggttcgttgcccttcaatttacgaccctgctgagaagtacatttcgttgatcatccccgcttataacgaggagcaccggcttcctgaggctctcacagaaacactcaagtaaggctctgatatgagcatttcctgttcctgttgctccgttgtttggagtatctttgaatgatacagtggctgtgttgttctggtcattgctctgttatgttaatctctgtgttcttttgtttctctggtagctacctgaaacaacgttcagctgtcgagaagtcatttacttacgaggtatgtcagggcagaacatgctaacagctttatttgacacagtaatacatcagggaagaaaacgttaggctgattttgcaagcaaaactaatcaagcgtaaatgagaaagtatgcatttcaccatcatgagatatgttagcgagctggttaatcacttcgccacaatggtgacaccgtggcagtccattagtcttgcaatagtaactgtttctatgtcatatattcactttttacctgagatatatcaatatcttgtttggaatgacatttgaatcactgaatttgttagctaggaaatgcacagtgtgggagccaaacactattgatccaataaagcatttacctaaactggtgtgtcaggttgctcggaccttaaagataggactttgtatctagggtagtgatgttttgttgataccgcttgctctttagatcaattgagaccataagctatgatgcctttgcaatgcttctgaacatatcagccatatctctcaattatatcatgctctttaaacacatattatgtataactcttattaacatttgcactattatatactgcataacaccataaccagatatttggcatattattattgcagaaccttttattcataaatcctgcttaaattagctaacattggaaatcggagaactgatttgcttttactgaatttcataaaggtcttgatcgttgatgatggaagtactgatcatacatcaaaagttgccttcgagtttgtaaggaaacataaaattgataatgttagagttcttctacttgggagaaaccatggtaaaggcgaagcagtcagaaaagtgagtaaatgtaccagtcgatcccccccccccccccaactcccctcactagttcaataaacacacccaccctcacccaaactagttcaatgaaataagcactgattaattctttcccatctgtggaaaaattgtacagggcatgctccattcacgtggtgaactgttactcatgcttgatgctgatggggcaactaaggttactgatttggaaaagcttgaagcccaggtctgtcataagttaaatcaaaacatgttttataaagttttgttatgcatactttgatcgtgattggtaacatcttggaatcatatcgtgctcctaggttcgcgcattggctaaaaaggctgagtccagcctagcaccatctagcagtccatctcagagactatctgatgctgaaattgctgtttttggttcacgtgctcatctggagaagcaggctcttgccacagtaagtgccccccaccccaaaacaaaaaaccttttcaatcgtgcgtttttgttctcttagattttcatgttgtgttgtatttgtgcttttcctggcgtactgcagaggaaatggtatcggaattttcttatgaaaggtttccacctggtagttttattgacagctggtcctgggatcagagacacacaggtatgctttgcaaacataagtcgtaccattaattcatgtggacagttttgctttggtattgtgctatgaactaaattccattttcttattgctaatttagtgtggtttcaagatgtttactcgagctgctgcaaggaaactttttacaaatatcagattgaagaggtacctttgttgttatgttctctaaatattgtcatgcttctgtttatcaaatcctgtcttatttttggcgtgtaaccaggtggtgttttgatgttgagcttgtatacctatgcaagcatctcaggatcccaatggctgaagtatctgtaaactggactgaaatacctggatccaaagtgcgtatgacaagcatcctgcatatggtatttgagctcctgctgatcaaagtaggttatggactgagcatatggaaaatctattcatagaccatatgcacggtacgctgacaatcaccatagcttatcatcactggactgtataccaagcttagtctcacatgtaaaatttttccaagattttcacctagagagaatccatttgtggcgctgagtattccatcatagatttcaacaaagatatagatcacgtgtattgttcctgctgatgaaattctttaatcatttttttagcattttacgaagttgggaagaatcgaaaatttgactacccttcatgtttgatgtttgatttgacggatcgttttgtttttaaaaaattggcttgaagtactatgccttttggatggtctgaatggtgaataatggtaccgatcatataatcactaagtataccatctatatagttaaatcattagctatgtaataaatgaacaatggtgtgcttcaccgtctcggagaagactgtcaagaggttttgttgtctgccatgtaaaggtttgctgagaattacagaatgtgctccagaagccattttgtgaaaggacttgagctgatgttataggctatcagttgtatggcgatgttggtacagattcgactgcctatatacttctgacatcaccaatgcggtttttttagttttcacttaggctgtgtttagatcagtacaaagtttggattttggttgaaattggagatgatgtgactgaaaagttgtgtgtgtatgacaggtacatgtgatggaaaaagttagaagttggatctaaacacagccttagctattcgctccattcctcttcaattcattagtatttgagttgcaataaattatagatgactgaacatttacactctacaggtctaccggactttctggtagattatactctctcagattcttcatattacagtacggtatcatgtatcagctgaatatctcagctggcaacaaaagcatctcttcttttatctctttaaaatatgtttatagctgccttatagtatgctatgtacctgctctaaatagcttaataccataccattatcattaagtataccatctaggaagttaaaacattaattaataaaataaatctattacagttaactaaaggtattatacaagtcggaaagattggagtactaagggtgtgttcagttcatgccaaaattggaagttccgttgaaattgaaacgatgtgacggaaaagttggaaatttatgtgtgtaggaaagttttgatgtgatggaaaagttggaagtttgaagaaaaattttggaactaaactcggtctaaataacagttgatgtaaaagcatactaatattttgcaaagaaggccccgttgttttcttattgagatgtacagtagattctaccttggtttctattatcatgtttttcaaaatattaaatagtatgtttcgtgcaaaaactttatatataagtttttctaaaatatctaataaatttattttcaagtttataataataaacatttaatcaattataccctaatggcatccgatacaggagtactatagtatccaagagacgagtgggctgatttgcgaaaacgtattctgaaagaccaaaaccgagccgccctgcctcggcgcgccatgtgttcgagcaaatgcctcctccagtctcctccccgtcggctccgcgcctctcgccgtccgcggcgcgcgcggccgagcagcattgcctccgcctcctcgcggcctcctcgacgcccacgtccctcctccagtcggtcgccttcctcctcaagtccggcctccacgccaactcgctcgtcctcacccggctcttcgccgcctccgcctccgccgcgcccgcgctgctcgatcccctcgtcaccgccctcctccgcccctccgtcccgctcgacgccttcctcgccaacaccctcatccgcgcccacgccacctccccgatccactccctccgcctccgcgccgccgccttcttccccctcatgctccgcggcgccgtcgttcccaacaagttcaccttccccttcctcctcaaggcgtgcgccgcgctcccgggatccccggacgtcggcctccaggcccacgccgccgctctcaagttcgggttcgcgacggatcagtacgtctccaatactctcatacacatgtactcctgctttggcggcgggttccttggcgacgcgcggaatgtgtttgatagaatgcccaaggagagtgccgttacctggagtgcgatgatcggcgggtatgtgcgtggggggctgtcgagtgatgctgtcgatctcttcagggagatgcaggccaatggggtacaggccgatgaggtgacagtgattggagtcctggcggcggccacagatttgggtgcacttgagctggctcgatgggtccgacgctttgtggagagagaggggatcgggaagtctgtgacactgtgcaatgcactgatcgacacgcttgctaagtgtggagatgtggatggggcggtggctgtgtttgaggggatgcagcagcggagtgttgtttcatggacatcggtgattgatgcgcttgcgatggagggtcgtgggaaggaggctgtgcgagtgtttgaagagatgaaggttgcaggtgttccacctgatgatgttgccttcattggggtgctcacagcttgcagccatgctggtatggtggatgaaggctgtggctactttgatgccatgaaagtggagtatggcattgagcctaagattgagcactatggttgcatggttgacatgtttggtcgggctggcatggttgagcgggcgatggaattcgtccgtacaatgcctatacaaccgaacccagtaatatggcgatcacttgtttctgcttgtcgtgcgcatggccgccttgagctaggtgaaagcatcacaaggagccttcttcatgagtacccggcccatgaggccaactatatcatgctctcgaatgtctttgcactaacacagagatggaaggagaagtcagagataaggagagagatgagcaagagaggaatcaagaaagtgccaggctgtagtatagttgagcttgatggagaggtccatgagttcatagccggagatgagtctcacccgcagtacaaggatatataccggatggttgaggaaatggcaagagagctaaggcgcgttgggcacattgcagctacctcagaggtcttacttgatcttgatgaggaagataaggagggtgcacttcagtggcacagtgagaagctggcaattgcatttgcactactgagaactcctcctggaacacaggtccgagtggttaagaacctacgtgtgtgctcggattgtcatgcagctataaagtgcatttcacaggtttatcgacgggagattgtagtgcgtgaccggagtcgtttccatcgcttcaaggatggttcctgctcatgcaaggatttctggtgatgaaattgtgttttacaaggttattctgttttggacaagatgctaatgaattttccagggagctcctgcaagtctcacacatctgcattgcaacacaaaggttttccacagaaaaatgtgatgcttattcaaggacgatggaatcagaattggaatataattcaggtacttcttcttgtaaactgagtcttcttgatacatgcttttctttttggatcagctgtcagtataattcataacttttatgcaaatgaaccgtatgcacatccccagttcttgcatcaaaggttgttctaaaaggcctagagaaacataaacaaaaatcactatgatgctaatcacacaaacaaaaatcactatgatgctaatctgtgagcagtccaacatttttatacagtaacacactcagaaagtgtgttctggattttgacagtctatctgaatatacggtgcccacatttctgatgcacaagtcttcatcttatttaggctatacacaagttttgtcttatttcaaaatatgcataagcttcatacgaaaatttggaaatttcatgatgagcacaagttaattgcaaaaaacaaattaggccatcttcaagtgcagagggttcctacctcatactcccaccgtcccaaaatataagggattttgggtggatgtgacatatcctagtattacgaatccttatattttgggatggatggagtactatttattctgattgccgttttcatgtttttctaattttgatccatgtttgctgacaataattcacttgattttgcagaaaatatcaattatcaaggttgaacttttcttttgtacatacaccaatagattggatcgatcaatcctgaggcatcattaaattttgatctctcgacagtgtgaggttatggattctgcccgccgcatgcatgaaaatgggatcttgatctatctggagcataataaatgactggtgttagccccatggcttgaacgatggttcctgctgcaaagaattccggtgatggaactttgattgaccaaggttgtggaaaaccaaggggagtgctacgactttacgacagacaagaacgttatgtttggaggggtggaattttgagactagattgggcacatttcagaagaacacgaacttttctttttattttttgccctaaacaggacagcatgtgagcttggtgggatagagttcggtggttgctggtcggaaatgagatgtaagatcatttgaagaactgagagaagaacatggtagaattgcagagagccagtgacagataaatgaagtatttcactatttcggtttaacaaagacagatggtaattggtgacaagctaaagacagatagtgacaaaagattgccatttgatatatggtggtctattattgatgcgttcaaatctatattttctgcggacacaagttaaccaggctgtcaaaatattccatatcttccgccaagctctccatggaatgcacaaagctgcggagttgatctatttcaaggtcacattccataatctctttgtcggcgatggctctgactgcatcgaggacgccgtaaccctgtcgctcagcttccttgaggacatcggcccagcgagccagccattccattcttcttatgtcaagtactggcacgatctcgacggactcgccgatatcaaccaaggcttgttggagtctttcctctagttcatggagtttccaggaatctgctccttcaggtagggaaacgccgtctacctgagcgactgagtcataattatcaaatgacaacacttccatgtcgttaaatgacaacaccccccctttttttaatacgcgaggagcatatctttatattaagaagaaataaatatatgtacaaagcggacgaaaaaaacaaagcgaaagggacagggtacaggaggagaaccaaaaaccaaaagcctaatcttctactaaaatttgcgacccttctccactaacatgggctaccaaaacagggattgcagctctagctaagccgccacagctccgcttcatccgttataacccttgcaacctccgcccaagttttgctcttctggttgaagacattgtttttttttccttccagatcgtccatgcaaccaacgttgcgatggtgttgaaacctcggcgatgttccttgaccatcttcttacgacagtcgcacaaccatgaaaataaagagtgttcattgagcggtaagcactccgaatgcccgatagctctgagcgcaacccaccacagtagccgcgactccgggcatgcgaccaagagatgatcaatcatctcttcgcattgatcacaaagaacacatcgatctgagtgcaacaaaccacagctccggaggcggtccgctatccagcaacggttaagggcgaccaaccaaaggaagtagagacggcaagggggcgccaaagattgctaaattggcttgtgctggagatgagttctaccaaaaaagagaacacgataaagccgagcgggaagagtattctcctgaggtctcccaccgctaagatagagaccggttcttcggaaagctacactgaccgaaggcaatcccaaagcttaaaatattccaggatcgcttgagtacccaacaccgaactgatgtcctggatccatcttttgtcagttattgcctcggccaccgtgcgatgattccggagacgagcagggacggctgcatagacagccaacgccagcgaccgaatggaggaaccctgcagccagcaatcctcccagaacaacaccgaattcccatctcccaccaagcatacgtggaaatcgatactagattgcgcttcttctgcgagaccggaatattaagcccttgccgcggcttttccggtgaagttctctgctgccagagccatctcaacctcagagcgatttccaacctctctagatcggggatccccaaaccaccatactccttgggcgagcaaacttgagcccagacgacccgacagacgccgccgtttgcagaagctttgccagcccaaagaaagccgcggcagatcttgtcaatccctttgataacccacttcggtgcattgatggccatgagcaggtaaacgggaattgagctcagtacaacgttcaccatggtagcccggccaataggcgtcatcaagtgagacatccaagaaggcaaacggcgcgcgattttgtcaaccagcggctgcaggtcttccttcttcaggcggaagatggacaaaggcaacctaggtatgtgcaaggaaaggaagcgacgtgacatggcaactcatcatgaagagtttgaagatccgtctcattgcactggattggagcgccgaacatttagcaaaatttgttcgaagaccagacacttctccaaaaatggcaagaatttgcatggctgtgcgaatctcatccacagctggccgtataaatgcgaccacatcatcagcatagagggatacacaaaaaggaatccctagcggctgcagcaaaccttcaacctcagccttggagaagatggaactcagcacattcatggctaagataaaaatcatcggggaaattggatctccctgacggacgcctcgccgatgcaaaattgggcagcctggctcaccattgattaagaccctcgagctagttgttcgaaacaacatggcaatccatgagcgccaccgaaggccgaagcctttgtgctccaaaacttccaaaatgaattgccatgaaatggaatcgaaagcttgggcagtatcaagcttcagcagcgccgatggagtccttcgatcatgcaagcgtttagctgattgccgcactagcatgaaattgtcctggatgcaacgtttcttcacaaacgcactctggtttttagcgaccaatgcatccaacttcggcgcaaggcggcgagagagaacttttgtgaaaagcttcacaaagctatgtaccagacttatgggccgaaagtccttgagcttcctggcatccgacctcttaggcagtaaggtgatgaaagccttgttaaccttaccaaggctggacccatccattcgatgaagttgattcaaagccgccataatgtcctccttaatgatgtcccaacagcagtaatagaactgaccagaaaaaccatccggccccggggcgttgtcacgagggctgtcagcgattgccttccacacctcatccacagtgaacggttcctccaagtcagagagctgctgcccccttggctcaaagtagtcaagatccaccgaaaactcacgatgactgacagagccgacttcagagaagaaattatgggcaagggcggccttttcatctggggctgtggcgatctgcgagttgtgctcgatttgttgcacaaaattctttcgacgccgccaggcggaatgctgatgaaggaatcgtgtgttggcatcaccttcctgcaacctaaatgacaacccttccatgttgtttgaggacatttggctacggcgccgctttggattcggcgaggcctctagctggagcaacgctatgaactccccgatgttcgccgactctttctccagcgcctccacggcgccgttcagcttcttcacttcctcgtcactggagaagagcgcgatggctatggtgatgacgcgctgtgccatgcctgatagggccttccttttgaaggacaaagcagtagcaggcacagaactgctactgctgccttcctcctgctgctgctggtggtcgctggcgttctgaccagtggcttcgtcgacgtctgcttcccgctgctggaagctatggagaacctcctcaccacgggaggcggcttctttgagcttgtcctgccactggatcaacgcggcgctcttgatggcgcgcttctctgacacctcgatcgtgctgtggattttgatcagcagcatctccagccgctggagcttctcggcggtggccgtttgctggttgaagttcttgagaatcttggacaccgccctgtctgcgaccacggcggtcactgcggtggtgatggagcggcgggaatcgaacccgtatcctctcctcggcaaggagatgttttgccgcctgggtcgaccgtctatgtctgggtcgaccgtttcattttctatttgagttttctttttattaatttaattgtctgtcaatcaattcggggtgcaaattgcattttaatgcgtctcacaatccgaataaacggcccttttttattttgtattgggctactaaatactaaacacatttaagaaatgagagaatttagaatagctaccagaaagaccagtccaatccataatgatgtaccggaaaatacaacgtttttattgtttgaccaaccatcaggagaagcaaatacaaggggtacactaatgactaagactgaggaagtcacaattaatgcaaaaacagctaattggaaagcaatagtcatatttctaatcctccaagttaccatcaaataaagttgactacatattatatttgatccctcacttaatcaaaattgtaataaaatacaagaagtaagaggggtttaatcatgaatccattgattcttctctttaaaacttattactcaccactttttttatttggatatggggttgagggggttttatgctttatttcacaagcggatatagcggatcctgtatacatggatacagtatacagaaatatatcgaaaagggacttgtattcgagatgtttctagaggttagtgagtcatttcgtatggctatgttctatttgtaggaataaaataaggattaggctgtggagagannnnnnnnnnnnnnnnnnnnnnnnnnnnnnnnnnnnntatagttctaggaactatcgagggttcgaatccctctctctccttttgctttcctctctctcttttcttttgcgtattgaatacgtttgtttctttatttgttttttttgttttgtccccttatctttctttcatagaaaggaatgaatggctcggctagatagaatacccgagccagaacagaaaaaaacagtagaaccctagattgtttcttatggccataccgcctgaaggatttaatagggacttggtgacacaaactaggcgtgccatagacatagttggtgtcatcataaggccgaccctccatttatatttttaatggcggaaatgggccagccctgcattttttttaaaaaaatggagctacttcacatcagctaagggcctaagaactcactcaaggcatataagttccatcgccattattttgtccctttatagttgcacaacactacacaagggcatcaagttagttccacgggcaaaggtccaccaagaagttgaaacatggcatgtccaatgccaacctatccacagtacgcgcaaagccgtaaagatcatctgctttctcactgccagctttgccatcgccgtcacggccggcgaagattgtgccaacaaggacgttgcctctctgctcagcctcccgtagaatagccgcccactgtcccagccatttgaaatcgtccaagtttctttcatctgcctcctcgacagccctgcccatacagatcagcacttgttctagcatttcggcgagctccttctgatcctccactagcacctctgtattttcaagctcctcactcgtgatggtctcctccgtctttttagttgatatcttcagattttgcattggcaatgtctgggtggataatagcctatgaagtgacatgacaataggttcagaactctcctcctccgtcttttcagttgatacctgcagttttcgaattggcaatgtcagggtggagcatttggttcttcggtcgaactcaatatgttgagaacgcttcatccgtttgctaggtctcttctccagcttcggtgagacctccagtataaactcttggatatctggagacagctcccccaacctctccaacgatccattcagcttttccatgtcttggtcgctcgcgaagagcgccttcatggcgctgtgcatccgccgtgccatgccagagagagcactccatgtgaagaacacggcaagggatgcgccggtggccacgccggctctgctgctgccgccgccgctgctttgctgctcatcatcggaagccgcgaagcgcccgataaccctcctcgacggcttctctgagcttctggcgccactggagcagcgagctgctctcgatggcgctccggatcctgagcagcagcacctccagccgctgcagcttctcgtgtgcggtagctggcgcctgcagcctccgcccaacggtggatatcgtccggttagtgatctggccgaccaccgcggaagtgactgcttgttctgccatctctcggtaatgttaatgttaatactcgtcgagtgatcaatctcgccagagatcgatatatatacaacaagtacgttatattctggagagaaaaacgtgagcttgatcttactagtttcatatatacacaacaagtacgtaatattctggagagaaacgtgagcttgatcttactagtttccatcgccttacggtgatgctcttgggacagaggcagacaacaactgcagattggctgggcacatagtttgtatcgggctaaggcctgcaagaaataaaatggtcgtaacgacgtgttgagtttatcagtatgacagtatctggctgtcctatttaaaaaacgccagcactgtctcatctcggcttcttggatgtactacaatgcacaagcttcttggatacagaggagcacagcctcacgccctcacgtggagtcacggttctcatagcatagcgcgcagtggacacgggtgattccttcctgctgctgctgctgatttttttggtgaacgcgtaaaaaaattatacgtcgatatattagaggaaaaaaaattttgttacacagtacaatcgctgctgctgggctgcccgctgctgtggaagctggggagagcagagagcctcctcgccgtgggaggcggtctttgtgggcttcacacgccggggtggtttagatgggccgcaacggagcacgtggaaagtgaccccgtcccaaggcctcttgtaggccgttggaagagattacgcgaaacatatgggcctcttttcgccgatgtgatgtactcaacccacggtcttacaatggggcacggcgccaaccagcaagagaacgaaacgctgctgatccagacgtcacaagcgcaagaacgctagccatctaccaccatgtacagtagtaacacgacgccaacccaaagcttcgtcaaaagccaaggggcccctcgtactacaactctctctagatcgatcgtcagttctctcgctacgcccggcgagaacaacggcgaaagccggaaagagacgtgacaccgccgttccccaccgcacggggcgttacgaccgtttcgccgtagcaaccaactcataatcacacatccatgcaaaaaaaccgatcgagctgtttcccggccgtagcagcagcaaaagtcaatccctcacttctggaagcttacttaacatgcaagtaagaaaaacaaaatccgacgcatgcatcgatccatttctttaatttacggtcaaatcagtcccatgaaaaccaggaggatcttagtagcttaattatctgttgacctactgtgcatgtccgtaatttggtggcgctggcctgaaagcttctccagttctgactttttgcaggcagagtgtgtatagctagtgctctgactaatccggctctcgatcatcagctgatctgcttcttgctggaggtttaactgtgaaatgatggtgtctgctctgcttttccctttgctccttctggaaaggaaagcataaacattgacataatgacaatttcagatcttagtgacgacttaatcttggagatcttgcatgcaattatgtcagggtcaaactttaattggttagtttagtctcgacctctcgttgtgtgcacctcacttagaatggtcagctagctaccatgcttgcatgcatacatgaattcatatatatacaaactggttgaacaaaagctagtagtagtagattagtcagacacttctcctttcgtttaattttaggtgtgtgaaatggtcgttgaacgccaaaatgtctaagtgggcttgcacgagttcaacgtacgtaccaccaaattagctttcctagtcataaatcacaaagtactgtaatgagtactaaaataagtcagctggtgtcatcaattatatattttcgtactccacgattagtccatatatttaatttcagtggctgactaaaaacgcaagccaattatagcttttccagtacacagtattataagcctgtcatatatacacatgatgttgtttcaaaatactactacaaatttactcgtatatattgaactacaatcaagatacatttgggtatttcctccgaccagttcgatttttatagcttctttagtaatagtaacccagtttggtttatgagctatagtgaaacgttgaaatcaatacaattgccagacaaagttttttattaaaaagattgagactacaacaaccaagtttatttatatacggcagctgctagcgcacgatttaaatatgcaactccatgatccacatttgactacaaatctacaaactaatttaataaatactagtagcaaatacattaactattgagtcaatccatagggagcacgcctatgtagaccttggctttgtttggaaaaaaaaaagcaatatgttttttgtttaatcccgtatgattgttatttgcatgccgacgtgaggatcaacctaatccatgttagcatgatggatgcaaaatgcaattaagtatttgattagtaggccggagttagtgggtgcttaccagtgtgcacacttggaccttaactttttcttacttgaaatactataaacaaattaaataaatcctgctcttagtaatttgaattatgggggtgtcgtcaaccatgcattgataattaatttaagaggccatcacatactagggcattgacttgtgctactgtcaatccattggattggattagttgtaacccacctgttttaaaacttttgatttgtatttctttttaggtcatcggaaagataccaagtacaacaaaaaatgttggtgcctcttgtcggctcttgttataatgtcagtatggtaaaagaaaaactatttgatttatggcagatacaaattttgagctggtgaccagctcgagatcaattgcaatgtcgtttaatatatattaaggaataatgattggaaaagaaagtcaaaacgatttgaaaatataatatgcactgtattgtatcgtacgttttcatgaaaattcaaactaatcttttacgtatctgggtcggtacatcgatctgcttaatctgtattgaataccacttgaatgttgaagcccaaaacgtccaacaaaaacagatcaatgaaaccaaatctcaccagctctgtttttttttcctcttgtacgactctaattacgtgacgtattaattttatcaacatgttaacacagagttgagaaatacacatgacgccacgatttggtaaactgcctggttggtctccaacatctgttctttgaccaggagaaaaaaagcaattaattaaagcagaacatatgcaagacatcaaaagggtaagtgagccttttggttaattactaagtacatttatcagggcatagcaaggtgaataattacatgtacttcattatgcatcgtgatgatgcatttcctgtactgtttgcacatgcatgcatgtggggttgcacatgttaggttaagatgttgcactgtaaagagccttcagtttattcaacaaattaccaccttttttttttcatttacctcccaaataacaagacaaagaacgccacagctagtaaaatatttcacggtgaattcagagtttggggcacatgcatgcatgaaagcgaaatggtaatgttttttttttactacctttgctgaccacagctttttaatctccaccggctgcctaaaaaaaattctgccctttgtcaaagcaagtaattaacagcgcagctagctgaatgtgactgtccatctgccttgctatcttgagctgtaaattactcatgcagtttacttgtctcctgtcagctggatagataaacaaaagccaaaacaaggaacagcaagctagctcaaattggaaccatatgttcttagtattttcttgtgtatagctagtttgatggtgagctctccctttgttttccatgaatttgagccatggggtagttgaatgttggggaacaagtgatggcgaccgggaaagggggtgacctaaaagtccatccatgcatgcatatattcaatcccagctgatccccacgacaactgtagtaggagtatatgtttttacaagtcaacgatcaagacgagagacgggtcccattgctgctccatatgttaactcatatggtccagaacactcatcttagccatagacccgaatcagattctttgtaagaggtatatatgggcaatatggccgtataggtatcgagagatactagcaattaatcttgtcaaaatgtcaattatgttataccattttaggattctactcttctaattaagtgtcctaattctacaattctagatattagtatagaatatatgatcttatgatcgtacttagagacctgattgggtttaatttaacagccttactaacagttactagcactagaaagtgtcaaaatgactgtcactctacaaaagatgcatccttaaacactatcataaatatttaacgtttatgattaaatttagtcaaatgtttaaaatttaaaccaccatcaatttttaaatgcttagttagtggaaaaaatatggttcgatatagatttagcttaaaagacaccatctaataccaaatatttattatattttttaaaacataatacaaacacaggctttgaaacacacgtgcactgatcatcatcaaagtttcaaacttttaataaaatcttgtcctagcgtatttacaaagacggagtatattaaaaataagaattctctatcgcgcttaccgctatacagagtcgccaaagaccaaagctgtcatgttgttgagggcaacggacttgatcgccgtgcacgaacggttgggagcggcctgcggtcggagaattggacgaaaattgccagcggcggtgcgtcgtttcccagtccattttttgttgttgcgctccggttgcttgcttgcttgctttcccgtgatgcagggcagcaaaagctgcctccgtcgcacacacgaccaccatgccttgctctgcaaatctgtctttgcacctgcaccactgaatttgtctatggctcttgtctactctacgcacgcatgcatgcatgaacacattaataattttgcttctacaaatcttacgaaaagaaatactgaccattaataataattccaactaaaaccattttttttcacattaggttctgcatgtatataatttcatgaattatgtttaacatggtttgggtatatatttggaatacgtacgggaaataaactaatttatgaggcgattccgtgagatctcatggtacaaaaatacggagtacgtgtgatcgtcatgttgacttctccaaatacaaagcgtcatgcaaccggtacctatctcggtttaccgagtttgaataattaatacgaaaaggtaatccggcgccggccacggctcggaaaccacacgaacgcggtcgcgtcatgggccacagaaaaaactcgaggttattccacactcacccccatcgtgatccagtgattgatcatcagtagtaggagtacgtgccacgaaaggagggcaaaacgaaatgtcgtctcgcgcgttttgtccccgcacactgttgtgtttcccctttgacccgggcaagcaagtaagcaagcaagcaaagcgttcgcgttgccatctactcgtacgcacaacgcgttggtggtcacctgtcgtcgtttgcgccggcgcgtttctgccggtgtttgtcacgcatctgctcgtcaaattcttgcctatttccccactccccagcgagagagcgtgctgagcgaaagcgagacggagcagcaacgaaacaaacgcattcggccagagcttaggtgactcggatcggatgcctttggaatttgcaggaccagatcgttggcaataaagcggtactgcggtagggatccaattggacctgagaaaagcacgtgcagcaagtagcaccagtgtgtgactagtgcagcttgcgactggcacacagcgatatgatacagcgtgctgtgactgtgcgtagctaccaaaaatggaaagcaggttgaaaatgggcacatggaaaagcgcagctggactgttgagatcgaagtcaatactccctccgtccttaaaaaaaagataaaccgcagttttctgtgccaacgtttgactgtccgtcttatatgaaaattttttataattagtattttcattgttgttagatgataaaacatgattaatactttatgcatgacttatttttttaatttttttcataattttttttaaataagatggacggttaaacgttggatacggaaatcagggtttgtcttttttttttaaggacggagggagtactacttacgcaactactactaccgctggtactagtagcgttagatttgatatatatcgagcagcaaccaaccggcgagttccaaaagcctccgatcatccaacgccggccacacgcgagcgtacgtgcgagaagactctgaccgactcaaacaacggatcctgaaatcatctattgtggacctcatcatcactgacccccgacaattagtactaggagaagaggggggaaaaaaagatccaaccgtcccgctgacttgcggtgtgtggatagcagaaagcgtacgtacgttacgtagcagcagcagcagcagcagcagcagtgggcgtgagccgtgaggtgagccacggcccacgcccacgcgcgcgccgtgctgaagcaggagcagtcgggatgctcgcgttggcgcggcgcccacgtgaaccgagggcgccacggctctctacagtctagtacaccccagccacacccgcggctgcggctgcacggccgatcgattcggtcacccaaactgcgtggcagcgtggggggcgcgcgcggatggacaccgcgtgagtgcgtggccgcgggcgcggcgcggcgcgacgatcggctacgcgggcgttggggttggggacttggggtaaacggggaacgcgtccagtggcggctacgcacgcatggaggagtcctcttcggcgccgcggctcgcgagtcgcgacgcccacgtacagtaggccactacgacccgttctccaggctgatgtctccggcgccgagcaacttgtgccgttggggagtaatggggtgtaaatggcgcaacgtaatactgctacttgcgagttgcgatttcacaaaactatagctacattatggattattgtcgttttgtaacaaaactataaatttaagttgccacatgatcactgtagcctattgagttaataattccctgggacatactcccttcgtctcttaaaaaaaaccttctagcaatatgtagatagagtatgtacagattcatgatagaaattcgtttttattcctatgtctaaattcgtagtcagaaaatcatttttatatgacagagggtgtacaatgctatatagatagaaatactctagaatatgtatttttcatgatactattttggtgttaatatgtggttttacgatattataataattttgacgctaaattcttagttttgttactatatgtaattttacaaaacaatttttattttttttcaaattacttcgattgctaggttttgcttctataaatttattactttcacaaactatagctatatatagattgtttctactcaaacgtactcctttctgcgaaagaaaaataaaatccttttttaagctgtaaagttgattttttttatcaatataaatttacggtaagctcttcttcaccttttcttataggcacctttatattttctatattataagatttgtcaaagcacatgaatgcatcacggtgaagaagaaaataaaacaaaattacatccatatataaacataatatagtggccaaattgctttccattggtgcgtacaaatttagtcaaactatctgcattattattacaacataaaagactattttaaaaggtatagaaaacaaaaggtgaaaaagaagaacatgctattttctttctcgatggttgacaaaggaaaccaaccgatccaagcaatggcaactggcaagacaaggtgcgcctccttcacagtgtgggccacacggacgcggggcgcagaaggtcgcatcaggtttcccgcaccgaggcgcccgcccggacccacctcccaggtcccgcggctgctgcctcgcctcgcctttggcgggctcggacgcccacacgggtcaacgcctagaggtggaaaccaccttaaaacgatttttgctacttccgtttcacaaatgtaagtcattctagtatttcccacattaatattaatgctaataaatctagatgtaagtcattttaatatttctcacattaatattgatgctaatgaatctaaacatatatatctatctaaattcattaacatcaatatgaatatggaaaatgctagaatgacttacattgtgaaatggatggagtatatacttataggcaaattttttttaaaaaaaataatagacgtaaatattgtacaatactacaatcatagtgtaattatattgtgacatgtatataactataatataatgtaattcgtgcaagagagaaaataatcacaacccacacatgcgagggaattttaggtggtgttcttttcttctaaagataaagatgaagattaaattttttttatgcaaaacgaggtggtattaacgtatgcttggttgagttttaattattacacacttcaaaaatatattaatatgatattatagagcaacttttatttagaaagttttcgcacgaaacacaccgtttagcagtttgaaaagctttgcctcaaaaaatctttatcttcatctaactcttattggagaaatgaatgcgaccttagcaccattatacattcattttcacaaagaaaatatatcacctaggaatttttaaaagttacatataagttacgctataattacatatcaattttgttatatttacatactttctccgtcccaaaatataatgaaatcagataatcggatagaacatttcgtattgcgaatttggacagacagcccatatagattctacctccatctcaaatatatacgaccatgagtttctatacccaactttaatctcccgtcttatttgaattttttttatgattaatatttttatttttattacatgataaaacatgaataatactttatgtatgacttctatttttaaatttttccaaatatttttaaataaaacagataattaaaactggatacgaaaaattatagctttgcttaaaatgtgtattatattttgggagggagagagagagagagcaggagtatgtccaatatataggtagtcgcctagtccctcttaaaatattccggcatttcaaccccacccactccgcacccccgcaagtcaactctcttccttcctcctccgtgcttaatgctctccgcattataaccacccacctctcctcctccccccacctcctctctctctatctccatctccaccgctacgcttcccagccatgggcaactccctcgcctgcttctgctgcggcggcggcgccggcggccgaggcggccgccacgtcgcccccgccgcgctcccctccgacccggcctacgacgagggcctgggccactcgttctgctacgtccgccccgacaagttcgtggttcccttctccgcggatgatttggtggctgacgcgaaggcggccgcggcggcggagggggaggcgaccacgttccgggcgatatccggggcggcgctcagtgccaacgtatccacgccgctgtccacgtccgtgctgctgctgatgccggaggagtcgtcggcgtccgccaccgcgtcgtcggggtttgagagctcggagtcgttcgctgctgtgccgctgcagccggtgccgaggttctcgtccgggccgatctccgcgcccttctccggcgggttcatgtcggggcccttggagagggggttccaatctgggccactcgacgccgcgctcctctcgggccctctccctggcaccgccacctccggtcgtatgggtggcgccgtccctgcgctccgccggagcctctcccacggtggccgccgcctccgcaatttcacccgcgcgctcctcgcgcgcaccgagaagtttcaggattctgcggatctaggctcgccggacgccgccgccgccgccgtcgccgcctgtgggggcgatccctgtggtctgcagtgggcgcaggggaaagccggcgaggaccgcgtccacgtcgtcgtgtcggaggagcgaggctgggtgttcgtcggcatctacgatgggttcaacggccccgacgccaccgacttcctggtatccaacctctacgccgccgtccaccgcgagctccgcggcctcctctgggatcagcgggagcagaacgtgcagcacgaccagcgccccgaccaacccggctcagccccaagcaccacggcctcagataaccaagaccagtggggtcgccgccgccgcacccgccgctcaagaccgccgcgtggcgccgacgacgaccagcggcggtggaagtgcgagtgggagcaggagcgggattgctccaacctgaagccaccaacgcagcagcgtcttcgttgcaacagcgagaacgaccacgtcgccgtgctcaaggcgctgacccgtgcgctgcacaggaccgaggaggcttacctggacatcgccgacaagatggtcggcgagttccctgagcttgcgctcatgggctcttgtgttcttgccatgctcatgaaaggagaggacatgtacatcatgaatgttggcgatagccgggctgtgttggcaacaatggacagcgtcgatctcgagcagatcagccagggttcattcgatggatcagtcggggattgcccgccatgcttgtcggccgtgcagctcacgtcggatcacagcacttcagtggaagaggtgattgaatcgactcatatcatggttcaatcctattggaattgctgttcttaatgttgcttaagtctcatatttgtttctgcctgaatacaggaagtaatcagaatacgaaacgagcatcctgatgatccatctgccatctccaaggatcgcgtgaagggctcgctgaaggtgaccagagcatttggtgctgggtttttgaaacaggttagttcatttgaatatgccctttttttttgcagaaagacatttttttgtgctccgttatgattaagcgttttgccattggccaagtttcaaagttgcgtatgtggatttattttttggcaagtaatatgcaatttcagaatgacacaattagtcaatgtatgaaataagtatgtgacctgacttccttccttgaatttgggatctgtattgatgataaagcatacggtccaaacttgattataccaggagcggaataattaaggtcagttttgctgctatcctgagtcaaacacataattaaggtcataattaaactaggtcagaaaaaggaaaactggatctggtctaattggtccaaagtttgaaaagtaaagtgagccactctaaattctcacttctttggggtgagaaatatgaccatcctacactgaaactgaccatgtctgacggggacatcataaaccatatgctaatttcaatgggcaaaaacttcaacgcatgaaaactaattagttaaattcttgagtcaccgcgtgtatagccagttcaaaattttgaatgagaagctgctccaagagaaaatgaagtttcttttgcttctgtccaagtacaaagaatctgcttgtgcagtactaaaatgtggccagaaaagagtgagttgagtggctttgaaggaaggtacgtttctcctcccatgcgaagaactattctctattgtcaactgcacaaatctatcttgctgctatgcaagagggaagtctctttcttggacataaagtgagctatctgatgagacagacatggcgatctgcgatattttgtcaatgaagaaatcccccaaagttaagcagcacagagaattgaacaagtgcatgaggcagccctttctactgatttagttgtcggtacaattttcagatagcctggttggaagttgcaaatagttaattttacaagcaaatccatagcgaacaatacatgcatcatttgtttttgctctctgtctgcaccttatatcataattccttagcattttgatctcacaattctctctcttttttaacagcccaagtggaatgatgcactcctggagatgttcagaattgattacgttgggtcctccccatacatatcatgcaatccatccctttttcatcataagctcagcacaagggatagattcttgatattatcttcagatggactttaccagtatttcaccaacgaggaggcagttgctcaggtcgaaatgttcatcgcaacaacccctgaaggcgaccctgcccaacatcttgtggaggaagttcttttccgtgctgccaacaaagcaggtgtgtttgcaaagaagtcaccatacatgtcaaatgtgtcgacctcattttgcagtaacttttgaacttctagaacatgatgctgaattttgtcagtcaatgacctgacctcatttttacatctattgctgttgcaggaatggactttcatgaactgatcgagataccacatggtgatcgtcggcgataccatgacgatgtatctgtcatcgtcatctctttggagggcaggatttggagatcctgcgtgtaaatagaaacaatagtaggctagtgaaacaaaacgtatagagggggttcttcccatgccttccttgagctgagaggtgttcttgcggctactctactcctcttcccccagttgctactgtacaatatcaaccaagcactgtggggggttggattcggcttgggctctcggcacatccagctgaatcgccatgaatcgcccgcagggctggccgcgtggtataatatgttgatgtaaatgaggatttgttcaattattaataatttataaaatcgaccaattggtcaactttctttgacattttgcatgtgtttttgttcatgcatttggggggtgagaatttgcatgtgcatgggagactgattctaagttggacttgatgattctagagaaagggttccttttggtcaggaaccgtttgctgtgttgacctcttaactgatgatagcaccagagctaccccaatttgacctttttttaaggcacaccatcttgaacaattcagcaggcactgccaggttgcctgccttatcagttaacacgatgatccctgggttatccttgccatgaatgaacctaagttgacctctgatctatttactacatacaatcaatgtgcccttgtgaaattaattttgtgtcttggattcagcacctcctcttctgattggctcaaagatcaggtggctgattgctcctcaccaataattgacatttctggccatgtctgcaagtggaattgtagattatttcccacttgcttgcatgcactccttggtttcaacagaaatgatatcaaatgatgaacaaagcttatgttaaaagaaatatatttctatgcaataaaggatgacaaaccggcgcgtataggcgtatatagctttgaatttttttccccataatcttaaaagtgagacatagtcatcttcgaatgttttaaatagataacactattgttaagcaagagaaagtaggaacaggtgcttttctttaaaaaatgtatgtttttttttctgattggttgctagagcgaaaagaaaggcgatcgtgcgagggcattttcctggtcatgtctctccctcccaccactatgcatactgacgttgagttccatttctgcactgcaaagttagaactgttattttccaagcaagggacgcttttttcatacggttgtagagggggtccttcttttaggtacacagaattttctttacggttttttaggtacacagtcacacagaacacatagttggtcatggagcttaccacattaaggacctgtttggtatagctccaactcctaaatttagctccaagagttagatttctagtggagttgtggagctgcttaaatccagctccatctctctagctaattttgtgagagaactccacccagctttgctcccattttaggtggagctaaaaactgtttgactgagcttcagctccaaaagaggtggagctggagctgtgctaaacatgccctaaattattggaaagtatcatacggcatagatgaaatatttcagcatgtggtttccttttccttttacatgaacacagttccttagaggataaattcatttttttcaaaggcaaaacatgctgctaatttgcaaaatcagtagtgcaaaaaagagagagagaaggggggcaaaatttgcattttagacgggcctagctaaaaaggccaagcccaccaatattgttccctttgacccataaaactatgggccatagcccttctgtgcccccgggccgccactcctacttagcagcaacccctctccgccgcctaaaccctagcgccgccgccgccgccgtcgccatcgccgttctcacactccgtcggcgtaagctcacaggtactccccacgatgacgacttgcttctggtgagttcgtgtgttcaacttttgcgcctacgggattcgatgggaagcttttgtttgtgcagggacggtaagatggcgccgccgccggcgaagggcggcgctgtttgttggtctgagatccatcggctacggcttaatggctatgactattgggatctgtaaatgagtaaggttgcccgccgccaacctgattgtttatttcttgtgttgaaaattgaaattgctatgctcgagctcgactgcagtgttaattagtaccgtaagtctttgaaatgctagcaaatcatactagtacgattgtgatgcggctgtgcttgatcagatagagacattttcagaatccgaagatgtcactgtacttctgcgattgtgcttgatcgccgcgttatcttttggtcacattagccacgatgctgaatcagttaacaatctagataccgctttgctttctgaagtatatttgtgtataattgtatactaggattgcacgatccctgaagatagtttttcccttgatggttcttacttgatgaacttggatgtgccgtgtgaagcacatattgtctgtggaaattccaatgactatgtgactatctgttgatctactgctgcatgtatgagaacatggtatgctggcttcagtgctttctatacctttagctatacttgtggtgacttgcaggtgctatgattaaccatgtccttgaaatttatttacacacttgcaaaaaaggagtattttattttgcatatatgttgttgagatcttgatctccaggatgaaaattagttgattcaatgatcaaatttttaaaaccaaaatttgctaaagcgtttaagtaagaaacgctgaaccaagtgccctaagggaattctactgttaggtttagctcatttattttgtgtcttatttccagtcctcagcttttcagtataaaattggtggcgagtcacttgtcttagaagcttatcctcttttctttttctttttgttttgcatatgttacactgttgccatgtgtaataaacatgatgcatgcatgattgagtggctttcccgcagtgtacttatgctgttcattaaagaagttattggattttcttaatctatattgttatcttgtaattttttgaacagcattaatgaaagcaacgagctttcattttccatatgaaaagatacagttgcattatgagtgtaatattgaattttgtttcagaaaactaacaagagggtcctttttgttcctacttgcctaggcaagtagccgggttagcaccacatgagaaacatatcaccgcgcttctgaaagccagaaaagaaagaaaaacgtgcagtcgtgcgctgaaggtagcaaaaagcacactagctagagagctaagacgaagcgtgaggagatggccaacgttgttaggaagatgaggtacgtttcctcctatctatctctctctttttggtggcgaagagaatgttgccaaatttctaaagagaacctgcttttgttcgaaggccataaagtttaagtatcagagctgttatgactctaactaatcatctaaagttggaccaacttgaacacaggccacctttggcttagccctttagaattgagctgtgcagcagtgctatccatacatcgctatatatatctcattcaaaaaacggtcatgtggatgatagtgtaggatcattattgcatcaatactatcagttgttttcattctttgcctacttgaattcttaactgcaatctctgaagaattgacaattggtgcaagttaaaatttatattttcatttttgtctctttgtatgctacaagatgatgttcctaaatttttttgctgctggactttgtctgccaatgtgaggttaatttggtggcagtttttctgttttgggacaatgtaattcttgaaaagaatccttttaaaagaatcatcgattcctagactcgaaattgtggcaaagcttctctttcactaaatcagtgagtataccagctattgctattgattgactaacgatcatgccattaattttccctccacttcaacaatgcgtcagacatgctgtctgttatgtaacgtatatattttcagaatctttggcagttgttgattagtttcagaactgagatttatttaagatgtgtgtgctaacacttaaagatagttgcattgcaatattctgtacacataaacagattcataacagtcataagtcatatacattgaaccaattataaactgcatgcttttcctacaattgaaatcatcattgtatagcacaaggaaaacgagaatgccttgggataaaattattgtcataaagaggttacctagtctgctaccctctactgttgtcatccatttatgtgcaaatggaggtttaggtcatgttatatatggatgtggattttcatcccttgaggggacattccctctttgtttgcatgtcatctaaatagttataaaaaaaattgaaagaaaaaatgacaacatagattaatacgaattatatcactccacaaacatgcaagaccaaattcaacttctataagttgcaacaaaaataacaaattaaagtgaaaatagttatcgcacattcgcagctatatttgttgtttttgttacaatttgtagaagttaaatttaaagttgcatgtttgtggagtgatatatttcatattaatctatgttgccaaaattttttttcatattttttgatgactatttaggtgacatgcatgaaacgaggggatatcccctcgagggatgaatttactttcccgttatatatgtccatgactctacttttcatgatatatgctgtggtgtttggcatcccacatggaagctatccaattattgtccaaagagatgcttgtatatcctgtaggatatagactaataatagggaggtgagagaactattttgggtcttgggatccagcatacatctgaattgttcctgtcaaaatctgccagtaatttttttttgaaacagacacgatgcaatgtttcatattggtatagcaggaaaaatctgacagtaatagttgcactcttgcctgaatatcctctactgtagtactaagctaccgaaaccaacaaatttatagtgcagggattgagaccaaactttgaaatacaatgttgatgttgtgccacccttgaacactttcttattggtattcacaatatactccatctgaaagtctgcagatctgctggagcttctgacaagaaaaatgaaacagtgcaacttcgtgtgaagacatgcgagatgcgaccactatggttgaaaaaaagacattgaacttcggtaaccaggtgtgttcagtataagacattactgtttttcagttagacttagtgttgatgttcgaatgttcgaccatgccctttatagttcatgagcactgctacacttactaaattctcttacgtactaacaatgatttcaaccatttgatttaactgcaggaaatcgaaaggcatgacgcatcagtattagtttttggaaattgcatgaacccacatgtttacactcatggaatttaattacagggactgatttttgtcaaaacattgtatggttaacccccagcagtgtactttagtattccggagctgcatgatagaaattaagctaacttctgcccttattagtattacctccgaatgcatttggcactttggcattggcatgttgtaaggagtgcggttatcgatcctggaacaaacagaacacggtcagtggctcgtctcgtccactcgccacttctaatcaacattctgttgcctactccatactactccctccgtcctatattataaggctttttagattatgcgacacatcttaatactataagatgtattatatgtacccaaaatcttttataatatgaaacggagggagtactatctgctatgacgctggatttctgtcacgacggagttgtggagtgcttccctgcagcgcacatactctctccatctcaaaaaggataatttctggttacgaatataaataagattcgtagctagaagttttgcttgcccgcagcgtacatactctctccatttcaaaaatgataatttctggttatgaatataaataagattcgtacctagaaatttatttattagacaatttatttattagacaggggcgtaagctcctgcctcgccatccaatccgtcgtagcacgagcggctggaaatgaacgaagacgtcacacatacaatccggcgaaaattccaaactcgaggtggtcatttcacctcacctgtttgcagaggcggccaggcaagcgatggatcgaggcgacctgtgtttgttgttgtgcgcgccaacgcgacatgcgctcgcgcggagagattccgtgtgccgtactacgcgcgcgggcaccaccttgcctgcctgtacgagcgctcgagctcgctgctattacgtacctacgcgcgcgccgggaaaaaacgccaaaataccgtgcaatcggcccgattctcccgggcgccgcgtggtggcggaatggaatcgctcaatcgcacattcgcattcaactgttctcgtcaaactttcaacttttcttttttcatatagaacttttctatacacaagctttaaacttttccgttatatctttctaatttcttcaaacttctaattttagcgtggaactaaacacagcctaaacctcatgattttttacagatcacataatcatgatatatacagtaatcgtacgacacagcgagttgctgaatgcttatagtgatagtgcgagtgtgaaggtgaagcagctggtagggtagagggcacatgtcatccatggaggcccaaagtaaagggggagacaatgcaaaggtggtgggcggattggacgggataatcccatttcccatagagaccgcgacgtcgagagagagtatcgtacgttatccccgggcgggtggggggacggtggacgagaatcgaggagggtgcagctgcagtgcagggacaggggaccgatccgaatctgcagtgcagttaaagtttgggcagcggaggcttctccttgacgcttcctcgatcgatcatcctgggcgcatgataaaaagcggctcatgtgcgcatgcatgacaaggacgcttgccgccggcctcgcgacccagagattccacggtcaaatcgcagtgtcgatcgatcaccaccccgtaaaaccacagctacttcctctgttttataatataaggccatgtttagttcgtgaaataaaaatttttggttgtcacatcggacgtttaatcggatgtcagaaggggttttcggatacgaataaaaaaactaatttcataactcgcctcgaaaacgcaagacgaattttttaagtctaattaatccgtcattagcacatgtggattactgtagcacttatggctaatcatgtactaattaagctcaaaagattcgtctcgtcatttcctccccaactgtgtaattagtttttcttttaatctacatttaatacttcatgcatgtgtctaaagattcgatgtaatgtttttgggaactaaacgggacctaagactttctatattaccaacatttatttagatgttaatgaatctagacatatgtacgtgtttaaatttattaacatctatatatatgtgggtattgatagaaagtattacattgtgaaactgagggagcactactactctcgatctggcggaataaagctaagctaatccgacggccggcccaaagcgaagcgacctgccgagaaacgcgaaggaatttcaccccgcatgcgatcccgatccatctcgcgcgcggtggatcgatcgttgtatcccacagaactcgtccgcgcggccgtgtacacgggcgccgggcgcagatggtacgtactcctacgagacgtgctgtgtcgcgcgcgatgcgttgcccactgctactagtcaataatgccaagcagttcgatcgatttgatggtcttgcattgcgtggtgatgactcgatcgatggatgtagcgtctctgcgcgcagcgttcgtcgctgtacgcgtacgtgtgggtgttgtcagactgggcaccaaaatgcatgcacgttcgtacgcacgcacttgcaggagtagtactgtagtaagtacgtcgtccatgcatgcactccatacgatatgatgggcccagattgtttgcattgcacgcgggccagtgtacgtacgtaccatgcatatatatatggagtagtactctggacgaggcagtcaaatttaattgtacgtgcggcagctagtaccattcaatatcgtaccggtcttcgcctgctggttgtacgtaccgtgtattaattcagtcaatcgatcatgcatatgtatcgtattatattgggtttgtttgaggggagcccggccggccggctagcttatctctagctagctgactaaataaatgtacactcttatacgtgcaactaggtaaagtcaaggttaccatacctaaatctacgtagcaccttgtgttttaaaatatgctccatccatctcaaaatataagaacagacgggacattttttagtacaacgaatttgcataagcaggacggagggagtagcaaatagatactagattagacacaatatattactacgaatctaaataggagaagtactagctaagttacaataatttaaaattgaggaagtaattaatttgtgagaaatacatgcaaataatacatatgtacattctcttaaacagacaaattctaatgaactgtgttttcgtcaggcgggtgtggaacaagctatctgcgcttggtaggtttgcattctaatgaagtgtgttttttcctcaggcgggtgtggaacaggttgcctgcgcttggtaggtttgcataacctctttcctgatcagcaataagcggtattccatccttggtggaagcaatcttgtggttggatgcacgagcacctcagaaaggggttcgacgactatggttacttggcagctttggttggagtgaaattctcatgttttcgataacgttattttccaagtagacacggtggtggacatgatattgcaaagaggcgactctgacatgaggtgaaacattcgcgtctctagtagtttttttttcccacttgttctctttaactagctaactcttcctcgccccttttcctttttggagtctgttccggtttagttagcatgcttttttttgcttggtcctcatcccctccataaccgttacttttgtgtcaaagttgtattcaaacttctttcttctatatatatagtagtacttcctccgtttcatattataagactttctagcattgcttacattcatatatatattaataaatctagacattaacatctatatatatatgaatataagcaatgctagaaagttttataatatgaaaagaagggagtagtatatattatagtggttgtgggttgcatctactataactgactctgaactgccctataactcaaaacatgcatatacttcattcattccatattaagtttatcttcagctctctctatttgtcccaaaataagtttattttagagtgatcatattgcattaaatttcactactagaatccaccaacttccctagagccaaatacactagggatcaggggaaaaactctagggaacaggtttccctagggtaaaccctagggatttcgctctagggatccattctacaggaacaacccagttccctagagtttttccaggaaaagctagggaaagacttcgttccgtagagtttcactccctagggacagttgtacatttggcatctgaatctgacgtgtaaagtggatttcttttggttttcagccaaatttggggaaaatattggcatttaaataaaatatttatttcattgttttattttggtttctttattttacggtcttcctttgcctcaacatcaaagctaaaatattactagttgaaataaaaatgccattctattattaatagaaaatactcaattacattgattcttcattttacattacattgattctacgacaatggagctgaaaatattcctctcacaaacatatgatggacacttcagatgtgctgatgaactgattctatcatcgctcagatccaaacgataataaaataaaatacaacacacgttcttgaaagcaaatctaaaccacttgattctagcttgcttctgcaacaacagtggaaagcttgaaacttgaaaaattgcatccgcaaagaactgaagttgaactaatcttctttgttcttccaatgcttcctgcccttgcctcttgaaaagaaaacccgaatagcatgctccacagcccagatcaagataatatgctcatgggcatgtatatgaaagaaacttcagttcgagctcagttggagcaacacttacttggatcatgatggaggctggagcaacagcaatcttgtggtgctcactgcttgccggagtgggctcttgtgctgcacgctatgaagaaagaaagtagaggaaaggagatgagaaagttggatcagaacaactaatgcaagacggagacaacggcgtgcggtgagagaggaggctccgtcgagctcgtcgagagcggtagctgttgggtgcttgctgtcgaccggttgctggagctcgagctttggttgagaaagggaaggggccgccgccgcgcgccggccggccgctgggaagaagaaaaacgagaggatgtggtttgcttgagttgtggagaagataaggtgggcccaaactttactgggcacaaattttgtatgtcgagggcacgttcccaatcgcagcaaggaaaaaaattgaagaaaaaatatattgggagtaatcagaccacgatgctgatgtggagcagctgtgtgttcttttcagccaaagttccctaggaatacttctttcccttgagtttttagtttgcaccctagggatcattttggtttcccttggattgctttaacaacctagggaacattttaaactctaggaaacccattgaattctagtagtgattatagtttgcaaaaatagagaataattgtatcgagagtagataaagtaaagaatatttgcatttggatttgataaagtaggagtattctagtcttttgtttctatattggtatgtgtgagatgggtgaaaaataaatgtatgttgagacggaggtacgtagttggtagtatatatatactataagcatcgatctgtgtaactttatcaggtcgcaattgaccaatgcaaacatcaatttatgtcgttgtttcgtacgtgtcatcaggttgtcatgcatatatacgtcgtactactgtctgcgtgtgtgcagtagtacgtttggatcgatgcacgtatatcggtgagtatatgtgtaacgacatgccacctagctagtcctttggtaaatatgggcagacacattctggtcccccattgagaagtggcctgcatgattaatttgttttctatgaattccatctagctacaagatcatcacagaacagagatccttgtcggccccgctagctagctagctatcgtgtaccttggttattttatgcaggtaggatgtattatatcagtacagtatatgtcattgtattcttaatttgttagtagtaagtagtagcacttatgttaaacaggtataaagatcgaccaccagtgcatatgctaatgtagattatcctagatgatacggtctggatcttaacctttttctctgaaagtgcgagtgggcaggatcttaatatatgggaacagcgttgtactactactcttgtaggagagaattaattgaagcatatgcaacccaatgcctagctagatctctcttgatttacttaaatatacagagtcctaaacattcgcaaattaatcgaaggaaattaaaattgatcgagtagctttactatagatacacacacaagtacaagccaatgcagtggcatcagattcttgagcattgggatctctgcattcatgtacacgccaagccgctcctgattaacctataatttagaacatacattccttggcaccttccctgggccaaaaccaattagtaatactctcctagaatgtatagagtttcccagtttgccatcactgtattatacacttatacataatgcatgtgcatgggtcatggggtgcaagcttacaacttgcaatgtatgattgtgctcatgtgatgcaacgtgagcccaaccacagtatctctctgtcttagactcgcatacacacacatgtatgcagatatatactgcacaattataagttgtaaaactagataaactactgttgttgccgcgcactagagacgacacggatctacttcctccgtcctaaaatgttgctacctaaaggacaacgaatctggacagaacctctctgcgacggaggtagtagctagctactagcaagaagatgagtaaccatgcgagtaaattatactccctctagctaccttcaaatacttgtcgatcgccagatattatttacagtatctttaaactttgcacttatcttcttttaaagaaaatatgcttatactcaagtattccatattaatgaaatgtattgtatcctaaatatcagcgacggaaccataaattattgaagagggagggctaatgtaggacttaactaatgaattgttaattttctcaaatttacatgcatggtgatttaagataatttaatcatgattttggaggcagagcctacggctcaaactctagctgtcttagagctgtctccgcccctgctatatatatagggtgtgtttagttcacgctaaaattgaaacgatgtgacgaaaaagttggaagtttgtgtgtgtaggaaagttttgatgtgatggaaaagttggaagtttgaagaaaaagttcggaactaaaccatgccatagtatggtcatgaacttttgtatatcgtggcataaccattatttaaaatctattgatgaccaaagttaaaattatattgttcaacagctggagatagttattcgaaaccggaggaattgaagtacaaaaattacaattcaattgtgtatttgtcgttcacatttcaatccatacaggtagagggccgtagcataggacccaagcagaggagaaaaaagtaagggtctctggagcttgggagggaggggcctggtgtataaagctaaagctgccattttttctgatccctctctctatgcgtgtgatttgtagtacagtctgacaggaatctgatacccctggcctgctgtcctgtgctagtacctcccatttgaagatcaccacctcaatcatctctctctccactctcacccacacatgtacacacactctctgacactgcacacacgcgtatgaaaattactctctccgtcccataatagatgacgtttttgactttttatttgcaacgtttgaccattcgttttttttgaaaaattagtgcaaatataaaaaagataagtcatatgtaaagtacttttgataataaagcaaatgacaaacaaaataaataataatttcaattttttttgaataagacgaatgatcaaacattgacaaacaaaaactcaaaaagacaagtaatatgggacggaggtaataactagcatgaatttgatgtctatactatttctgcttccagctctgaaatgaatttgtgttgttctgaaaggcacagtagcacactactgggaatttctcgattgcaggagaaaaaaatgcaagtgtctaaggccacatgcgatgttgcgccaagcgagatgagagaggccgcgacaacggcggaaagctagaggataatcgagcgccatttgattgatccaccaatatcgatacagatctgtgtcgacgacaaattaaagcgcagggcgagcgcccaagaggttagatctgactagctggtgtaacagttgaaatggatggttgtaagtgcatgcacactacactgatctttggtacggtgtatagtgatgtagtctgtcatatcattcatatgtaatcaatcgatatatcttacatcttgatcaaataatataatctaacttgtataagttacacatcaaatgttaatttgtctggtttgtctgcattgaattttttgctatcatgcatatattgatgtctgattctaaacatgaattttctactaactactaatatcttttacgctaaaaatctacatcttaatttaagttcagcccgaattaagctctgtgaaatttggggctcatggggaggcaacaagaggactgaaatggtcggtacataataaactctaattaacgaacaaaaatcatgcttcgatgttagtgcagtgagaaatcataggtacaaaatttaaataacaggtaaatccaaataagatggaaaagtggaatacagatatgctatggaagtaatttctgacctaattttatttattttatgccacttggattaccctatttcgatttagtctcctcatttcttactcaaaatattccttgacctacaataactagagagagtcttgagagaattttatgcacaagtccactagtcttcacctatacctttctttatatgaagttgtatactccatccgtcccataaaaaaccaacccagtattgaatgtgacacatcctagtgctatgaatctggacatacatttgtccagattcattgtattagaatatatcatattcaatattagatttttttttgggacggagggagtatatatctacggtagctaatcgtcggagaacaaaataggcgaacatccttattcctttctccattatacattgttatatccctttctagttgcagtgtgtattcgataattagctaggtctctgttgtattttgtcaatataaggaatcatattctatttttgccgggctcagcggaaactggtataacaaattaatatgcgtgccaagatggtgaaaggaatatatattgttctctctcacagtcgataaaatcattgtgactcgagtgtttttgacatataatgttggaattcaatgagaatctgcttgttgatttatacttcctttgcttgaaaatatgtatatatataaacctgaaaagaaattttcatttaatttccccctagctagttattctaatgagctactccctccggttctatattaattgacgtttcggataaggttgaggtcaaacctttataacttagactattaataactttaaaaatatttagtttaaagaaactagaacaatatatatagatttgtcttttaaaatactataataaaagtaaacatgcatttatttattatatatattataatagaaacataaggtcaaagatgtatcatcttttagaccgtgtcattgtccaaaacgtcaattaaaataaaaccggagggagtatttatatagaccttgaaaaatgataaggatgcaaagaagaagtgcggctgattagttttgtgattgcattggaacttcaatactattaatttacataggatcatcagtgatggtcttgtaattaatttgatgaaatccaaacatataaacacatggggtcaaggtgaggtcgtagcctttattccctctccaagaggggaagagtactgcattggactgcgcgaaagcagacgaaaacttagattccctcagacagcgacaggcaaacaaacgagagagagattgagattgaggctatacatccagcactgagcttaacactaattaattaattggagtgccaggataaatttaattacgaaattttaattttcatcgtcaatgaccactaggtggcactagctagttagctctctctttagttactgtacattaacaaggctctctctctctgctgcgctatatgagctgcactgcactgtgtggccggtgtgctagctagcttctcctgcatgaagtaatcagcttagcttctacataaacagacaaacaatcttttgctttccacattgcgttgtctattacgctttcagaattcagagatcagaaattcagagccttgctagcagcagctagcatcgatatcgtagatttatctcctaaagtggtaggcaaaccacggcatacgcatcaattttagcgcgcgcgcgaacactatcgattcatcgtgattcgtgagtcgaccatctccttaattttttcagttcgtcgatgctctatcgatcggagttagtagctatatgtcaacaattaatgtcatccacgatcaataatttgattatatcatttcaagttttcatatgatcatcgatcaaattaggtcaagtatatgatttaaccctgactggtttctcttgatggacagtttatgctcattcctgatgcatatggtatggttgttagctgtcggggaatttctgcattctggtagtggcataggcaacacatggtatatgctgcaagcttacccatacattgaaacagatagctagatttatatatattattgatcgagtattctggaatcaacagacaaatgaaaataatcgaattaattacgatacaatatatctgctgctgcaggttgagcaggatgaatatgcacactttgatgtggcattcagtcaatggccggccggttggcttcaaacctctagaaatgcaaagctactgacggccggccgttgccatgactcccatctcctctcctcgatcgagtagctaaaggtaaaaagatggcaaatggggggccaaaagaagcaaaagaacaaattctttgagcacaactaagcagattgctcgccatttcctgcacacttctgaattgcagtcagtacactagctagcttggttactggccggctggccccttcaattcattcttccttggggtgtgcatgcacatgaataaatgtctgtctctctgcctgcactgtggggacatttgccatgattaccgtggtcaggggaaaaaaaaggctttgaatggagattggtgcttggaaacctagaaacctacactatctcattcccatctcacatagaagagagatagagagtgaggagagatgtggctaatgctactagctaggaccatatatgcatgcatggagaactgggtcactatagtgcatgcatgatcactgatactgcttatactatgtgtgtatgtgtgtgtgtgtttgtgtgccgtcagaagtctgtgtgatctctcaaaagatgagaaatggaaccactagtttagagcttatatggatccctcatgctccattctttgcgttggctatagttgagccgcatttgcaaagattcatctggatagctaaaggaacacatacattatattcaacatgtgtctgcataatataatagttgcatggatgatgtcttgtgttcagtacttgcaaatatatgtgtgaatattcgatgttggttattcatcaaagtactgtatgcgtatgccggcgagagtgggtgcagaagatgattagcaaaggatcattcttgtatgcatgacctagctagctagctagcttaatttgtgtgttaacaagtactacaaatggagtctatgtgcacctatatatatgtatagatgcacatatcatctagtctccacaagacactgaaagtgatcatggtttcctaaatgtgcataatctcttctcttttttttggcaaatgtttgcagaattggagcattgccaatcacgaccttattcattctgaaatgataaagtgtgtaattcaatgcaacatcatcactgatgtgtgtgcatgtttggaaacttcttctcaacgatgcatatacattaataatactttggtgaagtaaaaaacatcgcatacatgcatgcattattatatgcattacatcaagtaaccgacaaccatatatcaaaatgcaattcagctagctcacacatatgaagagattgcatgcatcattatatatatgtggaccaaattaaattaactaactcccattgagtactctcgtagtcttgtagataaatatatatcaccttaattccaccatgaacacattgcaccaatctagtaaaccttacctagcaacagcatatatagcaagtttacaacacatattgaaaatggagaacaatatagagaggagaaatataatcccaccatcttatacgcgacaagtacaagaaccaacaagagaagcagaaagagataagaacagcgagaggaaaaactcaaaagcaaaaactagcatcgcctagcatttctctagacaaattgggtttgaagcagctcgatcgatcacgaacaatatatatggagatatatatcaatgcagccctaatcttgtacttgcaccacacacaactccttaattctcctttgatctttctcagagaagccatgactaaaattaagcttcagggctcgttagggttctacctcttttgcagcattgatccattccatcatccatttcgccggcaaatgcgtcgtgtcacagtatgttccccgacgacgacgagttgaatccggagagatcagcccatccgccgccgctgccgccgcctcccggagcgacaccggcgccgctgccgccggtggcgccgtctccattgccgccgggtcccgcgccgttgccaccgccccagaattggaggttgccggggaggcccaagaactccctcggcgagctgttcatcgccgcggactgagcgttgctgtcctccatcttgacggatgcgagctgcgtgatcaggcccgacgagccgggcaccttggtgccggccagcaactggccggcgaagccggcggcgtcggcggcggcctccgcgtcgaacgggtaaatgccggacattggcggcggcatggcgtcgttgcggctcaagaaggggaattgctgtatctgcgggaggcgccactgctctagcccgatggcggc

SEQ ID NO: 76376 - DNA, 2048 bp, Oryza sativa
aaaagtttttaggaactaaacagggcctaatctggttcatgtctggtaccatagtaatagaactggtacctaccataccgtgctgaagttacgttaatgtaattccgttcaacggtacggcgttatgtggtatgaaaatgctcctcttcgaacgttcaatcaaatgaaaaacgtcggatgcctacgaccagctcagttcttacatgctaatttctcctttctttatgttgatgccagggaaatgctgcaaatcagcagtctggtggattggacgaacccttatcgtactgtaatatacatgcacatgcctagttgtttcttttcattctttcctcctctctttaaatattttttctcctaaattacttatccgatctatggaccgatcacaccgttgtattcgttgcaattaaatatttacaataagatattacatgattatattatgtcaaaagaaaaacatgtgtttcaaaccattaaaacaaaatgtttcatacgtgttagtgatatgtttcaatatgtgtcttgtttcacaaaattcctgaaactacctgctactactctctctccacctcatgcatgcatacatgcatatgttttagcaagcttcaaaatgatttttccctcaaattacctattcaatttatgatccgatcactacattgtatttgttgtaattaaatctttacaacaagatatcgcttgattatattttgataaaagaaaaacatgtgtttcaattcgttaatacttgttgtttcatatgtgacagcggcatgtttcaacgtgtatcttcaccatatttcataaaatatctaaatgttccaattgctgattttctttttcaccatatatatagcatcatgttttacttgttggttaactgcaatatttaaccgttcgatttttttttcaatttaaaaatgtttcacctaatatagtcatgatgtttcattctgtaatgatcaaatgttaccgtgaattgaaacattctttcgctattcgctgaaacattattttcatataagatgaaacagcatccgataaaacattttcgatctacttaatgaaacaattccgatatacttggcgcaacagcgtgcaacagtaaaataattcaataataagctaattttttttatcggattatattcatgtgtggacttgttttaaaattttaattgcaatgaatttaatggtgtaatcggatcatgttttggataaatattttaagagaaaaaatagtctaaaatttgtttaatccatgcatgatggatggctggcgcacctgtgcatggatcgaactgtcgcgcgagacgtccgatttttcgtttcgcgccgtacgtccgacgcgtagcattctccgagtactcgctaaaaaaatgatccaatttgggattcacactcgtgggtttgatgagccggaagggagcacgtcaaagtggggccagttaggacggcccattaggcccggaggagcgcctatctgaagtccaacacccgtccaggcaccggctctccgccgctcgaagcttctctcttctcaccggaatctcgagagcacagcgccgccccgacgacgagatccctcaccggcgccgccgccgccgcggccaggaggccgaggggccatgacgaccatccgccggttctgctgcgacgacctcctccgcttctcctccgtcaacctcgaccacctcaccgagaccgtgcgtccgccctaaaccctcgccgtctcctttttcttctcttgatttcgagcttacccgtcggtatgctcgtcgcagttcaacatgtccttctacatgacgtacatggctcgctggcccgactacttccacgccgccgtcagccccggggaccgcgtcatgggatacagtacgtgttcttgcccttgggggcggctgggtctgtgctagctgttgctagtgattctgcgtctttgtttgtcagattcgctgaaattgtagagtaaaccctgcatttcctctggaaaacatgagaatttagggatcttttggggttacagtgcccgattggaatgtggt

SEQ ID NO: 76377 - DNA, 4717 bp, Oryza sativa
acttaaatttaatgtgacttatctcacatgatgtcttgaatgtggggccggctaatgggcgggtgaccgccctaggcgatcacccccctatctcccctatacacttctctcttccttcatcctctccttctcttcctactacaccataaattttaaaaaaataaaaaacacaaagttaaaaaaattatgtatagaaatactatatataaaaattttgaattcaaattcaaatttaaaacaggtatgtaaacttttgacttataaactttgggtctataaactaatatttgaattcaaattcaaatttgaatcaggtatgtaaacttttgacttataaactttgggtccataaactttaggtgtataaaatttagatgtatagaaatactatatataaaaaatattttgaattcagaatcagatatataatcttttgatttataaacttttgatctctaaactttatatgtgtaaactttaagtgtataaatttactataatatgaaagtaatgcggtgccaaaaaaagaaaccacgtggagaagagggggcgtgctaggagcgatcgatcgccccttagcaatcccgtttggatgttgggtagaaaccatgtcgagacatggtttccttctttttcctcatttattcacttgccacattatttttcattttaggttgcagcttatttgatgctatggacaccatcctagttattgggttgggaatgacctaagtaactattgtatgaattagctattaaattagctatagataatttggagttagtagttatggttggctatactaaacttgctagtagggaataatctgtgcacaccagactctcgtgacaaggttcagtaaattcagagggaattagttggagccagttcaaaaggagattcttatgtggaccatagtggccttcggcaatatggattagtagtttagtactgtactactccttttcgagtgtgaaatgtataggtaaaggagaatgaatagatgctgtagttgtatgtgctttaattttcacggtggagaacaaaagttgcgcttgcttgcagaaaagagaaaggcacggtcgtagattatttaagcttcagaacagagagacaaacagacatctacacttcgaagctgtgtaaacctgtgagagtcaatctctctctactttccaaacatggctgtaagctctactctgttcttctgtttatgcaacagtactgtataattttaagctctactctgttcttctgtttatgcaacagtactgtataattttatctgtagtactgtacatctactaattgatcacgcatatgcttctcaacaacgggtctgaattttttttgttttgttgcgacaggtggtggagttgaaggttgggatgcactgcgacaggtgcatcaaggcgatcaagaaggcaataaaaacgatcgatggtaagcattcgttccactgaatctgtcatttttatacgctacaaaacatgtacttgtatggttgcatgatcaaccgtgcttcttctgtaaaaattaacagatatggagagttatcagctagagacagagataaacaaggtcaccgtgacaggaaatgttaccccagatgaagtcgtcaaggctctgcagaagattgggaagacggcaactaactggggtgaagactgaagtgttcatctttagctagtagtatatatcagctgatgacttgatgtccttagtccttagtcctttctatggttactttgagctgtttatactgcagatatacagtagtactaaggaacataaagtgggtaaactcggcattgcttactctccctcagtagttgattaatgcaatggattatgcgttgccctgttggattaccttacctcctttgatgtgtacctgatttgtttgcaaaatcttccggatgatgagacaaacttttctacgttttcatggaggatatgcatgatatgtctttattcagaacaaaattatccatcctttccttcaaaatctgaatcagctttcgcttgcactcctatagaccatcttctcgaaaaaagaaaaagaaaaaccctgtcaatggttggattttgttcttccaaaaggataaaaaatgttggagcttgggggcctgaaatcatgtttttctcttctgctgctgcttgcagttcataaaggctgcaaaattggttcttcttttgcttccaaccaattcgtacctgtgaatgttacagtgtttaggcattgtttatggaacagacagaaatccgatgcaacacacgaagttatgtgagatttgtttaactccaatacatatcctaaattgggattcaaagcgtgtcagttagtttgatcctgcaactaacaagaatgatagaaataatcaaactaatcaaccgatattgctatagtgtggtagatgtaggtccaatggttaaagtatacatcggctggatatccgatgcaggtagattcgcatgtatatcggctaaccaactgatacatctaatacctgaagctcataataatgataacttatcggttaaaaccctgatgaaacgttgcatcatattgacttagtagatcaaacttattagcagcaatttaatagatcaaacctaaccgagacaatataagattgaagataaaaagaaaaacatatttagctgatagatctacacaaccgtgatggatatattggatcaatctaaaacaacaatatgattagagaaataccaactgtcgacgtttgaggtcacaactacagtatttgcatggtatggggatcattgataccaggtaaaagatacagagacaatgatttttatacaggtttaggccccttcgtaggaaggtaataaccctactcctattggccgaagccggtgttgctctatatttatctaaatcacacaagtacaatatttgggataatctatctagatgttgtcgacttggcggcatggataaccaacacgtagttgacgacaagatagtcttccttttcgagtacaaactcattgatataagagatggcgctagatctctcttgtcggcctctgcaggcaccatattgggtatgtctaggcttatctctgatgtcaatgtctggcggcatgtgttggtctctattctgatttgtgtgtcgatctgtctcgttgtgtcttctctcctcctaaggggtattgtatttatacccatagatgttcccttgcccaagtagaactacggagtcaagtatggatacaatccgattagttcttatagttttcaaataaaactctatttttctttccttatccgaaactccttctatatgcgaggtatgatttcgtataagacttggtatatggtgggccccactgagcttagtcgattactatgggtatgtggtatccataaccctgacaccaacctagttagaatatcagacttaaccaagaaaatcctaactaagccgatacaactctaaacagctatgcgattaaagatagagttgatatatctgataggcaaagcatgtaacagtctagttagaatatcggacttagctgaaaatgttctaaccaagccaatacaaacaaagttgatagaacttacatcctctccagtgaacgaacttaaccgatgtagtccaactcgagagcatggcctcgaacttgatttctcgccagagatcgaacttaactcatgcagcccatcctaagacaaaagatgtaaaaagacattgggtgtacatatttataccctggagtttgtgcaagtctaaatcgaacacgagataagatttcataactagaaaaaaaaactaatcctacttatttaagagagatactaagaaaatatgagaccatcctgatgtggtcttcccgactcctccttgaattcagccttatttatataaattttcagctaccgagcagtttatttccttactcgaatccactaaaaagagctttgttccggtgcattaggttataccttcaggtactggtatcaccaggtatcaaattaaatcaaaccgttattcaatcaacagggacatgataggtaatgaactaaaacatcggtggaaagggaatgtgcaagtgcaaccatcctctgcgtcaagcatgtgccgctgccgccgctagcctagagatgtcaaaatgatgggctgcaagcttggatccatgaccgacgagcactaggaggtgagggaacaagatcctctaacgtagaagattctacgtcagaaggatgtagaaggcttgagcgccgtttatttcgcatctgacggcagcgccggttttctctagcctccgccctctttcgaccagtccagaagcgcgatggttcggcccatatgcggtcaaagcgaaggggaaaaaccacgcatggaaagaaaacgaagccgcccctagtcggccatggccattggctacttgctgccgttcgtcgatcatcgcctcccactacgcgggtacaggtcaagcaaatccccgaggaagcaccttcttccgccgccctctgtagcgcccgttccgtcgtggcgcctagcgggaaaatcatctcttaaaaaccctaattgcgaaatttgtttctttgcttgttgtctagtgtccgtgccatctcaagatctcaatccccgatctatcgtcaagtccaattccgaatccaatccttccaaatcaaattcctccgcaaaagtctattttgcctcccccgggggtcgatgg

SEQ ID NO: 76378 - DNA, 3443 bp, Oryza sativa
acttgtatggtgatttgccaagtgtcttttgtctccagtagtatcatctagtgatcgtgctgttttcttttctgcatcctgataagattcaacataactctgaaggtgattctatcgttttggaatggaatgcagcacttagtaagtagtctatcttggaatgaggtgctatcttgtaaccataccgttattttcttgtatcgaggagttccacgtctgtatcattagcctccacacgattagaaaccagatgagaccttagtatagataaaatgtgaatgggccaagtctgatattctgcagatgtggagttttgaccttggtagcgggcgtaacgcgagatcacaacttcacatacgttagcactgcagagaggagtaagaaaattcatcaaacatttaatataaaattgccaaatttcttaagatttcttctcaaagttacatcaacccttggaatactgataaacatacgtgaagaacttgcactcgtgtttgtttgagctatgaacgtcgataggaaaaatcatcgatgtatgtaagtcgtcctctaattggccttaaatatgactgtagccggtagctcccatatccggctctcattttatcgtgctcaaaattccactaatatattgacaatagctagaaaaagaatatccattggacagcagcggggaccgtatttaatcttgttagggcaaaaaaagattttggaattcctacaccctccaggcctttatacagtccaatcaaccagtgtctttcttattagggaataacaaaattggtattgccctaaacaacgaatttgataggatacgtgcttcctgaagtccccctatttgtatatgagagcatcacgccctggtcctacgccgatgtaatggactgggataccaaccagctcttctatcctctccacgtacaaacgagcagtctctgggagatcgctgtagtttcgtacagaggaaatgtcgtcctcccacccaggtagaacctcatatttgacctataccaacagagagaacataagaattttcatcaattaccaagagtcacattgagtgatttagtgctctcatatgctgcctgtaaaattatggcatggaatatgagtaaatggaacaggatcaactgctcttcctcaccttaattttctccagaagatcaaggtctgcagggaatgattcaatttctttaccatcttcagtacaatatgcaattcccagctttacttccttgaggccagttaacacgtcgagtttggtcagatttaaagatgagaaaccgtttatttggcagcagtacttgagtgcaactatatcaagccagccacagcgcctcggtcgacctgtcgttgtcccaaacttcattccaaaagcgcggagcaaatcaccagtcttacccaacagctctgttgggaatgggcccaaacctaccctgggtgtgtaagcttttacctgcacatggaaatattaagttttgtagggagaggaaaagtatggattgttaagaagtttaaagatagctgtaccgaccactccaatgagatcaccgatacttctaggagcaataccaaggccagtgcaaataccaccagctgagggactcgaggaagtaacaaatgggtaagtaccaaagtcaatgtctaacatggtggcttgaccaccttcaaccaatattttcttattctgcaagattgattgattcatgaagtgcacggtatcagtaatataaggtcctaaacgctcggcaaacttttcgtacttctcaacctcctctttaagggtcttgcactgtattcaaatccttcaaagcgcagagctgcatctctcagcaaggtattgagtttagcaccaaatgtatccatatgccgcagatcactgactctaagtccattccttataactttgtttgaatagcatggcccaattcccctctttgttgttcctataagggaatttccaagctctacctctctgagcccgtcaacagtttgatgaaagtcaaacaaaagatgggcacgatctgatactaaaattcttccttcacaggaaattccatttgattctaacccatcaatttctttgaagaacccaggaagatgaactactgctccattaccaactacacacattgtcttctcattgaggatacctgatggaacaagatgtaatgaaaacttctttccctctgaattatatatagtatgcccagcattagctccaccctaataacataaaacattctacaagttaaaacaatatatatatatatatatatatatatatatgatcaaatcctattggacaaaactaagtctagtcttattgccaccttaagaaaactgaacttcataaaggtgtgcaaaaacctataaaaattagtcaatacaacaagtgcagagagaacagtaggagaaatgagcactatgtaatcaaggttttccatgaagcaggataatcattttttttaacccataagaactgcttgtgtaaagtgaaaaggcaatatccttgccataaaggaaatgcaccattagttatcaatactgcattactgcctcgactagataaccggaagggttatcggtattttaagatgttttataattctattttgttagtacgaaggattcgacattaaaaaaatgaacatatagaaggaatatccattgtggttatgggtttagaaaaattgggaatagacaaaatgctttctgcagatatattaaactgatgcttagaatagttcagctatccttattcgttaatgatgatacagccataaaaattatcatcataaaaattaaagatatattcaagaatgagaaaacagcaaggctctcgagtctcatcaagaatacgttgagatcggaagggcttcacacaattcaagaaaactggggaccaatggtacaagtacaacccatgctgatatcagtacttatcatcaaaaccaagcaagaaccaaaatggaagggagccttggactactaagcttccttcgtaacacggaatttctcctgttctgctagagttgaatttcccatgtataaaacgactttctgtgatagtgttgcgatcaaaggagtacaaagtagcagtagcttacagtagtacggtaaaggcagtctgcgtggatggcgccggaagataaacacccttcaagtaacgatcataaagcaaactaacgcaaattactactcccctctgtcagaaaaaaaccaacctagtacggaacgtgagacatcctactatgttggtttttttggacagagggagtccatctcagctaaaggatcgcctctggaaactcaccagcgccaacgggagaactcgtactatcctaccacaaggaaccaattaatcgaacaccttccggacaaactgacaaagcaaagaggagcagagagcgggtgtgtttggttgcaagccacacttt

SEQ ID NO: 76379 - DNA, 2070 bp, Oryza sativa
cggcggggtccaggcacggagggaagaatggcatggcggcgacggtggagggaaatcgaggagagaatggcggctggtggtgggccctccccgcctgctgctgggtttggaggcgacggtcgtggatgtgcccgttcgttatcttctctgttcgattctcccgtcgcgagatcggacggctcggatgtttcagaaatgattttcttcaattgtgtgttccaaatcttcaaaaattcgttttggtcgagttttgggggaaagtaagttgttgaatttcaggagatttggtgaaattcgtcatatcgcccgggctcgcatttcaaacaatgactttcagaacgcgtggtttgcttatttgcgttgtactttgggagcaacagtttgaacacagatttaaatttctcgtttaaatgtgaatcgcgctgcttgtaaattttcttaattttgatttgctttcattctagccgttaaatttctggagctaagatcgccatctactcatcatgttgcattttgcagcatcaccaaccggccaacagatatcaggccctaaactcctgattaagaattatgtagctagatgagcacttgagcagcaaccgcgtcaaaatttggaagagtaatagctactaatcatcagggaacacactttggacactaggtaaatagctcaaaattttctactgaggtatctgggcatattcttaaagcccatgtaaaacacctaaacatcaaaatggagctgcttatcatgcataagaatacgtaggtgtgcagatcatggcagcaactccacagaagcagcgaccgatgaacaatttgtcaaaacagatacagcatggagcaaatgaagttcgagcctcagcgacctttggccgaagcactggaatcagcattctttttccttttcttcagcaagttcaccttgtcctttttcctttcctggttaatctgtagttgcaaagggtaacagattagtttagctcaaagccacttaaatttacgctgaaacagggaaatgcttgtggcatctacaaggcatatgttataaaatttggcaatgtggctaaaatttcaatggatgacatggctgcaacaatgaacggatgtgaaacagcaagcaagcagaaagtgacaaatacatgcaaggcataagagcgcagacctcaattgcttgaagaaggcctctctgcttgcgagacataagggtcttggaaatgtcagcagcatccttctcggcttgtttatgagagtcctccatatgatcgtcagcttctttagtatcacttttgtccacaacatctggttggttatctgccgtcctatttgagaaggtctttccttcgtattccatcctcagctcatcgtggactgcttctctagcatctccaactttagaagagaaaaaggcaaaatgagacaacagagaatgctttctgtacaagaagcaaataagatgacagcagaaaggactaatgttttgtactacatggtgttgaatttaccttcctcttcttgtcagcaatttcattagactctgatcgatcaataattgcccctaccagtgaattttccatatcttcgtcccttaaacttggcagaggcaacacctggctttgagcagcagcttgcagcctcttaatggtctctgcatactcaggaatgtaaccctctgcatcattgtccacaaagggagataaatgtggtggaggcaccctgagaccaaaaaaaaaaggaatattgatggcaaaaattaggacaaacataagtataaaaaattagatcaacttttatgcatctttatagttcatttttgcaaactgtgcaagtacagacagtaaaaaaaggctgtcaatttaactaaatgttaaattatacatgaactatatttcagtaaagttgtttccacctaagaaccatcaatatgtgcaaccaaaatgtgaaaacagcatgcgacaaattaaggtattgcagtacagtgatttttaattaagttggaagtgggacaaacattgggctctcaactacaggagtgcaaatattatataatcagcacttaacaactattaa

SEQ ID NO: 76380 - DNA, 1743 bp, Oryza sativa
ccctcattgtctgcacatagcatataagacaataggttagtcacttcatttgtgtcactggccgtttgcaccttgtttccgttcaatctgtgctgagtactgagtactgatccttgattctttctacatagcaaacatgtacaaactcatgcaaagtaagcgaggaagaaatggagaaagatcagtactttggtcggcaacagtggcgctgacaagctggcaggtgatgctgtttccaaagacctcatggacgttgtcaaggagcgaggcagtgaagtcccttggatccagtaattttcggctcatcagcacagccaagcctttgatcttatttccatttttccctgtcagcttgtccttgagccctcccagcattctgtgatactgtagtcagtgacaaaagaagctatgttggtggtggtgtgtgtatgttgccgttgcaatggatggggaagaacttagcaatgcagctgagtttttatagaagggggagagggaggttcgcgatgtcagtgtgcccatgagtattggctactaatgcgactatgcaagtggatactatgtcaagtggaagaccgaaccccaaggcatcaactagcccattcacttggacaacacactgtaagttgctttcttttagtcgagaattgtagagatatttctcctgttttgaaactttgaagagtatcacattttagcttgaaaattttttagggtgtaattcgaagtctaagagatcgagctggtcatccttgtctcacagccttgtcaaaatattaatacttattcccttgttgatagaaccaggcaagggttcgacatttttgagtcgtatgagctgggttcatattggcattgaaatgaaccatctgtatgtgaaccttaccaactcttggctcttgaggtgtgctgccaaaaatattcgaacagttttcatgggtgtgatacacattggcctcctgcctagtactagtatatttctacattatcctttttattatgaggtttcacccttagtgatcctatagaagttatggcattacattagtatcaactgtcatttacagtaaggtgttaattattccctattggcctcttggctttacttgctgacaggtccacttcagctgcacagtatactggataagcactgaacgaagactgtattaacttattagcagtttgaaacgtatttgatgcccgtgccaagcaactaaacaagaggccttcgaattgtcattgacgaagacctgagctacgggcctaaggtgtgtccatgttttactccagtttggatcatgtgaccggcatcttggatcttgccaattgcagtcccagaaattcaggtaggagcaaatgaaatgaggagcatatgcaaattgggactatctttaggacacgtttgcaggcaggattatttttgccgtttatatgggaaatcgagctgatttgaattagattcctgtatttggtttcatgtacttgagttgaatgcgcttaaatgcgtccgatttccataggcttcagtagagcgtgtttaatgttctttctacctccaattttagcaactctttgattctgtgcgcatgcagcatatttcttccaaggaagtacacctatcatgaaagattcgttgtaaaaatatgaactaaaatcgaaccttccaatcattaataggacttctccagatttgaccactaacatggcaacacataataagattaagtagaacggccatgtaac

SEQ ID NO: 76381 - DNA, 647 bp, Oryza sativa
ccgatatatgcttatctgtagtcgtatgttagctaggatggtcaaacaatcatcatgtacgaatctgattaaaccaggtctagatgctctgacttgcaatatattgagcatcgacttgccattgtaaactccttaattagtcaacattttaccacgatcggagcatacgcacgctacccccacatgcacgcatgctgatcatgcacagcacatctcggtacccggtggtcgcctgtactcgcgtactgcctataaataggcagccgatcgatcaagcagcttaatataaactcctcggtcacttgcaaatcttctctatcttataagttctgaacaatggcaggcggcgcctcttctcctagggtggtcgcctgcgtcgtggtggcgctgctcctcctgtccttcgccgtggagccgctgcaggcggtggccgcggcggcggcgccggcgacggcgacgaagccgatccggtgccggaagtgcgaccacgcgtgcaagaagtcgtgcaagggctacggccgcaactcggactgcagcgtcccctgcggcgacccatccaacaaggccggctgcaagagctgcctccaggcctactactcgaagtgcctcaactactgtggccaggcctgccgcgccgtctgcatcaa

SEQ ID NO: 76382 - DNA, 2889 bp, Oryza sativa
tcctgcagcccattactagacattacatagcagcttagctggaagcaagtagcagcaatgcattcataatatatatctgcaggcagctgtattaaggcccagaactacttcagaaatctaatctaatatagtgaaagctaagagctttcttgcaaaaagggcctactcatgttggtggcaaaacatggccatcaataaatactgttcgtcagatttcaagaagcaagcaatcataaaggtccttcacagaacttctatcaacatctagtaatggagtgatatgactaccggtgacgcacaaactatacaagataagcatagctgcttgcagaaatgttgaaacatgatttgtttcaaatgaatattctagttccaagagaacaccaaaaataatgtaaaagactgagcatgtgtgtaataacatgagagtgcaacacagcttaccttgaaaggttggtggtaaactacccagagtaagtgtttcaaactcaatagaatctattttatatttttctttattctctgcaataattggatttgcaatatcctgtgcagttttgcagatagcctacaggttacacaacttttatcgtcaaccagaagtaatctacaacttaagagtattaatttttattgtcaaccagaagtaatcttcaacataagcgtaccttgttgaggtaaggccacatcatctccagaaatctgctcacccaatcaatctagcaacagagaggacaaaaaaaaaagggcattaaaagtactgcaattactattgatcgagtccatgaggtttcttcaccaagtagttgaaaacttaaaagatatagaagcatactctatcacagtcaggattcttgacccacaaaggaatttcatgaaggatgccatccaaagaatttgagtcatattccaccagtgggcaaactttgacgtcctgaaaggaaatcaggggatacattagtgtaacagtattcacaattatgtttcatgtatatcctgcatgagagaaccctttcttggagatgcaactagtccaagtgacaccgcatgggagaacacaaaaaacgtgttacccagtacccagatatatgcatatataaatcttaaataagtatcaaacatcagatgaaagaacattacaaacccaccaaaaaacagaaggatactcataccacacagatctaatgtaaataatgtgtggccaataagaaatgaagaaggttctgatatgaaaaaaaaattgaatcagctcttgacgagtttatgaccaaagtgtttcttcttaacaacaacctcagactgttcccaaactattttggttaaatgattagagatctattgacagagcagttaccacataacacaagtattcgctacacggcaacaaaatgaaatggcatacagtaataaataaagaggaagatcaaacaagcatatgcccaccttcacctcggttggctggaagtagatgaagaggaagtacccaataacaataccagctgagaatccaaaacaaaacccagagaaatcaatcaacatgctgactatgcccatctcagattcctacaccagctttctaccagaactctcatagccaagcacataagaagatgaaacaaaaaggcattactcagataagttaatcaaccgaaccacgtcaccctgctaaattacaaggggacaacctgagtaagctaacctactagaactagctagtacctccccttttttttctgcaagtatcctattcagagcatgacaatgccctaacatctgcaaacaggtattaaactaattccgccgatcatcatgaagcaattccccactttagaaactgtagggggtccatctatcaagactttcccccacggcacgaatgtaatgcttcagacacgtagacacaaagaaacaagcaaacaaacatgcttaaagtttcagaaaatacagtgaaaacgacactaaaggaactgtgagaacaaagcttagcaatgccctaatggcttggcaacacgaagatgcaagagcttctggagaggagaatacatgtaacattcgaaatggccacacggaattcagaagaatgtaatatagggtggtcatcagtcaagttgtaatgtgctaactacgaatactttggttggtggtccggttggttcttttttatgtgggtttcagaatggattaattctgtccctgtaaactgaaatagagtattgctattagatatttcaatatcatcgtttcggattaactcggtccaatcaaatctactcacaatgcccgattaaaccaacaagattgatcaatagatgccggaacaaagccatcagcaaagcacagatgcgattcctcgatcgcgagatcgatcaaaaacgattgcaagatcgagtagcagatgggcgatgagtttgaaaccgagtggatttacctccgtctcgaatcggccgccgatggcgtggtgtccgtgggattcatctcttgccgacgggaaaccgaaaccggggatgcggcggggaaaagaaaggcgccggcgaggagagggtggtccgtacgccgtcggcggatggcgctctcagcgagcgagggccagcgacggcgggccatatgcacggggcgccgacgcggcggcaagtcgagacgagagggagggaggaacgccgccactacgccatgcgcgacagcgcgaggtcgcactccagacaatcagacttcagaagatgaacacaggggactgcttggtgttggtaccatagtacttttctccgtcttaaaatattactatttattatatggttttaattaagatatggattttatcttggtttttattagtatctttctaaattgttaaatgatatatttcaaacctatttgatagagcatcaactc

SEQ ID NO: 76383 - DNA, 1149 bp, Oryza sativa
caatggaagcatatgccttgacattcttaaggagcaatggagccctgctttgacaatttctaaggtgcttatatgaaaacttcactagttttcttttattatgtataacatagtaatgaataacataaacgcctggtaacacatttatcttcttcatgaagtatggctcttattatttcattggttcatctcatacagtctcaactgctactctttgatctttgttttccaaaagttggagctgttattttttttctacttggtattaaattacgcctcatgtaataatattagttttatagggttctaaattattagtgttctgtatgcatagtatgataccggaggacaataatagcattcaaatggtcttgtttatttcattgtggaagtggggaattggcagaatgttaagtgaagcctctgttcggtccaaaactctttgaaatttctctagaaaccgtaaaatatgtcaagaaatagcgaggttctgtttagcgcattattcatttctatcacagagtaaggtaggtggacaccttcattttgaagtgtgaacattacatttgagtaaattacactcatggtgcatgaacttgtgaggtgggtgcaaatagataccacaacaatgctcattccggtacaataacttgcccggcctgtgttaacctagtccaaaacaatccacacatgcaaaattgatctgatgtgtagtaccaggacggcacctatgcatgctagcagttgcttgtagttgtgcaggcctgcacacactagctcaatttcgtatttgcagaatatagcagtcagcaataataattactatgttgcaacctcttgtaggctgcttgcactactggaataccgatttgatttttcaaaacaagcattttatttttcaaaacaaaacaactgctagcttgcaaaggtgtcatcagggtgcaccacgtttaatcaattttgcttgtgtggattgtttttgcctgggttcgcacggactactcaaattattgtaccgaaacgagcaatttacctatttgcacccaccgccccaagttgatgtaccgtgagcgcagtttactcattacattttaatgcttattcggtaactgcatatgtggctatcttacattttgattgcatttacca

SEQ ID NO: 76384 - DNA, 696 bp, Oryza sativa
tatagggcgaattcgagctcggtacccagagtaagcaggcttctgttaatatggctgccctcctttagcctcataccagccgatgccgtctgagatgcacgctcacttcctgctaaatcaacaaaatttttgtggccttgtgggtgagctagcatgtactggattgttgacacgttggagctggtcgctgtcaggatggaaaagaagtatgccgggtaaattattactatcacttctacctaggataaacgaaggattaacatggtggctgtcattgtcctgggtgggtcttgtctttgactaaaactgctactgcttgtatccggattgattactcagccttgcactcttcagccttctcacaaaattctagctttagtcataaaaaatggccttctgatcttgcagaaaaatgcgactactcatcagtcgtttatcctgtaagcgcagcaagctgaagggctcgtttggaacaggaggattttgaaagattttcgtaggaatcaaactactatatatgaaaactctgtagaaatcttaattaggttccaaaggtgccatgagttcgggttaatttgtcccaactctgcaaaggtttgtgtctaaatggggtgtgctaaactgatcaggactacactacactacaaaatcaatctccgatcaaatggtatgatatatatatatttgggctgacta

SEQ ID NO: 76385 - DNA, 2210 bp, Oryza sativa
aaaccatctttttcggtcgacccaaatccacaatagttccggttccattaaaaaccgggaggaaaaaggttaataagaggaagatctttagtccctgttgttgttaccaaccgagactaaagatcgatttttagtcccggttatttgaatcgggactaaagatagcgatctttagtcccggattcgtagtcccggttagaaaaccgggactacaagggggttacgaaccgggactaaaaagcacttctccaccagtgggtgttatagctaaaggagccaagtggccagcatgactctaagtggggccaacatgtggagctcgagctagaagatgcatcgaagaggataattaaacttaagctcagactcgctagatagcgtggacctaagctcaaactcgagcgcaaacatgacatctaccgaggtagagccctaagagcagttacaatagtagactattagctagctacaaacatattttaatgagataaaagatgatagagaagagcagcagtctacagatctgtagccagctgcagcacagactccaagatgcaatgtgtgtatgacagtgtgaccatatactaatagtatagtaaacaactattgtatgaattgattgactatagataaattggagctattagttggctatactattaaccttgctctaacacgagcatagtgtcgacggagataaagcttgagcgctaatggtgagcatgatggtgtgggtgaagatcggaaaagcaaaagctttttggagggaaaagaggagcttgagctcacgtatgtactacctaacgagaatactgtggtgagttgctagagacaaataggaaaaatatgattggtctaaattacatgtgtttatgttattacctaacccaaagtaaaaaaatattggcgagatgatggtccaaagttaaacttattacaaccccagttgtaagacaatgtgattttggagtttattttgtggtgtttttttcatcatacttcatttatattatttgcttttgaatcgtcaaaatatgcgtataaaagtttcaccaatacttattatttcttttaataaatcgtacgaataagtacaagcggagcgatagaagtatcttctacacctgctttaacattttccactaccatatcctaaagggaaattttgctataagatactgctattggtgtttttagccttaggacaccgctgaggaaaacattttataatcgtggtattttgccagtacacaccacaccgactaaaataataatttccggttaaagaggagagagaaatcgcgtgaaatgtacaaaaaatacccttgggcccacataccagctctcctatctttatttttcgaagtacctagctcaacgcagactctcacaacacacgctctctgacccctatgaaagcgcggacgcttactagcaggcactcacaacacacgcacactcacccatatgagccattttaaagactgggccatgctaatcccctatgaacgcactcacgcaaacactatccctatgagcatattcgaagactgggtcgggcaaatccactatgaacgcacgcacgcaaaaactacccctatgagcatcttcgaaaactaggccgggcaaatcatggagattgaagaagtcgtcacaggcgcatcgctgtcgacgggtatgtcgcctaccactgaaagcacaatgccgttaaatcatagaaaattcgctcctatgggaagttgaacttaggacctaaggtgctactgaggctataggctctttcgctctcctatcttgtatatgtggggtctacatggctgtgactcgggcgagcggcggcggccagtggtcgagcggtgaggtcgggcggccacggcggacaagatgcggccaatgcctacggtggcgcgaccctacagaggagcagcctgtggtggcacgacatggaggaggaggtggcccttccggaggctgggcgaagcagcggcttggcacagtgtgacgacgttgccccgcgagcggattggcaacgctgcagccggccagatccgcggcgaggcggccggccggtgccggcgtgcggtcgcaggcgtggttggcttgcggcgagcggcaacgacgctgaaaatatcgccatccactccccttccctttttcatttttatttcgttttcttttcttcggtttcttctttcttttcatttaccttt

SEQ ID NO: 76386 - DNA, 897 bp, Oryza sativa
agcccattccactacctaaccatctctttaaggttggcgaattccctcctcctaccccgatcttaatatgggatcctaacttaagtcgccactatctcgctggctttcaaggagaaagagtgacaaggatctaatggtgaaggattcatcagatattcaactcaaatttgtgtcaaatgaaggttagcaattctgctaaatatcccatattataaacaagcgtttctcaaaagaaaattgaaaaataagtacaataataggcaaatggatctaatattcttttttcattggaatggatctaatattataatcttgaccccgcaaaaaaaattctaatcttgagaaactcaaaatgtttttgaacactgatgaaatttgaaacgaggtgccagtgtgccacaaaacatgtatattgccgcgatatgcgccatgcggccatgccgccatgtgctcctcccctgatgcatgggttcccagatgacagtcgaccagtcgcccagccaggagcagccttcctccaggcctcgtctcgtccttccacaccacgtccaggtcatttccgcctccttttttaatagaggaagagcggaagacatggcgaagcacgtcgctggaaggacatgatctacgcacacaagccattatagctcggggaagagactcacagagaggaagtgctcccggtgcttccctgctcgtttggctgctcgccggccgcgtccgccatggggaattgcttcggctccgatgacggcgaggtggaggccgtcaaggtgatggcccgtcatgcgctgccacaaggtacatatatgaatatcgacatcccgatgctctgcttacaatatcactacgttttctttgtattcgtgagatttattttgttcatcgggatctgga

SEQ ID NO: 76387 - DNA, 882 bp, Oryza sativa
aatagttgcatgtgttggtctagtggagcagatatgcgtgggaatttactactttatcttaaattattttaaatttgcccttagcatttatttttgctgtagatgtcaggaccatgggctcaaataacatttgtttatctttctggtttacaagagagaggtcaaatttggatggatattagtgggtccatagatttgtaaatttaggataaattactttggatgtgttgatagcaaggttactctgggtgtgctgagcttaattcttttgacctgttaaaaagaagccccctgctttgcttttcatctacttatattcgattcaattttatgtaagtatgtaccaatgcatgtttagaactgtagaactaataatatagaattcattctcacaagtatgacaatgcaatttaagcaggggcatatcatggcatcgaagcggatcctcaaggaactaaaggacctgcagaaagatcctccaacatcatgcagtgcaggtatgagaaagatttatcagtggaaccatggctgattggctggtagacagtgtgaacttgaacgttgatatgataatgactctgttggtagtaatccatgttttcatgtctgatggaattgtacaggttgtttataatgggtttccttattattggaatattgcgaactcatccaatggtgtggttgtccatacattaatctttaatttattgtattgtattccatgtttgattcatgccgaaattgaactatcagtgttctgaatgtatagggtttatctagtactcttacaagagaatgcacaatcttgtcagttgcagtcttgatgcctttgtgttgttggttaggcagttgttatgtttgtaatttccaatgagtgaagtg

SEQ ID NO: 76388 - DNA, 3888 bp, Oryza sativa
agcaaaagaaaagcaacagaacagcaggcggcattcaggctttttctttgctaatccactgtaggaaaacattctgagtaccataattctaaacggtcccccttcacacccacgcacgcctattcccaacatcttagggtcgaagatagcaaactagtaaagctaataggggacctaagacacagtttgctacctcatgcccccggatacactatttactcttcatcgtcctcattttcctgcaaagagcaaattaaaaatgttcattagcaacacaactagcagtagtaaaaattcattgggcattcaagctaaaatagggcaccgggtgttcctttaatgattacctcatcgctaccaccatcctggtctcgtcgacctcagacttggacttgtcagagccttctccatcatcatgggtcttagctttctttgagcttgtgctctcctgaagaagtaattcaagaagtccaattagtgcctaacgcttgaagggctctataattaggatgcacaattattctatcatcaccttcttatcgaagttggccttggtcttctcgtagtcctgcttcttttggccagccttgtccacataaggtgccttctcctaataaaatttaacacgaagggccaaaaacatatggcacattgtcacatcaatagccacccatggtacttatgtgtacttaagcgcttcactgagtagaattcaaaaacaaattgcaattttcattcaactagtactttaggagcaattcaatctttttcctaacaaacaggccagaacaattattaaacagtcctctagtgatactcatggatgatgtatgctaaataacagatgcacacacttaataggaacatgtactaatttttgaacactgcagagaaaaactcacttgctcagacatagctcgccacttctcccctgcagccttgctcacctaatgaaccaacagaggagaaaaaaattggacatctaaagtacatcagccaaaaagtggcgaaaaagatgatggtgtcaggaagctcacggcggcgacactcttgttgtcaggatgcgctgcctggtactcctgcctgaactcagacctgcaaaagtaaaaaataaaaaccacaaaaaatattaaaattcaagaaaatcaacaaaaattaaacaaaaactcaagacagatctgtactagatctgaacagagcaaaacgtgggcgagggagcgagaaactcacatgaagacgaagaaagcagacggcgggcgcttcggcttgccgctagcggcggccttcttccgcttcccggcgccgccggcggccttgagcctaacaacaacaacaacaacaacaccaaacacaaaaccgctcagatgtgaaccaacaacagccaccgccagaaaaccctcctccaccgcccatacgcagcagcaaagacggccggagagaggatcttacctgccctcgcccttcttggaggcgtcggccttgcccttcatggctgcggcgcggagatcgcgaagtcggtgcgctagggtttttgcgggggtgcagcggaggaggaggaggcggagtttgggaggcggcgcaacgggcgttgtctggccttttggggcggagcgttgcgcggtgcgtggccgcgtgggagtgcgtgaaagggaaataaataaaggacagcgacgggctgagcgctgtacctgcgacgcgtgggtcggtggtacgatcggttttgggttggaggaagcgggctgggccgtgtgggatggcccaacattgcggtcagtcgcggcactgggctattgggccttatgtcaccgataaaacacagaaaaaagcctaaatcaaagaacctgttgcaaatgtgttatgagattcaggattgtcaaagggaaatggatgaatggctaggactaaatgagatgtgaagatatagatgagaagaatagatggctaggatacgatattacccttcgatggatgggatatcatttcccgatcccatttgccaaagaagcctaaaagaccattacaacatgtaacaagagatatgtcgattttctagatcggcaataatatttatcgggtgcactagacgtaggaaagatggtgacacagtgattatgctagttcaggcactcgaagagaggtaataccctagttcagtcgtatgagattggatctgtgcagaatttcgcaatacgacgttgagagtagcttgtagcgatcacccgaattagggttagccgacccccttatatagtcatcagggagccagctaagacatgcgtgatatctcttataatccggtacatgcctcctatttacatgagataagatccattgccttatctctaattcctttcttataatagaagtaagttggatgagtctagggcacttggcccgtgtaacatcctgaaaatccccgacaataaaaatcactaaaattttgaactttttaaaacttttgcatcatgctggatgttatggttggtattgcttgtcaaactataaattgtcaccactgaaaattaagctaaagctatacaactgattaataattataaaaataagatatttattgtgaaccctataaatatttacgcacaacacaacaaagccatacaaagagaaggttaattactaatttaatttataggccaaatattaaatattggaaccatgtgacaggtgtcatgacatctaagtaaccatgaaataatcgccactatgacgaccctatatataaaggagtgttgcactggaataattaaattaatatttacaatgttcatcaagtctctcaggggatagattcactcatgtaaaataatttgtcatgtaaataaattgagttctatatataaaaaagagcttatgggagtattcgattcaatgtttaagaccaatattgcaccaaatctcataataccttcatagaataaaacttaaataaattaaacctatgtatgtaaaatatattgctatacaaataaattcgaccaatgtgctattgtattattaaatgtcacaatagaatatttaattagtttttaagaaatatcaaagcctagaagttgaattggataatttttggataatctaatggaaagcaaactcatttgggaactaatgaataactaaataaatattcaaatcaaacatttgaattctcaaaaccagaatgtatagatttcatttcatttcaaatccaatcccattcacttttgcagattagcccttccccctttctctttttccttttcccccattccttttctttttcagtcggcactgttcatcgcccatgaaccgttcgatctgggcccaagccgctcacatgctgcgagtccgctccttcccggtcactactgagccgcgcacgtgatcaatcgcgccatctccgcatctcgtgtcgcccccgtgcaccgcatcgtgtccgtgccggtgcgccatcccctccgtgccgcaccagaaccgcgccaaacctagccgcctccccgccagcgcgtccggattccctccaggaaacatggcgcctcgcgtcttgtcgcgccgtcgccatcgccatcacccatcacctcgccaccgatggataacggccagaacgccaatccgcgtcatccctagccctagccaactaccttaggacgggaaaaccgccccagcaagccgccgctccgccacagctcccatgtgcgcgcgttccgtcgcccccattcgcgcccaatgaataaaacggagcctcctgccacagctagagttagaacgcacagactttaggctttaggtacgatgatggagccacataaccttaatggaggaggagatcaaaccttatccgcgtcatccacctcattgctcttatccgatcaccattagtactccagctcgcct

SEQ ID NO: 76389 - DNA, 1721 bp, Oryza sativa
ggcatcaagcttgccaagcgtgtctgagggtagcgggccaaatagccctactgctggtaggcgtagtgttcgcacacggctattgactggtgtgcaagtcaccccaacccatgaagtgcagactggggctgcagagctccagttgagcttcctgccatgtggcagtgaggcagcaaatgcaagaagagcctgcttgtcggagttcagatcagcactcttggcaggaggaatgcatgcaaagaggagagaaacacccagaaaagctgtaagtatatgatcttgcatggttgatgcttgttggaaacaaactggtccaacactagaaaccaatctttcccatcagctcttcactcctctagcatgagaaaaagaaaaagaaagtaaatcaatgtggtgcgtaacagcaagaatatagtaaagtgcaagtagaaagaaggaataaaaggttaggaaacatgaagcataaactctgcccttagatatactttcagcaccaattgccaaatttaaaaaataaatatgctaaaatcttgaagatgaggagcgactgttttgcacagaaaataatctaacactactagagttgaatgaacaagatgcttgctactattaacatctagaagtagtgtttccgtgttgatacttttcatattgggattgtcttagataatttcaaggacaaattcctaggccagctaaccacagcaaatatttataatatatacaagtataactgatatgacctgacaggggtttgacacatcaaattacacaaatggctaaataccagcagtattaggtccaataaacaacgtggatttgtacaatactacaagaattgctttagagtttcagaacagagtttaacagctctctagtttgtagctagccatcacctcagaataaccgctaataattcccatgatcaacacttgatgctgatgcaacctctttctcaggataaaagaaaaaaaaaaggagaaatgctcacagagtgagtcaactctatgcagggcacatcacatttctcaactgctacatggtaatctcccgtcccaaataaaatacacgtggctcatgttctcttcctctagtcaaagccgtaggactcaccatcaggctaatctgctttagtttattttctaaacggggcagttgggatcatctgcatatgacaaaagcaaccacccaaatcacatcacaaggcagctatcaccactcctctcccctgttttaataaaagcacacacccaattatcttaacaagaacttctactaccctttgccactgtgccctaagcaccgcacttacacttaggactgacaaaccatcataaagaaaaacagttgtcagacaactccaagaaactgtttcaacaagaactgccaacgggagatggcaagattcccttgcagccgggcgatctccttaaatgctccagcgcatggcaccgcatcatagatagatatctcacctaacattacatctgcagttctgcacccctcatgcggctgccttcgaaaagaaaccaaatatgctcaccagcagcgcagatactgatgatggttaaggccatggcacaaaagcaaaagctgcgatgcacaatgcgagacaaccaccaccagggaagagaaggaaaggaaagaaagacgatgcctttggacttttggggggggcgaggtgggcgccgggatattcatgggtttcatgagcttaccct

SEQ ID NO: 76390 - DNA, 711 bp, Oryza sativa
attcctgcagccccgataccgtcgttgatgtcacccctatattatttttattttcggttgtatgagatcgactgtatatttctataaaaataaattacatcctaaatatttttaaaaataaaattgaatgaacagtatttttcaaatttaattcgctgctgctccacttccgcacggggcgcaggcacacaggctttgggaagcgatgcttgcaaagagtggcagtgtccggctgttggcaggcgggcgcggctgaatggaccgatcactcgagacttggcgcttgtcgcacataaatggctgacccgcttgcatgtactagccttgatccgggccaccacgcactcattgcatgtccgaattggtaccaaaatctacggcacacatgacaaatctacagcagacacgatctgacgtacggtccaacatcgaggtcatgcgatcgcctttttaagcgttgggactgtttgggatggagattgggagataatgccaaaatacgataatgtgagcagcgcacgtatttgaaaaattcaaatacattttttgctggcaaatgccttataaaagaaaataaagatttaatcgtacgcgaaacatcaacatcgataataaaattaatatttgtaactattatatatatatatatatattttccaatgtgatagcatcttaagatttcaggtatgatgaatacaatacacacacatt

SEQ ID NO: 76391 - DNA, 65934 bp, Oryza sativa
tcgaattcctgcagcccttacctcctcgttacttagatcaaaaggaaggttgcatatgaatattgtcctatccagcccagcgtgttgtttcttgaattttgaggcaggaagggtgttttcctcctctgccacacgtttagaattttctaacttatcagctgcaggtacagatgcaggtaaatgtgtctgcttctgtttcttttctgatgtatcttgttctgtttctgtatctgtatcaacatcagaaccctcattgccagatggttcagccttctcagatgacttgatcaaattttcaagaacctttcttgaaatatcaatttcagtttcaaaatcatcatcagcaggacgattggaagcttcctgatcaagttcatagctatcatcttctccaacaagattatcttcagactcctcatcactgcctttgtcagacacatttaccagctctgtagggacagcaaattcatgatattgcatcttccaaaataatagctcagaaagcacaaagaattgccaggattagcagatgagacacagagtattaaaacatttttaattatgaaacaaataagccagttgatcatcttaaacaacatgaaccactgttcgcctaccataccaaagaaatggcaggtacctttgtcaaaagccaaaggtccatgttagaatagctgaagcgtatcattgaagtaaataaagatattgcaggtcacagaacaaacgaaggccagaactaaaataatagatacaaaaggttgtatttaccatcatccttagcgctggattttgcagcagcaacagtgtatactttctttggaacagcccaatcaacagccacagttctctttgcaactacttttccgttaacattttttatagcctatttaagagaaaaaaaagcaatattaggacttccaaagattttttactcttactgaacagggtactgaccatacattttctgcatcctgcttacgtgtgaaagatacaaaagcaaagccttttgatgtcctgtagaagaatgaatgaaatagtcataatttcttgtaatttgtttaaactacagaagaagtaaaggattcaatgcaaaacatacccgttatcagacttctgtggaatggacacatcccatacaaatcctgctaaactgaacatatccatgatctcctttactgtaatctgcaataatgaaacaaacgcatataacctctgttatctgttttagataacaaagtttggaacaggtgaagttttgcatttcatgaagcaccttgaatggcagattccggactatcactctccattttctgatcttcgagccctgcatagcaataagcaagtttcaaacagctgcaggtaaatggggaaatggccaaacagagaaaatgatagtggttcgacaaagtactgttaaacaccatgcaacccttgtgcagaagacagacactcatcaaccaaaagtaaagattttaagtaatctcattctatctcctacccacctattagcacaacagctcaactagccatgcaagatagtggtgcattataagcagagctaaagctccagtatatctattgttccattcacagaataatattaggatctttcaaacggaaagttctttaggtagaagtccagaaggccctgcttttatagaaagcacaggtgactaaatctctagaggcttgtacatcttttacagatataaaagagaagttagtggtagttacggtagtattttaagatgaaaaatatagtagtgccttttgtaaacaatcaaatcattccgtcatctacttatgtgtatatgcatgtagtcatcgaatctaatgtgaatgaactatgtaggttggggatactgtttttttttctagtttaaaacttatattacatttagtttagatccaatgcaatgaacaggcaccatgtgtacttatgagacaatgtaactaaatatatttgaaactgtagtcaggagacctgtaatgtatgtggtattcaagacatttccaggaggcacagctgcaggaggttactgttaatttgagactccagaacttgaagttccaacttccaacccatttttaattagcacatacccatccgttttgaattatcgtactaagacatgataaccaccttaggttagaacataaggacaattacatacaagcatacagctttgaggagcaactaaatgtgagcacgcacactactgcactggtaaacaaaggtgaaagaaaaacataagtatttgaaatttgtttaatcacagaatagaaacaagacaatcaagctaaaataatgaagtaatggcagcatatcaaggtaaatataatgcaagaagatacctccccaccaagttgacgagcccaaacaactgctcccttgacctccttacggtgcaagtgaacaactgaatcccaggctgatgtcacactagcaaaaagtacagctgctgcatctgttgtgcatccatctcgttcaagccctgttgagaatgatggtcatattctataatttacaccaattcaagaacatgctagtggtattaaaggaaaataattgtgtacttggagcttggaaaagcaaacgatacagaaactaaggtaaagacgtgtcctgcaaaagtacagcatgaactggaaaacagaaaatatgagatataattcaagactactacaatcagccttaactttcatgtcaacaaaataatttgactcaaagaacttccaccagagcaatttcgacctagtgacatggtatacaattaaaaaaagaactgaaaaaggagtagattaggaagtcataccatggagctccatttcctctttaggaagtgaatagttgacagatacaactgtgccaatctctccagctagacgaaaaacttcacttgccatagcaaagtctcggagaccaccgaatatcacagtttttcaatccttcatcataatcaattgcatatgttatattgtcgcactgggttaaactggataaaaataaacaattacagcatatatccttgaaaaaactaagaatggtgaggtcatgaaaagcaaactagaacaggatggcaaaatttcagcataattacttcaattttttttaggtaatgctataatgccttgatggtatagaatatttgagtccacacctttgcttttctgagcttttcaccttatcagtattgaaaatactaacttcctttgatactgtaatatcctttttcaacaactgtagtggttctggttcagtaaaacatgatgcatcagaaaattaaagcgtcgagaaaatttaagaatggaaacagtgctggaatctgggtaattttcctttcaaacctgcatcttttttatgagaggtctccttatgttttgcagtagaagtatcatcttcttcatttgttgcatcagcatcctgggcttcatttgttgaatcggcatccttggcttcatttgttacatcggcatccttggcttgcatggcttacatgcaaaagcagccaggcgatcagaatctcaatcaattgaaattcagaagcaactaccaggaatagagatttaccgttttccttcttctgtaaacgctccttcagtggagcacgatgtgttgctagcttaactctaatttttctaccagcaacagaaaatccatccttttgctgaatagatcgctcagcatctttaacagttgcactgtattaatgtaaacaagtcaaatatatatatatatatatatatatatatatatatatatatatatatatatatatatatatatataaaacaggttacaggccagttttgtatgccttgtgcctagatcattttcagcagaaagatattccttcatgaatgatcacacatgacacatctgtatttgagaaaaaagaatcgagctatatcaaccaaactcttatggtttcgcttgttcattagtgcagtatataatatacggcgaaaactttgtgcagtactccttctaataagaactaactattggtttggtttatcttctgttagggacctgatagtctgatactacacagtaacacagacacaccaccactagagacactgaacaatgaatttacgcttagcattgagaaatttgctcactagaccagtacactcacgatcaaaagcagttgtggaattctggaaatatggtaaagggaaacgcattttcattgaaaacacctacaaaagcaaccactgatacttacaactgtacgaatccaaagcctcggctcgtctccgaccctgcattagaaacaaacattatcgcataagcgaagcccttaataataagcaccaccaaacaccaaacaactctggctaaacagccatggaattcctgaattctcttacctttcggcgcgaccatgaagcagcgcctcaccggcccgacctcgctgaacaccgcctcgagctacataacagcaatacatcacatcataccgcgtaccacaacactgatccccccgaaatagcacaatcctaaccccttttaagcttcgcagaggagaaaaggctaggggggcacacgcttacatcggcggacttgaaggtgtacggcaggttggagacgaacacggtggaggggctgtggcctccgccggcggccgcgtcgccttccgtggctgctcccccgccgccgcgctgcttccgcttacccatcgccgctcgccggtgtcgcgggggaggaggaggcgtgtgaagctctccagtaactcgacgagggcttttgtgggctagggtttaatgatgactagatgggctggaccgccgccacccagctagctccagatctctccgcacctcgctctcgcgatcagaagctcggtgaggcggtgaggccactagcttagctggggacgaggatgaagcgcgctcgccgcagctcccgccggcgacgacgagcaaggcggccggcgtgcgtgaagcctctacgtcagtacgttgcggtgcgttgattcgcaccggaactggaaggtccaggatggatgtgtcgggccgttctgtgggccgcttccagcccacggacgtgtttgcgttggaagcccatgacaaatacagccctacaggggagttcgagattctgagaactaacatgcaagaatgtaaaactggaaaacccggtttctaatcacttttagttagttttttggattctattattgtagatcttaaaaatctaggaaaaattttgaagctactccctccgtttcatattgtaagaatttctagcatgcctatattcacatagatgttataataaatctatacacatcattaacatctatataaatgtgggcaatgctagaaagtcttatgatatgaaaaaaatgtggacaatgctagaaagtcttatgatatgaaacggatggagtatatgttataggaaaaattgtgactgctaaaagctactccctccggtttcattttaattgacgttttggacaacgacactgtctataaaatatatctttgaccttatttttctattataatatatataataaataaatgcatgtttacttttattgtagtgttttcaaagacaaatttatatatgttgttctagtttctttaaactaaatatttttaaagttattgatggtcaaagttataaaagtttgacatcaatctcgtctaaagcgtcaattattattattatagaaccgaagggagtattcgaatagtgcatcggatcaagcagacgaactcagcttgtttgtggctggtacatggtcaagtctcattgtttccttatcagccacaacaaaaatgtgaattttgaaacgttgattttgagatttttttttttaaaaaaaatcagtattggcttctaaatcgctaatacacagctgtaaaagttttgcctataaattcttttggttgatttgtttgtttttctaaccgcttatcaaccattgagcaaacgatgagaggcttattctcatggaatttcccaacattacgtttcattcgattcaacagacacatcagacatcatgatattcttgtagtaactactttgatgtagttatagttccagaaacttgctcgtacattcttttcgctgatatggtttactaatccattcgataataacaggacccatattacaagtgcagtaagataaggaatccagactagcacatatacacaccaaaatagaagaacacccaaaataaaagggttggaactttattgctaattgctcataggaccattcatagctaagtccaccaagtcagtctgatttctgattcttttactcttttgaagggagtcagagaccaacagcagcatctcatttcagacatgtttacagatacttctgccatctgaaggttgcaaagtacttgttgctatcttttggaactggagataaatcgacaaggctaacagctactatgcattcttatgccaaagggatctgaaaggcagctgagaaagccatgaggattcagagcgtggtgatctagcggcatgagaagcgtttgtgccagtggaagcgtcctgccaaaactttagaacataaaggctttcttcttcagtgcatctcttcaagagaacgcgtgatgcatagcccttctcattcatcaaatgacagatatccagaggatcgttatcttcaagagcaatcatatacagccaccctctttcagatagcagctcacgcacagcaggaaggatccgatcaatcacttggcgcccgtttatacctccagcccaagatgaagcgatgccattggactcgatttcttcctcaggtgttggtacataaggagggttcacaacaacaacgtcaaccaaaccatgcaggcgtttctcaagacctgacacaatatcagtagcaatcacgtctgcatggacgccatgggcttcaagggttgcttgagttgtctccacagcatgttgattgatatcagtagcgaggtactgggttcctgagcctaactgcctgagcatgattgctagagatgtgataacatagccactgccacatcctatctccatgcataatcttggctttagcgtcaaaagttgtgctttgtcagaaagaagcgcatcgacaagtgcaaaggaatcatcacatggttcatacacctctggatggcttgcaacgagttgaatctgtgcggtgtttaatgtccttcctgataaagactgcaatagaaagtgtcaccatgcggatattaaaagcaacatacattactcaaataaattattccttactgaaaacatgtaattttactgagataacttgggctgaaggtgcttgtatcttaaaacagtaaacgacaaggaaacaaatcggacaacttgctatgacggaggacaatacaaaatacttttttttataaagcaacaagagcaattgctcattgtacaaatgtcacctagacctcatgattcctccgactgtgtttttcttggatattagttttctgttcaggacaataatgttgcatgtactagacaagctccattgctatgcttggattgatcaggaggggaaaaaatacagaagaaacatgtatgctcatcaatacatacaaagaaatttgtaggtagctaaactgaactgtggacagctcatttaaacgttgtggtaaagcacaagtttccaatagggccaggaatcaagcaattagtgttgacgtaaagctagcaatcagatatatcagaatgaaaagaaaatggttcagacttcagacaggggcacagggctaggcatcataaccaggttcatcgaacaaaaagaagaatcttttgccttcacagtctttcttcccatacgactgtgccggcttagctgataagcgttcatccccatatcctctgaaaagcttattgcctaattgaagccaacagaatctaaaggcggcagtgccgtatttcagcgatcttgttctttttcccatcccatctttcacaagaatccaaattcgatcgttacaaattatgattaactgcctacagaagattggccaaggattcagattccaaaaccaaatccaagctaagcttcgccaagggagattgctcatatggagattcaatgtcgcttacactcatcgcccgatcccaaagaggagaactgacacgggggaggggagggactgaaaaggagagctcaccttgcccctcctggggagccccttctcgtcgctgttggtggagagctccgacagcctcccctccaccgccgacaccgccgcgctgtcgccgcccgccatggagcaatcggagcagcaagaggaggagaaagccggagcggcggagagagagagagaggctgcggcggcgcgtgcagttgcctattggggaaaaagagaagagagagagatagagagagaagtggaagggccaagctggtcaggcttagccaactcgagtccgactcgctcgcgtcgcacccgcgcctctcggagtccgactctatccactcccgcgacgaaaaatctctccccaaaatctactacgcgaagggagtggaatcctaaacccctcctcttcctcctcctcgtcgtcgtcggcggcggcggatggtggatgctcccatggcgctcgtctccaccaccgccacagtcgcgtcgccgtcctaccactactgcgacctgctgttcccgcccgcgaggaggtggtgttgcagggcgaggagacgcggcgggggcggggggcgggtcgcggtggtggccgcgagggcgccgagggaggcggcggcggcggcggtggtggtggagaatggggggcactcttacgaggtggagtcgctgatcgaccggctgagcaacctgccgccgcgggggtccatcgcgcggtgcctcgagacggcgcgccaccggctcacgctgcaggacttcgccgcggtgtaccgcgagttctcccgccgcggcgactggcagcggtcgctccggctgttcaagtacatgcagcgccagtcgtggtgccgccccgacgagcacatccacgccatcgtcatcggcgtgctcgggcgccagggccccgccctgctcgacaagtgcctcgaggtattccatgacctcccctccgagtcgcgcaccgcgctctcctacacctccctcatcgccgcctacgcgcgcaacgcgctgcacgaggaggcccgcgagctgctcgaccagatgaaggcctccggcgtcgcgcccaccgccgccacgtacaacaccgtgctcgccgcctgcgctcgcgccaccgatccgccggtcccgttcgacatgctgctcggcctcttcgctgaaatgcgccatgacccttccccctccgttcgtcccgacctcaccacctacaacaccctcctcgccgctgccgctgtacgcgctctctccgaccagtccgagatgctgctgcgcaccatgctcgaggccggtgtcttgccggacaccgcatcttaccgccacattgttgatgccttcgctggtgctggtaacctctcccgtgtggccgagctgtttgccgagatgtcagcaacggggcacactccagacccatctgcgtatcttgggctgatggaagctcacacgctggttggtgccactgctgaagcggtagctgtgctgcggcagatgcaggctgatggctgtccgccgacagctgcgacataccgtgtcttgcttgatctgtatggcagacaggggaggtttgatggcgtgcgcgagctcttccgcgagatgagaacaactgtacctccagacacagccacatacaatgtcctgttccgcgtttttggggacggtggcttcttcaaggaggtggtggagctcttccaagatatgcttcactctgaagtagagcctgatattgatacatgtgaaaacgtcatggttgcgtgtggtcgtggtggactccatgaggatgcaagggaagttcttgactatatcacaacagaaggaatggtgcctactgcaaaggcctacactggcctagttgaagcgcttggccatgcagctatgtatgaggtcagatgttgtatcatatattgatgaattgactcttaagataccccttttgtgataaaatgtttcatgatgttatatttgattccaggaggcttatgttgcattcaacatgatgactgaaattggaagcttgccaactatagagacctacaatgctcttgcaaatgcatttgcaaagggtggccttttccaggaggctgaggccatcttttctcgaatgaccaacaatgctgctattcagaaagacaaggattcattcgatgctctcattgaagcgtattgccagggtgcacagttagatgatgcagttaaggcatacatggagatgcggaagtccaggtttaatccagatgaacgctcccttgagggggtactcaatgcctactgcatagcaggtgttatagatgagagcaaagagcagtttgaagaacttcagtccatggtgactgttcctagcattattgcttattgcatgatgttgtcactctatgccaggaatgacaggtaactatcaaagaaaccttcatgctgttttaattaaaacttatgtggttctgattgtaaatgtaaagcattgagagtgataaatagggaataactttaatcaactaaactggctggttttggggctgtagaaaaatatatttggactagctatgtggggcccaaatgtcagccacaaggaatgtttaaaggagtaaagatttgattaatcacataaatgaccataaaaatatatttagatttgattaatcactatatggaatttgaaatataaattttatatatgaccataaaaaaacttcctctaagtaacatggggctaggtctaggggcaatcgcatgtctgttttgtgaaattccataaaatttgaatggcggtttgatagattaggaattctaccccctttgttggtccagttaacttgatatgccatatgcggcatgtaatgctgtaagtctgtaacacacttgttgctccaatcttgcaattttactctcatttcatacgctgcagaactttattactctaccgattcatatttctagagaccacttgtttctttatggttcttgaggggtttgaattcatatttgtaccttaaaatttgagaaagatctgggctgtgatatctttccttttttcctttgttctctcttcctgttatttatcctgcttaaatcatttagagttttgaccagcatcattcaggtagcattgataggcacaaggccaaaacttgaatactttgatctaaaagcacttaatattagaacaacacaaggtactataaatgatgtggacatcaaaatttctagaatccttaaaatgtaatgaaactacaacataaccgatgtacaatttcaggtggacagatgcttatgatctgttggaagaaatgaaaacaaaccgtgctagtagtacacatcaagtgattgcttccatgatcaaaggggagtatgacgatgactccaattggcaaatggtcgaatatgttcttgacaacagtaacttggaaggctgtgactacagtttacgattctttaatgcactccttgatgtcctttggtggtttggccagaagggtcgagctgcaagggttttggatcaagcattaaaatatgggctcttccctgagttatttcgtgataccaagctggtctggtctgcagatgtgcataggtaatattatttatcactctcatctggttctgtgagtgatccagtttttttattcgtcaagcggtgcttaaggttgtttgcatttgcaggatgtcagtaggtggatcattagtggctgtgtcagtgtggctcaataaactttatgatagactaaaaggcgatgaagatcttcctcagttagcctcagttgttgtattgtaagcttttagcttaagatttaccatgttctatagttatatcatgatatgttctagcactgttctggaatcgagttcgtgattcccatgattatttcttgtcttttcacttgcataaagaaatgcaatacgtagctacttatacatttttccgtttgctctaattgactgacagttctctgattgccaggaggggacaaatggagaaaagcacagttacaaggggattgccgattgcaaaagttgtgtactcttttctgaatgatacactatcatcatccttccattatccaaaatggaacaagggacgaatcatatgtttgaagtcccagttgaaaaagctccaggcagccatagattcttccaatggtgctgcaatttctggttttgttcccatgacaaactctcatttgccatcccctggttccaaattgtacactagggagtcccaagctgataatggttctgcccatttgactgatgaaaccttggtagaagaaaaggaatcagaactccttgcactgtgagttttcaggagcttgctgcctccttccttttgcagatgcgatgttatctggccgaacaagggaagataagacacagaatgtctcacaattttgaagtttgggcaatcagatcgtcctaatgtgcaatgagatggccttatgcctttgcagtgctctcttgcttcactatatgcagtggacgtgactcccaatatccacaatcttgcctagaacccagcacataagcatgagttcgtgatactggatttgcgctaacttgatagacaatgctggacttccagttgtgtttcaggatgtagcacttagtagggagaatcagagtatgcatgttgttgttagttgctcacttgttctatatgacatttcgtgcctgccccattcggcaagaacgaaccctgtctggaatatatggattcactcgatgcaagtaaaacatgctgatgagtcagtggaacacatcagtcatcgatacgtttctgatggaaataatatcgggagtttgtatcaccgtatggttccagttcctacatgatgtatcagtgtgcccgatctttttaatgcaagctgccttctaaaaatattcttgtgtatgatgctgccatgctggtgtttgtttttgaattcgtggtgtaagatcttgaaagcttatataagtaacaaatatgaaggtttaatttgtgcaatgacattaatagacgtgtcaagaaaatacttttatgtagttatattttatataattcgtatgaatatatgatcagagaagagtatgtaatcaagcctgtgcgagcgagtattttgtagtaaactgtaatgatataatcaagttctccaggcctccagctaagtgagtcgaaaaatagtactccagcctgttttttttttaccttatagtctttttaaaaaaacttattttaggatgtatttttttcgtagcgacaacatcattggcgtcgtggtctaacatgacggcattaatgtcattgacacctccccccttgcctcctaaccccactagtgaaagctaagtctaatctatactttatataaaattataaccaactaattccaaagcttaacatgcaaccatgccacatcatcacccaccaacaataattacatattcaacctcatgcaagcatgaaagagcatctacaatctatttaattctacaaattaacatgcaagcatattcaatcaccatctctcacatcatttccctaatagttttacaaatatctttatcatttttatattatttaatatatatacttatcaacatgttctacattaaagtgtaaattttatttgtttcatggtaaatattgataagcccaaagatttgatttttttttctttttactcctagctgaattataacgaaaaataatattaaaatttacttagtaatttccgaagcaaagcgcggggaatcccctagtataaagtatatcgacgtcgaggacatatttgtgatttttttaaaaaatgatctatttataataaatatatttacatttagaccctcgatgtgtcatcggcatcgaaaacctatttgtaaatatatattttttaattgcaaatatgtcattcgtaatattttttacaaatagtaattggtgccaatgaccgaccccctttatattagttacttaacttttacttttgcgggtgatagggacaatgccaacgtcgttgacataatcatgttagatcatgacgctaatgatgttggcgccataaaaatagtctattcctgtaataagttatttcatgggtctatttataaaataagttttttaaaaaataatcaaaaggtaaaaaaaatccatgttctctagttatgtaattggatcatgagtagatatacatgtgtgctagcaatagcaagtttaactttttgactaaaaaccgtaaattttcaagcgaggtaaattttcaagcctcgcacgggataaaagtagatttcgagcgaaatttcaaatgatttttaagaggtcatacataaatcaataaaatccgacagaaatttaattgaaatttgccaaagtttcatgttaccaagtcagaatcagggtttactaaactattttgggtgagtttaccaccaccccataataagacggttatcccgataattacacattaccgtaaaaaaccgtactgctaccgtgagatttatcatactgcacgtgatatccgtgataagtgcgtaaccgtatggcttttgcaaatgcaggccacagctcttgatttctcgctggatcctggttttcaccaaatcacctgcatcgcgtgatcgcggccgctaccgtgcacagtaactctgaaccagagctacccccaccaaccggagtatcggactccggaagccggaagcgacggcgccgcccgatatggaggcggagtcggcggcggcgaggcaggcgaaggagtcgctggagctggcgttccagatgtctcagatcctcgacaccggcctcgaccgccacacgctgtcgctgctcatggcgctctgcgaccgcggcgccaaccccgaggccctcgccgccctcgtccgcgagctctcctccgcggctcctccgaccaccgccgccgccgcacccagccccgcgtccaacgccaccgcggcgccgtccgcaaaagccgcgtcgcttttcccctccggtcttcgcaaaccctagggttcgtgcccccttctctcagacgagatcacactatcacttgatcctacattacgttgtcttagaatgtaaactagcggatcgttctgctctgtagattcgttttagccgcaacaccttcctggcttgtatcctcaagagattatgcacaatttttctatcagaactccttaattttaggagatcgtgacatggatccgttcagagatatggggatatcggtatgacatgaatatttgattgcggagacacttgtggcattaagactgagaactcatatttgtttgggcacttgataattttgaattcaacttccactgacatggaacggcctcatgaattgccatcttgatgttgcattgttctagagaactcctgttagctagttgttctttgtcagttacaattatggtatagccatttgtcaacaacttataatttcatcagttatgtaggttggttgcattttgatcctacctatgttttctttgtcgccctgggttaaagtggttatatacccatcaagttagttcattatccttcaatagttttcctagataaaaaggtcatgcttgagaactgtaggttatgtggggtttggtcatgtcttttgaccaaacgaggcactgaaaacacagcctatgctccccaccaggcaccagcaatgtatgtgggttggctttgctgatgtaccaagtagtaacgttggattcaactgagatctctgtttatagtccgataattataggcttttgatgtttatactgtgcattgctcagagtaaaaaaaaaattgaatagaagcctttcaactgctatgatactttgaaactaacaaccttaatactaacttgagacaagttgcaaatggttcctaacactcgttttcccttagcctgaccagacttattgcagtgctttaaatctcagattacatcccactgtgatcactgccagcagtagcaatttttttacagtcatttcaacactacgctaccttagtttttggcaacatttcaatgctacctttggtttcacttatcaagcatgatagaaatatataatgttcttgtggtttcaagctttgttagtggcttcttatcaggttcagctagacttaaactggatttcattgcaaactgttttttcttggtatagttgccgtgagttaactgttacctgtacgcttaagcagttactgaagaccgagtggaaccgatgtgcttgattttaaggtagagcagactcgagatttgattgctgggagaaaggtattgacaatcttaagggagatgtaaaatctttctttagaatgtatttgtgatgttgtgactggcctgtttcctcaaggaaggtgtggttcatggaacgctgtgtgctttgcttgacttgtggaagataagtgttctagtaatcatgggaatgttgcctttcccatttctaatagccaattgtatgtatcagcaagacatatggtcttttgttaattatcctctcttgaccttgaagtcctttgctttgccacatgcttatccaagaaggaatgtgtcatctccattggttgaactctcattttcagataacaatgaaagcaatgtgaatgttatctctgttccaccatctggttcaagttcaagtgcactgcagcttttcttttcttttttcttgaactgacactgcagcttttcatttctgctccatttggccccttttcaccaaattctactcttggttttatcctgtccagataaaaaggatagcatttcaattccgttcatgcaagtggtgaataaacttgatcaagcctttttagagaataaactttatgaagccatgtcacttctgcattcctgcctacaaagtcaggtctttatatggtcagggttggtggttgaatctttataaaaaaggtgaaaataactgaatcgaatcgaacaataatagatgtaaaaagtttttttaggccgacttgccttagactaggctagtctttgtattttgtgtggcctagtgggctggttcgcccacgcaatttcaggtcatttttatggaaaaaaaaacaatcatttaggtcggggccagcgaagatgagggcggaggcgaggtgcacagcggtggccggagatgtcgcagaagcggcagctggaggagagcagcggtagcagagcggaggcatgggggcccctggcccagccaaatctggggctgggagctcgtcgccgccccaccgctacggggagcccaagcatcagatggtccctgccctccgcgagtatatcccctccgttatctttgagaactcgattggaacccccatggttgtgtttgtgtggttggttgtctgatttggtgccggtgtgtggcttgccttcgtgcaggatgatcacggaggtgatgcagaaaagcagcattgaaaagttgttcatggctattgagcccctcatccgaagaatggtgaggcagcctatggaacctactttcttattttccatttctcacccatgtgtcatgaatttataggaagatatgactttttggtatatgatgtgcatgttttatctgtatccccttttgttctgttgggcttagggttatgtttgttgctaacgtggcttttatattgttcattcataattttatcgaaagtttcatctgtatctggtgcagctggcattcttagatctgttttgtacttttgaattacacaaaccctacttgtagtcttcaacttaatgtaaggaaccctgtaaatccgtaaattgaaacctaacaagtatttaatccctggaagactgttaattcctgacctccattttttggtttcatttgtttctatttagaagatagtattttcacccaaagccattgaaagtttatcctaggcaggattttcttcagccatgtgttatttggctgtccaatgatggccttcaggccttgatgttttatccgattgtaatttctaggtgaaagaagaaatcgagtcagcgtttgcaaatcatgccattatgatggcaaggtacgacattgtaacactgtcttaaactactatttgacaagtatcagccactgtatagattcattaagctaatgcagctttctttaagtttaacaacttgatttcttattttcccattagaactgtcatggacgttgttccacctacatcgaaaaatttccagctacagttcatgactaagctttcacttccaattttcactagctccaagattgaaggagagagctccttaagcataactattgctctagttgacactgttaccagagaagttgtagcatcaggcgatgagtccctgatgaaagttgaaatagtagttttagagggggattttgaaggtggagaaggcgatgactggacagctcaggagtttaacaataacattattagagcaagggaaggcaaatgaaccttgcttctggggacatttttgttggccttactaacggcatcagtacaatgggggaactatcattcacacataattccagttggacatgcagccgtaagtgtggttaaaagcattattttgttatgttgagaaatataaaaccatgaaacaatatatttcttagatttgaatgaataaattgtttttctgtggatggtcatggtaatctgagctcaaaagttttttcctcagcaagcagatgtcacatttctatccatatgtctgaatttgtcattgtttaattgtgttgtagcatgcttttgcagatgatagtgctattcagcaaaatatatggatatattggccctcttattctcaaaccatgcagatattgggcagtggtatgtcaacaaagatgtgggaggtcacagttgagcattcaaaaacttgtattctcactgacaaggtgcatttgtactatccacacagcctaatcaaaacagctgtcgtgttcaatgttgttggagaagtgagagggctaatatctgagaagttcgtttgtgctgatgatcttatggaaaaggataaggtattcacattttctctctcaacctagttacttagagaagattcttgtgtatttccctccaccagttaaaatctggaccatttttttaaccctgacttttgttctttctaggctgaagcacatgcagctgtgaagcaagcgtatgaaaattggaagaatgtatattcacctataacaatgaaacagcacttccatcaaatcattcacagctcctcgatgtgagatctccatcattgctcgcaaatgaatataaccaattcccaacacaggtttctactgatggttttggtttgagccagtcaagcataccatcagctgacattggatccttgtcaactgggaactgcagaaagcaatgaaaatcaatatcagcccgatttacccccacttggtggccatggaccacccgtagtatcacagacaatggataaagttctctaatttggtttatgatgattgcgccagtcatccctcattcagtgaagattactatcgttgtgcagatccatctgtatcctttgacacacaaagaccttgagctgcactgaaaggcttcgttgcaacgatatctaagcccaaggccgggtgtagagaatggaggacattgtcttatgttctagggtggatattctacaccaataggattgttgctctgaaaagaacgaaacctgggaaatgacggttttcctacttgtttatccctgtggactgtggttgtttagttaaactgtgaaatatatactatctccatctcaaaatgtttgacgctgttgacttttttaaaaatcccaaaatgtttgacgccgttgacttttttaaaaatatttgacctttcgtcttattcaaaaaatttaagtaattgttaattctttttctatcatttgatttattgttaaatatacatttatatatacatatagttttacacatatcacaaaagtttttgaataaaacgaacggtcaaacatgtttaaaaaagtcaacggtgtcaaacatttaggaaaggagggagtagtatataagtggggaaaagggaaatcatgtacatatgactatgagcttggcagtctcgtaatctttttgggcacagagctggtacgctttgctggtttacgagctacatccaacatttttgtttttagcaagagcattcagcattgcctgtaaataatcggatgaagttttgtgaatttaatccgtaaacatttgtggatggtgtcgactaaaccatgttctctagctcacctgagtagcacttcaaggtcctgaaatcaaatagtatcagattgggttatttgagggttaagttacttgtttgataggttgagtttctaatttaaaaatgttgtatatatccggttggatgtaggtacccttctctaggtctccagctcaattgcggttatcatcagctagttatatgatgttggcaagaacaatgttcctgcaacattagttcccctttcactcttaacagtttgcattgtttttcgcactattctattggattgatgaaatgtcttgattagagacagacgttagagacagacgttgatgaaatgtcttgatcaaagtgagcatcgctgatcactccatgctgactggagtaaagaacagtaccaaaaaaaaaacagtgatttggtgttcgcaggtgccaacgtctttattccctggtcactgcctgccaaaccctgcaagcactccacgcattatattagcgtgtgattactgatttgctggcacttggcagaattatcccaaaacctaatcagtacttgcaaccattactttaaacttgattacattacatgattcggtggtcggttgattgattgataccttgcggccgaaatcctcattactactactgcatgttaggaactgaataaagaagaggaggttccctctagatcctttacttgcacctttggcctttcttttctccttaatctacccacatggagggatccatgtggcccccagtatcaagttcaggtctccttgtgggccccaacggactcatttactcctcactcattaccatccaaactcctcttttaaccactgtaaatttattactccttgctaataatcctaataatagtcacattgcttagatttgtagtagtagtagtaataatttaacagtgtggtttgactgagaaaaccgcgagattggtggcagcctccacgaaaggagggcgtttgatatgattatatatatgcaggaaaaaaacgagatatccctgccgtgcgtcgcggcaacaaaccgccggcaaaccaaacgggcgtgaaatcatttcggaaaccccccatccctcctcccctttttcctcgtaataaccggacgccgacgcggccccccgcctaggctgccgcagctgaaccacggcgcaagcgcaaccaccacgccgcgcgtacgcagcgcggcagtaaaagttgcggtagaaaacggcaaaaacgccaccaccgccatcacggctgcgggctaccaccaccacggcaccaccgcgtggtttgactcgtcgccgactcagatcgcctcgtcggtgacacacacccacacacggcgagaaagagtgagagaaagacgaagtggaggactccccccactctataaatttactggggtttggttggtgcgtgtgcagtgcagtgtgcgtgagtcatcgcggagtcgtcagtgtttcatcgtgtgcgccgcgccgctgcgtgcagtgcgttgcgttcctccactcccgcggcgaccgcttcaactcgcgcatctcgaggaggccggctcggctgctgcgcctcactctcactctcactcacactgcagtggtggtagtggtaggcaatggcggcgccggcgccgaagcaggaggaactgcagccgcacgcggtgaaggaccagctgccggccatctcctactgcctcaccagccctcccccatggcgtcagtgcccattccctctctcatcctctctctctgcattccaggagtggatcgatcgatctccatggttggctgcttgacggcgccttcggtttctttctgcagcggaggccatcctgctcggattccagcactacctcgtcatgctcggcaccacggtcatcatccccaccgcgctcgtcccccagatgggcggcggcaatgtacgtcccctcctcccgccgccgccgcggcgtcgcaccgctcacttgcttctgtgactcactcatttggctgccgatggatgcaggaggagaaggcgcgggtgatccagacgctgctgttcgtcgccggcatcaacacgctgatccagagcttcctcggcacgcgcctgcccgccgtcatcgggggctcctacaccttcgtcgcgcccaccatctccatcatcctcgccggccgctacaacggcattgccgatccccacgaggtcgccctcctcactcccccccgcacccacgcaaagtttgctcctcttctgtttgactccttgctgtattgacactgacaaatgtggcgtgctgggttcggcatggcgttgcagaaattcgtgcgcatcatgcggggaacgcagggcgcactcatagtggcctccacgctccaaatcatcatggggttcagtgggctctggcggattgtcgtcaggtgtgcatgtctcatcctcagggttcagattccaggtcgtttgatcagtgtaccttaactggccctatcattctgctaattcatgtttatattcttgtaatgttgcaggctgctgagcccactgtccgcagcaccattggttgcgcttgttggatttgggctctatgagcttggattcccaagtgtgagtattttgtactacaattgtacatgtacagtcgtctggatgtatttgcaacagtggtatgacagcataaatttactatgcaggttgccaaatgtgtggagattggccttccacaaatcatactgctggtggctctttcccaggtatacatcaagatggctattgtgtgaattctaacggtggatgaatccttatgaatgttgtgtaaatctttgtgcagtacatacctaagctggtgcctttgttggggactgcgttcgagcgtttcgccatcataatgtctgtggcccttgtctggctttacgccttcttcctgactgttggtggggcgtacaagaatgctgctccgaagacacaatttcactgtcgaactgatcgatctgggcttgtagggggtgctccatggtaataccatgcatctatttccatgccatcctaacgtcggaaaggcgttacattacatctgtttgcatttatatcctgcaattggcagtttggcactaaagaaaagattagctaatataaatagattttcgtctgcattttataggataagtgtaccttacccattccagtggggagcaccaacgtttgatgctggtgaagcttttgcaatgatggcagcttcttttgttgctcttgtggaggtactgtggatatatctatggtttttagggggaggtgcagtatgttagagggcattatgcatcaaccagctaatattccttactgtctaatgcagtctactggtgcattcattgctgtctcacggtacgccagtgcaacaccatgccctccttctgttatgagtcgcggcattggttggcaggtaccatctagactccttaatctgcaaatattttgtccgagttcttgacaattcaaatggcatgcaggcatcttacctactttatttgtttgtgtgttgcctagggggttggtattttgctgggtggcttatttggaacagctaatggatcatctgtatctgtgtaagtacattctagattactgttgcctatattttactgttttatacagtttcatattaatactagcatttgatgttggtctgagatactttgtaccgttctggaacagtgaaaatgctggtttgctaggtttgacacgtgttggcagcagacgtgtggtgcagatttctgctggatttatgattttcttctctattcttggtaagcctaatgctttgatgtaattatgtatttagatggttttgatcgtactcttctgtcaagtaaagatgtatttgtgagtttgtgagagtggaaaaggtgaagttctatatccaggctgttatccatgacctgatcaagtatttcctgtaatgttcagaggtggtttgttaatggttccaacgactgatagctggataaatagctaagcttaaaatcagttcatgaatagtttctcaaggagccgcagttagccagaagctgaatattacaggaaatactattgcacaatagcaaggctgacactgactcagatttaactaaagttaaagtcgtgattactgcataaaaacctatacttgtgatgttctctcaggctttcataatttcttttgcttatttaagcttatcatcttgtcatacaactttaaagcatccttgttatgctcctgcaatactgacaataagcatgtacttcatctggttgtactgattctgtgttgcgttcctagggaaatttggagcggtatttgcttcaattccaggcccaataattgcagctatatactgtcttctctttgcatatgtcggtatgtacaatgaagagaatcttaaatgataaatctagctttctttctatcatatttgaattatgaacacctgcaatatatttggtttctgtccacaggtatggcaggagtagggttccttcagttttgcaacctgaacagcttccgaacaaaattcatcgtgggattctccgtgtttatgggtttgtcggttccacagtatttcaacgagtacacctctgttgcaggctatggcccagtacacactcacgcaagatgggtaagacccagtaaatatactcaagtgttactactcctttcatgaacctaacaattgatggttatgtttgttcctgtttgctctttcccagttcaatgatatgatcaatgtggtattctcgtcaaaagcattcgtcggaggcgctgtagcatatttgttggacaataccctccagaggcatgacagcactgccaggaaggaccgggggcaccatttctgggacagattcaggtcgttcaggacagacccacgcagcgaggagttctactctctgcctttcaacctcaacaagttcttcccatccttctgattttgcacgccagtgttttgtatcaaattgggatagcattgtagtacgattagttcttgggtaagtaattctagcattgccagattgttgtttctcctagtgtttttatactcctgagttctgaatcctgcagaccccagtgtaaaactatctgaggaaggagaaatgactcggtatttttgggtgtatattagttcggattaacagttaaatcaacaaactgaaaatgcctagtttttcttcccccgaggctgtaatttcagctgtgattttactatcttcagtgtaagcagttaaatcctttcagctgtgatttcactatcttgctgatcttctcgtggtatatggattgccttttcttcttcagacgacctaaaaaagaagtggaacagagtgcttcaaactgagcagatgatctacaaactgaaccatgagcccatgacgagatggaaatccaattggaccttgaattcgtccaaaccaaccagctgatcttgacaatgatacgtctctcttctttttttctcatgcctcatgcatgttcgagacaaaactctcaaaagcattgtcagtggagcccatctgccggtgacacctttggatcgttgacatgccaggtgtgagagtgtgaaaccacatgtgaaagagcatggtcatatgcgctagtagaattttccaatttgaatttaactcgttcggatcaacaaacctaccagaaaatccggaccatttcaactcgaaacagcgagctgcagcctgcaggtgcagggggagtcgcgtacacgacctcgtcaagtaccaaccactcacatgcaattatatgcaaaacagaaaaaaaaaacactttctaactctttatttcgtgcacatacagcaagtacaaatattatactcccatttagcaaccgacgttaaacgtgacaatacacgagggatactaattctttatttgaaccgtgaaattcgccagcaaccaatagtagatctgatgcaacggaaccaaactaccaaaggaggacagtttaaattcaaaattccctgatggctccctgaaattcctctgttacaatttatttttttaatcccccaataattagctgcttataatataataatcaattaagaaattaattaatcctttgctccctgattgcctctctgcctcgctgtacattgcccacttcgccgcccgtttcggtttccctttcttcattcttcttcttctcatcccaaatctctcctcctcccatcccgccgcgcccgcgagagatcagcagctactcgactcgactcgactcgaatcgaatccgaggtgcgcgccactcgctcgctgcgattctcctcttcttcttctgctggtttcgatcggttgcttgcttcttctgcggttgctttgcttgggatctctgcttacgttgctgttgtttgggggtttggatctcgggctgtgcgtgtggtggtgcaggggggcggcggcgaggggtggtggtggtcggccatggcgcaccgggtggacaacgagtacgactacctcttcaagatcgtgctcatcggcgactccggcgtcggcaagtccaacatcctctcgcgattcacccgcaacgagttctgcctcgagtccaagtccaccattggcgtcgagttcgccacccgcacgctccaggtcccccttccctcgcgcgatccatcctcttctctcgcgactatggttcagaatagtagtgttggggatttcgcatgtcaccattgcgttcgatgcatttttgtttgattggcctgtcgtgatgtagggtttttctgtttgatatgagatgattacttcgcgtgtactgaacatgaattaagttcagttcaattctgtgaatctgacgaacgaaatggggggaaaaatatctactactattgattaatgatgcacacgttgagctctgactctttttgcatgtaccactcgtttaatagtagtatgtcattttgttgtgcttcatggggcccttggaatgatttgaagaaagtaactttattcttaactgcactggtatcaacataaatcagatccataggtacagagctacagaggtactaagtatcatttatcatgtccttatttaattgattaaggggatattaagaaaaaacttgaattacatgttgctaaagtcaatttggtagtcaatgtagaagatggtgagctttatgctgtgctagttgaacttatgttgctaacttatatgtggtgcataaatctctactttttctgttggaagttctacaactgctttggcgtatttcactcaactgtctttcaatattggaagtatctctgaaacatgcatttatattgcattgccttctgatttcgtataaatccaaactttgcagtttgtcatccattattttgtttataccttgacttgggtgtatggattatgcgtatcattatttgaacagtatatttcacattgcaccatatattttgaccaaagtttcacaatgggcaaggtccaaaccaaccttttttcacttaacaccatatatctttgcactagttggcactttggactagggttgagcacatcaaaggaagttgtcagagaaaagctagtttaaatcatcaattttagtgccacaatattaggataaatatctttagaaaaagttagcaaatcagaaaataacttttttcagcaaatcacactaaaacaatgacgtgaacatgtttaaaagtggcacaaaatgatctatacattggggcaaatgaataaatagaaaatagaactagttaattaccacacactgaaaagaaggaagaaaacataaaatgttttgccttttataattatccctatgtaaatcatatgaatttctctcatattcccttgttttgctcaccccttgtccaaactgaaaacttatgtaaagatgtatgatgttagtgaaaacattgatttaaccctagtccattatgaaaccttggtcaaaatatgtggcccattgtaaaatttactcttatttcaatagcatgttaaagtataccgttatctttgtaacgtcataaagcttgtattaagttcataacaccggcgtggtaactataattctgcaggaattttttatttgatttgctctgttgctggagcattgctgatgcatttacagagcttctgaagtctgagcagtgtatttatcattattcggtatacttgctcaattcaaactgcttgttaaaaaatgatagcaacttgcactgcatagattgtacaagtggatcctgtccagaaatattttaggagaagggtaacattttggggaggtcggaagggggtatgtaccattactcttttgttttcttttagtgttgtaggcctctgaatgtacctgacggttaacacacactgtttctatagatgagtcttttgattaatttgttgcatttcagagaacttctgaattttgggagctgttttgcctgtataaggctctgatatagtgaacttgtaatagaccttaacaatctaatttcaccatactatagcgacttctttcatggcaaatactcaagttaaatttatccatgatattggtattttggctcaccatattaggtatgttggtctttcttatttagtgtggtatcatgtatacagatagaagggcagaccatcaaagctcagatatgggatactgctgggcaggagaggtaccgtgcaatcacaagtgcttactaccggggagctgtgggggcacttctagtctatgacataacaaagaagcagacgtttgaaaacatccagaggtggcttcgtgaacttcgtgatcatgcggactccaacattgtcattatgatggtaggcaacaaatcagaccttaaccacctgagatcagttccagaggaagatggtcaggcactagcagagaaggaaggtctatcattcctcgagacctcagctctggaagcccttaatgttgagaaggcatttcagactatccttaaagatattcatcaaatcatcagcaagaaggcacttgctgcccaagaggcagcaggcagtggacctcccactcaaggaaccaccatcaatgttactgattctgctgttaacacaaagagaggatgctgttcttcctaggtgcaaccgaagatttggtgatgctgcaaaaggaaattcccatggatcttacagcactaggtgttatgtaggtcgcttgactccttttggcctgtaattctggtggggttgtaatcacaatttaaatcgctagaaagaaatattccttttaaggtagataccatgtgtagttgcaaaattttggtagagactgttgctgggcaagactttctacagtttcatatctatatcatgttttctatcagtatgcttgtgttatatatcttgttatagtctaaattgttggagctgagaaatactatgatgttttccatgttggtgtaatatccagcatcttcctgctagaaactaaaaacatttatttttgcctttttggtggtattatccattccaacttatgaactgaacagctaatatatctccattctcacttgtactgcattttgcctttctgctgatcctgtttctttcttctcacttgttgcttgaagtatactgcatctgcggtccctgctcacgtgtatcacatccttcgattagttggtgtaacatcaggatttcagttcatttgattcagcgttttttacattattaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctctgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttatagaatcagttctatgctatctgctttagcataatctgcttttccattggaccgggaacagcatactttggcatcgttgtcagtgctggcctggccatgcatagaccatttgtgtcatgagagacatttgttctaagactcctaccttaaaactccatgtaactttgatccacattcgcttctgactttatatcatgagaaagttaatcattcttccatttttgggctggttcatttcaggacatttttatttatgctgattcagacatcaacttggtgatcatagaacatttgaacattatcatgaaaaattttaatcattcttccatttttgggctggttcatttcaggacatttttatttatgctgattcagacatcaacttggcgatcatagaacatttgaacagtaatgcatgtttgcatgcatggagaatcttacagagataaggcaagcaggtgacaattccttgtgatttttcatcatacctcttgtggtcttatattgtgagactgatctgatctcactgaagaagaatatgttctcctggcacaaatgtcagtcaatcctttctgctaggatggagatagatgcctttttttctgcatttttccttttgcgattacatgaaagacgtctacgcatacagaccacacggactgccattcgcgagtacacccctttaacatatgctcaagagtcacactcatgtatgaatgatcgtagatattatgatttgatcttgataaatggagtcatgcacctacaactccgctaacatatcctttttgggatcagaagccaaagagggtccatcttttatagaaagcaagaactacatcaatatatcaaaggtgtttatcctatttcttttttgcaaattggaggacaagagagtggcaaaaaaaaatcttgcaggtatgtcaactgcagagtctcctcctctggattcttgatggacgcaacatctgccgaatcgtgttctgttcacttccaagaatgtgcagccaattagctgcaacggccttccctttctttctctccctttttcgaggctcaaaagatgttcgagaaaactctagctcgctttttgctcgtacgttcaaaatacggtgcatctctctaaatataaatttcaatctaatggcaggcaggcttggagctgattgtgatctgtcctgctggtgattatcactcatgtgttctctgctagattctgaattttgtggccataacgcgttttcattctagaaaggatgtttggatgtcgaaatttctttgcttggtgccttctattttgaattcaagttaaactaaattctaaagatttaattcgatatggagggcaatttgatatggtcaaaacctgttgaagcttcatagtacaccacaggtgagttgatccagtttaagctgaaatcaaaagcagctttagtgcacttttttcacgaaaattttgactaagagggttgattttagcattcagtaaagatattctgcatacgaatacccacggaaatctgaaactttgaattcaaaagatttgagaccatggaaattgaagccagagtacaaacaacctttttagagaagatagttcagaaaattaaataatgtttaatcgattaataatcgaacattcacgatggactgatggtgtgcgcactatgctaaccaacttccaattgatcgtccaattagtgcgtgtcggatacaggagcaattattataataaatctttactcgatcactagaaatctacatatattaatctgtaattctgtatggaccatgcatagctaattttgtactccagcagaggcaccaataagcatataaatgtgagattttattcaaatttttaatagcagtcctattaattaatgtttgtaggcaccattttacctgtcatggaaaagaaggttcatcccacaatctatatgcatgtcctcatcagacttagacttgctagaaagagattaattatgacctgctggttaattaataaaaggactcactggtggctactggctagctagctaggatgcaatctagttttgagtataattaagttgctatggctcatgttcctctctagctagctgcagttaaatatatatgatataccggtcatgtggttgaccaggagattacccactaaaattctggagctaatcatggtctagttctcatcatggagttattgtggctagaattaattccatgctagctcaacaactgtcaaaaaaagggaaattaaacagatgcgtttgagtgttatagctttttaattacttattaagcgtgatgatagtatccaccgaccactgtaactagattagagctaatttaataagtagagttaactattaattataagttaatttaaagtagaactagagctaaaatgtataattataatagattattttttcctctctttttctctacttgtataattaatgcatttgcttaagagcatttgtagaactaactcttaaatgagaagtagcacagtaacactctatatttttattctctttcatatagattaatcagttggcttatagcttactattaaacttgctctttcatatagattaatgagttggcttataacttactattaaactttcatatagattaatcagttggcttatagcttaatataagtattttacatgagttttagcagagattattgttaaaatgaaattactttgatgtcccacgatacaataataaataaagaaaatcataactgttggttggataaataggaaattagtacttataaatgctagtatttgcaggcaaatttcaaaagttagacgtcacatttgtggatggagagaacactactgtactgtgtgcgcatcgatcatcttgtcccaatcgagtacttgtgcaacaattataattattcttccattttaaattacttattgttctaagtttattatcccaagttaaactttttaatctttaatcatcaatttctataaactcatatagttttatatcataatatttatattgttatattcaccttaaaaatactttataatatataattcatgtgttattaaactacactacaaatttaatggtaaaaataaatatgtttgacttaggataatctaaaataaccaataatttaaaacggagaaagtgtacattaaaccatttacaactactgtaaggtagtctcacgctaccaattctaatatatacactactagttcggtgcactaattcaatagtagcatgtatctcagtcttaccatatcttgaactttatcaaaggttgccacatcttgtgttagatgtttgactttatcctcttgtttggttcatacttgtggaaagattctctcttattttttatggtcttatatatctacaattctattttgttagttaaggtgtgtctcactttttgctagctatatacatcttaaacaagtgtggcataaaagtatgacaaatggtgcaaaacttattagaggacgtttggatgtatatcaaagtatggcaaatgatggcaaacatagtatccgagctagctcttgtatgcttgacagtatgtgacctatattgtttctctcttgtcgtcaactcaagttacatatcatcttttttgcaccacatagcacaataatagatcatagcctatgtacatctcagttgtataaaggaataattgtgttatctcgatgtaatttatgtaattatctacgatcagtaaagttttttttaatctaaagtaatatggtactattataagtggagcattttgaatagttttgcatgttgctaatttatcaaacaccacacggtaggatattcattgcttgacactgaattattgtaattctgatgtgattatttaataagtcttcccctgtgtattactctctccgtttcacaatgtaagactttctagtattgtccacattcatatacttgtgtctagaatctagaatcattaacatgtatatgaatatggacaatgctagaaaatcttacattatgaaatggagggtgtactagcaaagtggaataaactagtgctcaattgcttcaacctgttggaaaatatgcagatagtggtgaccttttttcttgtttgttagtaaacgatatcgtctggcattcaacaaaatttggactgaatccaccataactcatattaattgctatgaaaatcctacagtaaatttcacattgagtcaccttttattactgatgttttgttttggaccaccctttaaataaaatttccattttgaactagctaatcttgcctttgttttactttgtaccattccaattcgtttctcaagcatataaacaacctcgagtacgtcaactcctattcatcaatatactccctcatctatatataaatattttcttgacacatgacaaattggatgtagatagataaaagagttgagggtggtccaaagtgccacaaaagtaaaattacttggtccaaatttgaaaacattggttgaagggtggtttaaagcaaaacaacatcaagaaaaggtggttcaaagtgaaatttactcaaatttcccatcaaatttctacattccaaagaattcaataaaaaaaacttatatgaggacaaaatgatagtttatggcctaatatgtgaaatatttgtcctttccatttctcctctttatttttgtcgtgttctctcttgcttaacattaattttgtgggttggtgcttattttctaggaggtgagagtataagataactactctctctatattaaattacttgttattttaactttatcctaagttaaatatttctaactttaactagaaaatttctaaaaatccctagtttaacaacaagtgagttatatattatgaaagtacttatcatggtgaaaaacaaaaaataatcttataatgttaggctatataaatatctagaaattaatggtcaaagttagaaacattggacttcaatctaaaatgataagtaatttgaaatgggggagtacacgtaatctcccttaagccactactctaatttccaggcatgagtataaaaattataagttggaccagttgtcttgtgctgtgcatcatgcagctataaacctatattgtggatctgcccctccctaccgcaaccaactatgagcaggtaataatgaactagagaatgcttctaagccttaagaacctttacatcatctcaatttgactttggatttgcctaatgccaaatattttttttgccaatgaaagaaaagaagaagaattttccatgacatataccatgaataagtgcgattcagcgcaaacatcatttgtaaattgtgcattttgattgtgacctgatcaacccatccacccctaggacattttcggcacatgttgatgatcgacaagactagctactatggagatggctcatgctgagtgtagcgtgcgttttttatgtaatcgaaaaacataaatgatactccctccgtttcaggttataagacgttttgactttagacaaagttaaactgtttcaaatttaaccaagtttgtagaaaaaaatagtaacattttcaacccaagacaaatttattatgaaaatatattcaattattgatttgatgaaactaatttagtattataaatattactatatttatatataaacttagtcaaacttaaaatagattgactttgaccaaaattaaaacgtcttataatctgaaacggagaggagagagtaccgtatatgttggatctcatatatgcatgcatggatgacatttatgctcctaatattttaagcaacccctaaatgggcgacaagtggactgaccacgcgcaatacggtgacgcatcatcactaatctcttcattgtgtgatagtcaaatcgtggcactgcacgttcacgatcagcatcatactgtcatgttctcgcatgtcaaagagacattagttcgtcgatatatggatgatgtcgtccatatataatgggggtacattgtggctagattggtacacctgattgatttgctagctttaattatatttactcccacaaagcttggatcaatccgtagaaagttcattcatgataggtcaaggtcaggaacactgctataggcacccaaacaatatagaaaagttaggtaaatacagagtgtgaattaatagaaaatatcgtcgtatgtgagaattatacatgaggcctggacagcatgtttaatgttgatgtagtgtggtagtttctaatttcataataatcatagttgttgcacgaagaaaattatgtaatacagagtgtgaattaatgaaaaatgccatagcatgtgaaagtgatatatgaggcctagtacatcaattctaggatgatagaggtggtgtttgaatctagaacaagtgtttcacgcaaaacgaggtggttgtaacgtgtgattaattgagttttaattattacaaacttgaaaaatggatttatctgacattttagagaaactttcatatagaaagtttttgcatgaaacgtaccgaagaatccaaactttcatatagcagtttgaaaagcgtgccacgagaatccaaaattttatcctactcttaccgaagaaacgaacagggccagagggtggtatttttcccattttacaatcatcacataaagaaaaatgatacaattaatcatcacagaaagaaaaatgttgctaaaccaaatatacagcttagaaatcaggtagttgatgaacctatttgtcagtgactgtttcgattacaaggtgaggtaactgtgaagtacatgtagctagcctgcatggaattccaaagttgaaagtgtgcatcgttagtgaccctccactaatcacaaaatgttgcggctatctccgtatgagctagctgtctcaaattttatgctccatttcttacatgtgctaattttggttagttggaggcagactaaagcaaaaaattaaagtgggagagcaaagttgtggagtccatccgtccatccgtccatccgtccatccatccatccatcgccgattgcatccaacttgattttgtcggcaatgcaatctaatgcatgcttgcatggttatcgtctctactgacatctcctaatccagcaaaatattcagtgaatatgactgtgcagagacagtgtcgcgtgcagtgcatgcatccatggaattattgttacttaaaaaaaattcagccagatgtattaaatgcgttggtgtttttggttcattgacaaaaccaaccatataaaagaattggtggtaatacttgcatatccatttgggggtctgttgccaaaaaaaaaatgaaggggctaaacacaagcttcggaagtaacattgccaatttttttggcttgacaaaattttagtaaggctaagaatagctataataatccaaacaaacctattatggctaggcactagaatttgaattgttagcaccctgcaaaaatatttgggaatagcaccctgcaaaaatatttgggaatggtgccatatttgtcaataaaaataaaattttaacacgtatttacatgtaataatcaaatattacaatatttaaatctatatatttcgaatgtaaatttcagaacttacaatataaatagtatcaaatgtttacagtgtattttttttctaatactcaatgtatataagatttgagactaggaattattggttaccggtgctgatcaacaaatgacgtaaaaggggaaaataaaaattggaagagagagaagcggagggatatatagtctgttcgccaagccaagatttggggacatatgttgcccacgacggcatgaacatctatcgcacggtccaaatccgattgaaatcaatcacaaattgctggcgatagatttttagcaataccggaatactcctacttttacatcagaattgtacatggaagttatgtgtgcatcgatctgtaaactagtactggtaaattgttgcacaaagcttttgtgcgtttaatttgcggaaacaaaataaaagaacttaggtattatcagtgtcaaaaaaagcagcggaggtgacggactcatggcacatcagtttatgttgtatgtcatcctagaaatgcttgtgctagctgactagctccaccactccagtcctctgatcctctactgctcctgtatacttcttttcactgaattttcagtgaattggttgttgcttgttagtactccctctgtcccagattataaaaggttttaaatggatttaacacatcataatactacgaatctatacaagctttctgtctaaatttgtaatattatgatatgtcaaatccacttaaaattccttataatctggacgacaggtgctatattggcatgaggaagagcaattcatcatttacgattcaagacaagaaccatcaaaaatgtattaaacctgcttagattaggtcatatatacaatagatttttttgaactagaacaaattatttcattgttcttcagacaaaagaaagaaccggacaaattaatcatggccattagtacacactttatgtaattattttcctttaaaaattatcttggtctgatcaacgtcatccacagaatactatgcaggttggtagtgcttgttgtaaaacagtgtgtaacagtgaaaccgacattttttgcccctgatatgggctacacatgggagagctagacttttattttaagaacaagtaaatttcacaaaactactggtattttggttaaattatcaaaatattatagatttaatatgatgtatcacaaaacgatatatttaacactaaatttatcacagaactacagatttaaagtagaatatcgcaaaactatatatttagtagcaaagttatcacaaactaaaagtttaatatcaatttaatcacaaaacttagacatatataactcaaacatagcattggtgctaaggatttaaaccctacaatctgtagctttatgacaattttattagtaaatttgtagttttgcgatacttggcctttatgataattttattattaaatctctatttttgtgatatatcactttaaatttatagttttgggatgatttagccaaagtatcatcacattacatttactgtaagagaaatgatccccacaagagagagagaaacgaaagtgcaaaccattcctagaataacattacatttgctggaaattaaaattcatccatctttgattgcacattatgtagtataaggtggcatcacatttttagtcatagtaatcaaacatggtaaattgacaaacttcagacctttgggttggagaatttgaaatatttttgacaggtttgaatcaatttccatgagaatttaacaaccagacggcatgtgcccaaaaggttctaaaatacttccccacttcggttcagatgtgaaatttgttcaaaatttatatgaggctcctattagaaatttgatgagggctagagacttacacatgatcccatctcttaaaagtgggttgaagggtgccaatcaatcacggttgtgcgtgtggtgtgagtgtctagtggtatgtgtgcaccctgcatgatggaacaatcccaaatttaaggaaccaccacgcacctaaccctgagcatattgatgttcaaactagtcattaatttttacatagacacgataatctcaagatatatcggtctagttttccagatatgctcatagagatagatgtgagcatttataagggtgagtgtgcgtgtgttgtgatcgtccgcagttatacctgtttctcgaaagaaaaaaaaagatgatcaaaatatttcaattgacaattagtaaatcatcgagttacacattgtgaacattttagtcactaaaacatatgaaagaaatatgaaacatgtaaataccatttgaaatatttctctattttcttagaaaaagtgttcctttcttatatgaaatatcaaattttaacggttaagacatactccgtatattttcttacgcataaaatattttaagggaaaaaaattaaagcttgctaaggagctttattctttgtatgaaacatgcagccatcaatactaggtatctagagagaggagggaaaatgagcatgcagagcgtcctatgagcaccctcgaggcatatcttatattgataaaatcactataggtgtcttgctttctatgagtgctgtcagggttatagataccgcatacccaatagtaatcgactaagctcggcgggcccactacataccaagtcttatacggaatcataccttgtatatagaaggggttccagataagtaaggacaagtaaagttctatatgaaaacgacaaggactagattgtatccatattggtcttcctagtcttatttggacaaggaaacatctatgggtataaatacaagcccctaggaggagaggggacacgccacaaagccacaagatcaacacacaatacacaagccaacacacgccaagacatgccgtcgggtatcaacatcagagattagcctagacaaaccccgtccggtttctacggaggccggcaatagggatctagcagcatatctgatctcggcgagtgcggattcgaggaggaagactaccctgtcgtagtcggttatctagccgccaagtcaacgacaacaagataagttatcccaaatattatacttgtgtaattcaaatgaataaaggagcaacaccggcttcagccaacaggatgtaggggtattacctgtcagataaggggcccgaacctatataaaaatccttgtctctgtctcttttactccaatctcgcatataccctagtaccaatgatccccataccatctaaataccgtagtcgcgatctcaaacgtcgacaagtgcgttgcctaccactaaaaaaataattaaccttaaatacaattgcttatgtgaagtgtaggacttggacctgaatgggccaattccagctaaaggaatctattgagctactctcactttgattgaactctaatttcacgaagagatgtcctctcgtttattatatgttatctaaataattataaacaaactgataagatagattaaataattccttgaggcaagataaaaatatttttgccttctgaaacagatgttgagtgatatatcatgtataaaactatcttttttttataaatgtttagatggtatatatgaaaatagtttcccaaaagaagcctgtgggcgtaaattaggactcggatcctctacattaaaggaaaaaaaatgcaaagaatctacagtacacttgcattaggcatggtttttaccgttggatcttcatcaaacggctagaaacggatgttacactgaactcgaatagtagaaggggaataataatattttgtcaaccggtcaaacccacactgtgcaagcagtttttgctacagtactactatactgttctaacagtggcccttgcattacaggagaggatccacgtcccgtaaattatttcgtcctttttggatatcactgaattatttgcttcatgttttctaaaatatactccctccgtctccaaatatttgacatcgttgacttttttaaatatatttgatcgttcgtcttattaaaaaacttttatgaaatatgtaaaactatatgtatacgtaaaagtatatttaacaataaatcaaatgataggaaaagaattaataattacttaaattttttaaataagacgaacggtcaaacatgtttaaaaaagttaacaacgtcaaatatttagagacggatggagtatttgcttagaaaaaactttccagtagtactcattgcttttttttttttttgaacattgtactcattgcttgaaaacttatttcaaactattgactccatgaaaagtatatgtcatcgagttgcaacttgcgacgtcgtacaactccatttgggaattttgcaggagcgtttacacatggcgaagaacacgacgagcggttggcagttagccgctgactgaaacgcatgcagagacaagcatttcctgcgaaaaatcaacgccgattccggtgggcgatcgatcgatcgacggctgcatctgcgcatccaacttgcttagcttgtatcttcgtaaaacggccacgcgtgagtgagcccgtcaccctgcgagagatgtaaggagggcatgtacaaaagatagttcgacacgacacgatctcttagttaatacttctgcaatagttaaaaaaatataacctcttaactattactacatcaaaataaatttttattacccttattttcttttcttctctccatctccatgtaacaatatttcagttaataaatgctaccaagagttgaaatctaaaccgttgtcatacgtagcaacgctgtttttttttctttttttttcttttcacgtcactaaatttatatgcatatcaatcgaaaatcaaaagagtacgttaataaatatcattgtacatgtctaagaaaaacggacgtgaaaacgtgcacgctttaatttactggccctgcatctcggctagtttccatgcagaacagcggcgctagagacggcgtatgcatgatagatgtatgtatctcttggattgatgacgtttgctggaaatttgggagtcaatgcaaatttttatgttttcaatgtattatatctttgtgatgcatacaatatcttctcagtggactatttaatctccaggatttgatacttcatagatttcactcaaattaatgagtgctggagctattgtgtatgcatggcaaacattaattagaagatcaaggaaaaaaaatatagtgtgaggtattagctatgtgttcaatactccaccactaaataagggagacagattttgactccaaatttgaacgttgtggatagctatgatcccaccaccacatatgtgatgcttcccttcttttcggaggatatgcaacatgataatctatactccctccgtccaaaaataagtgtagttttgcactattcacattcaaggcaaattttcaaatttttcacaattttttcaaggcaaattttgctacaggacatcgcaattgtgtggttttaactcagggacaccgcgaaagtgaagttttgggggaagacatcccataatcgtggatattagccgatggacaccgtgccatttaaattagctcagggacaccgtgaaagtgaagttttgggggaagacatcccataatcgtgaatattagccgatggacaccgtgccgtctaaaggaatcttgccatgctgacgtgacggacggatgcccttttttgacgcggttggacctaaatgcccctgcgccttatctccttaatgtttggccccacatgtcatcctccatgtctggccccacatgtcatcctcaatctctctctctctcatctacaaggagaagactagagcaaggcaggcgacgaccagagctgggcaggcggctgacggcggccggagctggccgcgaagctgagcagagcagtagctcagcggggagcaaagcagagcagcagcacgcacgccctggatcccccgaagcaggaggtggtcaagccgtcgccgccgggccgcatccgcaacagcacgccctcctcccccaacctcctcgtctcgagcgccgacgccgatgccaagaacatgtgctgctactccgcgctgccgagcgcctgcccctcttcccctctctttccaatcctctccagcggctcccacgcgcgtgcgctcctgagcaagatacggcaggcgcgcgacggcacgggccgaggcgacggcggcggcctaaagggagcctggcggcgttgagtggatggggataaaaggctggctcagcgaggaggtgccagggcagcgccgagcagaggaggcggaggtggaggcgctgggtgatcgcggaggcggcgcccgtgtgggccggcttggccgtgcgcgggggcggtgctcgcagcgtggtggtggccccgagcaagacgaagacagcgggtggtggcgaagcagcagtggcgcgcgggtggtgctcgcacgggagatgtggccgcgcgcagtggcagcggccgagcgtggcgacgacttggtgcggcggcggagaggggagagaggtagctagcggcggtggggaatggcctgacgggaaggcctttttttgctgacgtggtgcaggggtatttacgtccgatcgcgtcaaaaaacggcctcccatccgccacgtcagcacggcaagattcctttagacgacacgatgtccatcggcaaatatccacgattatgggatgtcttcccctaaaacttcactttcgcggtgtccctgagctaaaaccacacaattacaatgtcctgtagcaaaatttgtcttttttcaaatgagacggacggtcaaacgttgggcacggatatccacggctgcacttattttgggacggaggtaatattttctttctttcttatataaaaaaacaaaccacataaaggaagtcgtgggcttaaaaatccacatcagtaacacactacataccttgtccacgaatacaaaaaatgattggaggtgtgaggtgagaaaattaaataaagagcggtggctaggagaaatagtttttgtgaatacttatatttgtatggcaaataaatattaaatgctaaaattctttatatatagtctatgaatctttatatgtgtaaataaattccaattattaggtatccttatatatacatatgatgtatttcaacttttttaaatgggaggtgtatttctactttgaacatgatgaattgagaaagttgcaataggggtcaaatctcttagatatttgtcatcccttaattattttccaaggatagtagttggcgatatttggtccaacgtttgtttgtagtaaaaagtaacggcaggagtacaaaaattaattaagtatggttggtaaaagctcattgaattgcatgcggctgatgaaaaaaacgtcaattttgtcacagatattttcacaccttaattactactagtattttacttaagcaagtcatctctaaagcagtgaaagactgaaagtagtgagcactagccactagcttgaagataaacacgccaagttaggccacagattatttttttttaaaaaaaaacacgccaataattagtgtagcaaaaaaaatccttgaattcccattaatgcgtcgccttcaaagattttttttggttagctagactaattatttccattttttcacaagattagactaattcaactaattcttttcatcgattcgcctttcacccaaaatcgatcgagctctcctttccctgattcgattcgttataggcccatcgatcttactaataaaatgattacaaatctaatcaacagcgaccactgactgaagccgcagtaatccggtcagtctgcgagtgagctcacacctcgatcctcgtcctcttcttcgattcctcctctgttctcgctggccgtacgtgtcaagcgtatccagcacacacggctatataaaggctgcacctcgagccccttttcctcccaaccaaccaacctcaaatcaaatcaagaacagctcgtgcttagatcgctctctcgcttgctgttcttccaatccactcctcttgtttgtggcaaagatctgggttctttttttttctttttttgccgggtttttttggagaggttttgtgagcatggagggtttaaggggcggcggccatggcgaggcggcggtggacggcggcgacgagaggtgggtggaggactcgtcggtggattaccaagggcggcctcctctccgcgccgccaccggatcatggaaggccgcaatgttcatcatctgtaagccactttaatttctcgatgaatctttgtccgtacgtgttcatgtgatttcttactgatcgactgagtgacgtgttcgtcgtcttcctcctcgatctcggcgtgaattcgatcgattggttaaatgaagtgattgagttcagcgagaggctgagctacttcgggctagcgacgagcttgatgatctacctgaccaaggttctccaggaggagatgaagttcgccgccaagaatgtcaactactggaccagcgtcaccaccctcatgcccctcgtcggcggcttcctcgccgacggctacctcggccgcttctccactgtcctcttctccactctcatctacctctcggtcagctctctcactagctctaatggcgttcctcgccggcagcgagcgatctctgatgatgatttttgttttgttttctgtcattgcaggggttgattctgctggcgatatcgcagctgtcgccgaggctgaaacccgagcgcaacctgcacctccacgagacgctcttcttcgtggcgatctacctggtgtcggtcggcaccggcgggcacaagccggcgctggagagcttcggcgccgaccagttcgacgacggccacgcggcggagcgggtgcagaagatgtcctacttcaactggtggaactgcgcgctctgcgccggcgtcctgctcggcgtcaccgtcatcgtctacctccaggagaaggtcggctggggcgccgccgccgtcgtgctcgccgccgtcatggccgcctccctcgccgtcttcctcgccggctggcgccactaccggtacagggtccccgagggcagcccgctcacgccgctcgtccgcgtcctcgtcgccgccgcgaggaagaggcacctccacctccccgccgacgccaacgagctctacgaggtgaagccgcagaatatcaagaggcggctgctctgccataccgatcaacttaggtgaccacttcatttcaactcacgttactttccttgccccttcttttctcgcaaaaagacactaatcattgacgcacgtacactgcaccacggctcaaccaccagtcgacccaaaaacttaagctgacgagagaaaaaaattatcgatagtgaaaatgataacaatatttgatcacgttgtaaagttatacataaggacttaccttgtttatccaaaagcttaaactgacgaggaaaaatgcaattgtgattgtaatcatggaatgtgtggatgacatggcatggcaggtttcttgacaaggcggccgtagtggagcacgacggcggcgaggagcggcgcggggcgtggcggttggcgacggtgacgcaggtggaggagacgaagctggtgctggcgatggtgcccatctgggtggcgacgctgccgttcggcatcacggcggcgcaggtgtccaccttcttcatcaagcagggcagcgtgatggaccgccgcatgggcccgcacttcacgctgccgccggcgtccaccttcgccatggccgccatcggcatgatcgtcgccgtggccgtgtacgacaaggtcctggagccgtacctgcgccgcctgaccggcggcgagcgcgggctcagcatcctgaagcgcatcggcgtcggcatcgcgttcaccatcgtggccatggcggtggcggcgacagtggagaggcagcgcctccgcagcgcctcgccggcgtccatgtcggtgttctggctggtgccgcagttcttgctgatgggcatcggcgacgggttcgcgctggtcggtctccaagaatacttctacgaccaggtgccggacagcatgcgcagcctcggcatcggcctctacctcagcgtcatcggcgccggcagcttcctgagcagccagctgatcacggcggtggaccgcgtcacctcgcacggcggcgccgccgccggctggttcggcaaggacctgaacagcagcaggctggacctcttctactggcttctcgcctgcatcggcgtcgccaacctcgtcttctacgtggtcatcgccaccaggtactcgtacaagaccgtcatggccggcggcaaggtcgtcgacgacaaggccggcgacatcgagtgcgccgccgccgcagctgctgctgcctactgatcaatatcaagcagtagctgatcgattagctagctagctagaaaatcatggtaagaaagaaaatggcatcatcatgtattatgatctgctttcgtggtacgtgacaacaacaaaaaaattgtaaggattatgtcgttcgtccatgtatatgcttaatctgcttgtgattgccatctgatcgtgtgatctactgctactgctgatgttgccaagtcctgaactgattcagtgtagcagtgattagtaagttacgcgtgtgcttagtgcaagaggcgaagtgctgagtagatggattacgtgcacttggagttaagagtgcgagattgagatggcccgaaagcctgcttaattcggacccatgggcggagccactacgattcctgcgtattccgaggaatatacttcagtatacgcacatgtacacatattagttagccaagtactcttcctaactgagatgcgtatagatgaaaggtttagaaaagtgaaaaatcttcttaatctttccattatgattgttgaaacaaagttgcacaatagacatgagattgtttacaagcttctcaaattggttatagtactttcagtagtaacagctagtgttcaaataatcttttatgccatgaataatgtgaagaataaattgataaacaggctgggggatcaatacttaaatcattgcttggtcacatttattgagtgtgagatgtttttgaaagtcaaggactgtgatattataaaccgctttcaagctatgaaggaaccaaaatagaaaattagaggtaccatgtaatatttgtagttttatttcttcgattatcggtattgacatactgtgaaccattgatttttttttactatgaactttttttttgttaaacgggaatacccaacttcgaaatcctggctccgccacttcggaccgagtttgcagccttgcgctgtgaggaaaaagtccaatgtatgtccctctaatgattgagtttcgatcacgtccctcaatcacagaaacaggtacaacgcattcctagtcttccaaaagccagtgcaaatatagtccaaaggcagcactgaggtcgtttttagctgacgtggtgcagtggtgcttatgtagcgtattgactaggttttcgtcttacaagacatctacgtaacacttacattcaagaacaaaaaaattttaggacctatgtggggccaacatgttaggggttcttcttcctccaaaacctcccttctttcctctcttccccatctctctccacctctatcctctcttcctaccttgtcggtagggtggtggcaagtagaggccgagatgatggcccaacacaggtagacaagatggtcacatacaatgagatggctaccatcactatcgagtgtcgcctgccttagttattatgacgtaccactttcattcatttcagcgagtcgcgtgtattagatcgattcaatcggtttctagtgcatatcgagatgacatggcatccatggagatggatattacaatgatacgacaagaagagcaagtcacaccgccctggtgtgatactgtggctttatggatgactacgagcaaatggaggacgatgaaccaccctcaccgtgagtcaacaagcccgggtttttttttccttatgccactgccggagcagaaggtgtccgtagcatatcatgcgtagctttggcgtacgaatgcccgaataaacaacaagtatgggtctcgtcggcccaatgaaaagaggaggaagaagaagaagtccaagcattatgtgtcgccgttgtcgtcttcaccatagtcgaggtcgccttcgccagcctacgagatactccctccgtactcgtaaaggaagtcgtttaggataatgtttaagtcaaaccttaggaatataaatcatgaataactctcaggttgttgagtttgaaaatataaaaattatataaatagatttgtcttgaaaaatactttcataaaagtatacatatatcacttttcaataaatatttttatagaaacaagaagtcaaagttttgtttttagagaccgtgtcgctatccaaaacgacttcctttatgagtatggagggagtatctccaaccctcgaacccaacgacccatactagataccaagaagaggggggagaggtagagatagatggggaagagaggagacagggtgaggttggaggaagaagaaccgctgacatgtcggctctacatgagccccatcgggtttttttattaatgtaagtgtcttgtgggatgaagacctaatcactacacaacgtgagagccacattacctagtccctacacaacgtcagtaaaaaccggcttcagtactatctcaggattacattttcactgattttagaagatacagatgtgttgtagccaattttatggttgagcgacaggataaaatggccgttaattagatagagacgtaaaagtagacttttcctgcgcatcaacggctgaaacagcccaaagagtagttacggtgctttggttgggttggactcgctgagtcctggtattgggccatcaagtcgcaatggggaataagttcagtttagacccctcactgttgtccagtctaaaattgataccgaaatggatacaacgtgtccatcaactcccaaaaccaccccaaataagatcacaagatggtttggatgacgatttcaactgatgtggcacctacatgaatggtttgattatcgccatgtcacgccacgccaagtgcagtgcgggtaatagttaagggagtcgaaagcccaataaaaagttggattttggcccaatagtaacaacaggttggatttaggcccattgtgtatgtaagctacagtaataagtactccctcaccaaactgcgtgacgtgttcaagatacagtctctcagttgacccgtgaccgtatgctcaccaaacttttttcttaaaaaaatcgccctgttctgtaagactgtaacggcgagttctgtttttttaaataaagaaaaaactgccgaccagcttggctaggctcgttactagaatcaaaatattgcattataatactcgtattctgaatctgagaatacacagccgtgctacacgtttgtcttaaggacgtgtcattaaaattctgattcgattcctcgtgtgtttggtttggataggtcatatgttaagaaaaaagaaaggctttattaccatgtgggacacatgtcgcagttgttttaaaacggttgggagttttggcttcggactggctttcacacggccgtgaatggacaccaccaaccaaacgatgccgcggaatattccttgcaacgattttcatcagggtcaagtcaattaaatttgtttatcatctgggaaaagtaagctaaagcgaagcaagagcaaaggagattactgctaatttttctgctctcttcatccaaatatatactccaacagtctagaacatatttagtagagctctgacttctaaatttgactccaagagttatgagtagagttgtagagccgccgaaaaccgtcgaaactaagctctatctctttagttcattagagtgttccactcagtttcacttctattttagatggaactaaaactctgtttgactaaagctgtagatgtgccaaacagacccttaaaataagattagatccatttaagaactacgaatataaaaataggatttgaaattagcctatttccatattcatagttctaagctagtccaatcaactactttctctgttttataatataaaatttttattaacgtctatataaatgtatgtgagtacgaagagcgtatattgctatatattgagaacgaaaggagcattacaaattgcactatttttgtagaaaagaaataaactaatctccgcaccaagacaaaagggagggagcaaccagcctcgctggaacggtagcgtccttatcctcctcctgctattgattattttgcgttcccccgtcgccgcggtcccattccgacctgttatcgcgtacggataccggccaccactcgcggatcttctatggcatcttcacttcaagagtatcatgtgcaatctttttcgattaaacagaagaggcacaaccgcacacatcaaatgcacatccacaagtatgacctcaacatgataagatcaaatataaacaaagaccaatagtatatatccttaatcccactaaatttctattaaaaacacatttaatgtgtaatattcgtgagtatagatttaaaatctagcgagtgagagttatgcacccaccattgcaccagtgcaccaccgatgtttcctcaatattatgtacatattggtgaagtgaagaaagtggcggacctaacaaccaagaccttacttttgtgttatactcatgatagtaattcttttaactaaccataacacttttacgatatagacaaatgcaaagcatgattaacgaagggtcgataataatggtgaaactgcattacatctggtagccttatgctcatgatagtattttttaagccaaccatagtgctctagcatctatagagtagtagagtccaatgtaattcgttgctatattgcttagacaatagaggtaacaccatgtacgaacaagattactatatcctgacactagcatatcacaattctttagatccaccactcccgataccggtaaatcataatttctgggatccacgactagttggtattaccttcatcctaaaataaaagagattttggttggatgtgatacctctagtactcgtgatactaggatgtgtcctgtacatccaaatttttttatatttaggatagaagaagtaagcagcgttaatagtaccaactacattagtaatatcacataaagtttcagtcatatggtgggttagtgatactattatccattgatttttataatagataagtatattataaactgtaagtagtagcacggtatataaatagatggtactggtacgagattaggtgctactaataagagtgtgttcttcgcagagcacagcacgggtggttttgtggtgtactatggccggcacagagaatcccagatggcattgcaggctggaacacctccgagtgggagtggcccatgaaaggtagtgcttcgtcgatcttatctccggtgactcatttccgcatgtgaagtggcgcgacgctccagcttatcaattgtatttcggatgtgttttttcacataacccctcctgttattcagtttctgctctgcacttccctaatatagaaattgaaaattaaggcccaagtttgcttcaagtttgtatcgtagacacacttccaactttccaagacattttacacaagagaattagagatgatattgatctaagcttgcaagaacatttactagtttgatttggaatatgtcggcatctttcatttaccaaaacaaggttgtgttcgccagtgtgagttcctaactccacattcttcattttctgtgtgcacgtttttcaaattgctaaatgatatactttttttaaaaaaaactatacgaaaattactttaaaaatcatattaatctatttttttaaaaaaaataatactaaattaatcatgcgctaataagtcgtttcgttttgtacgcaaggaattagagcatgtttaatagtatatcgaacgactaacttcaaatcatctatagtcaatttagtagccaatttatacaatagatacctataaacatatacaacactagtaatatctggtcctacctgtcaaacacacattatattttataatctaggtacaaatttatagcccgctgctcttctctcttcttatttatctactcgatatgtgttaatagttggcttatagtatgctgttgtactggctcttaggtcccatctgaagctactgaacacaacctaagtgtgatctaagcttgcataaacatttaccagtttgctttggaatatgttagcacctttcatttaccaacacaactaagtgtaatcggggtcatcgttttcttctaggatattgggttgtacataactttgtatttcaatgtacgtaagagagaaaaaatccattaagtagttttatgtgctatgcatatctttgtattttcctctggataactaagggctcaaattatgaacatgaattatttgtgtcctattttcggaaacttcatgtagctaatttttttcttaaaaaaatatagttttaaaatctagtaaactaggagttggttcagattctcatcagaaatttttagaatcaagctcatggagccttcatactccacaattttggggaaatgtagtggtcacacaaaaaaaaagagaaatatggcgataagaatctcctaattctatcacaatataagggcccctttagaagttgtacacttatcatcacaccacacacccctatctatcgtcaacttggtggtttctcagtgggcaggggagcagaggggcacacagtttagattttgtccctataagagcagacttctattagccgcgtacagatagatagacacaacagcaacaacaacaagcgaattcttcttgcagatagggaaaaaaaaacgaaagcgagagatgaggagcagctcggctctgttcttggcctttgttcttctcgccgtcttcctcgcggcgctccccttcgccgaatccagcggcaggcaccaccaccaccaccactcccatctccatggcagaggtacgagcaaaagcagaggaatcgaaagatatttgctttcttggagcgacttcttgcttgggtcaggagctaaattgaaggagaaatatttgggcttcttttcaggggaaggcgagagaggaggagaagcacggtcgctggcggcgaagggggcggcggcggcgtggccgtgctgcgacaactgcggcgggtgcaccaagtcgatcccgccgcagtgccagtgcatggacgcgaggccggcggggtgccacccggcgtgcaagagctgcgtcaagtccagcctcagcgtctccccgccggtctaccagtgcatggaccgcatccccaacctctgccagcgccgctgcaccgccgccgcccgctgacctcccccgccgcccatctgacccgacccaccggccaccgccaccgaccggccttacttaattaagagtggtttttgtttgtccctttttttttttggaaaagctgaagaagtgaagaagcagtagtacctactgtactggaggtgattggagggagcagctggtttcaggtttatgtgctggaatcagcctccagttttcatctcctcgctctgctaactacggagtaattgtgtagagattactcgccgagctatatgtacaaacggcctgtgtgatgagacgaaattgtaatggtaaattttttttcaccttcatatgttggatatgagtgaaattgttgctagcgaaatgatgatggatgcgtgcttggttcatattttccgttgctgtttgtctggctctgatgctttctctcctcttctgtattaatctcaattggattacaaggatgcctgtaaaagcttatgacatgctgttggttgattttgtctacttatgtcgataagggttaggagaggacgccaaaccctaaatctaattgcccgatcaagtgcgcactgtaaggagtacgtgaggttctctgctgtttcttttcatcaacaggaaatcagaacgagaaaagcaaatgaacaaaagacaaaactagaagaatcattgatggcttcaaacataggtcggtagattgattttataattaggagaggtgattgtttataggctaaagcttaagatcttgtaatctagaactctaacatgatgagggtaatacagcatgaacctggacgcgatccggcatgctgttccggggtgtatgaacctggacacgattggggacgaacggtcggtgaaatttgggaactgcacatcagaaggcttgtgttgctgtcaaccgaattaatcaggacgattgccatgaacaacatccacgatagtgagcttgcactttgcttagtggaggacggtctgggcctctggggattcgcatttccacaaggatatgcgttgccatgattttcactaggccgcttgtttaggcacgaaaggatgggaaagtgaggaatatgctcggcaagaagccaagaaccaatctccaatagtgcaaatttggggtgactttacatgtttgaattcaacattgcagtcgcgcaagtttgcaataccactatctgaatccgtggtccaaatctgaagagacctgcagtctgcacggtctctagagcaacattgccagtactaaagaagaaagagttccactaaattgctcatgtggtgatgttttggacttagctaaaaatatgtcgacaattttttgggctgatctcagtcggcttctctgtgcgtccgattgctctgcacgagttttcggttgtgcttgccggaccgttcgatttcttctcaaaatcatctcctataaagtaaggactgcatatgcttttgctttttaacttttccaatgtaagatttaaatttacatctcacttacacaccacttacatatgtaattactatgtaattttaagacttacatatgtaattttaaaatttacattgtaaatccattaaatttacatatctaatttagtaacttacaatgtaaatacatgctgactattttttgataaaaaatatggcgctataaatatagctactcccgatgttttttattgattcatcatgtggtggtgtcgtggtgatgttgaacagttgaaggaacagagggagaagaatctgagacaaaggacggcaagagagagacacacgtgctgaaaagaacaggaaaaagagttgtccaggcccaagtgtgcttctctcgtactagagtgaggcccaggaagtagcttacccgtcgcagcctatcaatgtgggcctcttttgtctccaaaccagtagactacggcccatgcaggcccatcttgccgcctaccgaaaagaattttttttatttataattttttttattaaaagttttacaaaaataattttccattttgaaaattgacggaagtagttgcctaccgctctctgggagggcgatttttaagggcggcgaaaatgacgtggcagccggccgttcgctctcgggcgacggccgtcaacgaaatttgcaggcggcccccttgccgccctccgctagggcgattttatactgtgcggggggccgcctgcaaatgggcggcgaggggggcatggaattttgcaggcggcccccttgccgccctccgctagggcgattttgtactgtgcggggggccgcctacaaatgggcggcgagggggcatggaattttgcaggcggcccccttgccgccctgggggagggcgattttttgcctccccctataaagcccagtccctcctctgttaaatttcattatattcactaaaaatccaaaaaaaacgaaagagagagaggggagggcagcagaaggggagcggcgaagccctgctggttcgctcacttcatcacaggtatgctcccatacatcttttgcatttgtactaatatgttatgtttgagtatatatgttgcgttttagttttagttccatatattttagcacatctgtagcacagagcacatatgtgtagatccagagcatagaatataatagtatgaattgagacatagacagtagtgttaattgtaagatgtagttagtttgatctggagaatgtaacgtaattttagaaatttagagaacaatattgtagagaatgtaacttagggcgtagtacagaaatgcaaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgatgcttggagacggtatgtggaaatggcttttgaacggtcatggcccctcgttatatttgtgttggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggactttactttttattactactgttaaatacttgtacgaaactgatggtccttgtccagcaggattcgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaagcctattcattggtaatacgtaatctagatttaagattatgtagaacattcttcactacaattttacattttggcagcaaaccaaatatgatcaaatgcaattttaccttaccaaatatttggtagtgccaaaacttgcttatattttggcacaaacaaaatatttgtacggtaacaatccaaatatgccctaaaaataataaaattgtattttaccagtcttggagattttaatcttgtataattttcaatataaaaagatttgataactattgatatttattaaaaaatatagagcacactataaaatcgccctcccccagggcggcaagggggccgcctgcaaaattccatgccccctcgccgcccatttgcaggcggccccccgcacagtataaaatcgccctagcggagggcggcaagggggccgcctgcaaatttcgttgacggccgtcgcccgagagcgaacggccggctgccacgtcattttcgcctcgccctcccagagggcggtaggcgactactcccgtcaattttcaaaatggaaaattatttttgtaaaacttttaataaaaaaaattataaataaaaaaaattcctaccgaaaacgggtggaagcgtcggggattagtaccacctcgcggagtcgaggaggtgcgggtgggagagatggctataagtagagagccccgtgcactattgctccatacttacctggacggggtcaacgggcgatcaagaaggctcgtggcctaggccaatggcccacattgcacttggtgggcgcgttagcttaccatctccccaagtgggagagtggacgtcataatttgtggtagagggggtacgcgtccgcgcggcccctgccaactctcttagattaaatttcggtccttgctattgttggttaagtttaagttctttattgcattcgtatgctttcgcgcggcctctaccaattctcttaaattaaattttggttcttgctactgttggttttggttcttgattgcataggctccttgtatcctgaattttcggttttggtccgttgggtttacgagccatgtcaatctcttaaattaaaattttggatttgggtttgcgctggtaagttttgcatctatcattaaacattgttatttttcgaagagaaggtccaaatcaagcagagttcattacaggaaacaaaacaaaacgaacacagcaaccacttcaggaaaactggggaataccagctaaactaggacagcactagaacacacacaaaaaccaacttctcaaacaaccacttaaactacttctggggataccagctaactaggacagcactagaataccaggcaccagctaacgagggcggaaatactcttcatcctttggagaacgtgattggccaggcttcagttaaaggcttggtggtgtttaccttagctgaagcactgctccccgtccgacaaaccagcgataatcataaagggaagacaattggcatgaaaggaaggctgaaggaacaaggtgctcctgggaacttgaatcatcagcgtcgttgctcaatgtcgttggagctttcaacccagaaactggtagaggagcaatcggactcgtggttagaaattcagatggacaagttctcctgtcatcttggaaattcctaaggcgttgtgtagaggcagaagaagcagagctcctggcttgcacggacaaatcatctacttcctccatttcatattataaaactttctagcattgtccacatttatatagatgttaatgaatttagacatatatgtgtaagatgatgccctctaaaagatggcaaacgagaattcaagtacgatgctgccctgatgtttcattgacaaaagaataggatactagtgtctactcctttctgaatcacgacacagcgagtcatgaatttaatacatcagatacccgtaaattttcatggaaaatgctatgcataacaatcaagtttagcctgcatatgttttcttggaaatatatgccagatatagttatctgaagaaaataaaaagtaacaaataaatggcttctctaatgtaagcccaacacaatcaaacccgagaccattaccggtccaacccaacagattacacctgtctaggattgcaacggcctgtaatacaaggtccattacaaaccgccttattttggcagcccaagctagcacaaaacctctcagaagtcagaacacgagatggaaaccgaaaagaactctgcgttgctccacattagtaccacctcgaaagtttgcgtcgattgcctggtgctctttcggtataagtacagaaccccgagatccgttgctccatacttacctggacggggtcaacgggcgatcaggaaggctcgtggcctaggccaatggcccacattgcacttggtgggcgcgttggcttaccatctccccaagtgggagagtggacgtcataatttgtggtggagggggtacgcgttcgcgcggcccttgccaattttcaaaattaaattttggtcctttgctagcgtttgcttgcaattggaaaactaaacagtccctgctttcgttttttgtcgcttcttgaactcactagaagtaataaatttatgaaaaatttgctcaatttttagaaaaattgtggtgtttagattaagttttctaaaaatatgtggtggtttttgtaatgtggatatgaatagattatgaacgattaaagtaattgttttatttctcgcgcgagcacgaggtgaggctcgattcactttcactataatcgcggccatggcggcgaaggttgggttgttcccctcgtcgtcactcaccaccagcccccacgccatcgcggctgcgccgaccaacgctccccgcccacgcggggctcgtggattggcgtctccaggtcgatccgcggcggcgatggacgccttccacgtgtcgtcgcaggccgccgagccgctcctccgcaccaccggcgccgccgccgccgcggcggcggcggcgacggcgacctccaaccccaggctccgcgtgcggaatcctgaccctaatcctccgcgccctaattatagccgtcgtcgcttcttctatcctggggcaaggtgctggtagtggtcgtggtttttgacgacatggaggtggatgtgcaggtgcggacacatgcgcagggcggcgaggcgccctccagcggtggcgccggagatggcgcggccgggaaggagttctcgtggtcgtccatcatccttccgtaagatagctcccctctccatctctttggtcagtgacatttggggataaaatcggacagtgataggtgataagaggaatgcatttctagtttggttctagcttcccaatgttgagggatagcattggcacctaatttcaattcaagggagagagaatgctttttaactgttcagtagatattgcttgtttcatcgtgttgatgagaacaatcatattaaattagggcagactgtacaatgcattgtaagtaagatgcaatataattctgcactgtcttctcttctctgctttaatgctagataagaacatattataattcaggagatgataggtttgcatagtattttgattacatactgaagacaaatgttatagttggatgtaaaccattggtggttattatattaatacggcttggaatatggataaaaaaacaaaagcataaaggggaaattggaaaatatatcaagctttaactacttgtgggtcaatgtttggaacctaggttcttgttccctgcattgggaggactcctttttggttatgacattggcgcaacctctggagcatgcatatctctgcaagttagtccctattttggttggctatgcaatctgttatagttgtcatgtattgattcactctaatggtgtttattcctccagtctgctgaactcagtggaaccacttggttcagcctgtcatctatacagctagggctcgtggtaattttttagatattttcatgcttaccaaactttttgttttcccaatcaagaacactactgtctttaatgtgattttttgtcatccaatttaggcaagcggttcactctatggtgctcttggtggttcgcttcttgcatatcgcgttgccgattttctaggtgattcgaaaaaaaatgtttttcgttttttttccttactgtataatctttagcaagaaaattgactgctagtctactactaccatccttggttcaggaagaagaatagaactggtcacagctgcagctttatatatttctggtgctctggtcactggatttgcacctgattttgtacttctgatcataggccgtctcctctatggtatcggtattggtttggtgagtaactctgaggcaaccttttttctccccaaaatgcaatgccactgttattgaacaagtaaaagtataaattcatgtagatgaatgtcagaggaccaatagttatatatctttttgagttgggtagcacatgaaaactttaagagaggaaactgaactgcataatctgtatacttggactgcaaatgactcattacttccagatttagtaacagtgtagcttgatgaccacattttggtggaattaattataaaataagtggaaaggaaccatgaacgcgtttgatccttccagatatggcaatattgtgaatgcttgtagttgaaatccatcatttgggacaaggtctttccatatgaactttggacattgttgttactcagtgttgcggcagatatctatacctaattaaaaaaatacataaagcttccggtaaaaatttcgtccgtcaaaacccatgtccgagagactcttttatccccgcacaattagcgaagtcctgtttctgttaaccaaattaacaaatttaagttagaagcccaaacacggtcacgccaaaaagaaggcctgacctgggccttgaagaaggcccgacctggtttgtggcgttggggaaaaagatgaggaaaacagcctaagccagctggtaaaaccatggaaaaaatttgtatataccaaaaataatgaacaccacgtataagtggaagagatatagaaaataataccatctaacataaattattacaataatgggataattttactaatcagacccaataaatttaaccaaacattatcaacacagacatcaaataatctttacacgcatatttctcggtggtctcagctcgggttgggggaggaagaattactaataaaagatacacaaggattccgcatatttcttttcgtacgctgtccataccaatccactgcacacgaatgatggccagccggcgagcttccgagcttcccctgacctttttatcccaagttttgtgaatcactccgattttgagggaaacggaaagaaaatatcgtgtgggtaaaaaaacctcaactaattttgggagatcgagaaagatttggccggatttgatatgatgatcagcttcggtattgtatagatatgggactgtctcccggaggttgaagatgctactaaagcgcgtgggtttggcttggcaacgagagaagatatatgactatgctatctgagcctgtggctccatttgtgggctgggtcgaagagagccgagccgagcagagatatatagaggcagcagactgagctggggcttataaggaaggaatgattttagtgaaccttttgcattataatgtatagtgatttcaatattttaatttattgttcaacttctaatagatgttgtataaaaaaacgcttttacccgttgcaacgcacgggcattttttctagttaatactacaaacagtatatttgtttactgccaactaaaaaaatccgcaaatatctaaactgccgatgctttgttagaaaggtgttaataataactgaagaggaacataaatgcaaatgaacatattcatatcaaactaaaggtttggagataatgaatcattgttgtgtccatgtatattacatcatggggttatgtaacatcactgaatcaccatgctttgtgccaggcgatgcacggtgcacctctttatattgcagagacttctccttcgcgaatacgtgggacattgatatctttaaaggagttgtttattgtattaggaatactggtatatctctcttccaactgctacacacttttaagtatacccatctatcccctgctgactactccctctgtccccctcccccccccccccccccaaaaaaaaaaaaaaaactactgggtttgaatctggacata

SEQ ID NO: 76392 - DNA, 2045 bp, Oryza sativa
atagattttagaggaaatctagcaagagctagattttagaggaaatctagcaagagctccagcctcttcaaaaatttcatttaagtctatatctctcatccaattcttacattttcatgcaatccaatcaaacgaccattcctatgttacacgtgtgttttgcacttgcatttctataataatcctatgtttttcctattcctccgtttttttcattttcctattcctccattttttcactcctacgattcaaaaagggccctaagttcaagatgagcgcaaaaaggcaaaagctagtgtttggtttttaaaacatgtttaactcgaagcaatagttctttagaaagaaagaagtcgtacaggtgtgcagttattcaactcgtagaaaaatgaaaaagaaatagaaaaattaaatcacattggagctaggtgcaccatatgattgtttcatgttccacaaactaatcaagattcaagaagcaacaaacgcaaaagcaaaaagggaagaagcaacataatcatatagtcacgttgatttgattaacgatcagaatctctgtataatttccagagtaatagatacagtgaatggattacctgagtacagcaacaacgctttcactatgcaggctgcagctgactagttgcaaaagctcgcagcaaggggaagtactgagaaaaagaatgggtattgaatggttcaattgcctctacctttgcaaaatgtggacttctagttgagtttcctcctgtacaatggcctcgaaacccatagattgtccaaaggaaaacgaatgtagataccagagtatacaggtgaagaactactgttttgggtccttggctatctagaccctctgtaatatacaattgcatcaacgacgtgtaactggttaacacataacaggcatggtaatatggaagtcaacgcctgttcctggtgggggcatagctcacctgtccattcagaatgcactgtcagcaatagactatgactaagatagatatcttcactgtcccaaaaacgaaggaaaaaaagaggaagagttgaagattgaatggcgatatagagctctccaaagccaaggatatgtagttggcggtccccaaatgaccccagtaaataagcggattggattcacatatctaagtccatgtttcggaattttactacaacaaaggaatcaatgtttggcaagtaaatatagtaccacacaataatggtagcaagtcaaatttggcacctcaaagattctgttatttaaagataccaggcaaaaaactactgcacttgatgatagtacgacactcaatcactcattaagcccatgtactatatatatccagtgaaggtgtaaaagctgttaatgatgtagataacatagagcaattctttcaagtcttagagttagaataaaaggctattctttttctaaaaatgtataaatagaaatgcgagaatttgcagaaaactatgagaagggatgtacctttgttgagacggtcagcttctgaaataattaatgaaattattcgtgtactatgatacagtgccaggcttgcagtaaatagatgggcaaactggctcagcagctctcatcaagctccaactcaatgcctatccagcacacctttgggtgaaatcaatgaccatggttgcacccaaggtgtggtggaccagatctcaaatccagtggaggcttaagttttacccgatcctcaaagcccttctgtgaagcatgctcagaaggcagtggcttatcatgcaaattccacacgctcacatgtcccatccttccaaattgagggctcagaatgtcagcttcagggactgccctctcctgaaaacctagcgagggttgtttcactctaacaaaacgaccaaggaccggatctggaggctggtttggcaagggctcatcaagacatctcgatgtaattgtgaaaccctcattattgtaagctaggtgtcttgcatggttaaaaggaatagctccattaccaccagtcagaggagtggaagcacctgaaggggctgcaggaat

SEQ ID NO: 76393 - DNA, 1109 bp, Oryza sativa
aaatctccctccactgtacgtacgggggggggggggggggatggtctctgctcgtgtaatcgtgtcaactgcctcgaggtcaactcgtgatcgagctcgactgttgctttttgtattgtctagtagttggctcgtccttttggctgtttgtgtttctgctcatgattaatggcgctgctgagtgagtgagtacaaaagaaaaaggtggcccatgcaggtctcgaacctgcgaccttcgcgttattagcacgacgctctaaccagctgagctaataggccaccaggttaagataacctattattatatatttgaacctacaagagcagcggagtacaactttccaacgaaggttaggggcccttgaatcaaagcaattatggagaaatttcataggattaaatcctacaggaaatttttctatgtagctctttgattttaaggattgaagttttccaaatcctacaaaattcctatagaatggcttgttgcatataggttttggaggaaacttaacaaaaggtctgtagtccaatcaaacgattattcctgtgtattgcaatcatctgttttatacttacattcctgtcagaattatatgtttttcttattccttaatttttttattcctacgattcaaaaaggccctaaatggctgacaagggcagcagcgcggagatactgatgctcacgtcgtcgcgactagcttggaaccagaatcgacggtccgcaacgcgtcccggtcaggaccgagcacacgcttggtgaaaccgtggacgtcaaaacgtggatcagaagaggcaacaacgaaattacctttgataaagtcacactgttttctctgtaatcgtttgcatcaacgagaacccgtgcagataccttcctcacgagtaacattacatcatccatcggagtacgaggaatcccagtccccagctacgagaaaggcacagctaggcgctattgtggcacatgagagaaatagcatcaccaccataccataataatcacggcaagcatatgttatctcattatcgacgggcaatgatcatatgttgatgttggggctacgagacacgatgctacatggatctgacacacacgactggca

SEQ ID NO: 76394 - DNA, 4022 bp, Oryza sativa
ccccaaacaaccctttgagcatgttgatcctatttaaagctattgtttctattcaactattgcatttattttcgaatgtcattgggtggaattaacctattgtttgttatagccctttttgatcttgattactttattccttgataccttgggttattataatttgactagttgagctttatttatattggttcagctagatattagatataattgcttagccctgcttagaaacattagcacattattgggataacttatgactcactattatttaatgatttcacgatggtcaatcgtgattggttaattaattaatgtgccaactaaaacctggtaatggtgggttgtgagcacatggtcttgatggtcgtgctcatgacaattaaggaccggttcacgagtttcggttgtgaaacattaaccgtgccaaccacaagccagcatgggcaacggctttatcttttgtatagcatggtttattgcggggcaccagactgagaagtggcggagataagcccacgggggtcgctggggagtccatgccttgtttataagggggtgattatgatccaggaaggtgcgctgcggtggattgtgttatgcaaggggtattgtcacaactccgttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataactggtaataatttgattagctcctggtttggaatggtatattcctggtttggagatagaactgtgcagccgggatggttgttcagaatggttgggcctatacaacagggtatgttgtgtagcgttggattaatattgattaattattacttaactgttttattaaattctgaaatgtttattaaaggctgtttgtgcaaatggaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatcttattttccgctgcttagatctttattgattgagaggaactatctacctctgtaatgaccttttattcgcttattaattagagtaataattgtactctattatcaatttgttattgtgtgcctcggctgattcctggacgagggttcacacacatgtaagcgtttggaattttggatagaaattccgggcgtgacaaccgtccaacttaacgcaagaaaaaaaaccatcatttccaaaaaaataagttagaggaaaccatccaactcaacgcgagaaaaaaaccgccgtttataaaaagaatcgctctgagaaaccgtccgactcaaagcgagataaaattaatggacgcttgggtcggataagatccatcgattttttttccatctcctacacatcatttgtttcctcacctaatctcctgcattggagaccctgcacttttgtatgcaattatcattatcagacttttttttaagtacaactaatattcttaataacatattatatggaaatagtattaaaaataaacatatttttaattgttatttagagaagagtgcacggtgactattttgtgtagactttatcgttagtgtaggatttgattaacctattattggttgcaagaataagattgaaagaatattttagattatatgtatattgttatatgaataatctaattattttagttaaagcaagcattggtaaaaagattgccattatcgagtttgggtcattacataaagatgctctaattttctaattgtgttagctacaacgatccatataaacattatcattgatatgggtatgcttgaaaaatgtctattgtcattggattattttttttacccgttgcaatgtacgggtattttttttgctagtactattttaaaatagatgaagtaggtacctgttcccggtaatacacgagtgacggaacaccatgactcacttctacatagatctagaagaggtcttttttttcaatatggaactagagcagtgggcagctcctaatttgggtggagattaactccaggatgtaacaccaaatgcgctgcattttctcaagaaaccgaaaaacaggcattgactaagagtctattgcttaacgttttggagtttcttgaaatgcagagctgaaactcctcttcaagttaattgctttgattagagtgggtgattaatagctcaatgtgccacatgtagtggtaactctcgtgcgtgtgcagcttatatatgctgccttcttgcattctgttacgttctgttctctgaccccttcgatatggagacgaaatatagtatcttggagcttctgttggtcagtgccgagggcctgaaacatgctcatcacttaggtctatattcttcaccctatcttgtttcagaaactctaatgctcatgacctccgattttgctcattggcatggaatgtttgcaggaacgcaaagacactacgtgaacattcagttcggggaccaaattttcacgagcaagatcacacaaggtatacattcctgtatatacaacaatagtcaattgtcattgctatcgatagggaaaatcttgctttgacatctgcaagaaatgccacttgcaagctttgttcaggtaaaggtaaaaaggtttggtggaacgagaagttcagattcccgttgtcatcggatgaatgcaaagagcttgcaaaggtcacactgaagatcatggagagggataagttctctgaagacagtctagttggggagacaaagtaggagattgtctgagataaagccgaaatattttaactgaaattaatcgtggttactgagactctcaacatttgcatcttgatgctgtgcgtgcagggttcatgtcggcgacatcatcagcgagggcatcgagagggagttcttgcagatgaagcctgctccctacaacgtcgtgctggaggacggtaggtacaagggagagctcaagcttggcctcaagttcctccccaatgtaagcacgcacagaggtcgctcacatcgcatcaatgacaatgcgtctgaagctctcgatcgtgccagtatacgtagtatcttcgtaggcatttgtcttgacctggatgcgaatcgcaactgtgtatgaggtaagcttggagagcctggagcagtgcaccgtgccgccgcggaggcagacgagcgtcccgtacaggccttttctgaacatcacgctgccggacatcccatggaggaggttattcttcttctgcacacgctccaatgccaaaggaagcaggaagacgaagaacagttgatccgttgccatggtcgtcgcaaagcccttccattttttcttgaaatttctccgtataccctttggagctagctagtggtgtgaactgtgaagtgtctatgacttgcgagctttgaggtgccgatatgtttagaatttagatcaagtgggggttttaaattttgtaaatggaaatttcttaaaatattccgttaagatcagatttgtgattttttagtaaaaagaaaaagaaaagaaaaaacattaataaaaaaagaaaagaaaataaagatgccctgctccgtcggcccgtccttgctttggacttgtttggaccgttcgctttgaatcgaacggtgcatacgcgctgggaataaaaaaaaacagagcagcccacgcccaagttcgcgaccccgcttcctctccccttttctcctttcggtgcccgagtgccgccgggctcgccgcggggcggcacgctcgaaacaggtggcggcggagatggagatgggcctcgaactccaaccagctgcagcgccgtagt

SEQ ID NO: 76395 - DNA, 1417 bp, Oryza sativa
  unsure (1)..(1417): unsure at all n locations
ccctgaacgcacccatgtcgccgctcatcggccgcctggttctccgcgacgtcggccggagttcgctgacgcggctgtgcatcggcgagccacctctctcttcccccgattgctcgccgcttcttgaaccagccctaacgctgccccgatcaaatgctgcgtagggagccgagctggtccgcaccggaggctgctcgccgccgccgtatgcgacggaggacgtgcggctcagcgtgtccgggtcgtcggagaacacggaggcggtgtcggcggagaggatctcgagctgggagagcgcgtactcggcgtcgtccgtcggctccgggttcttgcctgctcaagccaacgatcgaacacctcgtcaggtactcaggaacacacccgcgccggcaatggccgacggcgccgggaagaatcgtgcggcgtgcgtgcgtacctcggatgggcgtgcggcacttgctgcagtagtagatgatggcgttggggtcctggtagatcatggcgcggcagtaggggcaccgcccgaaccgcctcttcacctgctcgctctccatgctcgccggcgaccggcgacgtcgccgatgctacgacgccgtcgacgcgcccgcgcccacgcccacgtttgccctgcaaagagacgatagcttcaagatttgtcatccatgaacttaatccccatgcttcttctgcgttctacagttttgcagcgctatgtgtccatgttcgattggtgaatctactgaacttatcaaactcatttgcatctagaattcaagatggttatcccctaatctcctccctaacctacattcctacctggntaattcaagaacatgagcaagaactcctaggcagaaattgcaaagaaccgagtcatacaaggccacagaaacgaacagattaactaacttacctagatcagatgccaaaactctcaaagctcttcccgaattcttcacctaatcatcaacacgatcacacggattcccccaaacccaaagttttccgaaacgtgaagcaacaggcgaaagcgagcgaggcgatcgatcgtggaagaaggacaagaacaagaaaggtttcttcttttttgagccaccaccgagccaagcaagcaaaaagaatagaattttagtatgcggaagacgtgtgcgaaccgaagcgttcagcgcttcagctgagcacacatacaccccgctttttcagaggaagcgtttggtgattatactacgtaatagaaatccttggaatcaaaacgagtcgggagcgtgtgggtgtgctcggattgctgcttccaaccgccgttgactcgagagaaaactgaaatgatggagagtagcggcggttggctgcacgagcattgaaggccaaagaggagacccggtcctgcttccccctgtgcagagttgcttttctatta

SEQ ID NO: 76396 - DNA, 9396 bp, Oryza sativa
cctgcaccccttagtggtagctggtttatctaaaccagttaccactccatctataagcgaccatgtccacctatacttcaaataaaattttctcttaaaccactcatccgattacaccgttgtgttcgtaacaattaaatctttacaataagatctcacatgattatattttgataaaaaaatacaaattaattttatatatatctaaattacttcttatatatataaaagtaaattcaataaaaactaaaagtaatttacatatattatagaagtaacttataacaaaattaatgtaactttaatgcatgcctttttttcaaaggacatgactacacagctagtggtaactagtttgtctaaaccagctaccactccatctgtctcctttcaacttgaaaaatacaatagtatgtatctttttttaatctctttaataacttatatattttaaatcacatattgtttttaagatctatttgcatcattgtactccactcaaaatatgtgacaaaacaatatatgtcggagatatgggcccggggatatgcgaagtgaggggaatctaccttcccatcctgccacgtgtccctactgcctggtcctgtccccgcattctgcgaaccgcaggagcggccggggggtcggggcctcggggtgccacgtcatgcccctcgggcccttgcactcctttgccccgaggccctcgcctagccgccgtttggcggggggagcaagcgaggagggggcccaggctgaacttcctttaatgcgcgcaacgccccaactgccccctgtcgcatttaatgtagtggggcagatgtgcggcgtgctaaactgacgcgcgatggtcaagaatgaccagtctgtgaccggcctgacgccggtcacgtctgactggacggacaaccgtgctcccacgtcgcatctgcttccagcggagtggaggtaggtatgattcgtcccatcggggggtcattcggacggcggccaccacaagtcttcacctattaatgagggaatgacagggctgtcccccgtgtcaggcgagggacggcgctgggccccgctcaaggacaagctgtggtttagcttccaggcgaaggcacgggtcgagttccagtcaagatagggtgggtccctacccgaaagaagagtaggtagaggcggtgcatgtggtattcccttgaggtataaaaggaggactttgcccaccgagaaaggggacgactctcagaaaacctgagcttgtggaggagggaactaagagtgttctcccgagtttaggaacccttgtaactctcagtctaaatcctatacacaggagtagggtattacgcttgatagcggcccaaacctgtataatttggttgtgtgcgagctagctaggagccttggggacggatacgcgatttctagaggcgagcttcttcccccggccgaactcacgaaaggagggtctcacgatctcccgctagagaggatcattcctgacaatatccatattgaatatattcaaacattttattaatttaaaagtaatttattacatgttagaaagtatcaggaagtatccattacatcttgtacctatgattaattctcattagttattccatcaatgttatttacaacccatcaaaggttttatcttcttttctcattctacattaaaacaaaaatgaaaggaaaaaaacaatcggtgattaaacaaatttatgatagttacttctgaaccatgcaaatgttactttcaattaacattgaagttacttttaaaaattgttaaacttacatgtgctgatctgtgctgattaaatttaatttctagatggagtcatatttttatccctacaacgaatttacttctaatgtcgtgacaaagttacttccgttttatttttaagttacttttctaatatatgtaaattacttttagactttattgaatttacttttatatgtctaagaagtaatttagtcaaatttaaaagtaatttatgtatatgataaaagtaaatttcatatgtaataaaagtaatttacaaatataaatattttttcatcgtaatataataatgtaagatcttattctgaagatttaattgcaacgagcacaatggtgtaatcggattatagatcggataagtaatttgagagaaaactttataagaaagggaaaaaaaatgcatgtgtaatgaaaaaaggcatgcatgtgtcacacggttgtgtaggtgtcgcgcgttaagactatcgcgagaggcctcgctagatagattatatgtttaaaatagaagtattcctagttatacatctaaacgtttacaatcagaaatgcttagcagatagtaaaattgcttccgttctcttatagtaatgaaaacggtcataaaacttctcaaccattttcataaccatatttttctcaaaacccaaaaatagaaacagtattgagaatatgaaaaaccagaaactgaattatatcacgtaggtatcaatcagaaactggtaataatatcggaaacattgaattgtaaaaccacatatttagctttgcatataactatctctactactttaaaaaataagaggtgcttccatcgttcgtcaaaaagaccgggcggaaaaaatagagtgaaaaaaaaccaaatttaaccgatccaaaaaaacaggtgaaaaaaacgtgcgaaaaaaagaaaagaatccgataaaaaagggggcgaaaaaaaccagacggaaaaaaccaaatttgtttgaaaaaaataaaatctgtcagatcaaaaaaggggtgaaaaaaaggaaaagaaaaacgaatccaactccgtcaacgcggtaaaaaaaccgagcaaaaaaatgataaaaaaaaccacgcgaaaaacaaaccgtgcgaaaaaaaaaccaaatctgtccgatccagaaaaaaaaggagcgaaaaaaatgaaaagaaaaacgaatccaactccgccaacgcggtaaaaaaaggacaaaaaaaatctctatctctacttatctctactattataaacattgaagatgtttttgccgtcatccgtgtttaaattagttttaattttattttcagttttaatctctatatctttatctctacttaaaaagaataagaaatttccaaagtcggtaaaaaagaaaaagaagtccgactaaaaaggtaaaagaaaagtccgactaaaaaaatgataaaaaagcttctatcgttgtaagaaagaaaatcgtccgactcaaggaaaaaaaagtctcgccagtaagaaaaaaaagtccgtttgtgtttttttaccggcgactttttttttcacgcgaaagagttttttttcctgcgcacgcgttattgttttttttgtccggttttttaaatcacaccgcgcctcgcacttttggttttttcgacaatttttttcaccggttttttatcccatacgattttggtttttctcatctggtttttttaatccgatctattcgcggcatgtctaccgagttgaaccctggcgatgcgctagcgccatatcgatcgtgcgttttcacttcaatttgattgcaaaaaaaaaattcgattcctactcgtccctcatcattttctctgtaattttccttgctttattttgtcggatttaatctaatggttgccgatgatgacggcgatcttccccgattatttttatcctgagttttatgctctaattttgggtaaaacggaaagaggtgagtggccggataaaaaaccctcaaccaattttgagtgatcgagaaagattcgtccggattttatgggtcgaaggaagcaggccaaacgaaggaggtagcagaccgacctagggctaaaaagtaaaaacggcttcactcgtggctgggtcgaaacaagcagcctgaaaagtaaggaatgcttttggcctaaaacccaagaaatattttcattaactttttttcattataatatatagcgatcccgatgttaggattttcattaacttttttaattataatgtatagcgatcccaatatttcaatttattgctcagctcttaatataacattgaaaaatcgtatttacccgttgcaatgcacgggcattttttctaatatatacttaaaaagtaaagaaatttccgtcgtccgtacagagaaaagaaaattacgcgcgagtaaaaaaatgcgtgcaaaaatattttctgtccgattccaaaataaaaaaaattccgagcgaaaaaaaagtttccatcttcctacaaaaggaaaaaatagtgcgaaaaaaaaagtttctatccgaagggaaacacgcgcgaataaatacctaattaaaaaataaatatctatatctaaaaaaccttctgtcgtaaaaaaaagaaaaaaaaagaccgactcccgtatagaaaaaaaagtccgactcctgaaaaagaagatttctcgtccgtaataaaaaaaaggaaaaaaacatccgactcaaaatccgtaaaaagaaaaggaggaaaaaacgtcccggccaaacctaaagtcgcctcttgttgtccgtatatatctctttaactctaatctaatctatcgatctaatctaactttttaaaaagagaagtttccatcatccgttaaaaaggaaaaaaatgcgcaagaaaaaaatagtttccaaaaaaatgcgcaggaaaaatacggtttccttcgtctgaaaaaaacaaaaaaaaatgctactaaaaactatcagaaagaaatacaccatttctaaaaaatgtttcaaaaaaccacacaagacaaaaaacaccatttatagaaaaaaaaagccgctatgaaaaaactaaccgatgaaacactgtttataaaaaaaacagatcaaaaaacaaacggactcaacgcgcgaaaaaaccgctgtttcaaaaaaagttcgagaaaaccgttgtcacaccctaaaaattcaaaatatataaattgttgtttaaatggaatttttagaaataattttaaaagcctagaagagaagatctaattttaattaataaattccaatataaaatggggccagataaaatttcattaaatactttgattaattctataattcctagattttttttgggatttatttgagctaaggaagtatttttaataaatggaattgcatttaagaaataatttaaattgaaaaaggttttaaaaagtctcttttggctttgggccgaaagtcggcccaaatctcttctctctctcctcggcccaagtcggcccagtccgccgcccacgcgcgcgccctcgctgccgctgacaggtggggtccgtgtcacaccccgaagttttcctcccaagccaaaattgtaatttttataaatgaccctaagaaaatgcagatgaaatcaggagaaaaccctaagaaagtaatgcaaataataatcggatttgacatgtggaatttttcttgagttctacatgtcgaaattcattaacaggatttttagtggaattttcagagctctagaaataattttaaccaattaaaattgagcaagcaattttttttaattccagggaaaatcctttttctttttctttttcctctctttttcctcctttttttcgaatgggccgccggcccattccctccttccttccctcccccttactgggccggccgctggccgaggcccagccaggccgtcccgccgccctcctctcggggtcgccgacaggtggggcccacctgtcgggcccgtctccctcctcccgccgatctcgcgctcgcgccgccgcgccgaaaccgccgccgcgcccacgtccccgcctccccgggccacgtcgaccacgcccgcgcgtgcgccgcgtctcccgcgcccactcccctctctctcccgctcgcgcccgcgcccgagatggccgggattcgaaaatcgaatcccgcctctctctcttccccactcccccacgtcggccggcgattcccgcctctcccggccacgtccggttctctctccccctttttaagcaccgccgtcgccccctctcactttttccccatttcgccgcactctctcgagcctcccatcgcccccgcgccgtgcaacctccgcagccgccattttccgctactccggccgccgctagccgccgttagggtcgccgccaggccgcgccgtcgccgccgtcggattcgcgtggccgagatccaccccgtccacctctcctccgtcgaggttcgccgccggagccctcatcccctcgcgcacgggtgagcaccacctccaccgtcgccttcggctatggtttccgatcgccgtggtccatctccctctctctaatccctctcttctccttccttagggcaccccgaagctcgtccgctcgccgacgtcgttctcccgtggcttgccgtcgccgttcgccatcgtcttcctccgcgccggccaccctcggtgaggcacccctcccttcttttccccttcctctcctcttagtgtcgcgcgccgtcgccttcgactgccgccgccgcctcccgtgccgccggtcgccgccgtcgtcggccgcgtgccgttgccgctagacctagccggccggtcggttttgatgccgagccgagccggcggccgcctttatcgctgcccgtttcctccccttcctagccgccgttagcgcagccgcctccgcatcgcctttgcgccgtcgccttcgccggcaacgcgttcgcgcgcgcgcacgcgccgtcgccgcggtcggtcggccggccgtgagccaagccgagccggtgccgccgccccttctctcccgcgccgctgaccagtgggtcccgcgtgtcggcgcccttcctccctctcccgagtcgctgaccggtgggccccgcatgtcggcgccgcgccccgtgctgacgtcagccctggttaatattgcgcaataaattatttaaggatttttgttatagtaataaacacagtgaatcttctaaaattcataactaattcatccgagctccgtttaatcccattcaagtctcagtaaatcaagaaaaatgtgtagaatccattaaaaatgattttgttccctgtttcagtagtcttatagcctgtttgcaatgtttgctttgtatgtcgctagattccgatccttccgacgctccggtgtactttgagatagtcgccgaggttcctccagcagcagagcaaggcaagtcatgcttgtcacttgatcatattgatcctatattgcaaatgtcctaatgttttctttcaaataccgcatttgttttgcaatattactatgggatggttacctattgttacagccatgctattttgataccatgctcctttgttagcttgggttataacatgattagagttaggactagggtttgcttagccatgcttagttcaactagcacacaatggggagatctcatttaaaacctagactataggtttatatgataatgttagattagtgacaccgctttggtgttggttaattaaaatgaatcacatggtgggctgtgggtgcatggttttgctggtcgcacccatggcagttaaggaccggttcgcgggatgccctggaagaattcatcgtacttaccacaagccagcgtgggcaacggctgggcttgtagtgtggctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaatggtcctgtcacggcctctttccgggatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagactcactttagtttagtctaatgaatttggatggtataggtggatggttgggcctgtcgcaacgtgggttagcgttggacagcagatggtgaaaattaattaattttttttcaactgtttaaatctttcaatttctgtttataaatgctcgctttatgccaatgaaccacttcagctcttctttgttaattccctgcatcatacccccgttccggtatgacttgctgagtacagttggtagtactcagtcttgctctacttttcccaaccccagagttcgagttcgggtcagatgaaggtttctctgaggagtaggcttcgtctgtgccgtcgaggatgcctgtggagtggtgttcccgctgcagtttagtcaaagtttagtcaaggcttagcccctgttgtttttcttttcttccgctgcatttatgtaagactttatgatgtttgtaagacgtggatctgtatgtcaacattgtcgtttgtgtaccccggctggtcctggacggggattttaatgcacattctgcttggaattctattcgggaatttctgggcgtgacagtccgcctgtcggagtcgtcgtcttcgtcgcgccgtcgcccggccgaaccctagcgcgccgccgccgccgttcctttccaaatctggccgcccctttccttctccggccgaattgatagaggggaaatgatcctcgggatctcctctaccttttctcttttggaaacatcggctaattcgttttggaagttcgtggaatcgagttcgattcggatcggcctctttcctccgaaccccgaagtttccttctcgtcgccggccgccgtgggccttcgccgccccctcctagcccctttaaaaggacccccggtgtctcctctacccgccgccaccctcgccttcgcctctcgccgtcctcgtccgccccttcgccgtcgccgaagatcaccggaacaccgtcgccgccgtcgacccgatctccgccgccgtttcaacctcgtcgccgtcgccgtccgttgatcttccgccgctcttttggtcaccggtgagttcgccgcgtcgcgctctacccgttggtgtcctccgttcgtgccgaagcgccgccgttcgccggcgagcgtgcgccgtccgagccgccgccgccggtggtgacgtcatcgccgacgtcatcgtcgccctctcccgtgagccggtcgtagaccgatcgatctcggccgtccgttttggatcaagtcgatctcggccgtccgttcgcgtgaaccgtcgccgtgcgcccggtccaccgaaaccctagcccgctgacgcaataaatctctttttccttttcaaaaataattcattattgcgtcataattcaattaaaatcagtttaagtgttttaatccgatttaatctttaaaaattcataactaattcatcttagctcggatttagttggttcaagtct

SEQ ID NO: 76397 - DNA, 4866 bp, Oryza sativa
attcctgcagcccttacgtaataagataaaatacatatgttaagaacacaactacagaatatctttatcgttgtgtttgtaagtgctgtatagtaaaaagatggtgtggaacacgttagcagaacctgagcccatatgtagaatttgtcgagaccttgattggaggaaatctgctaattatgacaatgataccctaaaagaaagaacattgtttttcattggtgagctcttttttgcattctgaatggttactgctaattcttatgcttgatgcctcagacagtactaataactatagatcaaattaatggagaacaattacctggttttggggttgtccacttgtccagcggtgatgcgacagcgacaatgctcatcttgctggctcatcgacaggaactcgctcgtcgtgtgaatcatgagggcaaggaggcatgacggtgtgagggaaaccagtcgacggggcaatccggcggcggcatgacgctaaccgaatggatcagggatgatctgcaagagggcggctgcaaacaaatccagaagatgcagcgatgtggaaggaggtgacccacgagggaatgatgaggggcgcgatgcggtgagggtggagggaagcgacgcgcaggggagacaaggcgaagcgcagagggaaacgatgcgtgagggagggggcgaggacggaggtgatggcggcgatgatggtggcagacgggtgaaggtggaggcaaggcgcgcgaactcctcctagggcagtgtacagagacagtttgccgacaggaatacccattccctgtacataataacagcagcacacatcagcaaatgctttcaggtaaacatacatcatcacagctaaatcttttcgacatattcatgacagcaaaatcagggcaggaaatgggggaaaagatgcagtacctgacaaccaagatctccaaggccaagaatgcgctcaccgtcggtgatgacgatcacctggatgctcctctccggccagttcttgagcacctcaaggatcttccccctgaatccaccaacaagcaaaccaacaaacacagattcctgtcaggctgcaaattcctaatcaacctcaacatcagaaggaaaacagaatcctcgcaagaaaaccgcacttgtccttgaggctgatgtacaggccctgtggccgcctgtagatgctgccgtacttctggcatgcctctccgaccgtcggcgtgtacaccaccggcagcagctcctccacgttgtcgatcaggagcttgtagaacagcctctcactcctctcctgaaaaaagcacaaaagaaccaagaaacatgacagagtgttcagtaatcaacagttcttgctgcatgaacattcattatcaatgcatttgattttgagcgagtgatcaaagtgcgggtgaaggccagcatcccccgccggccaacctcacccctttctccatcggcgttgtcctattcctcctcccatgccgccgtcctctcccctcataccctgctcaatccggcgcggggtcggctcgcgcagatcgagtcggtgcagatcgggacacctcttccccgcccgtcaccagctcctttctacccgcacctcacaccgccacccctaccggcgttgccaccatccccaacgccgtcgaaaggggatggaggagggaggggagcaccggagccgactctgacgccgccacgaggggagggggatactggcgccggttacgccgccgccgcgaggggagggcgaagaagggggaagggggggaccggcgccagatgatgcacggcggcggcggggggatggcgtacggcgacgacggcggcggggcgacggcgtcggcgcggcgtggcagcgaggcgcgagagtgaggaagggaggggatgggcgtgatagggaggcgaggcgacggcggcagcgtctaggtaggcgatgcgagcgagagagagagagagagagaggatgggagggccggagcccggagggggatgcggcgcgtgagagtcgcgtgattgggggagatcacgcggtagatggaggtgggaggctgctgatcgatctggaccgttcggttttcaccagaaggtgggatcggcggattttgggaggtgggatcgatctcaatcgttcgattttacacagacgatctgaatcattgagtgatgaatgaaagaatgagtgaaactatttgtttaactatagggtagatataaacaccatttaacgagggacaccatagtatttcttctcaaaccttaatatatgctaaacaacagagaattacaattattttgggacggatgtagtactagtatgctgtttaggggtgaaaacggtacgaaaatttccgagatttttggctgtcgttaccggtttatactgaccgtttcaatcggtattagtaattattagaatatcttctagaaatggtagcgtaattaggatagtggtttttcggaccgttttctcgtaactgcatttgtccgataatttccatcaaaatttcgaaagttctctagcggctcagccaacccaacccattaaaagctcatgaatgaagaaagcttgcaacccattaggaaggggaagtggtcaggaaaaacaatgttaactctagggtgtggcatatagactttgttgaaatttgatctcctcaacttatcaatgttgaattattgttcaactttgtttatattgttcgttgaacttatcatcatatcactagtaatcatattacggtgttatgtggagtgtgatgatgtaagaatgaagttataaagtcatcttcatgcatagttaaatgtgtgattatgccagattgttgtttccgagatgaattttcgacttacaattaatatcggtagatttcgttcagacggtccagtttctgatatatcgatattatcgatatcgttactaattttgggtctatcgttccgattttgttttcaagaaaaaaaaatgaaaataaaaatggtagagggtttttggaccattttcatccctaatgttgctgctgtagggctactggatatcgaatcagctcaactcgctctggctcgctatgatactgaacggactctgctcggctcgctttctaactctagcgagctcgtttagcttgcgagccagagcccagtgagggaatggcaatctagagataggcaaggtaaggtctcaaggagtggccagcgacaggctatggcggcaccatgactcacttgcggctagtgctggtctccttgtgctgctacgggcaggtgatcggcggacggaggtatgctggatagcaacaacgatgacacaaggtaatttagtatatactgtacatagcaggcagttaacaaccggcagggcacgggatgatgcgaggtaatccctccgtccaaaaaaagacaaaccctggatttccgtgtccaactttgactgtccgtcttatatgaaatttttttataattcgtattttcattgttgttagatgataaaacatgattaatattttatgcgtgacttgtctttttaatttttttcataattttttcaaataagacggacggtcaaacgttagacacggaaaccaaggtttgtctttttttgggacggaggtagtaaaggagaagtgtgatgtcagtgtcaggcacgacagagcagcggtgtgatgtcagtaggcatgtcacaaggtgatattaggatgaatcttgacataggataaatttttaactcatgataacgtggacgaatctcaaccgttagatttattttggagggccaagatttaccctatatcatctcttgcgacatgcctatcctatatcactgaatctgaatcctgagaattcacggtgcaagtgcgagaggaggcgatgcaagagacgagaaacgcactagtggctcaaacgagattggtggcgccggggtagataggaagaaattttacgaccaaagatgttgggataatgagcgttgagacaactgttgtgcttggctgcctggctgagccttggcttgtttggctcatgatccagcctgagcttgtaaaaaagtgctactaacgtaccaagccaaaactgtcaaccctgaatcaaactagctagatgcttttcgttgttgcagctactgatagtgagtactctgtctgtttcataatataagtcattctagcatctttcatattcatattgatatggaaaaatatttatcaatatgaatgtgagaaatgctagaatgacttacattgtgaaacggaggagataactttttcatagagtgcttatttacccttgtttttactaactatgttccagccaaaatgtaagcatttctatttaaccagacgtatggaatgttaggatgaaaacgctcacaaatattcatgaccgactaacgctgtttttcaatttttactggtaaagtaatgtggaaattgttaccaacaaaaacaaaaacaaaaagatagaaatgataaaaagtacagaaatattgaaaacagagacgattttgatgtatactgagttactgaccgtttctgaattttactacatacttatggaaattaccttttctaattatggtaattactgtattttaaatactcaatatttattgttcatttctttatttgacgtatagtttagaggcccatcaacttctcaattaaataagtactccctttcgttttatacaagactgatatcaaactttaaaactttgactatgaataattttttaaacatttgccttagaaacatgatgaccgtacgtatgttttgatattttatatatatattattatagaaaatattgatcaaagttaagttatttttaagattgtgtccttatccagataacaattattttcaaccaggaag

SEQ ID NO: 76398 - DNA, 12170 bp, Oryza sativa
ggttttgcaagataaactgtaagatgctgcggcctgtggataatgtgcacactgaaaagagagcacaaaaattggattgcacagatgaaacttacataagcctgagtgtgtggatattccctatctctttcggtatgttaccagtcaagttgttccacatgaaatccctttcaaaagaacaaaatatagcagttaggtaccaaaattttggaaatgtaacaaaagaaaaggcttcacgagactaaatgcacaataagagtcaaccatgcaagaaacaattcctttatgtcccagttattatattatgtaagtttcttctttcttgtgagtcagaattatgtttttttgcttaaaatatactaaatgtagtaccccatgagatacaatattatctttaaattcagttaactattccagctttctatcaagttggtacttacaatgttttcaattgagatagaagaccgatctctggtgccaaagtcccagaaagattcatcttaaataactgcctgcatccagaaaaaagtatgcaatttcaagagaaaaaaaatagcatgatattggcaatccaattatcatattgcacatcatacagaatggacagaagtagataataaacagatatcagaatgcaaaatggatttcattagagaatgatcacggctttgaccaaaacatgaaaatagcaacttaggctaaaagtaactagaggtatgtgtcattgatgatagcgaacacaatgggaacttgaattattttacccagtcaaggctgaggtattcttttttttttcagaaagacgcacgagggctgcgcattttgcattaagaggtagaaaactcatagtacaggtgatgaacctgcttaaagaaaaagagagaaagccagaacctctggctggagctaagacaattatacaaacaacaattgcagagggctcactcaacaagtacttgggaaagaacaaaccaccgttaccactaaaaaaagagggagaagagtaagcgtataaaataataaggttgaaagattatcatacaattctgttacatgaagataattatttattggtatattgtcacagaagactcctttccaacttgatgtgcatggatctccactattccaattcttaagattattcatcggatcaattaatcttcctttgatagctctgagagcatttactgcacataagagggaaacagttcaattcacagcagttttaaaattttaagtatctgagtcaatattactgtttaaactaagcatcacacatctcagcaacaacaaaaaaactaataatgattattcttactttgattgcacagctatcttcagattatctattaaaaaactattcttcagatatttctttggaagaactactgggaagcaaccctttcaaatagttattattctacttctctaacaaagttgttcataccagattaactaacataatgttatgtaattgccaggcaatataatgttatgtaatattgtaagtttacttacaatattgtgaacttctttaatttaaaatctgtaatattatgaacttctttaactctgaattaaaaacatgttatatcatgaactttttaaattaccacatgaatataactgattactggtgtgacaacaattgagtgtgcggcaattgatggcatgaacattgtagaaacggacaattcacaacaggttcagatgggggggacgggatcttcgagatactttcaaaacatagcactacttacaaaaagatatgcttaaatccgcacagatgggatatgcataattgaaactttgaaagcttaaagcccaattctgtcttcctgaactatagaactagtagctattctgagctccggcaattcaaactgcctggctcaaaagtataacagaaagcaagcaagcaaatgcagtacagcacatgtcctactagagattactgtatattaccttcagcagggtcagtgctctgtccccttacgacattcacatgacaaatgcacagaacaaccacgatcactgcgcgccgaaaacctctgaagttcgccatgtctgtacaagagaatcaggagcaagtgatcagcaacttagtcatccctgcacgatccagacatccagcacgcttgctaccattctaaatgatcgattagtccaaaatggaggcgcttatcctacccacagaagactagcatccagtatctaaggtgtgaaagcgtgtcaactccatatgatgcttaacgcgcctgacctaaccatggtgtgttcaaaccaacaaccatggaaaaaatatggcccgggcacaatcaaaatcaactctcctcttgactaaagaaaagtaagcgagcttgcaagttacttaagctcctccacataaggtgaaaacaacctattaacactgacagcaagagccacatcacaaccagcaactgggacttcccaactaagcctgcagactgtacggcacaagagcacagtacacaaggttcaggacttcgagctactaatggttgtcaacgttaggtaaatttttatggcgacaaatatgcccttttccgcataccttctccgtcgaatattttcaccaaaagtaccaaacttttatagcttcaaaggtacagatacaaagaagagaagcgaggagccgaagaagaccaagaagctaggagaacaacgaatagggataaaaaaaaaaatccaagccttcttttttttttggcaaatagcgagaaaactgtaatctgaagtgaaatttcaatccaagaaaagaaaacaacaagatcgaactcacactagaaacaaatcctgaacaaaccaaccgcacaatcctcgaggaatcgaagaagcgaacctgcaatcaaacgcagaccgaccggccgctccaatccgaacagcgatttgcagcagccccccgatcggggagcaccagccgacgaggcgcccggccggagattgccctcaccaacgaactcgggaaaggcaggcgagagcgagcaccgcaccttcacccacagcgacaacccccgcggcgcggggggacatatactactactgctgctgcaacttttcagcccgtgcagctgtcgcattcctcccccaatcccatccgcaccccactccctttcctcctggatcgcggcagctacagcgacgaaggcgaaggcgaggtcgaggcgaagctctgggtgcggtgggttggtgggggaaggttgtgctttggcgaattcggggagttattaatggcggcttctgcttcatgcggcgcgctaaaatactttggattagtaggagagcccccccttggcgccatattttattcagtcaaaattgcatccaggacctcggaggatagagtatttacgcgaataggtccccgtgctcgtgtgaaagaaggaagcgaggaggaaagtagagttgggaaggagtccgccgcggttcaaccatcggcgaccgcattcgcctcgtgcggccggactgagtccggtgatctcctcctctgacaaaccgggcccacaggtcaggtcttattattttttatttttatgagaaaataaatgtattcaatacatcctaaaattttcatctagaatgagatgtaacataatctaagtacaacgaatctaaacagagcttccattaaaattcagttcatatccgttgtactaaattatatcccattttattttaggttgattttttttttgacggatgtagtagaggagagtgacctggcttggttgcttatcatgtttattatacggtgagatgatgcaactgatggttggtacttttctggtggtagtttcgattgttctgtgctttggggggtgttgacggatgcatagtgattattttgtaatttagtagcaattgtctaaaaatcgcacaagagaattgtcatttaagatcatgaatataaaatgattgattgtaaacagccgtcactatcccgtagcagcatcgcaataatttgttcgtagcatcgtacggtggcacagacaaatggaatcaagaacaagcataaagtacaagattatgagattagcttgacagaagcacttgatcaactctctagctaagtctagagttgagctgaaaacgtcctaattctgaattttcctgacagtttcaaatgtagccagtgcccttctgcactagttgagtttatttggaattaaaattacccaaacaaattaagaggtcaaataatttgaccggagacctactcctttacctactttcactatctcataaattactgtgtgtttaccaagctgtgctcgatttgacactgttcatctgtagtatttgacactatccaagtgaaaaataaacgagcagactgcttctccaacaacctgtggaacgacttcactaagaacactacctatgatttcataccgaacaacttgggacttagctgacaaaagtccataatttcatagcaacttgttaattcgtttcgaaaaataccaagttggtaacaagatgatctagaggatatgataacaatgtccacgcggctcattagtaacccccaaaaaacaggggtcgactaacaaaaagtcagagagacaaacacaagctgtagttttcagctccagttgaacgtgaccagagaaaaagaaattgccggccatgatctgttcggctgatatttttttctgggagccatatcgagttgctttctagtacgggtcgcattgatcagtccaagataatgacacttgtgtctgcagggatgacactttgacagatgttgaggctgcacactaaaactgttcccctcctataaccaaaaaaattaggaacattgacataccattaatatactattagaccagtctttttcaatctacggaggctgtgaacagtgtgaccatatgatgacgaactgatgatgtggtcttgttgtgaggctcccatggttttcagaaaacaagactggttgaagtgttctagttccgtgcacagaaattatgacatgtttgtagtgtttaaatttggttctgtattacacttatatgggctagtaacatcttgtgttgaaatgacattacagctgaagtgttggatacgctgcaactagagtacaacaaatgttcagaagaagagtagcttggaagatatttcaaccgtgtagatgtttcatctccctcagacagatgtttcatttcgttttcatggtgcagatttgataacaaccgtgtagaataaaaccaagattataagtcaattttttattaatactcaagatggatacgtctgtgtttcgcagctgcttctggatggcccgggttggttaacttacctcaactgcttaatatcttcggggaaactgatatgcttctgaaacccaactgttcttcagagattagctattccatttttcacttgcgaagcttctttagagaaaaaaaattgttcacttgcctatgatccatggcacggtatcttcactgattggtacatacaaccaacacaacgcgactaacctgcgactaacataagattggagtgcttaatcactttaaatctgtcaaagagcacgcgagtttgactgcagattgcagcttcacaccgacgacggtaaaaagtgcagactttaccagttttgtaagtggatttggggcatctatctttcgcctcttcaccttttcttgtagtgagatacgcgatgatcttgcatattctcagcaacagaaaaaaggcagtaaaatataacacttgtcctccaaattgggtgatacagccaagaggaaacggttctgaagatgattatactaatcctgatgtggtgatgatatggtcagatcaatgtcaccattagaaagtagctaggaaattgaaggtagggaacagaggaagattgtggctggattacttttaaacgtcgacgacaccggtgggtctgatgctgatgttctgctcatatttttgctggcattatcataatagagcagttactgctaaaccgctggtatatagctgaatgggatcatcccagtgcaacagcagttcacacttgccatgcccattgcaatctgcaagttagtagctgtagctttcagttaagaggaatcatattataaccttttaaatgcttgatttaaacggcaaaccaagtgctagtttacacaggcataggattttgtacttctgatgatctgacacggatgcgtcaaaaaaaaaaagatctgacacggacagctgggatattcagatgttcatcaacacagtacgtgcacattaggacaaagtattcagatatatgtggcaatgggttttgcattggattctctctctactttgtaacacagagcaagtgttctgttttcagaggttaaatgctacatggacatgcttctctctaagataatcacaagttctgatatggccacctatcgcaaagccaattgagatgaacatgtcaacaggccaaaaaaaaaaaagaagaaccggaatgaataggattccattaatcacaagtctaaggtttgcctttacaaatatctgatgatatcagtgagtttaaggattgcaccttagctgtcagcagagacaacgtaatgtcgccaatgcctctctgaatcgaagcctgaaacgagtgctctgacaggcccctggttctggagctcttccaagttcactctacaaaataatcacctttcttcccctcaaagaaataataataatcacctttctaatatcgccctatgagtttcaatcaagaacacaacgcagaagttcagtgagaaaaatgatgaaaaggatggtacgaggttgcattgccccatcccagcgtgtactcggactagacggagcttcaggtcgtcttcttgcacggcggctgctcttcggttcttcttgctgaggtcactattggaagcggcggcgaggtgcaaatctaagccataatcgcagccgccggcggccaggggggagggggacagtgcgccggcgaggcggcgacgagaccggcggcggctcagagggcggcgcggccggctaggtcgcaaccagtggtcgcgatcacgagccgttcgattagcattgggcggttatgatagaggcggaattcatgtggtttccagataccgttttgcaagaagacccctcgtattgttcgctatatcaagtacatccttgtttcaaatagaaaacagaaaaacgaagtacatttcgagtcttggattgctaccaagggtagcgattctagaccgttagatcaatgttgagcggatatgattgagggggaattggatgtggtgtaggtgggcactttttttttgcaaagcactaccattatatggtttgccttctttttatacagttctactctctcatagaatgagttgtatattcttttttaagaagcatgaatagttatatattagtaattatgatagtttgttttacggtaaatctagtcatcaatctttatgattttgctgacagtcaaagtgttgatttaattacaatttaacatttatatttgtggacagaagaagtagcttggaatggtatcccatattgttcacactggcatatactataatttgtaagtcgataactgtacctttcaccttttactattttaggaataattaggcctttaaacagttaagtaaacagaaaaccctatagcatgtgctacattacacaagcacatgatctttacctctggtctgagagaccgagacagatgagatataaagtgatttttgggaagcatttcaagaaacagtaagtagctagcttcaaaaattttggagaagctaggaaacttagcttttgacttctagtttttattttattttatttattctgtataatctgaatgaaaacaaataaatcgtttgtttgaggtagcttttgttacctgaagcaccgcaaacagacctttccaccaaaacagatgagattttgacaatccatgaccaacattctaggacgccaatcacttcacagttcacaatggagcaatagtgtttcaacacaatcagatgtttgaggggagcttgagaaaaaggaggatacacgttctagaagttactacatgttagggaatgaagatgtagaagaggaagatgtttttgtacgataaactcctggaactacaactcttgttcctccacctgaactcccttgggccaaaagcttttggtgggatgccgtaccggcccaatctgcaacctttgtggagtacttaacaccatgcttatctctgttgaaaggaatgtgatttaagcaataattatgacctgataaatttccctcaaaaagaaaaatatgacctgattgaataaaattctattcaccagctcaatatagcaagaaacttagcatggttggtaatggtgcaattcgaagagtctatggtttttgttatacatatgcttacaaattttgtatttgtaaacttaattttggagtcgattttattatttttttaaaaaacagtactattactatataaaagtgattaatgttactaataaacggctataagcgaaataatgattcccggttcatccgaacggaaggtccacagtccaaacgtacgacgagctgggcagagggaaacgcagctgccgttaccttgtcaccctcaggcagagggaaacgctagctggccagtggccacgcatggcatgggttcatcccgggagtaagagtaactagggtcggaccaccgggccccgggccgggtggcacgcatgtaaactcgcgataagatgtatatcgatcataagatgcaacggcatgcatgtgacagcgtatgcgtgctgcgaccacgacgaatgttcatgtgtgccactagcggattgctcgaatgcatcaatgcgtgtcaactcgatcgagctatagctacatatccgtgcttcacgagagggcgctgagccctagtaaatgaaagcccgatcgatcgatcccgccattactaaccattacaaccggtcgttgctcttacctgccctgctcttaataaaagccttaattgattaactaactaaccccaacgaacttacgaacgtacgcacaaaactgtagcgtccccgtcctgtacatgtgtgcgcgatagataaacagccgcatgcatatatatacgtccaatattttctcgtttagttcttcgggctaattaagcgctgtacgataacgttcgcctccgtgtacatgaaaactcgccgcgacgctgggcgacgccgacgcatgcgggatacgacgacgacgacccatcataagctaactgagtactagtacgtgtctcgtgacgcggcagctaccgatttcgatcgatcgccaccggccaactaccgtgcgtcggtgcgtgcaatgcgtatacgtgccctgccgactcgctcgcttcggttcagccgtggacacgcggccatgcggctatccaaccagatgcgctgatgtacaaacacgtactccctcctaaaaaaaaaaaaagtttccgtgcccaatatttaaccgtacgtcttatttaaaaaaattataaaaaattaaaaaaacaagtcacgcataaaatattaattatgttttatcatgtaacaacaataaaaacacgaattataaaataaaattatatcagatggacagtcaaagttggacacggaaattcagggtttgcttttttttttacggagtaaagcgcaagcctaccaaatgcaaaatttacgacatgagaacctgtgttcgtttaattagttgaacaatcaagtcatgcaaagcaaccgaacttagtacatttttgttgcgtggggaccaatgctttagggcgtaatcatccatactcacgaaggaaatcgttctggacaacgacacgtctctaaaacataacttttaacttcttgtttctataaaaatatttattgaaaagtgatatatatatatatatatatatatatatatatgcttttataaaaatatcttttaagataaatctattcatataacttttacatatattttcaaactcaacaacttaaaagttatttatgatttatatttttaagatttgaattaaatattgtcctaaacgattttcttcgtgagtacggagatactgctaacctaaacaaccgagcgaatcatctttgactaatcatcgccaccagataatggcaaaccttgaatctttagattttgggagtttttgaccgtgagaacacctgagcccggccgctcggaccagcgatctgatctatacaatggttgttaatagtgggttttttagcgttgttaattataaatacttgttgatatggaggaaagagaaaaaggagagacaaaacatcgttgttatgcatgacaacagcttaacaacgactcttagtcactataatatagaaatatggttgcatgaggatataaatataaaaagaatattaataaaagaaatattttttgagttaatgattagagcctttatcgtctcaactattataaaaacatggtctctaaaatcttgtattatttaagagaccatacccgtctctaccattgaacatgccctaatctaccccaacatcccaactttgaccgggcctcgatgctacggcacgtgggcccacccactgacaagtgggccccaccatgacgttatctccttcaccactccccctcgcgatgcgacacgtcgagcccgacacgtctcctctatccgagcaacgacgccgccgacttttccagacttaccgcctattctaatcccccacacctcccacctctcgcccactgacggccgggcccacacgggcggtgggcccacgtgtaagaaaaaatcgcgtgaaggtcacggggggcccggtgtttttaccgcccagcgtttcgaaagcgaaagggacaaaattgggaaaaaaaaagaaagaaagaaagaaagaggagaaaatttcacgccgcggctcacacgcattcctcttcttccctcctcttctctccccgcctcctcgcggtgtctgcctctctctctcgcgcgcgcagcctaccgccacaagcaaagtccaggagggctcgggcacggaagcttctggaagcttccgcgttggcgtgaggaaggaggcggaggggaggggagggggactgacctactccctcaccgcggtcgttccaagtcccgcgccgccggggattcccatcccctctcgcggcgcgccgcttcgacgggaggtagggagggtaggagcaagagcaacagagtgatgtcgagttcgggtggcttgcggttgttatcggtctcatccggttttgcggttgcaggcatcgtcgtatcgcatcgatctggtttggggggttttgggagtctgaagtggtgggtttgagatggaggacttgctggacacggagatcgggaagcatgactacgactggtaattgactggtttctccttacttatttggttttctgaattttgcgtcgatttcatgtttgctgcaattggtgaacccgttgtgctaagttgggtaagccgtttctctaatttggagtagctggtggcaatgccgcgtttgaaatttattttgggggcgttttattggttaaacttggacgacgttatacttatcgtgcttgtggttaggtgaatgaatggtgcttgtttatccgaggaatcagtggtgtcatcccagggaaatcatgatttggtgtatttaggttgagttctgctgactgcgattgtttccggttttaagattggccatgtacggatgctacttggtttagttagggaattagtttcgttgacagcaaagacaagtaggtgactgtattgtttggtctgtgggctccttcctagcttgaagagcaaagcgttggatctcaagtaatgtcttctctatattggaaagggaaaaaaattcggcaggcaaatagcattgctaactttaggatgttttatactggctcgtattataggataatttcaatagttcaaatgaattctataactcttttgtgaaatttctgaaactgaattacaccagcacccagccacccactgggaattacaatgaccagacattttaattgcaagtttagttgaaataactactgttacactttagttgactttcatcacattccactattgtggtgataaggccgatttggatgtcacgtctatgggcttgccacaaaacgggagtgc

SEQ ID NO: 76399 - DNA, 838 bp, Oryza sativa
tacatgcacatacagtaggagcagcaaactcatacctggcagggccttatgttggcttgtttgcttcacttgaaaaccaaaatgaaatccagatcgaatgtgaatttgtaccccaaaccgaaaccttgtaaagatctcacagaaaacacataaaaacacatagaaaccttgtaaagatcattaacagatttgcttgaaaattcatcaaccagaacaaaccctccctcagcggcatttaatcagagacctattgtgcagagtagagtaagtgtataacaaatgaatttacatcatcggtccgtttaagtcacaatcaaatagcaccaacaaaaggagtaaactggataggaggattctctttatatctcattaacatttgttagtatttcttttaatacaatcaaacaaaagtgcttgtccatagtattatatttattgacagaagtaagaaaattccttttttttcaataaaaaagtataaaagaataatggaaactggcaggtgttgcatgagtaatccaccaattaataaattaactcaagtcagctattacctgccttaaagggaaagctaatccatcactgcttcttgttgcttacctgcaaaacagagtcttatatcatagccttttgacacaaggaataaagtagtaactaacaggaaattatgtgtttccagagttaaaccaacagaaaactactcaacgttgtaacaagcacgacctgaacatcaaatcctacacatgatgaatccaaaatacttgccttctctgaccctaggcaagatgttttcttttagaaggttacatcgaacatcaaatgactgcacagagcaggt

SEQ ID NO: 76400 - DNA, 1011 bp, Oryza sativa
cttgcataagaggataatgaagtaatataactctgaactggaaagtggaaatgatttttgatgtttgaaaaccctaccatgcattgcccaccaaaataaactagttgaaagaaaattatgttcgccagagtgattttccaaattttagaatgcacctagtcacattataattgcaataactgtttcagtgcacatcgcctgcattggtaggttgttaggtgctgcaactagcgctaagaacaatacttgtttgaattctgtttaggcaacaatagtagaaaggcatggtaatcctttaacttgcctttttattgacaactgaatgccaatcttacgtttcatgcaaaaggagttataagaaaaaggcttgatgaaccaggtgatctgtcaataccatcataggatgttgaaaacagatagtcaccaatgctaccgtgatttgctgtattattgggttgtaatcatgtaaatttggagtatttcacgttattacatgtttgctcatattcatatagtgcaaagtgtacaatctgcagtagtcagtaatacattttcgtctacaatgaattgtaatttgtttttgggaagcaatcaagttccatctagttagcaatataatattgtaataatattgcaccacttatcatataaccattgatacatgctttagctgtatgacctgtttcttcaaatctactatttgctcagccaggcatgtgttgatgctcataattaacagaaatgtgctgcatgtttattgcagctttccattcctgaaacagagaatgggcattccacagtaccaactaggccagcacggagtaactctgtctctcgcccttcaatccaatctactcttatttccagcacaacaggtcatcagttgtcaatgcaagcatttcctctgtctgttcgccacctacaactccaagcaagaggactagcactctttcttcatcaaagccatcagttccagcttcacgtcaagtaccaacacggccctctactcca

SEQ ID NO: 76401 - DNA, 7655 bp, Oryza sativa
tgcctctctctctcggcgcgtgcagcgcacgtgcggggaggaggagcagccgagaggggagaatgggccgagcaagggagaaacggcccacagccaagagggacgcaatttagaccttttccgagagaactgatttggataggattgagagatttagggtttggattcgagttcaaatttgatattcgaactcgagggtttagggatgtatcaaggggaattcaaggagaagtcaaggaaaagattcaaaaggaatacttgggtatttgttctcgggaacatagggtggagtcaaggaaggaaacaaaacgggggtttggacattttgggatttggaaatgtgtttggcgaggattcaaaggaagggattgactttcggatttagatttcggagacttgaattgggagaggagatttgaggcggaggattttgatttcgatgagagggaacaacgggatttgaattgagatcttggcacaacttagactcgcacacaaagaacgaaaattttcgcaattaggattttgccgaaatagtttttaacaactcacgaaaagcggagcgttacaagtagctttttaaaatacgtgttaatagaaatatagaagtagctagggccctgtttagttccaaagttttttttctaaacttccaactttccatcacatcaaaccttttatacacacaacttttcagtcacatagtttcaatttcaaccaaactttcaaacttcagtgtgaactaaacacggcctaagttcaattacctcttattagaacgcgaccttagaatagcaaaaggtgtatgttttggatcataatatcctataattaataaactcgcatcagcaaccgatcaggggatgtagctcaaatggtagagcgctcgctttgcatgcgagaggcacggggttcgatcccccgcatctccatttttttttattttttttacttccctattccaagcactatcttcccaactgttctgaatgttcaagaccgtttatctcaactttctgaatattttccttattctagtaacttgtaaaacgagatggagagcaatgagattattatcagtcccaccatgattatacatatagtcggatcaattaactgcgcacattctctgaactttcagaatattttgtttaccctgttctaagacgagaggagaacaatgagattatctgagtctcaccacaccatctgcatcttttgcatacatacgggtgtgtttagttcacgtcaaaattacaagtgatgtgatagaaaagttgaaaatttatgtgtgtaggaaagatttggctgtgtttagttcaatgtgatagaaaagttgaaaatttatgtgtgtaggaaagatttggctgtgtttagttcctgaaattgagaagaagtttgggaaaagttggtagtttgaaaaaaaaaagttgagagtttatgtgaaatgtgatagaaaagttgaaaatttatgtgtgtaggaaagttttggctgtgtttagtttctgaaattgagaagaagtttgggaaaagttggtagtttgaaaaaaaaaagttgagagtttatgtgagtaggaaagttttggatgtgatgtgatgaaaagttgggagtttggggaaagtttggtgtgaactaaacagagcctttaatgtgatggaaaagttaaaagtttgaagaaaaagtttaaaactaaacaaggctgtaatagatcaataactgaacacgctactagtctcaagtgcaaatcagacgtatgtacacatgtgtggagattatgggtaccccatacccacacggcatggttatctgactagttataggggataacttatatgtatgtaatatgtaacagatcataacttgggtgttacgtttccttgtatattacggaacggcctaaagtcctggttggctaatattgtaaagtagatttaggaaaccgataccgtattggttaaggtttctatctcgtaatcctgccccccatcctatataaggtgggcaggaggccctctagggggcagatgagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtaggggtaaacgtcgagtttcctgacgacgagtgcgatggaatcaactttatgagtcgccggcttcgtcttcgctttgggagctccttgattcctcgccgccgacgacttcaacaagacgaatcgtcgctgctattctctgcctgatcttgttcgcatcagcacgacggcaacgacggggcaacgacagttcgacggatttgatggtcgtcctcgtccaccaccaagcctactggtccaatctacccaacgaggatgccatggtgttgcaagatggatctacaaacacgaagcatgccaaaaccgatctaatcggatgcataggagacggctgcagccacgccgatgcctccctgccgtcctgcgtcgtgctgatggacaccaacgccgcccgcgactgcgacctccgcctcctccgctccgtctcggagtcagtcgaagagatcaatctcggcgagttttttccttttaatctccgacttcgccgggttttttccttttcaacttattgttgtttattagattgatctctaaatgtcagattaatctctcttggtattttctgctgtttgcatgtaacgccgcggcactactcttgccgactggtgcttccgtctgcatggctggcctattaagccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcatcgccggcttgcctccgtcgccgccgattggtgcctccgcctacagggctggcctattatgccgccattagtgggcatcttcgctttcaccgtcgacagccttcgtcgccgccgactggtgtcttcattgttattaatggacgactttgttcctacattggccacctctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacctaagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttatcaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaaccggccgcctcgtctgccgccgactggtgcttccgcctgcacggctgacttattatgccgccgttgttgggcgtctacgtcttcaccgaccggcttgccttcgccgccgccaactggtgtttccgcctgcacggctggcctttaatgccgccgttgttgggcgtctacgtcttcaccgaccggcttgccttcgccgccgccgactggtgtttccgcctgcacggctggcctttatgccgccgttgttgggcgtctacgtctttaccgaccggcttgccttcgccgctgccgactggtgtttccgcctgcacggctggcctttatgccgccgttgttgggcgtctacgtcttcaccgaccggccgcctcgtccgccgccgactggtgcttctgcctgcacggctggcctattatgctgccgttgttgggcgtctacgtcttcaccgaccggccgcctcgtccgccgccgactggtgcttccgcctgcacggctggcctttatgccgccgctgttgggcgtctacgtcttcaccgaccggccgcctcgaccgccgccgactggtgtttccgcctgcacggctggcctattatgctgccgttgttgggcgtctacatcttcaccgaccggccgccgcatccgccgctgactggtgtcaccgcctgcacggctggcctgttatgacgccaattgatgctatcttcttcacggctggctacatcaccgtcaccgctaataggcatcatcatcttcaacacaagctgtctacgtctgctgctgactagtgccctcacctctacgtctggtttagacagctaccactactgatgaacatcatcgtcttccgtcgccgactggttatgctgccgccgactagtgcttttatcttcacaactgcgcgtcttcactaccagtttgcttctgtcacttcatcacggcaatgcaactttgtcatcatggatttctacttggacatcttcaacatttatcttcaatcaagcaatgactactcgacgataagaagctataattctcgactctatgttcagttgtttcccaactaaacaaagagtcgggggctacacaaatacatggctcaaaattcgacaagctttatgtcaaagatggagcaatcaattaatcagccaacgagtcaactccaggagtcattatcttcatctttgcttcggagcagatattctacttcaacaacttcaaatatttcggtttagacgagttgggcaacaacatcaactctcctccaattatttgtcttcacggttggcctactacgcaactgccgatagaggatctcatcgttatcatcggctgctacatcgttattgactggatcactgacatcgtcatcttcatcaacatcttgtcaagcctcatcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacgtcttcatccttgtcgtttccgtcgttgcaaggttcgcgagtgcgccggaagtattcaagaagattaattgaagaccgattattgcaagttgaagacaagttgcaaaggagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacattttgtcaccaccgactgttctttcgttgttgttgggcgcctacatcttcactgctagctgacctgactgttgccgactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgatagaaggacaagctatatgctcaggggctcatcaactcaagcgtgaggattatatctccaatttggacttgttccggatacattccacatggattcatagttatgagtctattttctatgctcaacgactggaccaattattattccccgtaagggctatcaaccgaatacttgcgccattcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttataagtcaaggtgctgtttgggtttttaagcaattgattggatacaatattattgctttttgccacgtaagtgtgcatttttattgaccaatattatggcttaggctgattatatattgtgatcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccagtactttgaaaatttctttattcacaacatacaagcttctttatagctattttgctatgtgaattttcaatgatgtagccaactttaggttacactcatcatattttacaaagcagtcggtatatcacttggatcatattattcagggattcacaccgcatctgctacatattaatattaagtcgcttggttgactacaattatcgaaaccactcggtgcatctagtcgatgcacctgactttattttttcagccctccacagtcttctgatttagaaaaagtactcgggagatcatggcgaagatgattgaagcactcggctttggagtaatctagttcgagagaagattatctttctgactgtgaaggtctcaggggctactgtgagattatgggtaccccatacccacacggcatggttatctgactagttataggggataacttatatgtatgtaatatgtaacagatcataacttgggtgttacgtttccttgtatattacggaacggcctaaagtccggttggctaatattgtaagtagatttagaaaaccgataggggtgcaggaat

SEQ ID NO: 76402 - DNA, 2391 bp, Oryza sativa
aaaaatttagggtttgtctttttttttaagcaagtaggggtgtccgtttctcgggatttgtggagggttgacggatctgcccctgaggtgaggaggctgagagtgaccgaccgacgtcgacgtcgacgacgacgacgagatcagccgctgctgcccctgcctggctggtggtggtgccctgcagggcattgactcagatacatatgggtcccacttgccggtgaagtggtgtatggtacgaacatcgttgaccaagcattacgtgatattagtccctcgaacgctaactgaaaacgaaaacgcagtgcatacgacttgctccctccgtgaactgtattaagatctaagtgtgattgctaactaatggtgagttgggtctggagtggagttgtggagtagcctaaacccagccacatctctctagtttattttgtgagcttcacccagttccgcttctattttaggtggtgttggaactcttttactaggcttcgctacaggaaagatgaaactagagttagagccattccaaataggcctctagttattagatccaatacttacgggatgccatgtctaacatcatatgtacccatggtaacatcagcatgatatctaaatactagatctaatatctacggggtattatatctattattgtgttgagttgtgatccaaattcatttgcatataataaaggccagcttctgttggagcgaaacggaggcccgtcgttgccgtagacttggaccgaagcgaagcggaggctgaagctggcccattgggttaaccaaataacgttatgcacctggggacacccgggggtgtgggagcggagcctccgcggtacagatcgttatccttttaaggtttcaccttcatatagacctcttgtaagtcgccgttcagcgttgtaatctcaccctgatacagtgaagatattttgctggctagcgcacgtggttttttctctcctgttgtgggagggttttccacgtaaaatcttgtcttctgttattgatttattgttttttatcatttatttgcctatcgtttcttaacattattaaaggtaatataggacctgttcactttgatatcatttttaaccataccattttttagattagatgccaaaaaatatctacgtttagtttgttgccaaatttattaaatacataagaaatcctgccaaaaattttggtattatcaaaatttggtaaggcttattttagctacattctgaacatgcccatagtatttgtgacccgttctaacgcactggcacatgcttggagagtggcggaatcaacttctgattcttggctagctcaccgttcatgaacacttcagcaatggtttatcagccgcaataattgaaacatcagcagtaattgagcaatggctttttttttatattccattatctaaaaaaaaatctaatcagccattgtatggcctccggtctgcattacatatgccggccagtacatattgtacatttttgtaccgtcggacaattcaagccactgtacactggtacgtcattcctgttgcacaaatcgcgtttgatcaatgcaacacaacgacacacgcattgctcgtttgctcctaccgccttttggatctgtagctgagctcctaccgagtgagcttaatttcagccatttgagcacggcagaataaaacgcatccactagggccgtgcttagttttccccatatttccaactttccatcatatcatatcacatcaaaaactttcctacacacataaatttttaattttgttttcaaactcctaactttcttcaaacttccggctttttttcaagaactaaacacacctagacaaagcggcagagcctgcgcccgagttggtcgggcaaccactcaggcttagctagtagcagatcagaatcctttgctcaacccaaagattatcaggttcacatgtcagtgatgaaggcacgatgcagttcactatagaggatctcaatccactagtagcctagctaatactgatatttattgtcaattttcgaaaatccttatgaaatgttgctgagattcggaaatagtcttttatcatctgaactcagttgtcgttggttctgccggccacttacaggtgttcatccttttcgggtggtttgtgtatcaaccgcagtgatttttttttcactgacagtcttgctgaggttctcgtgtgaaccagctgggttccatgccatattgtcaatttgtcacctgctaccgtattgaccgtctagccagagaacagcgtaccaattggcgcattctttgatttcttcccccttttcatcttgagcacagttattgctgggaatcatagaagcctacttcaacaaatcaagtgatttaccatcac

SEQ ID NO: 76403 - DNA, 6557 bp, Oryza sativa
tcattcttttcttggaagtatgccatatgggattcctttttaatttttacctgttggctgttcttgaggaggtaccacagtttgttaatgtaaattttggtatctcttgatgaggtaccacaaattaatactaaaaactgtggtacctcttgctaccttctcaaggaccgtaaaatcagttatatcacaacctaattatatactttagctattttgagttcggagtctagtacctgatttcttgtataacttaatttgttgcgcaggttatttacatagtagtgagaatggctgtaatgcattcgtctttcacctggaagcattggattggtcttgctgtgacatctgctgcatattttctgccgtacaagcaacttgccaatatgtcagagccagaatactctgagaatggagagttaattaatgctggttatgacttgaacgctggtggaatgtccgagtaaggaaaacacaattgtttttaattattctacttgaaaatgaattattggatattttccatggaaaattattaactttcagttgtggaccttgtaaaattcgccacaaagaccttgatccagcttctttaaaatcagttaccaaattttaaagctgaaattacatgaatactcctaactaaaattagagagctttgaccatcacagtgggttgaaacttttagaattttgacatcatccattgatggaatacatcaacttgtacatgcaaaacttcgtatgccttctgctgtataattgaataataaatcgtcatttgcttcttttcatgcagatatttacaagatgtgatatatatcactctctttgtgcagctgatgtctattttttctgataaattttggtggacatatttggtggtaagattcacacacaccattcttgacttcaattatatttctgtttactatggcgattactttttgttgatgtcactattggtgtcacccctgtttgggatgcccccaatatagaataaagtcaatatttataaactacataaacctgcttgttctgtagcatgttacaacatgaaaacttggttgaaaactatttaaattcttgtcctcatcctctttctttatcctatgtttgtatgtttccattatttgattgatgttccagcatgtctggtgaagattctgtgctgaacttgatattatcattcaacctaattatgccaatggcctaggaatgttatccatgataccatgaccgtctgatctatgcttgtaacttattttgtgaccactggttcataaggtggttttacagcggtatatttgaataacagccacactgcagtaccaatttagattaccgtcactgattgctactactgtaagctgttgtgctcttactttcaatcagtttttcctcgcaatcacaggcatgttaggaatgtaggcacatggcatcatggccaatgagttaaaatctctagaaaattattgtttcgatttatttttgttatacaggcatctaactatggccccctctttttgttgttaaataaaattctcaatgcgcattgcagatggtagctacatatgatgagttgtgcacaataccaagaggcattgccaatcattgttaacttgttattaaccacatacctattgattttcagattccagcttatggtggatacaagatttccggtctgttgagaggagcatttttcggtggtagttcagaggtaaaaatagagtgattgtcagtggcagtacattattatcacaaccgacatttggatatgacttatcagtattgtacctcctgtctgcagggcgaagaagaggatgagaagacccgaaagaaaagggagaagatggagaagaaggcatctagggggaagattatcaaaaccaggactcgttgatggcacatgtagtgtatcggggctcgttgatggctcatgtgtattattgtttgaagggtaggtttgctttacatggctgtccaactgaaatgtaagctgtcgggcagaattgtttcatgaattattcgatcatttgccccagcagcttagtagtagcacaaatttgaactaatcctcttaacttatcgataccagcattatcaatgagcagctctcttttgggttagcatttcccaacaatgagatatggcatatgagaattttctagagtcatatggctgtgttcgctaggggagaatggtaacctgaacagtgcacatgaaaaacggagtattccattaacgcgtaattaattaagtattagttttttttaaaaaaaaatggatcaatatgatttttttaaacaactttcgtatagaaactttttgcaaaaaacgcatcgttcagccgtttgagaaaatgagatgggagtgttggaaactttcccctcttgcaaacacagttgttttccaagcatttgctgatgttgctttcaactatcatttgcaacattttttactcctttgtgtttgcaaattacaatcaatcgtgctggtgtttcagttcattcctattccggcgacagagcaggcagtagacggcgccggcgacgaaaaaactgacgaaccaagcgttgttgtaggctgtctcaaatgccttggagacgctcggtagaactccaacattgtgcaggaatcccggcacgatcggcgcaactccggccgccatcgccgccatggcggcgacgttgaaaccgccctggaaatagtaaggcccgtggctgtcctccgagtagagcgcgtcgacgtccagcgcggttcgccggacgatgtagtggtcggcgaggatgatccctccgatcgggcccatgagagccgagtagccgagcagccatgtgtagacgaagctctcgctggagctgagcagccgccatggctggaaggcgatgccgagcaacgcggtgaccagcgcccccttggcgaacgtgaacttgcgcgggctcatgctgacgagcgcgttcgccggcgccaccacgttggcggcaatgttggtcgtgatggtcgcgaggctgatgccgacgatggcgagcaccgtcgtcaccggcccgccgatgcggccgaggagctcgatggggtcggagatgacgtggccgaagatggcctcggtggcggacgtcacggcgaggccggcgaaggtgaacatgcccatgaacaccggcagcccggcctggccgagcacctggtccgcctggctccgcgcgtaccgcgcgaagtccggtatgttgatggccaccgtcgcccagaagctgatgttcgcggtgagcgacgggaagaacaccttccagaactcggcgcgcgtcagcctcggcggcagcgagaggatgcgcccgaagccgccggcggacacgtaggcccaggccagcagcgcggaggtgagcacgatgagcaccggcgccgagtacttctcgagcttgcggatgccctccatcccgtgcatgatgacgccgagctgcgcggcccagaacgcgaggaagcacgcgaactccagcggcgctgcaccgaggcctggcaccggcgcgagcagcggctggtacgacttgagcctggacggcaggaggaggaacacggcgcggccaccgatccaggactcgatgccgaaccacccgcagccgacgagcgcgcggatgaccgccggcaagtgcgcgccgcgcaccccgaacgccgctcgcgcgagcaccgggaacggcagcccgtgcgtgaccgccggcgcggccgtgagcacgagcgagacgagcaccaccaggttggcgaacgcgacggtcgcgacgccctgcagcgccgacatgccgaggtcgacgaggctgccggcgaggtagtaggacggcacgccgaccacaaggccgacccagaggctggctaggtcccaggccgtcatggtgcgctccgacggcggcgtcggcgacaggtccgactcactcgacgacatcctgggcctcgccggtagcatccgcgggcgcgacgcgagcgtgagcccgggactccgaggaagaagaggaagccgcggcggggacgcatggtggctcttcacctcaattcggtggcccaaatggcttcgatgccgcgcggcgagagctctcgacatcgccatggacatggccatggccggtgggggaagcaggggaaggagaagttcttggttgctttgctcgatgaggaggagagctcgagaggatatgggatctcgtcgcttggttggttgcactgcgtgccactgttcaccggggcccactgccttcgacagcgaggaaagattccgttagtgctcggccgccgttggatcctcgctctctgagactgtgactcgcaatctgaaccgttggatgggaggagtattattttaaggacatgtgagacgtgtttggggaaggtgattctgactttggtgagagcgagacgaggatttggagtgttggacacttttgccgtgaggttgattggctgatctaacaaggggtacttgttatgaccatgtgatgcgatgataggccagctttgggttttttttacatgataatctcatccaagctgccatctacatgtagctgccaataggaaaattttgccaacttgtgatttgtttatagttgagtttttgtcatgactggcgaaccccttaaccacgttccctttgagatatctgcataagtgaaaagagaattccaaaatgccatcaggatgagccacatcatcaaacaaatattaacccttcgatacaacaattcggttggagttagacacagttattaagatagtaggtagaagtgaatggtggaggattgtgattggatgaatattagaggtaggtgggaaaagtgaatggtggagggttgtgattggttgagaagagaatgttgatagagaagttattatattttggaacggagtgagtagcaaacaatattattgttgttctagaaccttcatgcaatacccatgagatacttcctccatactcataaaggacaatgtttaagtcaaaacttgggaatataaatcatgaataactctcaagttgttgagtttaaaaatgtaaaaattatatgtatagatttgtcttgaaaaatactttcataaaagtatacatatatcacttttcaataaatatttttatagaaacaagaagttaaagttgtattttgtacaccgtgtcactgttctaaacgactttctttatgagtatggagggagtatgtggtaagaaagatatgagaatgaaaaaaaagtacattgacaaaaaaatcaccaatgaatattcatagaagttctattgcataaaaaataacgagtattaatgtatagatgaatagctaattaacctggtgctatcgattatttcattatgccttaaaattacaaatcatgttgcatggaagacattccattggagcagttcatactttagattgatgtcattttcaaccatacaattttttttaaagtttccaaaaaaatgttcgcgtttagtttgttgccaaatttggtaaataaataaaaaaatcctgtcaaaattttgacaatattgccatattgcctgaattttggcattgaaaaaatttggtaagatttattttggctacaatctgaacagtcttataagatttacgttaaaaattgtatatatacttctcaactggtcatgacagaattgcaatgtgtagaagatgtgagtatttacattattaaatttagaaattgaaggaggtaatggtcacggtaacatatgataaattattttttaaaataatattcttaatcacaaatcaaagatatagatatctgttagtgttatagctatacttcaaaatgtgttaaaaatgtatttgtttttaattattattaaaacatttaggctcattaacacaaacaacatataagcacatctaatagacagagaggttatattcgcacaaacgtgcgactcaacaggctagttgctaatgaatgatccgcaatgagggcgttgaaaaaacatttcatagtgtggaacaaatgcgatgtactacaaatatggcgccccgaactactatgcgtggtttataaatatagggccccaaactactatgcgtggttcctgccgcctgatatacttttatgcacgcgctaattccctccctctctctctcgcggctactccttctcctttcacttatcttttaaacgatttttctattaaaataattttctgatttatgatttaattatatcatttaatctttaccacaagaccttaccaaaaaaaatgaacgttgtttcactccattaagaacattgtttcactccactgcataaatacaacatttaaaactgctaactggagcatcaacaaccaattatatgagacaataagttctaacgagtgaaacaaaaaagacatacgaaaaatatgttatatttgcaaatacttaatgttgttgaagtgtttttatatatgtatgaaacaataagttgtactagttaaaaccttataaaatatttactgaaacattaagaataccatgtgcaacattaaaaattcaattaaatatcaaatatttttcagtggaggataaccatgtg

SEQ ID NO: 76404 - DNA, 1529 bp, Oryza sativa
cgcaggttttgtttttttacagagggagtacgaatcaaaccgcgaatcaggatggatgagcccacagtaacagttctcgtatacccgaaatgatacggcggagtgtgcagttgaatgtcacgtcaacagacagatgcagtgcaatgcaaaagcagagacgacatggatacagtgctgtaatactgtctctcatatgctgcacagtgcactgccactgtaccagtatttcgccgctgctactttttattttgttttatttcttcatgttcaactttgaaattcatagtactatcaatcatctgtttcaaagtatttcatacaaaatttccttgcaatattaaatactccaaatttcatacgccttatttataaatcaaagagagcttaaatggattaaagagggagtcagggagagaatagagacaaagagccaagttatgttggtctttttaatggagaactaaaatgaagttgtatttaggtgacatgaaagtatttttgatgatgtgataaaaaaataataaagtgtcataccagtatttttttatgaaaccatgttaacattgttttcttacaatttatctcttacatgtactacctatgaaacaaaaaaaatgaaacaagaaagaaaagatgacattttcaaaaattttcatattcatattcaagtacctatgaaaaatcattttcatattaaatatcttattacctaacacttttaaaaatatgaaaatgatttctttcactgggctactcatggagcaagaaagaaaagaaaaaaaagaaatttactatgcatacgacctaactatccaactcacgtagaattgaatttgatcaacgtttgtaaacggttgcagtgcatatgacatattcttctttaattgatttatggtttagtacatatctctaattatatatgggttataaaattggatagtacatactataacattactcctacttgagaaaaaaaaatactactccctcctaactaataatacttgtcgtcttagataagagtgatgttaaactttagaatctttgattgtgaatcgtttttaaaatatttatcttttaaatattgtgactacatgtatagattagtcttaaaaatactttagtaaaatcatatatttgttaatattatatattaattataatagaaaataatggttaaagtaattttttaaaaaccgtttcgtttttcaaaccaataccaggtttatttaccaggggaagtgtgggggaagggagaaaagaaggaagccaccgaggggatcccgggcgagatacgccgtcggggaagacaaatcgcgtgccaggtattattatcatattaattaatccccacaccagggcggatctgaaccgtccatccctaacggccacgctgatcctgcggctcacgatcggtcaatgcccgattgcccggtccacgtagcccgtctctcttcgaccgtacggcgcacgcgcactgctgccactgtcactgtctccggatcttctgtggctgctcggcagcagca

SEQ ID NO: 76405 - DNA, 1178 bp, Oryza sativa
agattagtatacattagcaccttcctattgggctttgctggtgtgccttgcatccaaagtgatgccactatctccacaaatgcaggctttaccccatgatcaccaaatatgcttatgggaaaaggaattaaaggagaagattttggccagttgaatgagtttaattgcactgtttattctttcagtgttggaatgaaatgtgaggtcaaaattgttctggtgatgtattcagtagtagaagatttttactctgaaattgaccgttgtcctgaagataaatgactgtgaacagtaaattttttacacttctgtaataactgttgctgacttgctgtacctgtacatcattaacctgtctaaaattttttcaaatctttacacaagcagaacaattgatgctccgtggccgtaaaattgtctctcttgtctgattcctgcaatctttggacattcaatccagatctgaaattcttgctgtttctacacaaacaaggagtatactattatgcagttgccagtggatttcaccatcttaaaattgtttgcatttacatcagcacaatagacagaaacatttctatgctgtactacaaagatgacaagatctagcattgcatcaagaagtatctaggaagaacagaaaacaggaaactgttcttagatcttctcctcatcaggtttcctcactgaagaaacttgcaatgctcatctctgcaaaaggttgatgcatatgcattgaaacagctctccaaaatgctacaagcattatctatattgaccaaagatctgttctttgcatctgtacctcacagaagagattgcttggaacataaaaagagctaagggtgaaataatttccatggaaagtgtcatgctcttgttgcttcagaatggcaggcaagggtggtaaaagctgatgggtgcaagatcctgcatttaagcacctgggtgcagttaatggcattactcatgagattgtgtagatggatgtgaggcagttcaagtgcctctgctgggtttgaaatggcatggcaagcttctggctgacagagtgacagagtgcattcaattggttgtcattgctgcatatactcctctctctacatgcagggtactaggggttgaaaatgtgcaattttttatagactttgagatgatgctaacaaaacagtaacacc

SEQ ID NO: 76406 - DNA, 4172 bp, Oryza sativa
gtgggcccgctgcatccgcgtccaccgcgaaccgcgcgcgtgcaccgtgtccctcccccgcccgagagcatgagccgcgtactccctccgcacggtgagccgagccgctgacaagcgggtcccacccgggaccgcgcatggtgagcccggtccaccggctctctctctcctccctcccgcgcgcgtgcgtcttgggccgctctgggccactttcttgggccggccggcccgttaagctcggccgagccgccctttctctcgggccgcgccctagccgcccgagggaagtctatattccctccctctcccctgttcttttcttttcttttccaaaaaaaagggatttaattaaatccttttcctttagaccaaaaatccaataatcttagaaattcaatatctttccaaccgtaaatccgtttgactccgttcaaattccaaaatttctcaaatctcgagatctatctaatggcacgcttagaggtcattaatagggctttattttcgccgtttgttgagttgtcccgttttgcgtgtagtttcggagcccgaagacccgcagtgcgaggatttcgaggatcaagctccagatctcgagcaaggcaagccacctttgaacatcttgagccatatttgaaatctaattatattgcttgcaaaatattatgcattgataggattgcacttaatctgttgttccgtctgcaaggcagattggcagacctacctaacttgttgcatttgatccttccattgttaattgctataccatgtccccttgtaaccatccagttgcgcctcgatattcgtgcaccctgtgccagtatcgacggtcgccttcaaacttaaaatctgagtaacaacttgggtaaaactggagttttacaaaagacttggaaaacccaacacctgggtcggtgcttgtgaactaaatgaatttccaaaaccgcggaccggggaacgtaccgggtgtacggtttcccgctctcgcacttaaggaccgatttcttggaatttcatccaaacataagacaagtacgaccacatgggtggaatgggacacccctggctgagtaactagcttatcaggggagccttgatgccgagagacatgtggattcgccggggtggtgtcgaggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttatgaaaaaggggttcgatgtttgaaaaatcagcagctgacgggatcagctaggcccgggtggccgtttgtaaagtcgttggcccgggtggccgtttgaaaagctgttggccgggtgccaatcttgtttcaattctaaagactaatacattgcacatactccgaccggacgagatgcactgtctcatccgtgtcgtttgagaagcactcacctagttgtttttagaaaagagttcaaataaaatcaattgcaaaaacagccgcctttccttgaagcctgcattaaacacttatttccctggcttgctgagtactcccgtactcacccttgctctatataaataatcccccccagttgctgaagaagatgaagcggatcctgctgatgaggagttcttccaggagcaagccggctacgatgagttttagggtttcggcctagttcccaagtcgcgcatgtgttgattggtccaaatcctggcttccgtttcccttttgtaatgcagttgtgagctcgggatctgtccgcagcccaacatgactgtacctctactctataataaagagacccctgttgatgtgatattctgtctccctgtgataccagcactgtttcctttgactggtatcgattaacaggttaaattggagcgtcacgggctagttccggtcggtactagttcggggcgtgacaacctccagccgatgtatgctttaaccttcagatcagtgcttattatatattgtttctagccgattggtttctatcggattatattattgttattttattacatcttcatcagccgattgccttcatatcattatctacgttggacatatagccgattgcttaaatcctatcgctatcggctggtattagcatcggctattatcggctatcggctggaactactccatcggcttgtcagccgatcggctgtttggatctactatttgcatatcttgtcagttgcaggatcaaactgtctggccgctcgcatctaatcaagatttggacctgcacaggagctaaacagatctcccaggccggtgtgttctattttctcgtcaacacagattcttggtcccaccgcggctgcgctcctcccctgcacgctccgcggcatctttgtccagatcggcgtgccaactctcagcggcttcttcgcccgcccctcgccgtcggcagggacgaagacgacgaggccacccatccccggcgccctccacctggactacctcgacaccgacgaaatcgaaaaatcccttctcaccataatcgaccactgcaacggcctcatcctgctcgaccaccacgtcgtcaacccagccacccgccaatggacgcgccttctcccttactcgccgccggagtcgtcgccgccgggcagcgaaatcatcctcgacggctatcacgccctcgtctttgaccctcatcgtgtcgccgccgcactaccagttgttcttgatgccctacgtcctcggacgacgagccacggtgttttctccatgtcttcgccaatttgaaagttttcaaatcttgaattgaaagttttaaaattttgtgttgaaagttttcaaatttaagttgaaagtttttaaattttgagttgaaagttttaaattttgacttgaaagttttcaaatttgagttgaaagctttcaaatctggattgaaaattttaaatttgagttgaaagtttttcaaatttgagatgaaatattgaagttttcaaattttaacttcaaaaattcaaatttcgagttgaaagttttccattttgtgttaaaagttttcaaatttgagttgaaagttttcaaatctgcgttgaaagttttcaaatatagggtgaaagttaattttcaaaatttgacttgacgtatatatattttttaacctgttacttaaaaagatcgtgaaaaaattcatccgtgcttgattaagagaaaacacgaaaaaactaactcatgcgagtagaaatatactccaatccattcacacggtagcacacatgccggataatcgttggacacaggcctgggcctcacgtgggacgtggcttgccagaaagtgcgcgccgccagcgcgtatgcgcttagttttctcggaattataatggtatattttaaaacatgaaaatttataatggcatggatcaaattaaccccatctttaaacacagagcagagttagttatgtttgccagctctaacattgatttgcatacatttaggttcttcattgatgtttgtctgtctttcagatcaatgattttttttctttttggaagtggaagcttgttttcagatcaatgaattccaggttacttaattttccttccaattaaccaatggagtacttgactaaccaatggagtacttgaacaatattttaatactttttcccaattaactctgtaaccttgctgaatgatgcaactgccagagtcttcggtttcattttgacatggtctcctgctttgcctctaatattgttcatatcatagcacagtccataattaatgccatagtgaagggactttttaatcctggtatttttaatcgacgtagattagcattaataaaattaaaatatattaaaaatcggtccaggagagcaacgagagacggatcggccttagactcgctggctctgcctccctcgtccgacgacatacgtccacgtatgtatatactactcgtactcgtactagtatagcatat

SEQ ID NO: 76407 - DNA, 20325 bp, Oryza sativa
tatatatatataaaccatgcagcaacagggccatgcaaaaaaaaaaaaggtcagctcgatctttagtcccggttggtgttaccaaccgggactaaagatcgatctttactcccggttatttcacccgggactaaagatagcgatctttagtcccggattggtactcccggtttggaaaccgggactaaaggggggttacgaaccgggactacaaagggtttctccaccagtggtggcggatccaaaaaattaattcgttggtgtcataacgtatctactggtgtcatagtatgctaattatgattagatcatggtgttataatatatgaataagcagtttaactatagattttgccaaaagttgtcggtgctgtctgataccggccgttacactgtagatctgtccctgaatggctcataattaaaaaaataaggtgtgtatttatatatgtaagtgtgcgcacgtggtaagtccctatgttttgcaatgtgtattagaaaaagattaatcattaagattgagtttttttttaaaaaaaaaagtagacaaacaatcaaagatagctagacatatagtcaatccaacccatgttacatcgtctaacttgtatcagttaggatatataagtagtaatacaattctagataggaggtggcttttacattatatttattactccatctgttttatattataagtcgctttgagttttttctagtcaaactttatcaagtttaacttagtttatagcaaaaattagcaatatttaaaacaccaaaatagtttcaaatatagcattgaatatattttaataatatgtttgttttgtgttaaaaatggtattatattttttctataaatttagtcaaacgtaataaattttaactaagaaaaaataaaaacgacttgtaatatgaaagagactacctatacatttgtcgacaaattttgtcgacaaattttctcccaaaaatttgacagatgtaattatagtacaatcgtagtgtaattacactgtaacttatatgtaatcactgtaacttgcatgtaactacagtgtaacttatatgtaagtttcacataattttgaatcgttagatctattacaagatttgttttggtgagaaagaaaacaaatcacagcacacacatatgtgaaagaatttgttcccacgacctccattttaccgaaataacatgttacggagagatttttgaaagttacatacaagttacactatagttacagtgtaattacatgcaagttacagtgtaattacactacgattgtactgtaattacatctgtcaaattttgggggaaaaatttgtcgacaaatatatagcaaaatcgatatgaaacaggggagtagtcatcttgctcaatgaccccggcccacctctagagatatgagccgaattttggccctacccacacagctgatacctgtgggcctcatactaggccgcacaaatgcaattgggcctcatattggcccacccacacagatgatacctgtgggcctgctactagatcgcacaaatgcaattgggcctcatattggcccactccacatcgtactggcaacatatcccgttccgaaattttcgggatagcgagctccctaatcatgcccagataattggtactattaatcatgctgagacaatcatatttttactggcaaagattatatatatactactatcaatcaagctagctccggaaaaaccaaggagtaaaagggaattcgatggaattttattcatccaaattatcgaagagagatcatcgagtgcatgcgttgccatgtcaattattgtactagtagtgatcgatcaaggcacacgaaattaattaagccgataagcttaattaattaattaagcagaggcgatctcgtcgtcctcgtcaccggccgtcacgccgctcgtcggcgggcagaagtcgacgcggtagttggtgccagcggggcaggtgaaggtgctggtctggtcgtccttggcgtagctgtaggcgtcggggcagagccccttgaagaacatggagtagctcgtcggcgggcacacgtgctcgaaccgtccccggcagcagtaggtgtcgccgccgaacttgccgcacgcgctggcgcagccgccggggacacggagctcggggaggcacctcgccgtgatgtccacggcgcagctcggcccgcgccccttgctgcaccgggcgccaccgccgttcgccggctggaagctcaccggcacgttgaacccgtcgatgagcgacaggtcgaggaagtcgtcgccgccggcgccggggcggccgagcgtgtactcggccagcgtggtgggcggctcgccggagacggcgcaggacagcgcgccggcgcagtcgcccgtggcgcagcggccgcggccggcgccgtcgaaggagcagccggtgcgcggccagatcctggcggccggtgtgccggcggcgacgctgatcgaccacgactgccccgggtcgagccgggcgccgccgcccgggagcgcgcccggccacaccgtgtacgagcagcggttcaccatggtgatggtcgccgcgtcgacggcggcggcggcggcggcgagcagcagcagcgacacgagagcgatgtcgatacgtcgtcgacgcgagatggagggctccattattgttgtgactagcttgaatttgattgatgctgtagtacagtcaatgcctttgcaagtactacaatttgtgtttaaatttatagaagacatgagatgcatcactgacacgtgtgatagatattgcgtgtgaaatttataggtactccctccgttttatattatgaggtactttggcatttttcctaatcaaatttcattatattgaccatgtttaaaaaaaagttatagcaatatcaaattaattttattaaatatagcattgaatatattttcacaatatgtttattttgggttaaaaatgttgttgttattttttataaatttaatgtagccttaaattttaattagaaaaaaattaaaacaactcatcatatggaatagagggagtagttaacttgtggtgtcagtgcatacatgtaaataaattgggaaatctggctggaaaatatagatctaacctgccggcttgagcttgaatgggtcagaagtgatcgatcggtcgacgataacgtacgtggcgcacacagacagagcgccaggccgccagctgatgccatcacttcactgttagttgcatcttcctgtgcaagcacagtttatgatttttatacttcgtgcgcatgcttatgcgcgggaccgtccaatcagtaagggtgaaatcggagcggattcggacggacagtagtcatattatatcctaaactatattttttaagcgggtttggtgcgggtgtggatagtataaggatatggatgtggagcggattgttttggatgtcggaaatggtgcggagtcactgtggaatcggttcggaaacggattaaatttatcggatgttacatgtatatacaatcaatgcaatatcgagttagcaatataaggaacaataatacaataatcaataaatgacccattgtaataattatatgattaagtactacaacatgaatacatgatgtccataatataaaaaatatagctatgtgagtgtgacatgagatggtaaaagccttagaccaaaaaaatctatgttaattgatgaattaaggcattgtatgtaccaacttatgttatatgcaatagatagagtggttatatatgttgataatttcggattatccggcaaacggtttatcggataatctgacaaaaatgtcggataatccgcatccgccggattttagagatatcatatccgcatccacatcatactatccgcatccgcagcccataccatatcggatcggatattatctgatccgttttcacccctaccaatcagtcttgcggagatgctgatctgctgctgtgaaaagagaatgcctattcatgtgttggagccaacacatattataattcactgcaccctccgtcaaaaaaactaatctactattgaatttgacacatcatagtactataaatctggacatacatatatccagatcatcatactagaatatgtcgcatgctgtcttagatttttttttatgggacgtagggtgtagttctttctttgtcccaatttaattgtagtcgtgggtttccgcgtccaacgtttgaccgtccgtcttatttaaaaaatttaccaaaaaaaataaaaaagattagtcacacataaaatactatttgtattttattatttaataacaaaaaaaattaatcataaaattttttcaaataagacggacggtcaagttgaacattaacggtgcaaaactactcttttcgggacgaagatagtattaatttttttatggaacattattcttttttagaatatatggaacattactcgatgatttatattttttaaaactatgtgcattattttttaaaatctgtttgaaccattgtactgtacttaaagtatatgatgaaatgagtttaatattaaatttattcaaacatttaaaagtattttactcgaataataagtttgttatagaatacaatggttcaaacggatcttaaaaataatatatatacgtacaatttaaaaagatataagtccttaatggttaatttataggagtgttaattgtagtcaagaatatatagattgatgcatgaatcaatggattgactagctagctgttaaacaatattattgtgtaatgcttgtactggttgcgtgtggaaactagatcgatatcttatatagttgtacaaattccacaccatcagttgacaaactgatgatccagctcatcttatctatatatatatataaatccgtcagctgtgatcgaagttaatctgaattatttcgatgccattgccggtcggactaatgactgacggagtgcaccagtaacatgttgagtgatgtaggacggacacagcagcggcatatactccctatctcccataaaaaatcaatctagcagtgttacacattgtaatgctacgaatctaaacatatatctgtccagatttattgtattagaataagtcacattcaatcctagttttgtttttcgtgggaggagtatatatatatatatatatatatatatatatatatatatatatatgtttttccttcaaaagtagtagcgccgattttgggtaagtgggtcacccccatcgtcgaattggcctaactctttttgtaggtaccaagagtcgacaggtagtcctaaatccctatcccttttggcgcgagctaattcctttacgtctttataaagataattgttccagcaatatgtagtctttgcattgaatttgaatatatggaagcggcgaaccatctcagcatcatcatacttcctcttgtatgacttgcaatagcgctcaaataaggcccacacggcttcgtccgactcaaggtcctcttttgtcacgcactttccatcatctatatatcgcaaacaaatcaatatatttttgcaaacattgcattacattacatctaaaaagtggtcaataattaaaacagcgaattgtactatcaaatactagcatgcaattaaattcattcaattgttacatgctattcgatcgtacttttttttttcatgcaacaactgaatgaatttacttaataatactagaccatagatatatagtttgtttatgtaaatgtaaatgaatttaatacaaatcaattgaatgaaaaaaaaaaagactatatatagtttgttttgaagcaaattaggccctttttgattcagcttaggattattataatctaaattattagaagtaagctgaaacaaacaagtagattattatgctaggttattataatctataaaccagattactataatccaataatctcctctagaggagctttttccagattattaagtggctaaagacccactacccttagatgcctttaataatccagagaaacaaacaactcgtagattattttacgattattttgtgtcagcttattataatccagcctagagtaatctgatttaataatctaggttataataatcttaagttgaaataaataggtccttaattagggtgggattaggtaggtttacctgggggctcggtgctgtagcggaaagagaggcgatgagagttgtcagggggcttggagaggtcggcgatgcggcggcgtcgagacgcggcggcggaggcagcggccgcgcgcgctgagcgggcgacacgagacgcggctaagctggcggcgcgagatgatgccccctcgtcgtcacggcgcgccgccgccgccgcagcagctaagcgtgcgacgcgggacgcgccgtgggcggcccgcacgagcctcgacgccattgttgtcatggcgatcgatcgatcgagagaaggatgggtgacacggctggtcgccggcgaggaggacgacgacgtacggtgttctatcgtgtcgtgtggccttggtggcgagagatcaatcatcatcaggcttaatttgggtgactacatatatggttacttggagttatgaatttcgatgaataaaatcgaatggatttcaaaattgagatataatttggaaatattagtttgcattccttaattaattaattaagtcatcagtacattgacccggccggcccatgtatgaaagaggatgagagagagttgacagcccaaagaaggtaggtcgatgggcccatcagatagagcaagcccagttataacaaaattcttctcacctgaaaaagcgcaaaaggcaaagctaccattcggactctcctcctcctagctccgtccggccggtgagcttcacattgaccacttgctcctccatctaccatcgatcgatcaagctaccatttgttagatgcagcagcccatctaccatctcactttatccatcccatttccttatatatatacgcacgcacgcacattcatcgatcgatccgtcgatcggtgagtgactcacaggcacagctcgatcgatcgatcgatcaccatggccgcctccgccactcgcagtagtaagctcctcgcgttgtggctgtgctgcgcgctgccgctcatcatgtcctccaccgccgccggcaccaccactgccacgacgccggcggtccagcagcagcctcagcctacggcggcggcaggcgccggcgaaggccagtctccctcatcaactgcctaattaatctcgatcgatcatgatcagtaacacgcagtaaatcgagagcttcacttgcaggtgtcgtgccagctccgacgacctcgacggcggcgtcgaacgtggcagctgccgatacgacttccaagaagataccagtggaaggagcagggccgcacgaggagtacgtgccggcggcggaggtggcgtcggcgctgccggtgccgatccccgacgggaaccccgtggagggcgccttcaccaacggcggcctcggcggcaaccaggccttcttccccggctccagcggctacggcacggcggcgggcctcggcgccggcggcttcggcccgtacggcggctacggcggcggcccagggacgtacggctacaacggcccattgtacttcggctccgcgccgacgagaaccggctcgccggccggatcttgcgccgccgccgccgtgttgctccttctctccgccgcggccatgtatatttgagataataattagttaattactcggttataaatcctaattaattaagctagtatgcgggagcagtaaatttacactcatgttaatgttaattacctaagtaatactcctatatatgattaatgatttgtatatgttaatggtgattatttttcgaggggatagacagtgagttcctgcaattcaatgtagagaaagagagttgatccagttaataagaaaaaccaaaatcaaaaaccttataacaacacggttaattaatgaaaaaccggtgaaaactccgacattgataagaacaacagtccaacaagggaaaaaactcctaaaacgaagccttccagaagggtacaccgacagaacagcgacatcgtctaatcctaacgaatttaaggttttcactcggagaatccccttgaagtggcgctgaacgagggctccaatagcaacgccttcaaaaaggtaaacggcgtccgagggtgtcgctgttgctagcaccggaagtggagcaaggcttactgttaatggtgatggtacgagtaataattaattactccagattgattcttaatttatagtagtagctatcaacagtgatgttcctctttaactagcttaaaattaagatcaacagctaggtaggagtaggacactcttcatgagtgacacaactcgactaatgcaggcaggccatatcctacaaacactccctacatatcccttaatttgtccttctttgagagagagtaacacatgaaggtcatggtgtggtgaaagcttcatcttaacttgcattgcatttctccaagcaagtatatagggagtttgttgagggatctaacaggctttatatgttgcaatctgcatattctgttgcatcagacctgagagtcgcgccgatacgtttcccgatgtctttcatgccgattgattagtactcctacatactacctccgttttttaatagatgacgccgttgactttttctcacatgtttgaccattcgtcttatttaaaaattttatgcaaatatataagatatataaatcacacttaaagtatcatgagtgataaaacaactcaacaaaataaattataattacgtaaattttttgaataagacgaatggtcaaacatgtgagaaaaagtcaatgacgtcatctattaaaaaacggagagagtacgtaataagaggtgacaaattatgtacactatcaggtgcatatatatattgggcatattaattgctctaggtgatcagtagcattggaggaaggaggaaatgaaacacactacttactatgtcagtgtttgtatatcttatatatatatagtatattgggaatttgggataaagggttcataacacacatatatatcctcatcaaactatcacattcatatatctttctgataggtaggtaagataatactcggtctataacaacataatgtgggagaattggatgatgccaattgaatattgaattgtggttctaccactatcagatgaagtgaattgcctcgttcaagtatttattagcattgtaaaagaaaaagaagaggaaggtgaaattcatactagtaccaggcaactccaattcagtgttgaagttgtcaagaccagcttcttgctcaacagttttggtatggccatgtatgtgccacccaatccatcccatccatgagaccatgacggcctttgcagagtgaaattcagctctggctgttttgctgttttcaggtgtttagtgtagctttggggaatgatcttgaggtgcttgtaggatggtgctttcagtgagaacttttcttagatggatgtatatctcttctttatcaatgaaatgagacagaacttctgcctttgttttttttttaaaaaactctggctgttaggctggagggaatgagggaaagacacaggtaagacagtacaatcaccaaaaaagttaaaggcacaagacaatagaatgattgagtaaattgtacgcaaaatcgacttttacctgcttggaacaactatgcacggcatgccagtgcgctcaacaacaaactcataaaaagctatcatctgctccacatttctcttggaaggaagtactgttacagtgttactcaacttttctttctttttgttttttggagaaagagaggtgatcctttcccatttcattaaagaaatgaaagcagttctaaccgacgttttgtttcaaacttgcatctttgctaccagcgtacattactgaacccgactgaaaaaagccaaaaacaaaagagagagagagagagagagagagagagagaagaaaataacagggcaccaaacatgtgctacaccgattatcagacaagagacgcaaaagacaggcagtagttacttaactaggtctgatggtctgatactaattggcaacatcactcaccaagacatgccaagcactcaactaggaattaaacaggaggcaaagggatgatactcaaccgagttgtcttcatcaagttgagagcatgtgatgcgctgttattcacaagttccgggtgtcttccatgtctacagagagctagaacttcagtatactgtagatgtttgtcggacaatgtggtgatcattgtgacagaaaaagcagcatgtccagtataccgaatctccatattgcggaacaaaattaagcttatgggagtgaagcttcagcttcatattctgtttttgttcgtgaggatggatttctggacgggtctcttgtgctttatgtgctttgatctgcatatttggttgcaacatctgaagattatgttctcataatattcccgatggcttccatgcctattcaaagttggccatatatatataggacatgagttggagaaaaggtgacaaggtagatatatgatttgatcatcaaatgcatcaagcatagtgctctcagtgatcagcagagtgagcagcaaatgaagcaatactgtaatgatttcttttatgatcttcaggaaatacacttggatatatactgggagaagaattcagagactcaaaacatatataaggtgggtgaattggacattgccagttgaattgaattgtacaccacacgagttatggaatctaccacgtactgacagatgaactgaattgcctcattcaagtagaacagctgacttgtgaaaaaaaaaaagggaatgatgaaatcaagcaccatggtatttctgcaatgttaatgtacctagcaagttattgaatcaggtgtttgagattttaaaactcagacggaaaaaaaacacttcatgttattactcccacataagctgagaaaccaaaccaaaccagaaaataggatgagctgccttgtccaattacagcgagttcagtacattttttttgttacaaattcatataggagtatattagtaccagccaacccgagtgcaggtccaaattcttaaagaccgtctaatccatggctatgagagtacaaaaaaattgatagggctgcaggtaatcatttttttttaataatggattcaaccggcctcaacatccaaatgggatgtgcacagccaagggttgcaggtaattaatcatggtgactatgtttgctaagcttctccctaagctatccctgattacttgtatggattttctggagggatctcatgggctttatatgttcgatctgtacattgtgtatttgtgttgctgcaactgtctgatctgcaattctgcatctataagcttcccaatgccttccatgcttatccatagtagtagatccaattaattaggacatgaactgaagaagaggtgagaaactatcaaacacatatatccaacgcagattaattgctctaggtgatgagcagcattggaggaagaaggaaatgaagcaccgttgactttttaagtacgagtttgaccatttgtcttattaaaaaaatataagtaattatttattcttttcatatcatttgattcattgttaaatatgtacacatatagttttacatatttcacaaatctatctaatctaattatatactaaaagtccattaaacttcctacaaacgctcctaaaccgccacgtgcccccctacaaacgctcctacgccgccacgtggcactctaataaattagaagaattaagcaaagcatctagccgttggttttcatttaatctggtggacccactatttttaaacgttagatatagcataaaaaaatatcaattagatttattattatctttaaaaatccacacatgccctgtacgtgtacgtgcatgtacgttacatattttgtacgtgggccctactcccccttttcttttttctttttcactaacacatgagaaaaaacaaaattcatattccagcccatatggttcggagtatgtacttgcatgtagggcctcacgtccccacttttcttgtctttttcttttttttcactcacatgagataaaaaccacgttaataatttcaacccatagttgtacaaatataagttattttgagttgtattgtactatacgcacgtcatcgaaatattcataaaatatctaaataaatgaataatatacattatataatctatctatctattatatactaaaagtccattaaactttctataaacactctcaaaccatcatgtggcgctctgatatattagagaaaatcataaaaattctaagaaaaaagaaaaacatctaccccttgattttacacttaaattggtgggtcctatattacacaccgttagatgaaattgattttaaaacaaaccaagtactatagggtcccacctctcctccttctcccgcacatgtgtgggtatacgtatgtaccatggtatgtatgcttccttcccttctttttttccttttttcttattttccccatttatataatagatatatatatatatatatatttaaataatcataatttcaccaacaaagaatgctcacaggtaactaaattagctctacaatttttgaaaataaaatttacaccattatatgttaccattaaattaataatattatatattttctacataaacatgtgtactcattattttgtactattattttcacataatgcactattttaaaataaagtttacacaattatattgtgtacctatcaaataaataattttagatctatattaactgatttatatgtgcacttaaactgatggacccattatttaaatcatcggaactatttttttttacattggactattattctcaaataatgcactaaagtctacatcattatattgtgtacccattaaattaaaaatttaaaatctataataactaatgtacacttataaagaaccggtggactcatcatttaaatcatctgatatattatttgctaataaataaagcgtccgaagttctctttttggcccgctacacaatgcacgtctgcacctttaccttttgcacgcgtgacaaagcatcgtgtctgaggcatctaaggtgatcatgactgccgcagcactaacgttttgccacatataaattcatacatagagaagattaatttattaataacatgaaaagaaaattagaggtgtgatgcagcaagagcagaattaagcaatatgggttgtgttttttctaacacttagctctatttaagttaaaatcgagagttaattacagaataattataatgtattgtgttatgtcgtgtttggattttgtactatttgtagctctatttaagttggaatcgagagttaattacataataattataatgtattgtgttatgtcatatttggattttgtactatttgttggtataggtaaaagaaatcattatgttataatatgagcacaatattaacgaatatcaatagaactcttacaaagacaagagtgctataaggaagtttaagaccctctttttttccttgattctatagttggattttcgtttgcacgctttccaagtttctaaacggtgtcatttttaaacaacattttaactttctagaagtcaattcattcatgtataccctcaaatagctatcacataaatcagataattcatcaatttcagctgtcctaaaccctaagtagtatatatttttttcatgcgagtcatggtgatcattaaattagggatcaacggataatcaaagtcgtaagatgaatatgtacaaactactatcaacaactgtaaattggtgtcaaaattaattgctactaattagacatctaatggcttgctagccacataattaatttctctcgacatgtatataaacatgcacgaagctagaacaaatattaccatatgccccatacatatatattaagcggttaatattctaattacatgtgttaagtcctttaaaatttcttaaagtgctctcaagctgtcacgtggtgctctaataaattagaggaaatattagaaattctatggaaagaaaagcaaagtatccattacttgattttcggttaaatcggtacgcccaatattataaaccgttatattaaattgatcttagagcaaactaaatactgcaaggtcccacctctcatcccctggcataggtacgcacctacgtacgtgggtacgtacgctttccatcccttttttcatttttccctttctttttctttctatgcatacactcccctcccccctttcctactatatcatgcgcttcatgagacaatttatcacaagaattttgagtatcttgctctcgtatttttcatttgtggccatacaacacggtatgtatatgaatggcctgtatgatatttaactagcaatagtttattatttactcgagaaaaaaatgattcaaaagtcgtaagtacttaattcatctcctactcaaagtttgtgaatggttttttaagatacattaagaaaaatagaacccttaaataatcataaaatgacattatccgagctttagtttgcccttaatctatgagacaaaatttttgaacaacaataatcttatctttcaataatataagtgcccgcgcatgcgcgcgggccaccttcctagtttttttaataagacgaacggtcaaacatgtggtaaaaagtcaacggtgtcaaacattttgaaacggagagagtatatgatagggactcaatctgatgacataatgtgggtgaattcaattgtgccaattgaattgaattgtgtgctataccactaccactatcagatgaactgagtacaatggcatgtggcctagcgaaaaaaatgttaaacagcatatacttgtcatggctttctgcagtgtaacaagttttttttttttttgagttgatgcaagttatggaataaaatgtgacagattttatgtagacactgatgaaatccaccatcttattactcacggtagggacaaggtttgaaatttcgttttgcgtatttacccagggaaatttcgaatgaaatttgtattaatgtgaataaattttgactgaatttgaccaaaatttgactattcaaaagaattgaaaatttctgttgaaaaagttcatgccaaaggggtccgaaattactgaaatatagaaattttgaaccgaaatttcaaacattgggtagaggacgcaaacccaacttgtgaaggagttcaattgccgcgatgaactatatcgagttcagtactttttttttgttccaaaaaaactctgcccgaaacagcttatgcaatctcattgctggcctagcttcttggatgattctctcaatcaccaccggcacttgcgacaacacgttctcaaagaagtgagaactgtattcccggcctccatgggtgccgcaccacgaagattaccgtggagtagaatctatggtgttataagttctgatatgcatattttattctgagagaagttcacccaaggcacctataagcttcctcatgccttccatacccattcgtagtagaggcgtagaaccggacgtgaactgaagaagaggtgatgatttatcagatgaatcgattcagaagatttctctagcctctaggtgatcagtagcgttggagggaggaggaaatgaagcacactatacatataggggtttctttctgatcttgaggaattacatttcaatatatatatattgggataaaggacctagaacaatagataaggtaagataattgatatgactcaatctgacaacataatgtgggtgaattggatggtactcccagctgaattgaattgaactgaactgtgtggttctatcactatcagatgaactgtactgcatgctccattttgagaagaactcagttagctctgaaatacaatttgtttcaacaagagttcactaggtcttaagggtacatcacatgtcatgcattcactaatccaagaaacagaggaacaaagatcactgatcgattattttcagagtacatgcctgtttctctctttgcaattgatggggttcaagcatcctaccgaggcatcccgcgtggttgttgatatatgcaagaaactgaataacaccgaggcatcctgaaaattagcagctacttgattcagacgagaaaactaatctatgggaaaagtcacaacagataagtaccatcaaatagcagctacttgatttttttagataatgaaaatggattacatccccggcttctgtcataagacacacagccacagaaaacttttatggtacaatgaactgctagtatatactgcaagtatatatgatctaacggtgtatattgatttgatattttagttaattagattgcaatataaaatttgaaagggtaattttgtcttttctttcgttattctatcatcaaatcgtgctatcgtcacgtgctttgtcatcaaatggcgatcaggatgctcctcccctagtgcacgataagatctaggaccgggtactcccaattagattcaatctgaatcaaaaattactaaagtattattttattttctatcaaattcctaatatgcccttctatatactgccagtatatactggtagtatattgtaccgtaaaagttctctatagtaataaaaaggtaaggtaaaagtaaatcaaaatgagaaataaagtgatgggacaaatcctcaattcccctttattattgactagcgttaaaccacataaaatttttttagctagcaattctaatggaactacgccaccaatagtggaataagagacccttagctaccgattccaagagtatagcactattgcgcatagtatcctgctcctcctgtgatagcatgatcgtataccaaaagtggagccagtaggaagacacgaagataaagcagctacttgaatcaaacgagaaaactgatccatgggaaaagtcacaacagatgagtgtcatcaagtgcagagcatgtcatcctctagaagatgagactaggatgtgattgtcaacttccagatgccttccatgcctagctacagcaacaactagcaatggcgattgtatttacacatgcagtgattttgcatatgagaaaggtttcgaagcagaatgagcattgctgggagcagctacactgttctacttgtatactccagtatatttcttgtatgcaatgcatatgcctgaagcaggggagatgtgtgtcagacaatatgctgacaatgatgatagagtaaattttgttaaggttagcaagggcattctagttattttcatgtttattgtgcacatttatatgctcctttgagcaagcctatctcaatgtatagagttttatccccaaatttcccttcttctcagcatcttgacaaagttaataagcagcttggcaggaggagcatgctgaactatgattgatggtatagtacttgatactgggggagttaaggatttgaatactattccatttattattactatgaaccattaggggaggacatgccctgttagaaactaaacacaaggtggttttatttgtactggaaaagtggaccatattcagaaattaatgatgattgatgatgcaagatactactagtatatgtttaacaatcagggtcagggaagaaaacatggaagaatgcccactcaacttcaattgatgccaaacaaaatatatgcaaatacacatacgattaatcagatgtaattaatcattgatgattagaacaacaaaccagtaacaagctagccagccatcatctactccacatttccctgcgagagaagtactaactacctagctctgatactaatcgacggagactcgctgggacatgccaagcactcacctttcaagtacacaggaaacagagtgttgatgatcagacggcgcctgtttccatcacaagtagtttgagttcatgtggtgattaactatagatagccaacaaaacgatgacgtttacaaggaagcactggatgccatgggaaaagaaaccaatgacgaattttatgaagtgcgaagaatgtcatcgtctaagtcaaaatgtgttgatgatattaccaagttcaggattcctttcatgcctacagagagctagagctagagcttgggtgtaatggagattgcatgtcacacaacacaatgtggtgatcatgatgatatagcaaaatcaacttcactagttcaggacttcagatcagaaccttggcagcaggagctaagctagcatgcatatatgatggtagtactataggagtaaaagaatttggatcctcttccatttattaccattagccattaggagtaaaataggagtactaccattttctacatgacttggcagtgtgaaaaaatattgcaggcataccatcttgtagtttcagctttacattgcaatttattttgcaagtatggattttctggagggatctaatgggttttataggttttattctgcatattctgtagctctagatctgtgcctcgcacctaaaaatttccagatgccttccatgcctattcgtagtagtgtagagccaaggatgtgaactgaagaagaggtgaacaatcatatatcgagcagattgatcaatagcattggaaggaggaatgaagcaaaatatagtgtggtttctttctgaacttgacgaattacacttcagtgtatgtatatattgggataaaggactcatatcatatatcttcactataatggagacaaattatcatatgcatatatctttctaacaggtaggtaagatatatggtacgactcaatctgacaacataatgtgggtgaattggatgatgacaattgaattgaattgtatgattctaccactatcagatgaaatgaattgccttgttcaagtattttatcaagctgtaaaaaaataagaggaagatgaaattaaacagcatgggcttgtcatggctttctgccgttagggaatcagatgtgcgagattttgaaatgctgatgaaaaatcaccatcttattactcacttttatgcaaagaccaaaccagacaatgagttcaattgcctcgtccaagtacagcgagttcagtacattttctgttcccaaaaaaaaaatgatgcctgaagtagcttgtgcttctcatagttttctttctgcaatgtactacatagaggcctcattttggttgtaacatatacccaatccatgggttacatacaaattcaaactagtagcaggcaactccaatgtagtgccgagttgtcaagaccacttcttgctcaatagtttcgatatggtcaagtcagtaccaccaaatccatccatgacggccttcgcagagtgaaactcagctctggcggttaggctgggaaggacaggcacaggtaagataaacacaagcaccaaaaaattggggcctaaggcagtggaatgatgactaaattgtatgtgaaatcgacttttacctgcttctaacaactatgcatggcataccaatgcgctcagctgcaagaacgccagattggctacctgcgacaagaacacagttttgcacgtcccgtccaacatactcggatccagcgcgtagagtgacaataatcttctcggagctgatgatgcaaagtaaacagtgtgaagttcagatatatttctcatcaaagtacaaaacctatgaataagcaaacaataataaccttttagacgctgcattgatatcaacactaagtttcagaatggacgcaacttcttctgctatcctctgcttttctgcagaagctgtaacacagcacgcaggggaaaatttttaacattacagacacttaaaatacatgagcaaggcttcaattgttgcagtcagtaataaatactaaccagccttttgtgcttccttaactagctgttcatccaaactggaggctactccttcaccaagaacaagttgtccatataagcttctttcaacctcttctttcccaacaatatgtatttttgatgttctctcttggcctaatttttcaatgatatatctgcactcaaaggtagaaggcacataatatactaaaactgtcgcatgtcattcaggtccagattatcttgacagtgtcatgcatgtcccaaagtgcaaagtttcatttctatttattttgagaagaaccacagagttgactggaaaaaaaa

SEQ ID NO: 76408 - DNA, 2410 bp, Oryza sativa
aatgacaaaagcccttgtatggcaactgctgaactcccagaagaccatccaggttcaaataaagttgagaatagtgtaagtgggaagcaggccgcatcgaatgcctcagtgaaaatcttgccactgagattgtcaccagctatgtccaagaaggctttaaacgctgatagatggaactgtacctcttggtgagtgctgcagtttgctttgtaacactctgtatcttcagaacaacgatgcagatgaatgcactgcaatgcccattctataaacttctgcactttggcacctgcctcaatttgtaaacgttcaccaccaggacaatcttgtagacgatcatgtaatctaaatttgaaaaccaaaagaactaacatcaacaatgatggtaaacagaatatcgtggaagaaacagtatgcaatttgtggttacctctgagctatgatttccttgctatcacctaaagtaagcgccttgctttggcaggcaacgacacaagatgcgagcaatgaagtcctgaggattgccctggcaaaatccttcgcccctgattctacaatcttacctatcagatggttgagaccttgaagatcctgctccgtccgcaagaaccaaatggcatcaagagcaacggacaaaccataatccagcattaactgatggtctgctagagcaacaaggctttcagcgagaccccactgccgcgagaacaaaaccaactgcagcgaatgcccaaaatcaatctgtccatgctcatctatcctctggtttggcatgcaaccatttgattcttcaacagggccattgccatgaacatggctggcactgcattcctggtcatccttgagcacaaggctagcctggccatgctctgcacagtgtgccggagtgccatggcagctaagttcatcagcttctacttcagtgaacactgcattgtccaaaggcatcacctttgcagggatagctagttgcttgccatgctctaccattttctaatttgcttctccaatcaaaccattatattatgtcctagcaagaatattcggatactccctaaagatcaagcagaaaaacaccgatttaacaaccaatctattagcttgaagaatcacttaatccaagatgctaaacagggggacaaaaggatccaaaatttagcgtttactgcacatcacatataaccataaaactaataaacttctagtggaggctggaaatacgaacaaaaagatttcaaggattagagctacagataaatcaaaatccgattgacaagcaatttgtggggggtcaccatatgagatcaaatgttgcatttggtatttggtaagatcatcagaccacacggataccgacgaagcaacagccaaccaagagatgatatccccacaggtacgaaaacttgaaaatttgtatttccagaagagttttaataagaaaacaaactcgaaagaccaactctcaactaggaacccaacctttttaactcagaaaatttcggattcctactcggcctttacaaggggctcttatgaattcaagcaataaataaatatctacctccagatcgaatttcctaataatctcaatatgtggaaactaaattcaatctaaaattcctttaaaagtagaagctcaacctaacaaccctcttaagattttcagatgattaacaagaataaaaaaactcaggactatgcactattggatggatcaagacccttcacctgggcgttccaaaaccgcgcctcaccgcgctcgccgccatcgagacgacgggcggaggcgccggtgccggcgcgacccggggaatcggcggccgggcaggaccgcgggtgaagtggaatcccgggccgccgccgccgccgccgccgcgtggaatcggggaaaggatttggctcggattttgggggagaaacggaggaggagggggaggagggttgggtgggtgcgccgcacgtgcggcgagcggaggaagaagaagacgacgcacgcgagggagaggggggaggggagacgagacgatctccaattctgcagcgagagagagagagagagagatcggacggccctggtcgatttccacgggaatcggacggcggcggtggccaagtgggttgcggagacgcggcagtacattcggatgcgatcgtttctttctgagatgcttatacccaactactacgtccgtcctaaaataaataagtgtagccgtgaatatccgtgtccaacgtttgactgttcatcttatttaaaaaaattatgaatttttttttaaaaaattagtcacacataaagtattattcatgttttattatcatctaataacaacaaaaatactaatcataaaaaaatttcaaatagacgaaacaatcaaatgttggatatgaacagtataaaactacactt

SEQ ID NO: 76409 - DNA, 5610 bp, Oryza sativa
atattggcctcaatagttcatgtagtacaatgtttatgagttgtttccaagttaatagtcattttagataggtattatcatttataatagatcgtggaataacatacatgcataagcaaaatcatttacaaacaacatgaaaactaatgtggaaattgacatacttatcataattcccaccgaaagaaagaaaaaacaactagcaaaaatgttagtattggcattgtcatcaatatgcttagattagtcttgcagtcccttgctgaactgactttgttggtgggcttgtcatttgaacttcaccaacattcgattcgtcaaccggtgagtcaccaacattttgtgttcttgctgctcttgcattacgccttctagcattttgagcccaattggcaagtccttcgaccacattctcatcaaatattacttttttgaatgaagttcccatcttcaagttggacaaaagaaattagtaccataaaacattaagaaaaatagctagataagtatcgtgtaaaggatatgatgtcattaatatgtgagaagatcacaatttgaaaaggacaatttatatcattgatatagtttattaatgtttcattaccagctttcatgtccatcaagagaaatagtttactttctaggaaaattagttttaacatttaatctactaattgaagaatctaatcatattatcaaaatatgtttcttaaaaaactcacatgagagacaatagcgtagagagggagggtgctatagccgcatagaagttgactgatgacactgaaagcatagaaacaattgtgagttttccaactgaaaaaaaatgattttcctagaacaaaatctaaatatggcaataagtttcatctatacccacaatatgccactctttgtgaggatggcatgtgggcattagcccacctattgataggatatcgatggcatattgtaaacatcaatgaaactaaatgttgtacatcttactaggatagttatttttttttcttaccttatgaccaatcgagcaataacatatcctttatttcccataatgcatgatttgaatccatatgtaacctgaatgtgttgacagatttttagatttcatctcacctcacctcacacacttgataaaaaaaagatagtaggctaaataaacgtaggattcacaaattttataaatttgaatcaaatataaagtatcatgtgatagttttcaaatagctaaaatttgaaattttgaacgagtggaattttgtgcaaattgtattagacatgtaattagcttgcgtactatgctattaatcatgtaaatgtttactattatttaataaaaatagttaatatttttacaagctagcaatggacatctaaggatatgttttatgcatggaattcatttgccaggatatttccctaaaactttgagtcattttatgttgttcttaccagaagccaaaagaaaaatgcaatttcaaatgcattttggaacaagacaatgtggatcaacaagaggactatttttggtcggtggaaccaaaatagctcatctgatggggatactacgagctccccttcaatcgctgtatgtttttcagcaacctgatgggctagctcagtaataatgtgctccaatttagtcccaaccacaagtagcatctgaaaaaaaaacaaatctaatgtttatttttactaaaacaatcctgctttgtaaacatggaaaatcatatgtatgcctataatcaatatttctactaaacataggtagcaacataattcgtaggaatgcttgcatttaatctagggataacataaatgttaatgtgcggatgaattgttataataaatgttgtacttacaacaaatgggactgccgatatccagatatagacataccatcctagacatatccatatgtaacaaaagaatattgtcagttttttcacatagtacaaatatttaaagcataaaagaattgagcaaattacataaagaagcttgactagtgttttacacaaatgtaaaagatcaatggtttgagccatgatagaacaaaagaagatgcccgagtttgaaaagttttgtgtagaaaccacaccttgaacattaagcagcaagaatattatcaacatagcccaaaggtaccaactgcatttaattagcatatatgttaattagtttctacataaaattctatcgaaggattataaataactagtacttgtgtgcaacctaaatctttatccattagttacttacctaatgcctacaactttcttgaaatcatcctccagtgctctaatcatgtatttgtaaaagttgaatttaggattgcccctgcaatgtttctgttatataaaaaaaaattactgatgtaagacaatatgcctaaagaaacaaattagatatcccacttttcaaacgtaaaagttcgaattaccataatgaagccaagccgcatggttacatagtcctcctcagtaaccgacccatagaattgttttaagaacgagcgctatatgatggaaaataaattagtttgttctctatcacaattcacacaataatacatatcaaactatttctaaaaatctacttctaagtttttaatattgtttttgtgaattgtatgttagtgattcatacaccaaaaatttgtattgtatactaagttgtccattaattagtattggcattttaaaaaaaaatcttaccagccaaccaaatgttttccaccttttgccgtgtcctttaaaatgatttttgataaatgggaattcttgcacatgtttgatcatttggggacctgaaagtttcattccaataatccatctgtaagcaaatggtaatggatcgatctttacttgcccaatggagaatgttctttcatcataccattttcatcacttgcttggatcttgttctcccaatgttgccatttccttgtctagatgataatgcacaaaatgtttagcaaaagcatgacacctattaacaaaaagatgtaagaataacttgatttccaatacctgtgcgattcctagaagaactgtaacagcacttagaaccacatgggagaccgctaatacgaagataaatatgtgtaattgatgaatggcttcaactgaaagtattggaactaaaccctgtgtaatatagtaataattagtttcggcaagaaggtaacatgaatgtgcaaaatagatagaagataagcacaacaaaatgcagcatgatagtgtgttactaagatgagaggggagtagcatattgaaatgtgttgtggtttgctttcattttatacaatggaacacgaagtaaaagaagcataactacataaacttggtactccctccttcccaaattgatcattaaaaatacaattcaaaatttctcaaattaatcatcatataaccgcatggatacggatttcatcagaatttaattaatgcaacatgggagaatgtgtgaatgctaagttgtactaattggtaggatgttttaatcgatgcatgcattgtgagagaatgtgtgtatgatgtcttgattgatgtgatttaaattatccttggtcttggtgcataaacatatatatatattatgatcattttgagaaggagggagtactaattaaaaaaaaataacaatatgtatgatggatgcaccatggtacttgttctaagttgtaacaacaatattgtgcacagctcggcgtcctacaaacaatagagtaaaaaaggacacctctagttctcgttccttgtgtttggttaacgaacttgaaacgctggacacgatgtatagatgcaaccctccctcgtttaccgtttacccattcttcatgataatttgttcggatattgtacttgaacgaaaaagaaaaagagaagaaaattttatccattcgctgatttgtgtaagtctcaacagtttcgagttaattaatttgtggcatttctaggaaagcggcatgatgagagtcaaacaaattaaaggcaaatcaaattaaatagtcctaactactactagtacctttttctcgcagtagtcagacttggcccctcctccggcgaggagcctcctcacgccggcggcggccaagtgcgcggtggtcttggccgtcttggcgccgctgaagtcgagcttgcacggctgcaggtggtccatgacgctcgccttcacgcatatcttctgcgtcagcccctggaacacgttcagcagcagcgagatgaaccccagcagcatcagctctgcacatcagccacggttaattttcagtcgatttcatccttaattcgcttgctagacaattcttgttttcttttctcatggagatgatgagattagttttgagctcaccttctttgaccttgaggagtccctcgtagagcggcttcttgcggctcttcttcaacctctgctcagagacggagacagagattatttatagctcgtgtcggatcgatcgccatggcggcattagctcgaacacactagctacgtacgacgaagagcagcgacgtatatataccttgcccaggcggtggagcaggcgctcgaagagcagcgagatgatgacgatgacgaagcagacggcggagacgatccacgtcggtgtgtgctccagcgttatcgccggcgcttcgccgccgcccgccgccgccttccctccccctccggccatggccgccgcgcaatcagcctctcacaggctcaccaacttcttctccttcttcccgcgagaatgtcaaactcaaactgggaagtaaatagtgcacggaggtggaggagaacgtgcacgccgccgcgtagagagtgcggggagagaaatttttatagcggagtgggagattgaccaagcgcgttggcgttggtggaggaagaagaagaagaaggagaagtggactgacgggttaattaggacaaattatagcggggaaatttaattaattaggtgcagcagaagcgatcaaaaactgttgcgacggcaaagagaactttggacacgctccttgtccttggaaccaagtagctgggtcagcagctcagcgtagcagctaaattcatgtgttcaacaaacaaccccccgtctgaattgggaatttcaacaaatggcagcttcatgttttctgggacggagggagtatctttttatgttattttgattttatgacaattattcaacaccgaattcatattaattagattctagtggttttaaacattgactcgatcgaccacacatcacagcaagagtacacatacacatggtcgcccaaaaagaaattaagaagcatctcgagggcttcgtgctacgatccatatatccaccgggacactagctagctaattgcaaaaacgtgggtcaccatctcttcatgaaggtgcagctagctagcgtcctgctaattgtcctttttaataaagcagctagttaaggttgaatgttattggggttggttagagtgtctacggtccttgtttgaattatttttctagtttatcatctctaacatcaccttgttgtgattattattaattattcgctttgtttttgttatcttccttttctgcccatgcatgtgagcattcagaagtcatcgagga

SEQ ID NO: 76410 - DNA, 2639 bp, Oryza sativa
cttttttagaagccaagagattgtcctggaaattcttccagaaaaaacttgtgtatgtctgtgagcgcagtttatgacctataaaagctgtcagatgtaagtgggcccggcctgggagaggaggtgggatcttttccggaagccgatctctaaaaaacttgtgttggtctgtgagcgcagtctatgacctataaaagttgccagatctaagtggccccggcctgggagaggtgggatcttttctggaagccgatctctaaagaatgggagaggtgggatcttttccggaagccgatctctaaagaactttgaggttaagtgtgcttggcctagaaatctatggcctataaaagctgccagatgtaagtggccctggcctgagagaggtgggatcttttccggaagccgatctctaaagaactctgaggttaagtgtgcttgcctgggagaggtgggatcttttttagaaaccaagagattggcctggaaattcttccagaaaaaacttgtgtatgtctgtgagcgcagtctatgacctataaaagctgccagatctaagtgggcccagcctgggagaggtgggatcttttccggaagccgatctctaaagaatgggagaggtgggatcttttccggaagccgatctctaaaaaacttgtgttggtctgtgagcgcagtctataacctataaaagttgccagatctaagtggtcccggcctgggggaggtgggatcttttctgaaagccgatctctaaagaactttgaggttaagtgtgcttggcctggaaatctattgcctataaaaactgccagatgtaagtggtcccggcttgagagaggtgggatcttttccggaagccgatctctaaagaactctgaggttaagtgtgcttggcctagaaattctctgaggttaagtgtgcttgacctggaaattcttccaaaaaagacttgtgttggtctgtgagcgtagtctttgaccccgacatgggagaggtgggatctttttcggaagccgatctctaaagaactctgaggttaagtgtgcttggcctgaaaattcttccagaaaagacttgtgttggtctgtgagcgcagtctatgacccataaaaattcttccagaaaagacttgtgttgttttgtgagcgcaatctatgacctataaaagctgtcagatgtaagtgggcctagcctgggagaggtgggatcttttccagaagccgatctctaaagaactttgaggttaagtatgcttggcctggaaattcttcccaaatgcgcacgagtgaggacaaagtgtgcagaaaagacttgtgttggtctgtgagagcagcatatgacctataaaagctgctagatgtaagtaggcccggcctgagaaggcgggacgttacagcatccacggcgccggcgcgagcgcgagcgcgaggtgaggcaccggcggtggcggcgacaacacaagctcggcggctccgcctctcccctctccctttcggccctcgcacgccgccgttgccgctccggccccgcccgctgctccagcgcagcaaagggggagagaaagggaaggagaggatggttgtgggccccacgtgttagtgggtcctactatttttttttgtgtgattgacagatgggtccatatatattttttaaaattttaatgccacgtaaacgccacttgaacgatgactaggtcaatattaacatgtaggcgccacttcagcgaaaccggccttcaaaaccgccgaggcattcaaattgcaccggttttaagagtttgggggtcgagatatctggttttgtgatctagagtcatagattagatttcaatcaccaagtgaacttattcctttttttttcaacgtgggagtatcagactgtgttgggcgagctacagtgactaaaagcgagctccacatccggcacctcaagtaatttcttattaaatttggaaggcaaagctcctttaggaaaattattttcaactatttttctataaattacaagtctgctttcattttctgggaatcaaatattatgcttctgtttgtcttatcatttctcaaacattttagtctgttagaaattatcggtaataaatatgagatatcctgcacacttacagataatcagtgagaattctctatcggatttgctagatttctgttaacagaaaacaaggagaaaaaatttcgattttttggccgtcggatttgccttgagattcgtgctggtatgtggaggggaaaaatctgcgtgagaaagcctgtgtacttgcaagggttcgaacttatcacctcactcccgcacctcaaggtgaccagataatcctttggtttcaaggggttcgaacttagcaccttgaacttagcttgtgcacttgccttttttttctcgctcgcacggtggacggcgagaaaaaaatggattggcgccaagattcaaacccaaaaaagggagcaatgccagaattcaaacccaacacacggaattcggtggtgaacacaaaccattaggatacatcaagttatagactaacttgagcaaatgaccatactccatataatactccttcggactgataatatcaagaattttaaaccctgagagtattgcgtaccgttacatgggt

SEQ ID NO: 76411 - DNA, 5887 bp, Oryza sativa
actcagggtagtactgtggtccataccgttgggtggggcttggggcttgagtgctcggtttgtgtcactgccccagctgatagcaaaaactttcagctccctgcattcgtgtctctgactcttttgttatgtgatacacgatggcaattttccgatttcgtttgggcacctttaagctccatatgcattaaagtgtcttggcctaacttatttttacaactgatgctaagcactgtatgaggcattggggttgtagatataatttctcccaaaatcaagagaacatagatgtagccatgggttatttgtatcataaaatggcattaacgaactacaattttgttgcattgagccatcttgaagttcaattagtctgtatctgtcatattgctgccatgatctattgttgatctgtcctaatccatttgtttggtatgctgaattagaacttgaaaaatgtgaaatctttatatggtaggagtgagtgcaggctgcctcagaaatgctatgcaaaattttccaaggttaaccatcaacattttgttgaattaaaaggcaatgatctcacaaccatgtaagatactaaaagagtaaatgtaatgattgctgagtggttgggatttggggaaaaaaaactataacagacgctaaattttttttgtgtatatccttgaaattgcaaaaatatgtttgtatcttagttgctcgatttagaggttgctcacttaacaaatgacacatattgcagtgtcattgtggaagctcttaaggtggatagtttgcagaagctttgttcatcactggagccaattcttcgtagagttgtgagtaaaagaactcatagcattggatgttagacatttcttttctatagagatcatacattatttctttgttgatcaatctaattcattatattctggaataggtaagcgaagaggtagagcgtgctttagccaagttgggtcctgccagaattcagggaaggtacaagatcactgtaaaacttgcttgttgtggtgatacttttggatgtgtctatgtgaatttcagttttttctacagttatggtttgagcacaacgaaaaacttaatacaataacattatacctattggaaacaggtcctctccaaaaagaattgaaggacctgatgggagaaatcttcagcttaaatttacaactagattatctctaccactgtttactggtggaaaagtagaaggtgagcagggggcagcaatacatgttgttctgctagatgcgaacactggggttgctgttacttcagggcctgaatcgtgtgcaaaactggatgttcttgtgcttgagggtgacttcaacaacgaggaagatgaggattggacggaagaggagtttgagagtcacattgtcaaggagcgtgaagggaagagacctcttttgacaggtgaccttcaggtgacccttaaagaaggtgttggaaccataggggagcttattttcactgataactccagctggataagaagcagaaaattcaggcttgggctgagggttgccccagggtcttttgaaggtattcgtgttagggaggcgaagacagaagcttttactgttaaggatcacagaggggaatgtatgtttgcaatgagttattgttttactcatactgctagatgatttgaatgttactcgttaaccatatttctattgtatcttgcagtgtacaaaaagcactatccacctgccctaaaggatgatgtttggagattagaaaagattggcaaggatggtgcattccacaagaagttaaatgcaagtgggatttatacagttgaagattttctccagcttcttgtcaaggatcagcagaggttacggagtgtaagttctacaattgttgttaataggttgtaattaatgtagtttaattgatgatcaaatacctcttttttcttttagattcttggcagtggaatgtcaaataagatgtgggaaagccttgttgagcatgcaaagacttgtgtcttaagtggaaagcactatgtatattatgctattgactcaagaaatgtcggtgcaatattcaataacatctatgagttcactggtttgattgctgacgaccagttcatttcagcagaaaatctcactgacaaccagaaggttggcatcttacttatctctttctttgttttaaagttaaaaatgcagtatcttataaatttataattttgaagtgttgtatagctgatttttggcatattaggcatgttgccacatgacactgtaaacttatgttgctgtgctgttggcagtaatgtatcaatgcacaggtctgcgtcctgcatgttcaccttgcattcagagccctatagtaatatacataaatctgtggtgcttcataactagtttttgatatcacgtttccagtggttgccacaatagaatatgcaatttgttataaattatgtgcctcttgaaggaaatgtcttcctgacaccgatatgtttcttttgaattcaactgttgtgtacccaagagctgaaaatataaataccctattgagtgcataacctggctgaactctattgcagatctatgcagatggattggttaagaaagcatatgaggattggatgcatgttgtagaatatgatggcaaggcactcctgagcttcaagcagaaaaagaaatctgtcacaacaagaagtgacacggctgcagcagcaacaaacagccctgtttcctatggttcatccaacacacacaaacaattgtctcaaccagcaaaagcagggcaaacttctacaggcactacaagtgaaggtaatatgatgttcagctcaaaatcccggtacatctatgtatgttgacaatttttatggtggtctctgctgttactatgttccctgttatgtttttgtttaggagctgcattttctttgttatgttgggctctatttatcttacctaatgcgagccaagtgatttcggtttgtctttttatccatatgctcgctgacccatccctggaacgtaatgttgctgagctcctacttaatttatttatatggaattatccatctcatctggagtcactctcttgtcttcaaatttcataatcactaattcactgcaatcttcctagtgagaatagaaagatgggtagaaagtggtctatgcaattatgacaagcacatgcagagtagggcagtaggcccattgagaatgctaaaactggaacatgacaaactgtagcagcactggaagatgtgcgtacggccgtacgtcatgactacaaactgctttaactactaccattcaatacttttgttttacttattggaactcagccattgttggttggaattgatgtatgcatttggaaacatgttgatgcttctgatcatgttcaggtcagattatctgtgaacatattattgccattactaatacattgcgctactgaattcctttggtcttttcagcagatggatctacaagtgcatacaatggaaatcaggcaggacgatatgcagtcaattctcaaagcatacctgcaaacgtcactacacaatatgagcggagttcactgacacctgaaagccagttcaatggttccgcactgcagaatcaagtttctaggggctccaatatactggcattgggaccaccacagcaacaacatcagcaaaattttgaattctcagcactaggtggccagtccatgcagcccaccggcttgaatcctttcgatgactggtcgcaaccgcaggagaaccggagtggggttgacgactacctgatggaggagatcaggatgcggagccacgagatattggagaacgaagagatgcaacagatgttgcggattttgagcatgggtggcgcgtcaaccaacctgacggaagacggcttcgcatttcctaactacatgccatcaactccccccaacttcaactttggggatgaccgtgcccgcccacctgggaaagccgtcgtcgggtggctcaagatcaaggcagctatgcgctggggcatctttgtcaggaagaaagctgccgagagaagagctcagcttgttgagctcgaggactagcaaacatcctaactgctggtctaacaaagctccattggtgttgctgctgctgctgttttaaggatctgaaaaatgggcttagcagctcctgtttggaggacgcttccttgaggccctgggttcttaattatggacacggattctcgtctactctttttttgtatagttgtttcatcattgtttgtttagtgtgatgcttagttgaatcctgtacgaaccttaaccagaactgtgtacatttaattgtttcaaaattcacacaagcattcgacactccgtttggttgtagtttagttttgaattataccaatataaaagcaggaaacatataatagaaacaatataaaagaaacacggattcatttttatttttttaaaaagaaggaaacatataatagaaacaatataaaagaaacacgtagtgcagtgggggtttgagttgagggacatatctatctttttccctcggtttcaggcatgtttcagccaacaattcctttacgtaatgccaaagttgcgcataccgtgcattacaggaaaacaaagggtcctgttctatatacagttgtggagaaatgacagtataccatcacaagcaactgaaaaacataccatcacattttatggtgcagttgtagtgccaacgctgacctatgacagcaacaaaaaaaaaacaaaaaaaaaaagtttccaagcatttatgtcttctcacatcgcaaccgcaaaatgctctatacaatctcgacaacaaactcctctctctgacatagtgaactaacacagtgaaggctcatttggctccattctactgtgtcaacagctaaaccatttgggttctgggtaaaattccatgaggtttctcaagctccagttatgaatgatgggaagtaatgctccaaaaccgccaggaaatctctcctgttgttttccatgttgaccggaacgccgagccggccaaccgcctcgaccagttcccccctcagtctctgcggcagcagctgccctcttgcactcgcgcatgcccggtacagcggcaggtacgcgatagcgagtgccatgggctccgggaggtcatgcaggcggatcggagacgcccctctcctcagaaccctggtgatgttcacaaaatgatcttccccagcctctactccttcagcaaatgcggcctgagaccactgctctttcagaaaatcaaccaggtcttggggaatatccatcgtactcgtggtcgcaatgctgtctgcaactgcatacgtagcggcggcatcgttgaggaagtttgaacggagaaggaaggaaacaccttcaaaagacccactaccctgtcccctcgcagctttgagaatctgtgggctgagggcttcgaggacatgccgggggatatgcgcaagcaggtaggtggcaactgcgaagtggccgcaagaggcagcggttgttacagcaaggcacatctcaatgtctgaaacatgccggttgacaaaccactggacaacctgcaagcaaccacgctcagaagcttttactaagggacaaaggaaagatgtggcatgcccttcatccaccaagcatgccatcgtttcaaatttgcagtagtgagaagcatagactagagcaagatcgacatcgacagccaagctgttctgatgagcaatctgcaaaaaataggcaaaagttatatagttgcataccatgcttctacaaaaattcttattcacacatgccaaggactatataataaagcagatagtaagaaagtatattctgctataatataatcagtactgaagagcaaagaacagcacaa

SEQ ID NO: 76412 - DNA, 580 bp, Oryza sativa
ctggcttcaccagagtactcttatataatacatttctaatgcttgaaaaccttgtgccagctttgtaagctaaattgtggcttaacatactacttgttctaagccagtatgtaaatttaataccaccgtgacaaatattccttcactttattctttccttgcccttcttaggatggtaagatttatgttaagtatggtttgcttgggcctattacgttctcagacccctcgagaaccttgcctagtctatatatgtatacaactgtttatgtattgacactattgaggtactttgtgttctccaagcatagaagttttgctttgtgtaaagtaagattcttaattctttatttgatgacagactgatgagtcaactgaggcatctgctaaagatgtttttgaagagaattacaaagaattaattaaatgggttgatgccaaaactacaaaatacggctctttaactgtcctgcgtgagaggcgctgtggaagacttggcactgcattgaaggtatattcttcctataccaattacccattaatattttcatagcattgcaattatgattaaatttaaatg

SEQ ID NO: 76413 - DNA, 1603 bp, Oryza sativa
  unsure (1)..(1603): unsure at all n locations
tgctgtttttgtggtcttgtataatatgctatactgcaagttcaggtttaaatccatattcaagatcatcatggaccctaagtattttccctctgtatattttcactctcatcattctatttcatattcaacttatatgatgattgtctaagacttgcaggttgataatgataaagaaaagggagtttcatctggaagaaagagtatttcagagagattggatgacgaggtaggagcactttagtccttaaggtcctttgaactcattatcttatatgaagtgttcttttcggaagatgtttcttggtagaaagtaaataaattctatatgcatgcaactgatcattaatgacgaatttgtgttggatagattgttgtggacttaagctacttagaaagaatcataacttctacctgttttaagttaatttattttaggtaaaatggtatttctgattgcaatataaaatcgtagggaataatactgtcttgacattaaattgattgatcaggttcgagacaccaagataaagttcctttctggctttaatcaagaaactgaggatgacaagtcttcttggacggcacttgttgcttctcttaaggtagcaacagcttctcttccttagtcatatttatcctatgatttgttatcacactaagaaagaccagacatgattattttattgttatatacatggtgttaaacttaaatgcatcactttgttaacaatatgccaaaaaagtggtcctttagcatccaaaggtcacaattttaattttataatactgaaagcttgcagttcgccttattagcaccaaaggnttaccttcgttcttctnatttagcattccgntcaaaattcaaaacttctgttggttttctcttttttttttatctggaaagaaagatgtggaataccaacagtaccctttgctttcttcctcctacaacccattccctatctcaaatgagatcagccatggttgccatggagactctcgccaccccattgagctcaccaggcatgaccagtcaggtctcaggtcttgagcttgcccagccgctgcagttcgagcctcaatctcgtctgactgctggaaatatttgtagtttgcagattcataacaaaacttgatgtcgactctagtttgttttccttatttattagttttatttatgagcatctgtagtttgcagaattgtgattacagtggtacatgtaatcttagttatttttaattaatgctaagatgttacaataaagaaagacaatgatatcaatgtaatttgaatttttattgcctaacatgttaaattgtgccattttattataaaaattatgagctacatttgtttatattctccaatgtcaattaaatcaccttaaccattattgcatattgcagccagagtatcccaagtatacacctttgcttgccaaaattttggaatgcatagttcagaaagcaacttcagatgataagtttagccatcaaaaagaggtaattaatatttccttttcattttatgtttccctgcatcttactatgttgaataaaaaaaatgttcaaacaattttaccacatctatggctggaca

SEQ ID NO: 76414 - DNA, 9999 bp, Oryza sativa
tggatttccttactaggcttttcttttctttttcttgacaggcctctgttccagtagagcttgggcttctcctacgattgtcatatgggccgttggagtttgggcttctccaatgcaatccaacggcctcttctccctcttatctctgcaactttaaaacacagagtcatctttctttcatatgttttattctcaatcatcatttcagtacatttctatttatatagccctgcctcgttacgaacattacaaattacattatagtatgttcttatttgtatgcaaattagggccatattaccggtactataataatataagaaagcaaagagaaagaaagagagacaagtgttgtttggttcacttgagttgggttgcacaccatgccatatatacgtggattagtagcactcaccaaattcaatcatttgcagcatccatacatgtaagcttacaatacaatatttatttgaccgagcacgtacgcaaatgcactctttgacaaattaagcaagatccgagtgatcgaccatgttttccggaggacttaactgaagtagatagatattcagatactccatctaactactactagatgatactatatgcgtacgtcactcagtcaatgggacgatcgactagattaaattattactttcaccatcctaattaatcctatcttagtataaaattatcccccactaactccttaagcttaacatgcaaagatgtcacatcatcatccactaacaatcatcacatttaaatatcatgcaaacatgctatatctttatagtttttataatttaagagatttcaaatacaaacatgttaaattatcatccaacataatttacataatgtttcaatgtatatctttattatgttttatgatatcctatatagttttatagttcatccttatttagttagtgcttaaatgattaatctatggtccaaattatctttctcattttttcatctaattaagtcatatcacatcaattatttttaacctttagatgattaatctactttccaaaccatctccttatttttcttcttccaaaaagtcataccaccttactttttacatttgaatcaccattgtacatactatttaaatttaaattatcataaaccacattaacttacttcttaaactgatgttatctagctatcttacaggttatttttattgtttccatactaaattttccacagcaatacgcgggatttcacctagttaatgagatatgcataccacaatcgttcaattcagtcatatttttactatcaatcacttattaatccattcattttaaattactaatcgttacgttatatattagtttaaatcaaacattttaatctttaacgttaatttctataaactcatacagtttaacatcataaaatttatatttttatataccatagaaataatttcataatatatgaatcacatgctaaacaacacatatttttaaaattggcatatatgtagtgctacataatatttatagttttcatagaaatattacttgtcgcatgtacttctagcaggttttcgggaggaatctagaaattaatggtaccactgtacgacaataaataaataaataatgctattgataggccactcggccagatgtcaaaaacctaacgctactcttgatacatgtgggaatatgtgtacatgcataaaatatttcacgcgagcttcaaataatattttatcctaaacaacttatctagcgcccgtttcgtcatggcgcctagtgggaaaactatctcttaaaaatcctaaatgcaaaaattgtttccttgattattgtccagtgtccgtgccattccagatctcaaatctccaatccatcgtcgaatccaaaccctaatctcaaatatgtcctaaatcaaatcctctcgaaaagtctactttgcctcccttgagtctgtgggccgatctcttctccccggcccatttcctctcagcccatctctccctcctcctccatccttgcccgcacgtgcgaggcacgtgcgacgctcgggcgctgagcacgagagagagctcgctctctctttctcttctccttccctctctgctcccgctaccgcttcctgccgacgccgcccaaatcgccgcgccgttgcttcccgcgcgcgtgcgcgcgccatggtggccgacaggccagtcgccgccgccgtcagcgcctgccgcgcctgagcccgcgcctgccgccctgtagccgcgcccttccaaaccgcccccgccgtcatcgccgtcgtcacgacccggccccaccaccaccgcgcatgcttccaagggttggaggcagagctcctcctcccactgtctcgtcgccctctctctccttccttcttttcccaaagtggcaagaggcaagtctcctttccctctttcctttcttctttttctcccccgccggcgtcatcctccctgtcgccgttttggccgctagccggagcgctagctcgctggcttgaccgcccaatgtcggttccgccctcccaaaccgacattgtcgcccctataaatccgagcccctttccccattccaaactcccttgttttcgccttccgtctccaccgcaccattgtcgctccgccctacttgcacctccgccattcgttgccaaagcaccgggagagccggcgcgtgcgaaggacgcgtgaaggggactccgcgcgctcgtcttcttcctcttccccggcccgaggccggagagatcactcccgtgccgtcggcctctcatcacagcgccccgcctcgtctcggtagggcatccctccgttctccctcctcgctccatctcttccccttagctttgagtagcagctcgagtagtaccccagtagctagttggcgccgccccaagccgcgccgccgctcgcagtaagctcgccgccatcgcacccgcgctcggtagtagccgcccgtcgccggccttcctcggcgatgacccgtccaatccgacgctaaaaacggattcccggagtcacgtagatgctctaactcgcccgaatcgatctcccgtcatgccgtcgccgtttcccccttctctcgccgccggttgccgccgccgcaacccgccgccgtcgagccccctccggcgaatccgagccgttggctcgtctccctttgtcccgtgcaacctcccggtgcgctcgcccatgcctgcatcgctgtagatcgccccgccgctcgccgccgccgtccgccatccgttccggccgacgtcgtcgtcttcctctcaccagcccacgtggctgccacgaaggcggcacgtcggtgccacctcggccgcgaccgggtcaagcagacctcggtccgccgctcccctccgccccgctcgcgcacgcggtccaccgcgagccgtgaggctgcgcgtgggcccgccgcatccgcacccaccgcgagccgcgcgcgtgcatcgcgccccgctccaaaccctagcgccgcgtcgcgtgctcctcgctcacggtgagccgagccgccgacaagcaggtcccactcgggatcacgcgaggtgagcccggtccaccgactccctctctcctcccctcccgcgtgcctttgggccgccttctcgggccggccggcccattagctcggccgagtcgcgcctcttctctcgggccgcgccctagccgcccgagggaagtctgtttcccctccctctttcgttgctaattcaaaaagggtttaaataaatccttttcttttagtccaaaaatccgatgatcttagaaattcaatatcttttcaaccatacatccgtttgactccgttcaacttccaaaattcctcaaatctcgagatctatctaatggcacgcttagaggtcaataatagggctttaatttcgccgtttgttgagtcatctcgttcgcgtgtagcttcagagcccgaagacccggagtgcgcggatttcgaggatcaagctcaagatctcgagcaaggcaagtcaactttgatcatcttgcacctataatttaaagggacaattcgaaccatgccacacaaattttgcaaaatttgtgatatgccaccctgacccacatgtcattgactcatgtgtgtcctacatgtcattgagatacgggtggcatatctcaaattttgcaaatatagggtggcatggttccaacaaaccctaatttaaatctaagtatttcttttccacaaatattgcatgaataggattaacacaagtaaatcggccgcggcttgcgagatagcctgccggcccaaccctaattgttgcaattaccctccttgaattattgaacacttaaacctcctttgtcgactgttgtgcttcgatgcacgggacttcgggcacgcgcatcgggacacctcccctcaaatttaaaatatccaacgatgggtaaaacttggggttttacaaaagacttggaaaaacccgacacctgggtcggtgcttgcgaactaaatgaatttccaaaatcgcggatcgaggaacgtaccgggagtacggtttcccgctcttgcacttaaggaccgttttccttggaatttcatccgaacataaggcaagtgcgaccacatgggtggaatgggatgcccctggctgagtaattagctaatcgaggcagccattatgccaagagacatgtggattcaacggggtggtgccagggagaacccccgggcttcctggcacagtatggtctgggacctaacctaatgtcggtttgggacccctctcgttggcatatggtgaacctgtgtcagctttcgaaatgccttgtcatgaaagcctcaaggtctctagacgtggccgttctgcacgggctgggtgatccgggttagtaatgtcgtgtgggtaaagtgtaccccctctgcagaggttattaaactattcgaacagtcatgcccacggtcatgggcggatgtgaggtgattcctagcgtagttttgtttgactactgcttgtgaaattactgttgtggaatgggttcgatgtttggaaaatctgcggctgatgggatcagccaggcccgggtgcccgtttgaaagccgttggccgggtgccaaccttgaatcaattcaaagactgatacattgcacatactccgaccggacgagacgcactacctcatccgtgtcgtttgagaagcactcacttagttgtttcaaaaaggagtttaaataaaatcaattgcaaaaacaacagtctttccttgaagcctgcattaaacacttaattcccatggcttgctgagtactcctgtactcacccttgctctatataaataattcccccccagttgctgaagaagatgaagtggatcccgctgatgaggagttcttccaggagcaagtcggctacgatgagttttagggtttcggtctagttcccaagtcgcgcctgtgatgattggtccaagtcttggcttccgctttcccttttgtaatgcagttgtgagctcgggatctgtccgcagcccaacatgactgtacttctactctgtaataaagagacctctgttgctgtgatattctgtcttcctgtgataccagcactgtttcctgagactggtatcgattaacaggttaatttggagcgtcacgggctagttccgttcggggcgtgacaacttatccaatctatgatccaataacactgttatactcattgcaattaaatgtttgcaacaaggtactatagttaattctttacatatatattctaattaaaaaaatacatgtttttatcatttaggtcggatgtttcacacttcaaactgaaatctttcaactggtctgttactatgttgcacattttaattttgttttataatatgtctttcttaatgttgcatatgaaattatttggatgttttaataagtgcttttcccatgtgttactagttcatttgaaaacattacatggtaattatattttagttaaaatatacatgtttcaattatttgaggtcggatgtttcacacttcaaactgaaatgtttcaactggtccactactgtgttgcacattttaattttgttttcataatataaattttctaatgttgcaaatgattttcttggatgttttaataagagttttctcatgttttaccagttcatttgcaaatattacatagtgttgtttgaatgtttcagcagatattttgtgatgttcttgatctttcacgctttatataaaaatattttaactacaattataatgatatactatttttctccagaacataatcatatgaggtcttactgtaatcatttaattgcaacaaacaaacgatggaatcgatcacataacaaataagtagtttacaagaaaatatattgatacaaataaccgtaataatcaagaggtccatatatgatatatggtccataccaagtaaatatatcacacgactatatatatccctagcagccacgaacacacttcaactaggttattgggatcaagatacttaatgtgttgggcttttttttttccaaacaattatagaatcagttcgtaggatcaaagatactaattttatcaagtatatgatttatgtaaaatttgcaatattgtaaagtttgaagatgataatattagtttggtagggatcgagctaataaccttgagtccaactgcgagctactaaggagtactccctccggttctataataattgacgttttggacaaggttgagatcaaactttaataactttgaccatcaataacttcaaaaatatttagtttgaagaaactagaacaacatatatagatttatctttcaaaacactataataaaagtaaacatgcatttatttattatgtatattataatagaaaaataagttcaatggtatattttgtagaccgtgtcattgttcaaaacgtcaattaaaatgaaacagggagtacttattaatcgtgacgaatatttgcatgtaacagtaacaaccaattaaggcagattaattagtaggactactgtacatggtgtatacaatttattaatgttgttctaggatggatcatttgcatgaatggcagcaaataatgaattaatcccctagctagtagctagctagctgcctactccatgtatagtcttttatacggagtaacaaattaagatgacccctaatataatttttccgttaaaaataaccatcttttatatgaaaaacttgacataggtcccaacacaagctatatctacttaactgtcaagtactgttcatcagccaatatatcattgcatttaattatatatattcgtgatgtgtgtgtacctttaatttgacgaacgtatatatgttgctttctagttgatctcctcgccattagttatgattattgagatattttaaaactgcctttactttactgataacagagttaatctatattgtttatttctttactaactactatcttatgaatcatatttatttatagcagatctatatacagtatagatatcgactactagtagtatagtagtatagttgtatgtatttgttgtactgtattatgtctcgtctcaattctaagaattttttgaacggtgagaatatgcactttcagcacgatgatcactaaaataaacagggaaaatatgtagtgcaaaactaactatgtatcgaaaaaggacgttcaagattcgtccacaccaaatcctggacgtacatttttttgattcagcgtgaattttcagacttccacaacatatatagtttccaccatttttccaaataagcagatactcgtcagtaatgatgttttgatgattgatagataaagagagcaaaaggctagctacatccaattcgctagctagctagagtatatacacgcgtaccgcatttatatggatctgcaattaattctacatggagatggatgtaaatgagtgcttgatcagttacgttaccaaaacgatcttttgataccatttggcgaattaaattaaatggagcagatctaatttgagaatgtatatatgaatggtcgagggacatgcatgcatatcattgtctaaaataaagatggaggtagaagcggtctatctcgggcgccctctgcctctggtggacaaggacgatttgaattgatcgatcgattaattattgaacttttgtcatgactcgagacggcgacggaaaaattgatctgcaggtacggtatatgtatatatctcgtctcagaaaattaattaactaattaaccgcgtatctatatctcattcgatagagatatatatatcgcaaaagtacatgcaatttgtcagtcttgagtttacacttgactacacacgtatacgtgcaagcggtaaatggacgttgctctcagttagtgtatgtggcaacgtgacggccggtaatctagctagctgctttcttactagtactagtactactactttagctacaactttcacaagatagctaataagatagatagattcttctcacttgctcttgtgaaagggagaaactgaaggcatcgagcatgtacatacgttcagattgatccatacaaatacaagtacagctagcatgcatgtatacatatgtacagatcgatcaatataatgtaattaatgcgtatatatatgcatggcgatcgatcgagactgcagacaggccggcatgcctgccgatatccagcttacgactcaatggccagcagtgacaggttttgactatagagacgatggtcaggagagagtgactgtggcagtggtgcacgtaagcatgcggacaagtcatgtcgatcgagtcaaagctagatctatctcatgaaaatgccaacatgcatgcatgttcaaccgccgtatcaacacatagggaaaaatgtttctatctcccgcgacgtcgtatcatgcatgcatcttaataatattcgttaaaatatttaagaaatatcaagattaatatgtgatatatttttttctcaacaaacatatgcaataactataacttacacaaattgaatttaagcttcgtacgtttatagaataatatatctcatattaatttatatatattttatataaagatatgatacgtaaaataccaagagatgtgtctggagacatgcaaatctatctctgtatcgatcgtgcatattgatcgacgacgacgacggtgatgtgcactagctctagtgtactgtacatcatgtcgatcgatcgatcaatcggtagtctatatatatcgatccggaccatcatcctcctgtccactgccacgcgcgctagctacttgttgagtatatatccatcgatgatgcatgtatgataggagaaaattaaaagctactctaggtttgttgttatcctgcagtacgtttattggggatcgatcgatcgacaggccgccgcgcgtacacacatatactaactccttccttaaatgtttgacgccgttgacttttttaaacatgtttaactgttcgtcttattcaaaaaacttttgtgaaatatgtaaaactatatgtatatataaaagtatatttaacaatgaatcaaatggtaggaaaagaattaataattgcttaaattttttgaataagacgaacggtcaaacatattttaaaaagtcaacggtgtcaaacatttaggatggagggagtatatactccatcgatcgatcggtggcttggatatataggatggatgcatcatccatcgatcatgcatgcgcacctgggctagctgcatccagaagctactcatcgctttcatcctgcgggattcctgcccaagagtagctaggactcaactcatatataatttgttcaatttttaaattacataatatgatgctagtagtgatgtttgagtccgttccaacgccataattaaactcacatgtaggatcataagttccccacacgtgtatacttttgctttggatatgacatcatatacctaatcaactaactatactataaacttataacgtttgcttttg

SEQ ID NO: 76415 - DNA, 839 bp, Oryza sativa
ccccatcccccccccccaacaaaatttaacagtaacaagaaaatgtttcaaaacattccagaagaacttatgctctatccctgtttccacaataacctgattagtacaatactcctctataggactgcaattgcatatgtgcaacctacataataatgatagaagttttggtggtggtgcaatatgcacaaatcacaggataatattagatgttaatgtacacaactctagtgcttacacatgataattcacacttcacagcatttttgactggctaaatttccatagttaccacccatacccccaaaactgaaatgacatggggtttgtttggtgaaagagatgatgttatttataatcaacaacatttacatgccctcaataaagcatgcaattaaaatatgaaatgagtctcgtactcattaacaatataggacacaatacctttttctctagcttcctctcgataaatagaaccaactgcttcagtttctccaataactgcacattgtcatgcctacaccatccattagacaaattcacgcaataaaccatatttttttactgaagcaacaaaacatagagtacgatctatgaaattgtcaaaaacaaccaacataagataactctgcaaatctacaattgaaaagataccaaaaataccatatggtgggtgcaaagaaatgtctcttttcttatgtgtattttatcataataatgattttatatctatcatttatttgcaaattgaaccacatcaccatggcacaatcactaagaaaagccctaaagaatgccaaggaaggctggaccgcgatggataaggaaaaggaaccatt

SEQ ID NO: 76416 - DNA, 1060 bp, Oryza sativa
tgacttacgatggtatacatttggcggtagcaccagccaaaatcttgtcgttgaaaagacgagacaagtgctccatttataaccatcgttttactagagcagtcatcctgatattcagctggcgtcgaccgtaagtttatgcgggaaggataaacgatgtcgtcaataactaaaccgggaaattagaatgggaagatgacaagcagacaaaactgcacaaaccgatgagcttagcagtagcaggcagccttcttaagttcttattaccatttgaagaaataaaatacctagtgaaaaactaccaaaccagcaagtttgctaccaacaatgacaaaaatagtaaaatactgaatccatggtgatgaaaaatgagtgaaaaatagtcctaacaattaaaacggaggcaaagatgggggaaatcggacatgcatccactgcttctcgtaggccgatacatggacccatcctatctcctcaatcaattggatcttcaaatcataaagtcttttctttggttgctcagagtcatcttgaatcatgtcattcagaacctgtccacgaataaagttaagaccagcaaagtagtaggtgcatcggaaaaaaattgggggttaagatggcaagttaacaaaactaagtttagaatttctaggatgtcaagttgtttgttgtttttctttggagaaagtaggcatgccaaagtcaatcttctaatttttatttatgaaaattgatcgtttaattctggtgatgtggtttctcgactatagcattttacatttctgccttgttacaaaacaatatatcatgcagtgcaaattgaatgatattcaataatttgttctcatcaataactatagtcggtgcagcttctacaaaaacacagttgaaccatagcaagtgaaaacggagcctgatgcaaactctactcatatcacgatttaggcaaagtgcaataatcttactgtaatagatttattatagttcacaaaattgagaaactcaacaagatcagtaagttctactgaccaaaacgagttaagggaacagcattttactg

SEQ ID NO: 76417 - DNA, 5662 bp, Oryza sativa
ccacaaaaatacttactgtatactgtatactaaaatttctgagtttaacattgcagtcttctgaattgatacaggactcacagctgatacactgagtgcgacaaaggtgagtcatgtgcggcaaatttgaggatcatgtatattttggtattgctggcaggcataagtctcaccattgagcgaaacaccacattcataagtttaacggctatttatctaaattcaattttgcaaaaatgaaagttttgtttaatggctgaaactgcacagtgctactatgatctcagaaccaaagaaattaattgtctgagtttcctaccagcaaattgatttgttcaaagatttaggtggtcacgggccataataaatcattgagaatatgtcatataacattcagtcatgtatcacaaacaatttgattttgacaaaattaggtaacacataaatcaatgtatgcaaacatccagatacctaacactattgactgcttttttgtttcgagggggctcactgcttatattttattgagcttagctatattgtatttctctaaactgcataaccatctcactgcatagcccatatctatataccaccgtgacaataacagctacatctctacaatcttactactggtaagaaatgaaggattggtggtacataaagtgcctcaagttgattgaaacaagcaaccatttgtagatccaaacaatatcgtcgttgttattgtcatacatcttgtttgtataacttacatatctttcagactcaaggtggcgaagtttgatctctaaaatagcaatcggtgttttctgcactcgaatatgtaaataagctgtagtgtgtcagatattacaatggtgttcattatagagcacacttgccgacaacattttgcagtgggcttatctatgaatattttttttattcatctgttgcatggttaccagtgtgctgtatgtttcattcaattcgacctggatttgtaggcacgtctaaatggttcatggttcatgagcacgtattgtaaacatgagttggattactaatcctaaatcttgtcgattaggtatgtatggatcaagaattggatttggagatataatcaataaccaaacaagtgtagtgaaacaggaagttcattatatgtattactattgattccttagaaaaataagatcatataaaaaacatgaaacattaaatattaaaagttattaaagatagcgtttagcacgggcgtattactagtgaaaaaaggcccctaaatatccatcatctaactctctgccaccgtacatgaaaaaaataacatatgtaatttggatttcctatcgtaacgcacgagcatctttactattcttaaaagaaagagaaaagagagagatgaaaggaaaatgttcacttgaggtctcttatcttgtcgttgagtttcaaaactgtccatgaactaaaataccagatataacagatccctaatcttgcaaaaccaggtcacattacgtctcaaggcactattgctccctggttttagtgatgcggtggctgagtcagcgtggggccatatgggtcccacatatcaaccgataatcttctcccacgtatctcccctttcttcccgtctcaacccaaacttccagggcagccgacaagaggtggggagaagagtggcgactgacggctgcatcatggacctacatggtgaagagcgcaaagaagcgaagtaggaagggctcctgacacgtcgtccccttgggttacactgtcacatcgttgcatggcagctcgctgcgcatctgcgccgcgtccgtatcgtggtcatatgtcagccacaccgttgagattggcgagaggatctccaagagttgggagatggagtatcgttgcgacgcctgagcatagtcgcgagcatcactgactccatgagtgttcgtgcatgcacacgaagaggaagccggacactgaatcgcgggagaggtgtgtggtggccgatgaccagcagggagaagggtggcggtcgttgggcggcggcggtaggtagaagcctgacgatgggtgggagaaggctggcagccaacaagaagcttggcagcggcggggagaagggcgcatgcgtcggggacgatgcgaccgcaatgtggtgtagatgaagttgacctcgaagacgatgtggcggaaccgcgtgtgtgcctctgcagacgagaggcggagctcggggacacctaaacacatcagcttttgagcagctcgacggggggcgactatgagctagggggataggagcttggccagtgtgatgaggcagaagcctcagcccttgtgcgtgcaggtgaagacgacattgcagttgtagttgagacccgcgcgcgcaaatccatgatgtgagcgctcccggccattgggagccacgtcagcggcggcctccgccgtcgagcttttccccaccgaccgacacccttctcccaacccattggcagatgccctgaaggtttgggttgagatgggagtagaggggagtgaggtggaagaagattgccggttgacttgtggagtccacgtgggacttagccgccacatcaataaaaccggaaaacaatactaccttgggatcaaaagtgatccggttttacaagattagaggagggtttaggaccgtttaaaactcgacgacaagataagggaccttatatgaacttttttgggagatgaaaaaattccagccccaggggcctgtgcatatgacccataggcaggcgacaccgcggcggcagagcgctgcacgacctccgcctccccaatccgccccgtctccttgcccgccgccccccgactcccgtctcctcgcattcgctcaccggtgagcatcctaatccatcccatccggcctcggcctcgaatttcgtctcctcgcccgccgcttgcgccgatccccatcctgcgagcaaggtggcgcccggcgtcctcctgcttccaccgcatcgtctatcgccggtgaccatccctccctccctatccacacctcatcaggtattctgcgttatccctcaaaaaagtttgggggttcaaccgaaaaccgacccctcaaccgaaacagggttagatctgcctctgcccagttgcacctactttcaacttgttaattttgatttttgtttttagcacatgtaatttggttactgaatctcatccaaacacccttagaatagttgcattagaacggaaaatgtaagctcacataatttgtactcatcctaactcacataaatttcttaagaagaatctataccacaaactactcatagtcactcaaaaaatctttttattaaggtatatattcttataagaagttttcattccataaaattttctaaaggacatactgtgacacttggcattaatctaagggtgtgtttagatccaaactttgaatccaaagtttgcaaaattccatcacatcaacatgtcatacacacacaacttttcagtcacatcatctctaatttcaactaaaatccaaactttggatggaactaaacgcagcctaatttaacatttttttctttattaggttataaattttctaaaaaacatattgtgccacttggcattaatctaatttaacattctttatcaggttataaattgaaaccatcgaacgtactttgtcttcccgtttctaaaacattgcgatatatctataatattttaatttcaaaaataatttagactaacagtatagatatttaaattaggtaattaataaattcaaataaactatagtttagaataaaaaacaaaataatatatgccaagtacaatctaataacaatagaatgttagagacaatgtgaattcaatatttttataaagtttattttgggacggaggtagtagtaaattagccgggaaggcacactctggttgatctaaccccgagtcaaaaccatttctctacctggcaaactcagatggcggagctgaccacagccgctgatgtcaccgccgccccgccgcctccacctgggccaactccaccaccggagcccgtggtcacggccacggtcgttgccgagcagaaggtctctcctactgctcctccgctcgatgtgccggcacccgcaccgccgccgccgaagaagcgtaaggtggaggaggcggggttccataactccgcctactacaagatccgggccaccgtcgccgacctccgtgttcgtttcgtgcaggtctgcgctctccccgcaaaatccctctcctttttttttccgctactggttactttcgctactggttacttgcagtgcttgtgtgtgggggatggcgtgttgatctccgtaaacctggggttttggggaaaaaaaatttaagcaacgacgctgcttaggagacctgccaaactgaactctcgcaagacttgtacaattgcacttgatatgtaacatgggatttcgcataatgatctgttctgagttacctactctctcttttgaaggtttacgaagctactgatttccgaaacagtgatgctgctcgcgagattctgaaaggtaaaaaaatgtctcgaatttatgtcttgttagaaagtcactaattgctccatttagttggtaggaatcaacctagggctcgtgaaaaaaacatgaaaattgaacattggttggtccaaatatcataattttgtgctttatataattccacccagtgaaattttcggtgctgctctcctgtctgttactgtggctgtagccggggaggttacttgggtgaaggtggagcatcagggcttatcgcttccattgtgaatgctcgaatggtgtaggcaggaggcagttgaggcattgtagtgttgtgtttagttcacgccaaaattggaagtttgattgaaaatggaacgatgtgacggaaaagttaaaagtttgtgtgtgtaggaaagttttgatgtgatggaaaagttggaagtttgaagaaaaagtttggaactaaactcggcctaggtgtgtgtggcgagttggtgactgggagctcctagagggactcatcagagctgaggtagggcccacacggcggtgccacatcttcaatgggaagctgctgctttacataggaagtggtggagaagtacacttgttggtgattttgagtgaatgagtgagacttctatgtgaggattgaatgttaatggaggaaagtgtttaataacatgggcgggattagggtggaataatccaacttgcatgtcagcacttgaatgtatagcaggaggttttatagtcgtagaagttaggatgctttggttctgacccttgatggcgatgcattgcagctgactgtggtgataatcaggtagcagaaaaaccatgtgcaggagaaccgtgcacaaatggcagaagaggagagaagcaaacgggtactttattcaggcccatatatggacaagaccaccctcctaaataaccaaatcttatgcgtaagaactcagttaattgcctaactttaagagctatctcatctaaagaagtctgtgctaatgcatcctcaactaaatggcaacttggctacaccagctgtagagtgccttggtcaacatggtagataaatgtgtagctgcaccagctataagcctggatcaacatggtagataaatgtgtatcaatattcaata

SEQ ID NO: 76418 - DNA, 1101 bp, Oryza sativa
acagaagcaagtacagtaaggtggtactcacctaatcagtagcgacgactctatgaactcaatagatttcctgtataaataccaaagtgtttgtaacttgaacggctagcctcaaacacagtagcacaagtgccagttcctggatcctcacttctaaattccttatttacactcctagtatagactctgccatcatctaataccagcaaaggatgcacagttacaataataaactgagatggcaagctgaactttttaacccacataccagtctcagaatctgtcaaaaaccacaggtccatgcggataggaggaatattgtgaactgtaactaagcagccacctgaatcagccaacgataactgcaagttaagttccgagtaagtgctgtcaccatcctgaacatgcctgtgcaccacttctggaccttgtactgtcatccatttctctgtctcgaggttgaatgaagctatgctgcctggttcaacagggagcaccactatttcaaaataagtcgtgtaaaattccatcatgaaatacaccaccccatcgacgaccacgcatctcatctgtttactgcaacagatggttgctgggggcccctgcattttccgccacatgtcttggttgttgccatcaacggcaattacctcacacagctgcctttggtaaaatctgatgatgcggagcgccttgtacactccagtggaagagatttccccaaaagcatgagactcgactttgccatggtacatcatcatccctctcccagcagcaatttcatctgagtggttcttgggcaatgcgacggtaaccccggtggctgggttaagcacccagaggcacagagggtgtaacattctagtaaatcacaccatgtcgagatgggtgcgcaagcgcacgacagcatcatctcttatctggaatcgcaacaacctcgccggacttgtccctgacagcggctcgacggtcggtgacggccgattgaaaaagttgaattttttacattaatacccttgccgcccactgccagggcggcaaggggcctccacgcaaaaaaccagcccgagaagggctattatcaacagagctggaaagaag

SEQ ID NO: 76419 - DNA, 5090 bp, Oryza sativa
agtaaatacaaatggcatgataactgtgggcaaaaacagtctgggctatcacaaaaaaaaagaagggttcaatacatatcagaaagaaaaaatacctttcttttcttgacaataagattatatgtatcctcaagctgccttttcttatgtttcctagccttatcgagagcaccatcagcctctgtttcaaccaaaaagtaattttactattcaggaaaaccaaattagctaaaagttaacaaaaaaatgctacacatccactgttgcacagagttcctccaagcaagcaaataaataaaaaacaggcaaaaatgctgcagtaacacatatagtgcgactaagaggcaacattagttgtattccagtgcattgcaaggggaatttgatcccccccccccccaagtatgtactaggcaaagaatcggatctgtaaaggtagggcccacatgatggtgctgacggctgactcgctgaatgataaggatcaggcctcctaaaaacaaaatccactaaaactagattgtgagtgaaatgccatccagtaaatagaacagatgaaaactggaagatagatatcacataatcaagaaaaattccacccacatatatattgggtaaaacaccgcttatatttatatatattgtgagtgatgcattaagatgccttagacattgaacaggtttgacagagcatcctagaaacaccagtggagctaataataagaatagataccacatttaccttgataaaagcacagatgaaagttaaagaaaaagcatacagaccatgaattacaatcatgtctaaattaatattgcctaaacaggtatgattaatataactacagagtaaatgaaacacaccaatgtgcaaccaaaacagaaacaatatgattatttgagctttgaaaagaagtctgtaaaacaagaaagaataacttttttttctagaaagactagtttcaataattttgtctagatacagatatgcactaatacaagttattgcgcaatatacttactcatcttttccagtttctcaatctgctccagtatagcctctggatcctttttcaaaatcccaacctctcgtactttcttcctttcttttttattctggcaagtaaaaaaggtgatgggaatttagaatgtgaggacagaacaaactaattggtatctaccgtatttatatcagcaaccataaaagaaatagaacttaacaagagtacaagattaaagaaaatctgtaaaaggctagattggtttgctacacttaccgaaatttggtaataccgaaattttggcaaggtagcaaaaaccaaacactccaacaaaaccttcttccacaaaaatgttggcaatgcccatatatgtgcctcataatagcccaattttagcaccaaatcaaacctcttagccattctacactaccgaaatgtggcaataccaagattttggcaaggtacagaaccaaaccaaccctaatatacaagcagtcatacagatagtgggtacacgtgcaacaatcatggttgtcaagtcgtaaagtcaagtcgaggtacccctggaccgacttgtcgactagttgacaacttgtccagttgtccatgacttggtcatgcaaaaacaggggatgcaatatatagtataaactatggactatggagtagcaaagcaagacaataagtcaacaagaaataaaacaaaagtactaaacacaataagccaattagcatggtgaattagtgatttgctacgactaatttacaaccaactttacgactaatctatgactaaccgacttcacgactaatgctattttgtcgagttgtggctctctagtcgactagcttgaccgattttacgactaatcgcgactagtcgggtgacttgataacagtgacaacagttgccacatttctagataaaatggcatgttataacattatatcaatgtgcatatgaagatactcctggtctcctgctcagcagcatagagcaattgcagtaaagtagctgatcaatatagtcactaggttgctcaagtacaggggaaaaaatatcatgggcactccacaaaattttccagctaaccaggagaatcagcaaaattatgacgcaatataattggtatttgcagttgtaaatgcaagaggaaaaagttccattggtaatttggttccattggtaatttggtactatttgcagttgtaaatgcaagagggaaaagttccataaaccaaaaatctgttttcatcccaattacacctgaacacctaatattattcaaacccgctacatatagggctaggtgaaaagaaaatcacgaatccaacaatctacaatgcaggctgccaagcgaatcaatttacttgcagtacgcaccatttacaccaccatggatattcaagtaattgcttagattatcagttgcattgaaactcttaaaccgcaatatcttagtgatgcccatggaaatatgcttaattgcttattgcatgaaaaaaaaatcccacattggaactgaatcaaaaccaccatatttcgcgtagaaccgatcgcacgaattaatttacgatgttttcctacctcagatatagcccaaatcgacgaaagaacagtaaacctgacgaatcaaatcaccaggcgcatagcagtcaacgaagcatgaggaacatcacaacgcgcctctgcccaaggccaaattccactaccccccccccccacacggacccggacccgcgcgcgcggggtgatagcatgatacgaaccctagggtttgagaggaggaactcacccgcttgagctccttcttccgctgctccttgcggaaggcgtcggtggggttcatgaccttccctcccttggtcgtcttcatcctgccccacctaccctcctccccttctcccccaccggcgacgtacggcggcgagcggcgagcggcggcggcggcggatttagccgcggggggagagagaggagatggggttcgggtcggagtcggaccggagtggtgtggtctggtccccttggcgagtcgcgagtggaagcgggtgggtcacagagacgagtgggtcggtttggttaccgccgtgcagccggcccaggcacgatactgcccgtttacgcgagcaaggcccagtcggtccacctaattcttcccaatttttctaggaaaaagtacaccgaaggtccctcaacttgtcatcaaattacaaaatcgttctccatccacaaaaccagatatagggcatccatcaacttacagaactgttcattttaggtcctttggtggttttgaccccgttttgtccgacgtggcggctgagtcagcatgaaatccatgtggggcccacctgtcagactgtccacgtcatcacctctttctttccactgttttctcacctccacctctctctcacactcttcatctcattcgggcagggcggcggcaggtggggaggaggcggggcgaggcaggagaggaggtgctgcatccggcggcggagacgcgggataaggggagggcggcggcgacgggagaatgggaaggcccagctgcccgtctgccttgacgccgcggtggcacgccgtcgtggttgcgggagaggcgtcgacgacgaggaacggcgcggcgtgacacagggccggaagcgagcatggtggtgggaggaggagggcggcggccgtcgagctaccaggatgacagccatcgcgccacagtgggatccggtggggacgagggggacaccgacgccgacgccgacgaggaggagaggatcccgtcaggaggagcagacttgggcgaatggtatacggtgcaaaagcggtggaggtggcggtggagtaggggaaggtgcgggcaagcgtggcggcatttaccctacggggcgggagaggttgagcttggactcgtctctactgcgcttcttgcagcggcggtttctggcgtcaacggcatcatcgtctgagtctgaatcgtaaacagtgttctagagaaatagatgttatctagattctgtcatcaaatactccagctttatgtgatttggtatggatatctaagatcaattaagtttagatggagagtttgctcgttctgtgatagggcaatttcatgacatttcaatatcgtccatggcagcttcgcccattgatgtgggcaggagaggttccctgccctctcagccactctagagcgttgtaaatgctctgacttgaagaagcttttcagaagaaaagggggttgatctgaagaggactgaacgagtcgaagtggtagagctgctttcttctgaacaattttgttcttgttctctttttgggtgaagccaacccaagctaagctagctgccgcctacacaagccaacgctaccatgggcaaccggatagcctgatgaacagataatagagacaaagggcatgtttagatcccacaaatttttttaccatatcacatcgaatgtttggatacatgcatagaatattaattatagacaaaaaaaaaagaaagaaaaactaattacacaaattacatgtaaattgcgagacgaatcttttaatcctaattgctccatgatctgataatgtggcgctacagtaaatatttgctaatggtggattaattatgcttaataaattcatctcgcagtttacagacggaattattagtctatctatgtttaatacttcaaatgtgtgtccgtatatccaatgtgagatatgttagaacttttcatccctagatctaaccacagccaaacatgctgcaaagttcagttcgatcgactggctgagctgtgatggatgcacacaagagcagagattccttgcagcatttcacagacttgatgatctgaaatttcaggcataaatattgtcctttatttactggatgccattaacttttcaacgaatccttgaagatgctaatggcaatgtggcatagcaaggcttaggtaaaatcattgtcacaactcacgactcaagcaaatttaagagaattttaacatactttttttttgaataattgaggtatgtgatttaattcgttggaagggaattatgctacaactgcatctgcaaacaa

SEQ ID NO: 76420 - DNA, 9633 bp, Oryza sativa
  unsure (1)..(9633): unsure at all n locations
tgtgaatataaatatatattggggaacaaaaggatgagctttttattttttttatttatctacgactaaggacagagctactgttttgtgagggcatcagcaatggcactaccacaaaagtacatgcaactcagtctttctccaaagaagcaggcagcagctgagttgtctagccattagggaaaaaatgattagccaatcctaatcttgtagccgttctcatgttttgttattgatgattcgtttcaaggcgttatgatgagaggattatattattgcagccggccatggaccgtagtctatggtgtaagggaaccgatcagtgatttgtctcaataattgataaagaatcttgcgttgctgcacctccacaacattatgaccctcttttttcttcctcacagaaaaggcagacgaaggaaagaatggtcatggtttgatcatggtgttcaagctttgcagagcccatctcatctggcccactatgttaacccacaatgatcacattttcttctttctttctcctctgaaatttacctttctttagaagagctttagtttagtttgctgatgtttatgtttgttttcactttgattctttaactgtggtaaaatgtttacacacccaatagagagatgaaaagcaggaagtatcagactatgagtaagttaggataagtgacttacatgatagtaatcgcagatgctattgaaattctacttctgcatttcagagtttgccgattgctcatccatgaagcctgctggtcttttgaatagaggattcaatctacccatgaattttatgaaatcatcattccgcacaagagttgatgaaatatctttggacatatacaaggaaacaatctccatctccaaacaaaacagggcttagctctgcactgtactgctgtgccagatcctgcacgaactcaacagtttgagatgcaacgaactgaacagacctcatcaagataatgagtccaggtgattgcaaaatcttagcctctctggacaacctaaaagtgaaggaacagtgatgaccaacgctgtcagatagatcacctcgtgggactgtgctagcaaaagattagccgatcgaagaacctttttctgtactcggtgacagagagcagaaaattgtgaacattactttttccttcagacatggaaacgacgtgttcctgcgatttcagagatgccattatctgcacaatgaaacgtagatcgaacgcatcatcaatcaaccacaaacagacagagacaccatcgataacggcactcgcaactcacctctgatgttacctcgagaggaagaaggttctcacggaggagcactcgccggcgccggccatcgcctaccaccacctccgacgccgatcgccggcgctccgccgccccaacgtaccggggaaaggtaaaaaggaaactgactactcgatctacgtgacaagtttaggtttcttctccctcgatctgaaccgcacaacgtcacctggacggtccctgacccttataacaggatataaacccagacaaagaagaagaagaagaagaatgttgtgtgatctgtagataatcataatcacatggcaaacttcaaagttacaagtgttcatcttctcaaaaagaaatgaagttacatgtattcatcgtacagaagattggagccatgcatgaactgcacaccagacaacttcagataattgtataggagatatcttgcacactctagtcaccctctgatttcatgaatccagcaaacccataaaagcaagagcatggacgaactgtttcagtattccactggttactgactatctgcattactacgttgcaagctttgacccaatggatcatacatttttacaatcgtcaggttcctcgcttcttctgccatggatcggaggattaacttggagaacaaaacttgaagcatatgaattgtaaaatatattataggacttaacaacaacctatacattatttatccaaggcagcaaatggctagctctaacatttattcaagtacagggcagggtattttgagctccaccattttcagttcaggaaaaaaacaaagagagaagagctcctagaaatctcaaagcatcctacagtatatcatataatttatcttctggtgcatggtttgggtgaacagagtgttcatgccttctcaccagtgaacttatcgaagtaggacaatatctccgaattcactctctcggcctgctcttgctggatgaaatggtgaccttcaatgatgacaacctcaagatttggaacgacggacttgaaagcaccgctcttgacaaagtgctcagttccaaaggacttgagaccagtgtccttgtcaccacaaatgaactttgtaggcaccataattttcgcgttttgccagggtgcagtaagcctccaattcctgcatttgccatatattactgtggagataaatcaaatagaatgcgcacatacaacaaaatgggtccaaattttacgtgtccatcatgcggtagtagttgatgggtcctgtgaacccagacttctgaaacttttccgcgtactggccaagttcttcctcggagatccatggaagcggtgtcgaacgtgcctcaagaaagtctatgatctccactccagggggtgcggtgaggtcatcgatttcaatggagaagaactttttcaggacagttgcaacatcataacgggcaaatgctctttcagctctccctggttcctgcaaaaggcggtttttaattatgttgatccattttgaacgcgtacggtgctgatgatctgctgctaataatacaaagctaattaaggtgcattctgatggcaccatggaagtgaaaaatgtgaatcttttgcaaattccaattgtcctctaaattgtcaaaatctccgatcctcttatgtgtatgaaataaaagatgacatgccatttgtgtattgagtagaagagacagtttcaaacttttttttttttttacaaaaaaaggaactatggagggctttcatgccagcctgaacatttattgctcaaaatttgaaaccttcacaatattgaatagaaggaataactaagttttacattgtgctagcattctatttttcatatcaacaagatcctgtggggtgaaactattaaagctgcagttagcccactgaaggagatcatcagcaaaacatctgcaggtttcacacattcagacttaaaaaaatgtcattcacaaaatttttgagtttcaacaagtctaagcaagtgtctatgaaaaatcaaatcaaagcatccttaacttaccacaggattggagcacactccatttcattacaaagaatttgtgttgtgtgcctatcttaaagcagttgctgtagttactagcaaaatgtccatcttattcagactagatcgaggtgatgcatttccttcatcaaattaaagcaccgtaaacatttcttcctttccattccatatgctgtccatttcacatcctcaattttgcaatacaatctttcattcatgtatgtagttaaatttaagagattgcaaacctggaactgcatgatgtagaggccatcgcgccctgcgaatgcctccgagagcgagctaggcccccgggggaagaaggggacgccgaggttgacgacggcgagcagcatgtccgggcggaagaggcagagatgccacgccacctgagctcccaagtcgtgccccaccaccatcaccttggggagggcgaggtgatcgaggagggcgacgaggtctccgacgatgtggaagacggtgtaggcggcggggtcgtcggggacggtggagtcgccgtagccgcggaggtcgggggcgagggcgcggaagccgcgggcggcgagggcggccatctggtggcgccacgacagccagagctccgggaagccatggatgaggagcaccggcgggccgtcggcggggccctgctcggcgacgtggagggagatgccgttcacgtcagcgttccagtgacgcaccacctctccccccattgctgcctctgctcagctccaacaaatatatactccattccaacaaatgtgtctgaaaattctgcctgtttgactttgaaatttacagctgaagatcaccaccacagtttaattctccgatgaaaatctatcaccacggttgaattatccaatgatgaaaattaaaagaatctacagagaggtcatcgtcacagttgaattatccaagaaaataagaggaaggtcggtccatcaggttggttccttgttagcgctgaatactgaattgagcactgtccataatttagtccagcgcatgcaacaattcacaaactctccttgttaccacgaatcaacaacaaattgctaaacgaacaagtagtgagtggagaaaataacgaagcccgtggctttgggtgccgtgcaaaggaaaacaaattcatgttgaaagccaacagagaaatgtttagatcgacataggagacatgagaggtggtaaccaatgaaaagaggaagattttgatgtaaaaagaagagatatatcaccataactgcaacttgacaactcttacgtactaatagatgagcaaaaacagacataatatgcagcagatgctggatttctgtggagacgaacacagaccgggaattgagaatcgacagaaaccgaacataaaacaaagcagattatggaaaaattaagtaatcaatcatttgcgcaagaatactactagtactgttccaataacgagcaacaattaattgcaaggctactcgtcgtcgtcgtcgtcgtcggtggcctcggtctcctcctcggcgtagccctgtttgacgtactggtcgatgaggagctgctcataatcgttcatcttgcgatcaatgaactttgcgatgccgtagagctggcgatatgacgcggaacaattggcgagctcctcgtcggagagaggctcggtagtagctcaagtagactccccgtagttagccggcgccgccccgaccgttgccgtcgctcgccgtgtgctcgccgccgtcgccgctcgagctccgtagcacccacacgtcgccagcctcgctcggcgtagctccgtccaatccgacgctagcatcgagttcccgacaccgcgtagatgctctcaccgccgggaatcggtccctcgtgacctcgtcggcgtttccctcttccctccccaccggttgtcgccgccgcgattcgccgccgtcgaactccctctggcgaatccgagccgttggctcgtctcccctcatcacgaacaaccgcccggtgtgctagcttttgcccgtatcgccgtggttcgctccgccgctcgccgccgccgcccgccgtccattcgcggccgggtcattgtctacctcccgccggcccgcgtggcagccacgtaggcgccacgtcggcgccagctcagcctagaccgggtcgagccgaccccggtcagtccctccccgtgcgcgcgttccaccgcgagccgtgaggctgcgcgtgggcccgctgcatccgcgtccaccgcgaaccgcgcgcgtgcaccgcgtccctcccccgcccgcgcgcatgagccgcgtactccctccgcacggtgagccgagccgctgacaagcgggtcccacccgggaccgcgcatggtgagcccggtccaccggctctctctctcctccctcccgcgcgcgtgcgtcttgggccgctctgggccaccttcttgggccggccggcccgttaagctcggccgagccgccctttctctcgggccgcgccctagccgcccgagggaagtctatattccctccctctcccctgttcttttcttttcttttccaaaaaaaagggatttaattaaatccttttcctttagaccaaaaatccaataatcttagaaattcaatatctttccaaccgtaaatccgtttgactccgttcaaattccaaaatttctcaaatctcgagatctatctaatggcacgcttagaggtcattaatagggctttattttcgccgtttgttgagttgtcccgttttgcgtgtagtttcggagcccgaagacccgcagtgcgaggatttcgaggatcaagctccagatctcgagcaaggcaagccacctttgaacatcttgagcctatatttgaaatctaattatattgcttgcaaaatattatgcattgataggattgcacttaatctgttgttccgtctgcaaggcagattggcagacctacctaacttgttgcatttgatccttccattgttaattgctataccatgtccccttgtaaccatccagttgcgcctcgatattcgtgcaccctgtgccagtatcgacggtcgccttcaaacttaaaatctgagtaacaacttgggtaaaactggagttttacaaaagacttggaaaacccaacacctgggtcggtgcttgtgaactaaatgaatttccaaaaccgcggaccggggaacgtaccgggtgtacggtttcccgctctcgcacttaaggaccgatttcttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcatagtttggtttgactactgcttgtgaaattgctgtgtgaaaaggggttcggtgtttgaaaaatctgtagctgatgggatcagctagggccgtttgaaaagttgttggcccgggtggccgtttgaaaagttgttggcccgggtggccgttgaaaaagctgttgatcgggtgccaaccttgtttaaattctaaagactgatacattgcacatactccgaccggacgagacgcactgtctcatccgtgtcgtttgagaagcactcacttagttgcttcagaaaagagttcaaataaaattaattgcaaaaacaccagcctttccttgaagcctgcattaaacacttacttcccatggcttgccgagtactcccgtactcacccttgctctatataaataatcccccccccagttgctgaagaagatgaagcggatcctgctgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattctgtctccctgtgataccagcactgtttcctgggactggtatcgattaacaggttaatttggagcgtcacgggctagttccggtcgggactagttcggggcgtgacaatatgagagcatattagattagaccagagcctattgtaatttatggttaaaaaggaaaatagaagcaccaatgagcattttgatttagggatcgcaagttaatcaccatattatagtattctaaattaggctcgaatagctattagaataacacactttttattatttacagttctccctagtttccatataatgatctccagcatgatttcatatgtggatccatcacagaagaataaatcaaggcaatggcaaaggccgctagactagatgtttcttacagtcatgcgtctagcaggatgggttggcagacaagtagtaactgtaattggaaaaagataatcctaagggtataccagaggctaagcacgctgttcatacctttcactgcagcggtgtgaagatgagtgacatttccatttgagcgaacttgatgcagataagcgccatgatcaaggaggtatctgatgcaggcaggcagctccaggggtgtataacctagcaacaagcgcgcgcacacagttgaacaaataaaagctcgtcgagccaagcaagcatccaagacctgtgttttcaagggccaagtgaactaatcgggcatgattaccctgagcagtgtcaggcggtggcgtccattttgacctcctcgaccaaatactggtaggctgacacctcatagatggtgagtaaatagcctgtagtcatcagctcagatatgctagacagcctaatctccttgtaattttgttgcacgcaaaactaataaccataagcaaaataattatctagtggcatgaggccaaatgtaattagatccttctctcaggtaattaactggctacacagaaatgtttagatcgatccacataggagatatgaaatgtaaccgatgaacagaggaagactgaaaagaagagatgtcaccataactacaacttggcaactcttactaatagatgagcaaaacattcaatggtggtcctgaacagacataatgcaactaatgctgactttctgcagtgatggacacgaatgcaaaaacctgtaatggacaggatcggcaaatttcatacagaggaattgcccataattgattccctccaaatatgcagtgatggaatcaaacattctgatggccacacaagacaataaaatttcaattcattggcaatatgagatcaatccttagaaatgtgtgcactcttgcattggtgatggaacaacttacttatttgacgaggaaaacagaatcatgtaacagcttaggatggtaaagccaaattgattaacatggaccgagaagtgaaagagtagccagattcaaccgtacatacagaaacaaaacagattatgactagagtaaatcgtttgtgttatctgaccatcgagatgggggaatctcaactaagaatactagaattgttccaatcagcagcaattgtaaaactgtacttcactagcataaaacacatccattgactcattcattccaatacgatagctggttcaattagtatagcaaggtgtaatatcaggaaaatatatagctcaagtagcaaagcatgcagtagcaaataagatatgagatgataacacacaccaagaccagagtcattggcgagcagacacttcacttaggaaggaaggataggtggtggatcacacagacagacacagggacacgaagatactactccagtaagcaagcaagcgatattacttagggtagatggatcttgcaccacaacacagacaggttgctacttctgctcctcctcctcctcctcctcctcgtcggagatctccgcctcgtcgaacgcatagccatgtttgaggtactggtcgatgagggtctgctcgtgnngcaacatcttgccatcgatgaacattctgaggcggtggagctggcgatttgaggcagaacgtcgggccagctcctcctcggtgcactccgggtaggtgtaggg

SEQ ID NO: 76421 - DNA, 10074 bp, Oryza sativa
aacaaataattaagctgattaatatatatttgcgttgtatactactaattagttctgtgcgtacgtgcagctgagagatctcatcaggatatgtatatatgttgtgtacgtacgctgcccgaaaagaagagagagagataagatgattaggaaagcatttaattatgaagtggaaaaaaacctggagagagatcaggtaggtggctagctaggttaatgtctttataaattgatgatatgcgaatcagaagataatactaatatacggagtatatatattaccaactccaggtctccagcgatatatatggaaatggaaaaaaaaatcttatctctgcataactgcattattttgctagctagtggagtatatataaaatttaaactcgtcgattccgagcagagccatttaaatttcatatatataaaatttaggatatcgctcatccctgaaaatagaatatatttttctagctagtgcatttcatgtttcgtctccattcactggctagggtattgtactattaattgttatccaaatcatgcagatatatatggctttgttctaaatatatatacatatagatatatatggcttgttaaaaaggctaaccgagtttaaaaatatggtcatcccacgctctcttgtccacatgccaaaattgtcaagcgcagggtagttcattgacgaagtcattttacaatagttcgtatgcaaaccaccatttaatttttattatttttttaaaaaaatatactcctatctgaaatgcaggggaaggcatattttcactcgtggatcttgggtcatatatatatacagcctaggacggtaggacctatgttattctgttagaactcataaattaaatagtaccttatggatttaacttccagcttattgagtttatgcctaattttggttactaaaaagaacataactaaatgctacgtactgtaccaatgatattgatgtgtgcactaataataattaaagtatgcaagcttcacctgcactactactttcatttacctggcttttgttgacatgaagaaatataaataattaaataaagttgagctgtgatcttatggcggcatatacgtgcttaattagtacttcctccgaatttcctccgtttcatattataaaactttgtagcattgtctacatttatatatatgttgataaatttagacatatatgtgtgtctaaattcattaacatatatataaatatggacaattctagaaagtcttataacctgaaacggagatagtgctcacttaatcactcacttacgccaccctcgacgttaattactagctctctagcttgtcgccggatgacaaccaaatgcttaattaattaattagtaattaactagacaaggattagtgattgtttaagcgcaagatttgtcctgcgattattggctcgaggtctttaagctagcgcctgctgcatgctgattggattggattaggtagtaggagtatagattaaatctggggccagcagcatccagagatcgagttgatcatgcgtatattttacatgaccatgactactctgctcatggttagtgcagtactttgattaattagcttattatattcgtctccaccaattaatttaagggattcgtcatgatacgctgacgtgaccgattgatcgaatatgcatgtactccatgtatttgcagatgtcagtgtgtatttctttttacatatgtatatgtggacttataatttaattaattcatctcctttaattagtcggatcgatctgttcacgcattcattcgacgagatcttcccctgcttgtttttttctagtttattatataattcaaggcatcttgattttattggttaatgctagctagctgtatcgccaattaatcagttcttgaaaaaactgcatgaataaccaaagggatatggcacaagtagcttagctcatggttctcccaagcaaaaaatgttgggtgtgtttggctgcgtgttgcagtgctgtttggcagcccgctgctacttgcctactgcagctaatgaattactatactctgtcccataaaaacgtattctctccgtttcaaaatgtctgacgccgttgactttttagcacatatttgaccgttcgttttattcaaaaaaattaagtaattattaattttttttatcatttgattcattgttaaatatattttgatgtaggcatataattttacatatttcacaaaagtttttaaataagacgaacggttaaacatgtgctaaaaagtcaacggtgtcaaacatttcgaaacagagggagtaaactatatctactaatctgaacacgtatgtgtctaaatttatagttaggattagacttttttttttttaagacagaggagtagctctaaactatagcgcagcgctgtaacatgttgccgaacagttccattagtacatagtatgttactgtgagaactgaaaaagtaaccataaaagcctacaaattgccacatagtcgcaggacaaaagctgatatggacgtgagcggcctatatgctatacgcgtggcgcagctacatgcattagctagcaagatgattcacgtgcgccattgcatacatatatgattatttttagagatgtgcttctatgctaaaaaaaaaaaaaggttaattggatccgtgccaccgtaaatgtggcaaataaaaaaatgccacacatatttacgttattggctggatgccactgcaaatttttaaaataagaaccatgccactccgtcatgattttcgtccaatccatcacattttctgccgtctccgtcttcgtcctctcgtcgtcctcgtctcgacggcagcaccagcacggcagtacgaaggcgagcgcggatggcagcacggcgcacggcggcacggcagcacggtggtggatggcagcacggcaccggcgacggtcgtgcccgcgtccgctccccgcgcccctccgcgacctcctcgccgacttcctctctgcaccgttgcagccatcgtcgttgaccatctccgcggtggaccagccgccgtcgacctcatctgcgcgggagagctcgggagccgccgccgccgttgctgtcctcgtcgtggtcgtcgacgagccgcaccgcctccgcccagatctggcgaggagggctgctcgtcgttgctgccgatggaggaggcgtcgagcctcgaactccgccgccgttggccccaagctttgtcactggtgctgccgacgcccatctcctctctccacatgaccatcctcggcagcagctgcgccccctccgcgacctccccgggagcgtcctcgtcggcggcggcggcggcctcgctcgcgaccgtcctcgccggtagcggctatgcccgcgtccgcctccacggctgtcctcggcagcagctatgccccctccccgacctccccgcgagcgtcctcgccggcggcggctacgcccacgcccgcctccgtgaccttcctcggcggctgccatgcccctccgcgaccgtgctcgtcggtggcggcaaagatcgatggttatatgttgattggtttagttagctagctagctagcctcgcgcgctgcatctgtagcagctagctagctactacctgagcttgttgggtgtttctgcctgagctccgttccgccgaaccccgtcagacccggccgcgaccgcgccgggctgtcctccgcccgtgccagccgtcgcgccagctccccatcctcttctccgttttgtcgcgtgaagccgatgcgtttttgtcgcgtgcgcctcatcggcttcgactccggtggtcgagctgctcacacgcgtctgggggcagcagacgtgagagagagagaggaggatgacggcgtgagagagaggacggaaattgtgatggagtggcatggttctcattttaaaaatttgcagtggcatccagcggataacgcgaatatgtgtggcatttttttgatttgccacatttgcagtggcatggatccaattaaccaaaaaaaacttgcacgaaagttaaagctaatcagcggctgtgattagaagcgagattagcacttaattatcattagcgaggggtaatttcgtccaaagattttcgagcccatatccagcccagtccatctgaagcgatccccacccccaccggtctaccacggcgccgctcctcaaccgcaccgcctccactccctcctcccctcgcctcgccgccgctgctccgctcaacgccgccttgccgccccggcgctccgctctcttcttcccctagcccttaaagcgcgcactgcagccgcgggtcgaaccggcccagccgcgcctccagctccgcgagcggtcgatccacgcctccagctccgtcgtcgccgcgggcatcctccgcgccgtcgtcgccggggccgtcctccgcgccgtcgtcgccgcggcctcctccgcgccgtcgtctccggggaccgcctccgcgccgtcgtcgccggggccgtcctccgcgccgtcgtcgccggggaccgcctccgcgccgtcgtcgccggggccgtcctccgcgccgtcgtcgccgcggcctcctccgcgccgtcgtctccggggaccgcctccgcgccgtcgtcgccggggccgtcctctgcgccgtcgtcgccgcggcctcctccgcacggtcgtctccggggaccgcctccacgccgtcgtcgccggggaccgcccccacgccgtcgtcgccgtggaccgcaagccgtcgtcgccggggccctcctccgcaccatcgtcgccggggaccgcctccacgccgtcgtcgccgcggtcctccgtgctgtcgtcgctcgatttgggaggacattacaggatgtatgtcatttaaaggcattttgtggagggcatttctttaaaactgcctcaaatcatctctttcaaaggcaattttcataaaatgccacaaaaagtatttctatacatggcaaatttaattaatgccttcaatacttttatcattagaaggcgttttaaagaaaaacgcctcaaaaactctgtgctttcaaggcaatttcattagcgccttagaaaatctcctatttcagacgtaatcacggaacgccataaattttatattatttgggggcattttgcaaaatcgccagggtaacagatagaaggcacttttgagagaaatgcctcctaatctataccatatatgcaaaaagaatcctgaaagaatttaaggtataaaaattagtccttccaccacacgtatgctaccttatcagatccgaatcagaatagatcgatcagatcagatcgaaaaaaaaaaatctcacgcggctagcgagcgcgcgtgatcgactcccggccgccgcccggtgactcgccgccggcgaccgcccggcaccccgcgcgcccgcccatcgcccgtcgcgccatgccgccgtcgacggtcgaacgtcgcccattgcggcgtcgcccatctccgcatcggcgcatcgcgccgtagcgccgcccgttgacctagctcatagggagattcgccgccggtgagcgccctgcgtcccgcccgcctgctgcccatcgcggtgccgccatcgacgctcgaccgtcacccgttgcgccgcctcgctgcctccaccctccagcccacggcctcacgcgccccgagcccacgacgccgccgcccagaggtccagcttccacctacagacgaagccacgcgtgaattggtaactcttcccctcatccactgcctaaatgctaaatccagggatggttaggaacatttttggtttggaacttaggatttagttaatagttgaatttaggctctctcgatctattggtgatatgatttaaggtgtgtgaaatgagaattttagtagacatgttagtctccatctctacccatcacactactgtttgagcacgatgatatcttgaggtttgtgcttttccagttgggttgaatttacctcagtttttcatgcattgaaggtgtttgtagtaatgcctaagcgagtttttatggttcataactggttcggtacatatcattcatacagtgagctatagggaagcaatttcttacactgaaatagtgttccaattcattgtactgaaattgcagtgttcataacaagcttatgttctactacgtatttgcaactagtagtgaacttcagtgttctgcatgtcaaagtgttaggtgcagtaactctagcatccaaaattccaaacgagatgtttgttttatgtttctcagagactgttctgcacagttcaataatcttggtatggaagtaacgcacgagcgtaatactctattttctataaaattagagttagttttgttgtgaagcataagcatgattgaataggaactctattggcagttttatcacaagaaatcttggtggttataaccttataggaacaaaaatatactatggtttgtgatgtgatctgaacttagtgattcattatgtatgcgtgcttagttgcaggggtgccttttgaatagttgggactggatttattagtatattaattagtatatgactcagaaatgttaattaggcaacataactggtagtatattggatctgactggttagctgaatatatagttctttgcattatgagaggctcaacgactaattggatcatgtattttggatgaagccaccatattggatctgctcttttgttttctaaaacagtaacaatataaatccattggaaatgctactagaacctttatgttcactttaatcttgatccaaagattagaatgctagttttctgtgggatattctacacaagtttttcccccataaaatttatgcacagttataatttgggttataattttctgcatatgcctcactagatttctgtggtttgatgatatgtttgaactttgaagagttgagctgctatctgtcggactgtcacaagtgcaaattaacttcgattgattgatcatggataaagggtggatgaaaggagaacaatacatgatctaacatgcaaggataacataggacatgaagatgtacattctaggacaagtactcttggaaaagccagcgctggttccttaagtgctatcaagttcactaatagccaagtgctaacaacttcacggttctagcttatgaaagtaagtctcctatcccaagttcgaatgtcttttctcaagaccatggcaataactctgctgttacatgataagaaatagaactattggtctggatatattgtttcttactagtatttaagtggatttgcattgtaaaatgtagcaactcattttatggacaattataatttctgcagatacctcatttgacttgtattacagttattttcccctagatactttcatggtgcattccccaacaattatactatatatgtttaaatcttacggattcaggatatttttcatggtgcattccctaataattcaaaatattttgggcacctactaatgattatatttacttcagtgctggcctaagaatagtaatcctgagagcaatataggatagtatgttatggttggttagctgaggaacactgagacagtaagtatcatctctttgtgtctctttgtttgtttgcattatgttctgtttaaaagagtatgtagtcatgtagaatgcaatctgactcaaatcgatcaacaatttgttactttgattatgtgcactgtatatattgtgaatctaattcatgtaattctagacttattcaacttgcagcttgagagttaaatgttttgaactgatagaaaattggaacaccattatactgccacatcattatactgcaacatcatcaaaattggaacatcttgatgggacactaaaatctgtagttttgcaataaatgcattgctaaatcttgtattgatggaacattaaaatatgtagtcttaatgtatatttataatacattgctaaatttgtagtttttgcaatactgtgacttgcagctttttgataaatctagtgttataagcttggatttgttgttgtatgatttttgttttgtcctaatacttgcagtttcatgtaaagtacactaaatcaaatcttttttttttaaaaaaaaaactagttttactggaaactggctttggttatccattattttgtctgttaaccaaacagaccagcaattttccaagaccctgctagacctggtctctacaaaattcataacccaaacaacctaaatctttcctactgatttcatatgtgttgttgctatgcattatatcaaggcaaagcctctttttaggctggttgcctgattgtaatggtttgataatcttgtatactagacgtttctttttctttatacttttgtattctttaacagagcacaaaatataattggaacatcatttactatttttaccaccacccaccttctcaggttgtcatggagcacaaaatatctaacttttgctgtccatatcatacttcatcattttggttcttttagaaagaactttgctcaagttgtcccgtgtttattacagcatcatatagcataataaagcatatgtatcatcagatgtttgaggtatgagttatgaattatgtatctgcactgggaatcaaatcaatagttgatcatcattaatcttttaacaacattgatcattacgatgattaaagtgcaaaaatatttcatactctgcaggcaattattggatttcatttttggattaaagacatgtacgaagattatcgttatctggcaagtgttctgatgccatcagaaacaattagaagctatcacgtcaagatattcaacaactgcacatggccctttattgatttgtttgtcttttcctctcacttgtagccagtatataacttcagtgtaacagaatgttatttttttagttgtaaactgtgatgtgagaaatagttggaaagatatctaaaaaagatagcaaattgcaaatttttggtgttgaatgagcactaatattggtttgattgtaccaatatatcagtatgtaattggatgattcattggccacaatttaggtttttttattagatgtttttttcattggaggcattataaaaaatgccacaaagcaaagatgaaggcattttgaataatgccacagatacctaaaatggcattctggaaactgccctagtaagctctaacggcattcttgaaaacgccaggctagacactttttaaggcgtttgtaaaaattgccctggattgcttttcccgtcgggagtaaatgtggcatttttcaaactgcctctaaagaccattcaaggcgtttttttgactattcaaggcattccaaatcgcctcctaaagtgtgtcatcctgtagtgggagggggaaggcgtgggacccacgattggataggcgatcctggctggccaaagttggccagcgtgaggccgagtttagccagccaagccatccggctggccagtctgttggagtacatttttggcctaaaattactaaaatttagcttggagagtgagataagtagactgttggagatgctcttagcaggttggctgacaaattagtgacagtggtttcactatagcttggtacgcctttaatggtgcggccacgtgacaatgtcctcgtcagctggcccgtacatacataaattgtgatccactgcatcatcatcgatcgcctctgtatttggaccgacgcaacgtcagactagcgtgataaaacaacactgttatatgaggttagcaccgttgtttttatctcgcgtggcaaagaccgggcttaatttgtcacatactcctattaggttgacatacacggctagaaaaagcatttttcctaacgtaggggtctcatttttgcagacggacataccccttagaaccaaacgaccgcctaaaaaatatatatcgggatgaatgtgccggtccgcctgcgaaaatctattttcgcaggcggaccggcacattcatcccgatatatattttttaggcggtcgtttggttctaaggggtatgtccgtctgcaaaaatgagacccctacgttaggaaaaat

SEQ ID NO: 76422 - DNA, 6719 bp, Oryza sativa
  unsure (1)..(6719): unsure at all n locations
attcctgcagcccgacaattagtgcaaatgcttttccttaaacctaacgagaaaaatcagaaaagcatgttgtgccaacacataaagccttgagttccttcagaaagacacaggacaatatggtcagccattcctttatctctatttgaagtttttaagtttctaacttttttattaaagcaaaaaactgtgtggatccctattacagtgacttagaacttatccttttccatattctgttcagttttgctaattttggaacataaggcaaatttcctatgcagagagattatagtaaaacatgagcgcaactcctcgagtgagccatgaaagagcacccatcaatccaaatgttcagtgctcaaaatatacactcatatcatggtttatctagacaaagttgcctcgtaaaaagaacagcggtcagttttagtttctggaaaggttcaggacttgaggttggggagtaacatgatagtattagggactggtcgcataccatgtgtactccatcccctcagctggtgcttgtacgacacagtgagctccagcagccatagctggtgagacataagcgccaacgccaataatgcttgaactagtaccaccaggagcaccgacagtgtttaaagcaggaccattgtttccagcactactaataaatataatacgatgcttgtctacaacctgtgaaacagtataaagctccagttaagattttacagagcattctaggcatggataagaaataacaccacattaaaggacccacctcactagcaagatcaataaatctgccatagtcaggaagaagggtaggctctccatagctcatgttaatcagatcacatttgtgctggataaacaacaaataaaggaggcattaaagaaaaaataaagtaactgaagttcaagacgtgaatggtagtgaataaagaaaaacttaaatatcaagtagaacaagaggtaatacatgttttgatcgaatcattgatcctcaagcactgagcacttagttgggatgtatttacaaaataattgcattgaacagaacagattcaagtacattttgttatttattctgatgaattgatacaaaaaaaactaaggaagcgtaatcacctctactgcagctatcaaggccctaaccaggcctgtccctgtctccattgatcctaaacgggtatcgccaatcttgcaggaaatcagttgtgcacccggtgcaactccattgagcaaaggttcctgtttaaagacattgtcaacagatcagtgccattataattttcataaaatgaaaatcaaagagtcaaggacatacatcaggatgaaaagcagctgcaatgcccgcaacatgggtagcatgaggagagcaatcagttactatactaacaaggtttccatcatcgtaaatgtttgctacaaaagagcaagcatctaatttgctaaaaatcccaaacttccgctcaagtctgcagataattttaaataaatcaggaacacaacacattgaagataacctttcagtttgtacatctaacatggatggatggaataagataagatacaagatcagcatcttgtactctaaacaataagtgaaacatgggtaatacaatgtttatgcacttcataataaagtactatttcatatttgatcaccgtcttctaggtctctgactctacatgagatgcatgcagtttcataagttcaaattgggcagcaggtccagtcagaagaagggatgcagcaggaacagaattataatcgtataaaactaagcgagagagcacacttttgattaagggcttaaaagaattagagcttgcatttcagagaagtattcatgtgcctacaacacacacaaatagaaaaccaacaaataatacatctgggataagaaatgagcaatgaaccatgtgtctgcaaggaaggttctaatttacaacatcaataagaaaacaagattgaccatacctgtagtttgtcaatggaacaaaatctgcaagttttccacaatttttgttgccctcaaggccctgggtatcaacagcaaccctccacacatcaccatcgtgccatgcaacaatatcaattaccggccccctgtcatcgtaaccctacagaaacaaaagtaagacatataaagtagcagacgttggctaaaacttcacctcatgctatatgctcgttttccttacttctgcttgtttcctcaggtactcaagcctgctttgcaggtcttcacgagccattttttgtttggcgtcatcagatttactgtgtttctgcaataattttttaatggggttgagacattcttgcagaaagtgctcacaattttcatagaaggtagtgcaaagcagcaaacacttccccttaattaatacattaattcaaacattagcaacacataggccatttcacatttacttttatttacatcctacacttcaatcatatgctatatcacaaaagttcacaataattgacaacagcaaccgtgcaaactatccataaagaaacagacgaaagacacagggtgaatgaaaactgtaacaggagtgaacctaaaattcctaaatgcactcaaagaaagtcatctccaaccttttcgaattcattcagctgtttcaaggcctcagatattgcttcttggttgtgctcgtcccatttcttctttctttctttctgaagtcataatgcgtaagttcttacaaagatatcttgttacaaaccttcagaatgcaggcaccaagtacaaagtttaccttcaaacgagaggtaagtgtgtccgtgaagagttcatagactaatttacagccaacatgccactcttgagaagggttcttccatgagggatttatagtcagatgggtgcctgggtgaaagcagagttagcgtatcagttaaggcaggaactcaacgttcagaatatggtatttctgtagacatgggcccctgtaaaacacagttgatatagatgatatctttaaaacaaatagaattgatatcagaattagcatgctaaagtttgataacaaagaaaatttccacagaaactatcattaaagggaaaaaatcatgcgccaatagcttgaaattctccacgctatatgaataatataaataatgcagacctaaacggtcaatacaagcaaaataaacatgcttcaatagcttgaaattctcctatgcatgaataatgtaaacaaaccaaaaaattataagaccaacctgaagcaccaacaatagaaccatcatcatcagctttcaccactttggacgtgtcaacatcaccactacccgtgctgcacttaaacacatgtatgtgaataggctgttgaagaagcatgtcaaaagaaaaccaacaagcttcactatttcagaggggttacagcaccagtcaataacatcaaggatcttgggctttccatctgaagtagtctgcaaaccagctgcanccggatcaactccagaatctgtcacacatacaagtcaattggcaaccatatcttttttttttcgaaaccaatagacctacaacaatgaaattataataatatatacatatttgcatgaccaagtcagatatattgcagatcatccaaggactcaaacctctgacaagtaaattatatatcaaccttcctaagaagcatgcatgtagttcagtggttgtaatggcatctgaatagtaaagctttctccacatgtataattgactgtctactagcggtatagtgtcaattctgtgaaaacaaacccagttgtctttcttatttgaaatagagacatgtgtgatgtggcgatgccctatactccaacatcaattggacaagtaagggaaatttggttctacaagtgaatgcttctacattcacatcaaaacagattctattaatgccacatcattcccacaaaattcagttagctctttgatgagcgatcggtctcacacgatgaacattgcatcgatgggcataaattgccattatcaatagtaatgcagtatctacacaagtcgcaggggccatcgaactgagccagtaaaacccacagcaacaagctaaactagacttagagtaccgaaccactcaacgaattccaatctccagcctcggagatgcataaacaaaaccttaacgtggtcggcgaagagcaggggagaggttgctcaccgaagatggcgatgagcgcgccgcggccgtcgtactcgggatgcgcggcgaggaagcggtcgacgccgatctccttcttcggcatcagcgactcgaggaacgagggctcggtgaggcggaacccacccgctgcagcggtcgtcccctcggcggcggaaggcggcgaggaggacgaggaaggcatcgctctaggcgcgacgcccgcgctagggctcgggccgcctcgagtcgtagtcgaagccgccgcgacgttggaggctgcggcggggacggaccaggcggagactgcgaggaggaggcgcaggtgggcgaccggtttatgtagcgctgcggctgctgctgcggtcacggagctcctcccccgcaagtgccacatgaggtggcccgggccgattcactcacgtttatcgatttgagttcttttcagtctcagtttgtcttaatttagtccggtttagccggggaatctgcgtggaaagcacggctttaatttgacacgatgatgaggcaatgagtgtattgagtggactaacttttagctgtgacggataaagttggagactgctacactcactgccgcagcaatggcgaattggggctctgctcgccggcggcggagggcggaggctgaggccttggacgctagctgctgccggtgcctggtggttggcttgggccttgggggtacagcagcgtggctgatgctgggcagatatttcccgcgtggctggtgctggattctctataaaataaagaatatggtttcttaaagagttcagaacaaatattaaatcctaagtatgttgtgtttatggtaattttggtgatgggtaggttgagccacggctaataagccgtcgaaaaataaatgagacaacccgaaaattttaagatcagacttatacttctattctaaaatgtcaaaagccatggccgaatattagaaaacaatgaaaaaaaaggctaaaatatactccaaaattaacttctaaattctggctacgtttgataagccaataggcagatagtgatagatttagtgttttcgttgcaacgtatggaagctttgctaatgtttttttctaaaaaaagaagtcaagcatatatgaccttgatggaaccgtaactttataggaaaactcttccttccttaatagaaagtaattagttttactcatcttggtttttttcatcccaaatataagaaacaactactactaacgcaaaaaaacagaaaaaaaaatatcacatttttatttgtatcactctaataaatataatatatgtatcgagggtgaaagatttaaaaaataaattcatgggagaggaatatggtaatatattacatgcatacatttgtgtcttatattatgaaatatatatatatatataagttaagcattagtatattttaggtggaggaagtacttctgagttcaatgggtgtgttcggctgcccaactgcagtggctatggtagaaattatgtgttgctattgtagctactggctactatctagtagtcacatcgaacaggcccaatgcacataaatgaaacttaatccaagcactacactgcaacataggaaaagagtggtgtaatattgtaacaaagcaaataattaacaaatttgcttacagctaatctgaatgtatagtttatagttttaatttaactgagatttatttgcaggtttaatatctagtggtgctcactgttcgaaatgaaaatcccagtatcggttttcttagccgatagcgtttcgttcttgtagagtagataattggattttgattgagttatttttctaagggaaaaaggaaaaggaggattcaaaatccttttttcttctgactttcccaaacacaaaatacctccttgtattcgcactctcaaatgagagtggaagaaattcgactttcatataatatcttaatagtaacccacaatagagctatatttttccccaacacaatagataactgtaatccctctacccacaatagataactgtaatccctctcccctcgagaggcgcttccatgcctcgcctgcttaatttggagtagcttttacctgagaaattatcaattatcgtagatttatcaaactctgcaacgccctttttttggtgcgtctttcgaaattcctatcttagaaaaatgagcatcaaatttccacgtatcaaatacacaaactacaaatgttttggaataccaacaccaaagtatcttacattctcgagctttgttgggtgccaacttttacaaaattctcgggctgccagattgctaatactagctttcaactggcagttgccaataaactttacagcgtcccaggaagaacatcttaatacacgaattgggattacagtgttctatgtatacaagttcttgaaaaactaccaactagaccccttcgtgaacctattttcggcagttagccctacaaaatgcaaaatggcaccaccattgattattgatcatcgattgattcgcacattatggtatctgcacttcattgcccccgggggg

SEQ ID NO: 76423 - DNA, 13984 bp, Oryza sativa
attcctgcagccctttttcagctattcatatcttagctgctttatgagagacagcattataatcagacttgaattttgtggcatagaatgttatgatgtaaactcaaataattgactgcagattctccaccttgctcataacaaaccggagatagagcggagggtccatgctgtgattgacaaatttgcagaacgtggacttagatcgcttgctgtagcataccaggtgagaagggttacagtacaccatctatcataacctgattttcactgtgcagcagcgatggtatcatttcatgaacaggtttaaagtaattgtagattttagtaactaccaagtcttgtccatgcaaaccatgactttcctctttcactgtttactgcgtacgttatcttagtggtgtgttactctgttgttgaatgtaggaagtaccagaggggacgaaagaaagccctggtggcccatggcattttgttggtctcatgccactttttgatcctccaaggcacgacagtgctgaaacaattcggcgggcacttaatcttggtgtcaatgtcaagatgatcacaggtgcatgctcaaatattctgtattgtcagttttttttcaggcttatgcaggaatacagaattctggagactcgatttatacaatcaactttaaacaaaaaaaagaaaaggaaaataggattcacatgagaaccaaatagtacaatgtaagaacatggtcgtgagcacccagacctcaccaggaaattctgttctgctgttagctggccagatttttcaaccctagttctgtgctttccatgggatgatccaaattatccgtttgtctgtttggtcactttatttttacagtgaacatggttttgatgcagtcctattgataaatagaacataactcagattaaaaatagtatatttcctggaggtagccgttttcattacattcaaaagactgctatttgcgttcttttgtcctagtttattaattggtctcctaatgttcaggtgatcagctggcaattggaaaagaaacagggcgtcgcctgggaatgggtacaaacatgtacccttcatccgctttgctgggacagaacaaggatgagtccattgccgctttaccagttgatgatctcattgagaaagctgatggctttgctggtgtattcccaggtatggtgataaggagttattacactgcaaagattgagagttgggaaagatgaattgtttaattctaagttaactgagtgaatggcttttgtccagagcacaagtatgagattgtgaaacgtctgcaagcaagaaagcacatatgtggaatgactggtgatggtgtcaatgatgctccagccctaaagaaagctgacattggtattgctgttgctgatgcaactgatgcagccaggagtgcttcagatattgtgctcacagaacctggtcttagtgtgatcatcagtgctgtgcttacaagtcgtgcaattttccagcgtatgaagaactacactgtatgttaaagcggaatagtgttcaagtactcttttatatgtttattcccctaatttatctttctaatgcattttcatgttggcagatctatgctgtctcaatcaccattcgtatagtggtatgtttatcttgcttttacttctgaatgaaaacttttatatccatgcattttttaattatgtgatttaatgtgttggtatcaagctgcatcaagtctctgtatttatttatttatttgaacaattatccttgatgcgactgctagggattatttttttatgttattcagatcaagttacaaatactacgagatttcaatccataactgtccgctatgatatatatccatcttgaacactgaattgtgccagtgttctctatttgtgttacttctgagggattaattcactttgttaatttcaacagcttggatttatgctacttgcgctcatctggaaattcgatttccccccttttatggtcctaatcatagcaattctaaatgatggtaaatctctctctctctcacacacacacaccggcacacaaccactgcacatgttcacacttgctttttgacaatagaaattatgagcatataaagatattcaactatgtactgtgatcgataggtaccatcatgactatatcaaaggatcgggtaaaaccatctccactacctgacagctggaagctggctgagatttttacaactggagttgtcctcggtggatacttggcaatgatgacagtaatcttcttctgggctgcatataagacagactttttcccggtaaggagcactgtgttgagacttgagacatttgtttgtgatgatttttaagccagctatgcaagtattcttggctactaacgatggttaaattgttagtgaactacttttaggaccttatttgctttactcgctgaagcttattgtttataaaatttcagagaatatttcatgttgaaagccttgagaagacagctcaagatgatttccaaaaacttgcctctgctgtttacctccaagttagcaccatcagccaagctctcatctttgtcacaaggtcccgcagctggtcatttgttgagcgccctggatttctgctggtctttgctttcttggttgcacagctggtctgctcctactctctcactgtctccctcttatattttgcttcaggagttaaagccgcattgacgtaaacttttggtttaaacaaatacagattgctacactgattgctgtgtatgctgactgggcgttcacctcaatcaaaggcattgggtggggttgggctggtattgtgtggctctacaatctaatcttctacttcccactcgacattatcaagttcctcatcagatatgctttgagtgggaaagcatgggatcttgtcattgagcaaagggtaattaataatgcatgctacacaactgtcttggcccctcacacctattaagtttctgattctcactaatgtttgtctacctgcagatcgctttcacaaggaagaaggactttggtaaggaggagagggagctcaagtgggcacatgctcagaggaccctccatggactgcagccgcctgatgccaagatgttctcggagaaggctggctacaatgagctcaatcagatggctgaagaggcgaagaggagggcggagattgccaggtaggaggaccacactacacttgcaaaacatcatgctttcttgcgtatacgatttcttggatcctttagtattgttccacctgtccctttctccatcagtgcattgttactcatgaatccatttttgaatatgaaaagtagtatctttttttggcgccaataggcaggcaacagttacattgaacatataagttggttgataacgatgtgaagctaactttgggatgatttgttacaggcttagggagctccatacgctcaaggggcatgtagaatcggttgtgaagctcaaaggcctcgacattgagaccatccagcagtcttacaccgtgtgatccagcctgtccataaagaaagaaaaaagaggattattttttttccagattttcctgtttcgctttaacttgactgcaattctgcaatcacctacgtgtacttgaaccgaattgctgtaatctttgtccctcctgctccagctttctactacatggtagtgttatataatttttggtcacctgaaaatatataagtgtttgaggtgaagcacaatggcaatgccagagtttttttgctcggttactgagaagcatgttttcataatcaatcggtcaattgtatggacatattatagatgaatttggtaactgtttgtgtgggggcagctggcagtatgtaacatgtgggcttcaatgtatccaaccaagaggcaatgaatgaatgaatgaatagcggtgactctggtcctggactggaaacggatctgtttgttgttgggttccagccagatctgtagtgaggctctggctggctgatattgttgtctgccatgttgcctgtcaagtttgcaaaaactgtgggcacatcacatgagatgagttgagagcttttattttctaagctgcttgctgcgttgcatgcaggatctcgaatgatgcacgcttgcttgagctgtgcctgtaccaaatgtatgtagtactagattgtgtatgtactatgtattctccagctgccgtactgtgcacggataattggtttgtctcgtctggtctggtaaatagagaagtccaagtgttcaattcacagaatcttgttttgtagcaaaagtaatcaaatgtcatgagatttttcctttttcttgaataacaaatgtccgtcctagggacaatgtcacatcagtttggtatatgtagaagtgtagtaagaatcaatagattacagcacattcagaaacggtgatcccaacttaaaagaaggccacggcccacggcccacgacccactgaaatggcaaagcccaaagaggaccaaagaggcccaaataaagatgaggcccagaagcagaagcaaacaccatggttagctcagctggaggagagccaacaagcaaaaatgccgcagtggccgtcactccagctgcccgccgccgccgccgcccgccgcgccactcccttcgccttgtgcaggagctcgtcgtcctccgtttctgcgtcagcgtccaaccaggacctggtagcgtgttcttggcaaaaggaggatgaggccgaggcgcagtcgttggtggtggtgggcggaggcgccgccggggtgtacgcctccataagggccaagtccctggctccccacctcaacgtcctagtcttcgacaaaggaaggttcttgtccaaggtatagaaattctctttgtttgttttaatttctattttccatcaggcactacttcctttccaccgaatatatcattgttactgttgatttgttgccacttccgacgaggctgctgtaggtcaagatttctggtggtggccgatgcaatgtcaccaacgggcatcatctggagccattggtttgttcttgtccacactggatgcatatgctctatcctatcgtctcctttgttcactttcactgtaacagactgacagttgaattcttgttcaggggatggcaagaaattatcctaggggacacaaagaactcagaggatcgttcttcaaaaatcatggccctcaggatactatgcgttggttctcagatcatggtgtcgagcttaaggtatcatagtcatgacaccaagattattaaataaatcttttacatccattgatcatctattagtctgaacccacccggtcaagttattgatgtcgtggctgtttctattggttcgatttcatatcagacagaagatgatggtagagttttccctgtcactgacaattctgcatcgatagtagattgcctactgaatgaagcaaggcgacttggaggtatcttgtcctaattgactctgttgtttattcatttgtcatctgaaatttaaacaacaatcgaatggaagtttccctgcaggctggtaaagctgtgactggtgcatctgtcactgaaaatgggaagtttgttgtgaaggttgagaagcgtaccgttgattttgtggatcatgtaaacgctaaatatgtcttagttgctacagggagcagccagcaggtttgagaaaagatgtttggctcctcccttcttgttattgatgtataatacagcataaagttctcctcctttacatttttcttacctgcagggttattcaattgctgcacaatttggtcactctattattgctccagtgcccagccttttcacatttaaaattacagacaagcgattggctgacctctctggggtatttatccatgaatacctttgtggctcttatgttatgaagtagcaaccaagacttgtaaatctcgttttcatcactgttatgcttttgacaacaaaacaatcatgtattgcatatgaagagtctggagttaacatgtttttgtgtgcttccatggtctggtctaggttccatccgagtttaagcatctcatgtgcatatgtatcctgttttctgtctgatatctagtggaaatcacaaatcaagtggaagcatggaaaccctttcagaattcacgttagcttgctgcctcaatggatttttcatgtttctgtctgtgcttttcactagaattgcagtaaacattactatgaaacttaaaacacctctgagtttgctcctaaaaggaggaaagctgatattgtagattttttttttcaagtcaattggacaagagctattcaccccattatctcctgccatgtaggtcacattcccaatagtcaaagcaaaactgaagctagacggcattaagagaagtgctcctgaattaactcaggtgaacatgtcaacattcaattgtttcatagatgtttgcttacattaactgcttggtctttacagattggacctatgttagttacacactgggggcttagtgggcctgttgttcttcgtttgtccgcatggggagcacgtgaactgcatcagtacaactaccaaggtaagatgcaatggaactatgcaggaattgcactacattcgcagcctactggtaaatggcaacacaattttacttgccatgtctgtctgtttccgtacttgcacaagttgcattcagtagatccacaacagagcctttttcttatcagattgctgttttgctgggcatccttatgaggtcacttctatgtagaatgctaaagtcgctgagttattattcaatgagttacgcatggttgcaagtttcataacaaatgagactactggtatctcatattaggaatctttatgctgtcagtggatttggacaaacttaccttcatttgaaacacttctcttgctgtttgttctcttggatcatatgattcttcgatgtattgttctaacaaacagtaaacagctaaagaatggtctctccaccttctgagccaattagctttactgtttgactctttggcagctgcattgagaatttttatgtttcatcaagtatctgaaattttccactatgataatattttacaattatatgtaagacagaagtaaatgtctatattatccacttcactgatacccatacatttcttccaacacagcaaagctcaccgttgacttcatacccgacattcatattgaggacgtgaagcgcatccttttcctgcacaaagatcaccatgcggttcatttctcactcttgtgctattccctttacatgttctattttttttttataatctccttcacgcattcatctaaggatctgaatttctgatgactaacattacacttgattgtccttgctttaataattcagaacgtgtgtactaaaaatagacacgtgtacaaatctctgttctatttgacatattggggtgttttaatcaagactttagatggattctgtaatctgttgcagaaatattccttgtgttcctgtgaatgttctaattgctgaataaaaaaattgcaatgatgaagttgaattaacaagttttagtccttgcagaagcacaaaataaacaactcttttcccatggagttcgctctggtgaagagattttggaaattcttgctagaacaggaggtcataatattactgcggtgctctttactcattcctctattttaattgatggtttcatcactaaaatcttctcgcgcagagtttagatggtgatatgcactgggcgtccataccaaataataatctaaacacagtagcccttaggttaaagcaatggatgtttgaggttgtcgctaaggtatgtgatatcttaatataccaattgaaaacataatgagcgcaatcatttaggtaagaatattttttgtctgtccaaactcacagactgttatctcatcatcatttgtagggtcaattcaaagatgaatttgtcaccgccggaggtgttccactttcagaggttattagtcttaattggttgcagttttcatcaaaactgaatcaacttgcatatatatatgtctaatttgctgccctgttctaaagatatcgctgagcactatggaaagcaagaaacagcccaacctgttttttgcaggagaggtatacatttgttcctgaacttgcaacactctggatcagcaagagaacaattgaccttagcatgaccgtggtgcaggtacttaatgttgatggggtcactggcggattcaattttcaggtacgcattacaagttcccttaaagaatttcacctattttaaaagatcgaactgttcattagagacttggagatctttacatacgacaaagcaaatttcaatctcatcgatcaagtatagcacttgaaataatagaatattattttgattaaaaatgtttcacttattttcaagtagaaaacatggtttgtaactataatctattctacattctccacagaatgcatggaccggtgggtatatagctgggacaagcataggaacattggcatcaagcaacatgaggcagcaacagccatatttgcaactggacggatcatgaagtatcacactgcaaaaaggactcctgcctgttcttactactgaagactaacattgacaaatgacattgtagatgtacatagaggtcaatgatcgattgtagagatgtacccgtgaaacaatctcttgttattagttagcaaacaagttcagaagtagtggattgtgtactctgcacagctgtgagcaaatctagttgtcatttctccaacataaaatcagatataaagttacactcaaggttatctgttggcagtagcagctaacgagtcattcaagctcccagaaaaggttggaacagcaatggacgtgctggaacacgaaatgattctaattggctatcaattaagacaggataatctcacttaaaatgcaccaatgccatctctaaatgttatcacaaataagaggtttcaaagcataaggaatcaaagagaactacaacttagactacagaccaatctagacagatgcaccagatcatcattcttcccccaaaactgcaccctgtttagatgagtcccttatttctgactggaataacctcactagtcactagagtctctagagcagatgcatgcgctcaacataaggattgtgcagccacctattcagtggctccccacatccaacgaagcatccagtattgcctcgcgtggtgacgaacgggaattcgaagagatgtagcagcttctgaactgactgtctaaccaaggaagacccggttaccctgctcctcctgccccagccagtgacaatgtcaattctttcagggcatttgcccattgtcagaatctgcctgtggaaccaagccagtgtccttgacagcgcagtcactgcagtgccctccgacatcaggtgtaagttgatgagccaatatgatgggtccttctccctcacagaatccgggtacacattcctctgggcagcaacctcccatatgaagccagcctcctccttgaggccggacttgtgtaggaaatctatgacagcatccattaaaccccttttactctctctgtcctcactgtgcatcatgtccaagaaatatctggtgtgatccctcacattctggccgccaggttctgcatcgggcaaatataacaagaacatgtgggcagggtgtccagtgatcgccatgagctggcagcataaacccatctgtgcttgagcctcagtacaacaactgagcagcaaggtgtaggtctgcaaagatggaacgagcccctgagcaagcatgttttggagcacgctgtaggcatcttggaacctgtttatcttaagaaaagcactcagtagggaattgcaggtcggcacattgggctgcaaaccatcctgaagcattgcatgataccatcctagtgccttgtcaacattgccagctttgccccagaggtccaccaaaagaccatatacaggctcatcaggagcccagtcatgcctcatctcaatgaacacagcctcagcctcatccagatgaccacaatgaccaagaacttccatgacaatactgtatgttattttgtcaggacgaaacccggcaacctgcatgtccttgtacagcttcacaacattttcataatttcttgctttggcctgaagagcaatcattatgttgtatgtaactaggttaggtgtgcagccattttcaaccatctcacagaaaagcttataagcagctgccaggtgaccaccttttccaaggcaattaaccatggcactgtacgtgaaagtatctggtgacagccctacttcttgcatcctggtatataaatccattgcaaattccaggtatccacctttagcatggatatcaatcaatgtacaatatgtaacccgatctggctcataaccggctttctgcatctcctcgaatactttaacagcctctcttagataatttgcacgaccatatgcatgtattattctgttgtatgttacaacagttggtttgcagtgaacactgttcatctcatcaagaagtttcctcatcgtaccaaattgcctggcttgtccaaggatgcctatcatggttgtgtagctatgaccatcatgcttgaaacctggttgccgctttaaccactggaagaaaccaagtgcaatggtgtggtcatgaagcagcttgagtacttggtttgcctggaatgcatctatcttgcaatggagattatccagaacgtgttccgtcataggaccccatttcatttgctgcagtgtatggtagtactgttcaactgagcgcaatgacttcaatgatcttaagttagactgaggtcctccaccatgactctttattgttcccgcaagggcctgagatttgtgaccagaaccagtatacatagctggagctgacaagttttgggtttgaacttcatcccacctagcatctgtactgaaattgttagaatgataatttgtgtggcgctgaccaggatgtctttgattctttatttgcgatggtgaattagcaaccatagcaggaggtcctgaaaaactctggtttgattttgcatagccagatcttgatacacccttcccaagattattttgcacggaaggattataaggcatctttgcctcaggaagactatgctggttgtgtgacttgatattagaaggctgggcatccgacaagggctggtaagaatagctagtggccatctgtgaagcttgattggtgcctccattatttgatgtggacttgaggtttactaactcagtgtacacaccagctcctgcaattgcagaatgagaaatgcttctggcggtctgcttagaaggctgtacataatcatttcctagcacctgaggagttcgagggtggttgctagtgttgccagatgctggctctgtctcttgagatgagttggaaggaacaatatgaacagctggagcagggtaaccagtggcccgaccaatggatccaacaacatgttgtacagatggagtttgagcctttacagagggtctgcgagttgaatgaaacttctgctcgataccattagccgtctgcctttttggagcagaagtttcatcttcagggcatgtgcatgaagctccatcagtgctaccacaccttgacccattaacgtagaaggaccgtgcacactgggttagcgtgccgagttgctttgccctcaacatgaactgcaatattaagttcacacgatgttatcagctagaacaacctttatgttatgaatacatcatacatgagaggttctgcttgtgatgatgaagacagtataaaagatatatttgatgttgctttgtggccttgtgctcattttatatatatacccataactctttcctattatttctaaagataaaacaacaatgatgtgtattatgaagcatgttagtaacatatatacgaatagaaatgggtgtgcaggtgtcaactggaagaattgatggctatgatggctcatgctttagtttgtaacctaagttcatgtacaagcaagtctattaatgtgagaaaacacagtcaatgatataaggaggaagggacatactggttagttggttaataaatcaagctagaacttttgataatgtcagtgcgaacttctagcctccactgaactccatatggcccctcactggtaaacctgaaacaaaaatagagccaataaatatatgctgcttacaaagtattttgtttagctgtactaaccagtacgaagaagaaaaagaagaactcattcagaatactagatatgtataacaaagggggattctaagtgttaacttctgggcaactacacctatctaggcttattgatccaatctacataactggtgagtaaaatccaacgatcaaccttataggcactagttacaactgcaaagtagtaataataaagttaaatgatatgctcagaacgttcagttcgtcgaaaagccattatcttcttttggaaaaaaatgtcttttaaggcgcgcagaagcagcatgtcaaacagaaaggcagaaacaggattacagatgaagccaaacagattaatgtgcggcaactaagatgaaagaagcagcttggtgaacaatccaaaaattcgttgaagctttaggtctgcaagacgagatttttttgtttacagggaggcaattagggttgagttttctgagccacagcatgtcctttcctatcagaatcagagcattcaaaatttataattgggggctagattctacacagaactttattggattgaatttattacatcacattacaggataataattccaaaacaaaagaaagaaacccttgtttggcattgaagcagaagaagaggtaaaaggtgtccttaattaggataggctaaaataatcatccggtggcgaaaaggaaggaagggcctttgctgcgcaaaatccaaaatttgaccatggattgaggagcacgcgggcgttggggatagggcttggagaaggcatacctcgaatcgggtaccggagacggaggaacgaccgaaggggcctctttggtcgttccagccggcgggggcgcgctctcggttccaacgccagccgcgccacccagcaatcgcacggcgggagacccagctggacggcggcggtgttcggcaacccctcttctgcctcttcctcgtcctttctactaggagtagtacctagctagtagtactaggttccaaggagacatggagagcaaaggaggagcggcgtgaggaggaggagcaacaacaacgaagaagaagaaagatgcgatgcgatgcgatcccgtgtccctccctcccggagacgcggcagcggcggcgcacgggtggggtgggtggggattggggatgttccgtggcttgcgggagaatccaatcctccttcagagccagaggaaagagagcaaaccttttctctcagactcctggaacttgtcacgcaagaataataatctcaaccaatctaatctgttgttccgatttctgaatctttcattattagtatctttttattcaaaacaataaatactacagtttatcgggtttgaccgagtttagttaacaatcctgccgttagttcctcctcctaacccatttggatttggtgtttgttcgggtggattaaacctacaactactactccatataagatattttcttcttcttataagaagccgccccccctcccccacaccactaaattcatccaaaactaaacaatcctttcttcatattgcattttctttgactacatcagatattttattgaggttatacttcgtccgtttctaaatatttaacggccttgattttttaaaatatatttaaccattcgtcttattaaaaaatttaagtaattattaattcttttcctatcatttaattcattgttaaatatatttttatgtatgtatatagttttacatattttacataagt

SEQ ID NO: 76424 - DNA, 6314 bp, Oryza sativa
  unsure (1)..(6314): unsure at all n locations
taccactttgaaacggaaccaaccctctctaatacccgcccacaatgtttttatctaaattaaaagaatttagtcctatttttctgttgagttgataaaattacccccataatcctttgcatcatctaaattagtctcagctggctgggaggctagggttcccggttcccctcgcaccgatccgggcaccaccctcctctcgcgccgccctccctcccctcgcgccaccgagccatggccgtcctctcgcaccgaccctgccgccgcttgtttccgttgtggcagacgaggaggaggagaccaccacgctgtcttcccctcgcgccgccacactgtgccgcgccacggccctcccctcgtgcagactcggccgtcgccctcctctcgcaccaccgagttgcggccgtcctctcgcgccgacccggccgccgcccattcccctcatggtagatgaggaggaggagaggagccgtgctgccacccctctccacgcgccagtccgttgccacccctatactctagctcactaaccagcttctccgacggcaccacctctcacctcgcgccagtcgaggggcagtttggtcatcaaagttgggagaaaagggacaaaatgggaaaaaaaagaaaagtaacaaaatgattttgatttactagaaaggaagaaaatggcatttcagtgaacttctcccggttgaaagtggtattcgggcggatcccaattgtaggatggtattcaggcgaagccctgttttgaagatggtataatggccattttctcaacacaaggggaccagcagggagctataaatgcggagacgaaagatgatgttgtgcagacgatgccgacaccagaaagccagctcgagccgtggcgggcctcgtcttcgtgctcactcctcactgtgcgtattgaatcctatcttactataaagttatcctccactagctccttaagcttaacatgcaaggatgccacatcatcatccactaacaaggtgctacatcatcatccactaattaacaagatgccacatcatcatccactaacaatcatcacatttaaacatcatgcaaacatgctatatctttatagtttttataatttaagagcttttcaaatacaaacatgttaaattatcatccaacataattcacataatgtttcaatatatatctttattatgttttatgatatcctatatacttatatagttcatcctcagttagtgcttaaatgattaatctatgatccaaattatctttcttcatttttcctctaattaagtcatatcacatcaattgtttttagcttttagatgattaatctacggtccaaactatctccctatttttcttcttccataaagtcataccaccttactttttacgtttgaatcaacattttacatactatttaaatttaaattatcataaaccacattattttacttaatatgatgttatctagctatttttatcataaaccataattttttattttccaacggagaaacggtttgggttggttttgttccatgggttgcacggtttgagcccaaaccgtgaacaggcccggccaggtgatcagtgatctaacgtgtgccccggaaactacgtaatggacacaagatacacctccataaacgcacggcattaacgcacgtcagtttccttttcacccctcccataaacagttgctaaaaaaagaacgtttgaagatttcagaaccggaaaaggcgcgcccctcgatctaccaacggaagcccagtcaggccaccccccgttttcggcccgcccgattcttgcgccaccacgagacgagacccagttttccgccacaaccgcgttgaatccgtggtagattaacggatccaccgtatcacgagttcatagagagagatcgatcgatcgatcgatcagaactctgatgatctgacaaactccgagtcctatactcccaatctctgatacacacagatacttcccatgaagagattccccccatcccccagcgtggccgcgcgcggcatgcacgaccggcgggcgcacctacgctacaaagacgccgcgcgctacgtgaccgcgcggcagaggatggtttgggttcttctcgcggtggctcgcgcggttgggcgcggatgccggccgtgatggaggagccgatcgatcgatctgtataggaggcagcgggcggcggcggcagaaggggaggagaggatacgcatcacgcgtgggtgggtgggtgggttgagatgggagggacggacggggcgcgagtgcgagcgggtcgcggagaggcgaccgctataagtatcatcaggccccttgcccccgcgcacgcgcacgcgcacgggcaaccccccctgttgttttctctcaagccctacgaagcggaggcggagcccctcggcgcgatcgagtcgacgccgcgcgccgtccccgcattgccccaggtaagcccgatcgatatatcgttgctccgccgtgcgtcgtcgaatcgaaacatctctttttttcgatgaatacattgatctgggtttctcttctcgacgaaactcgccgaaaagattgatcttgttttcggagaaggaatcgttctcggttgtttgaactgtatatatatatatcttttgttattctttactagggaaagattgtgccccccacggccccgtgatcttacgaaagattgaaactttattagggattgtgagttgttgttgaagagatggcgagctacgacgacggaaccaatgtaagtcgtaagatttctcctgcgcatcaatacgaagaattagcagtttactgcattgcagcattgctaattgctaacatataacattgatcgtaaatggctttttccagctcgtggacgatgaatacgatgacctggatgatttcatcgtcgataacgacgacgacgtggtgttaggtgaggagcagcaagatgaatttgaggaggaggaagaagaacaagaggaagaggaagaggaagaagagcctccggtcgggcaagtggagatccttaccctcagggagcaattgaaggcggacatcaggagaaaaaatcaggcacaacagggcgccaccgccggcagggctagctgctcgtcgtcggtgcagcctctggccaaggataggtacgttgcattgcattgcagattgcactgcatgatgtttctgctgccttatctttttttttaacatgaaaattatagtttctctcccagttgttaacagaaataatcgcttgcagatttggtagcttctttgggccatccagaccttcacttgctcgcagagtcatcgaggaaggctgttcatcaataatcaaagaaaaacagaacgtaccatccaacgtatgtactcctgaacttaatcttgctgaaattggttcatttttatttttcttaaagatccagcaaacgtgaaactttgataattgaattccaacgtaattatttgcagaaaagcagtgtttcttctgcttcaaaaaaacaaccaatcccaagcgggcagcagcagaaaccgaagtttgttaaagaggtatggatcatttaggattaaatatcaccaggttatgttgcttgcagcccttaaaaaaggattacgatgcattagttttgacctgtgattctgcattggtcgtttggcatttgcaggagaaaagaaaggtcgatgcactccgtcagaatcgggattattcatgtctgttctcggatgatgctgatactccacaggctacaaaggaacaacctgacaacatgcctgttttgcctatgaaatatggtacctttttaagcttttattatgaatacatatgatatgattcctacttccttccattcctggacaaatttctcacttgtttggtattacagatgttggagacattgcatcaaccagcaaacttataagtcagaccgacaaagtatcaaaagacagcggattgaagggaccttccattcagagtcgtgtaggattagtcggaaaggagcctcatccaaatacgaagaggacgatcgcttcttctgccaaaaatggatccagcctgcctgccatgaagaaaattcagagggtacagccatcctcaaatggccagaagatgcagcaaacactgcagagcaagaggcctcaggcaatgttgtcacaaagccacgggcagcagtctctgcaatctcggaagcctaaaccatctctcaatggccagaatttcaggcaaaaggtgtcagccccattagcacaaaaacatttggctccttcctcaagacctaaggtagcagcatataacgatttttctctcgtctattcttgctcttagttcaacttaggatagaactaccaagatgccaatcctatccagaatttagatttgcaattaagaatatcagctgttcaggaatatgcgtttgaatcttctctatgtttgcagccatcaagtgcagttcacaacgatcacggaaagggaaagacaaggcgtttagtcaaaaggaaatctaaggaggatggatgtgatgaagaggaagttgactataaatcaatcatcagaggaatgttcaagtacggttgcttcttgtccaatctgttaaataatttgttagttttttcactggttatcaacggcttttggtcttcttgtgctgttgtgcagctacaatcctgcaaaattcgttggtagagatgaagatgacagagacatggaagccaattatgccagcatacaaatggaagagagaagaaggtacttaaattccacctttccattgatctacacccctttttttttgtcggcaacaatgcaatcctgttgcaaaaaacgaccacctagctagctaacatttttccgttgctttggatatgcagtgcaagacttgcaagacaagaggacgacgaggagctccgccggatcatggacgaagagaggcgtgagaagcaggagaggaagaggaaaaagctagcgcaaaaggcagtagtagatgccagccaggactgaactctttgccaagccagtagtgtagtagttcgttagcaattcagttatggacaagattagatttatctcgttagtgctgattagttgtggtgatgctcctagtttattagccatctcgctggtggccacttgaacagatcaaaacaatagcttttgtaggtcaatttgcaaataacacaacgttatttgcatatctcannnnnnnnnnnnnnnnnnnnnnnnnnnnnnntatgggtacggggtaccattgccactactacatacttctcttattgtttaggaggcgtgcgcgtgtgtttgtgtgtgtgtggggggggggggggtcgcgattttgctaagggctttcacaatacgtctatgtgtcagtagaattgagtgtgtcatgtctgctggaaatacttcctctcgacgaaactagcgcaggcgccattgtgttttagcttggagcctcatcatgtcttgggcctagcaagtgtgtatcctgcactgctactaccctagacacatagagtggtcttttgtagtagatctgtggaaacctcaactacgaccgtttggtaaggtggctggaccgttaccaccaggtagggtagccaccttgaccatgttggcgctaaagcctctagagtggccttcctttgtagatccgtggtaaatcttgacaatgaccatcgggtagggtggttggaccatggggccaccatgtaggatagccacctttcgaccgtggcagcgctctttaacactagctcactaggaggggttttgggcaatctcctttaccatagacttaacctctaagggccatgcaataaagtcacgtgaaaatagaagctgtgttctttttcacaactccaaactacaagcttcatcgttttccatttgcacatgcttcccgaattgctaaacagtgaatttgtgcaaaaaaattctatataaaagtttcttaaaaaataaaaaaaaatatttttttaagtttgtaataattaatactcaatcaattatgcactaacaagacttcattttgcgtgctgctaatatgctcctccaatataggttcaaacggatgcactcggacatcatgtcgatcccacattgaattaatgtgtatgtctatcacaagtctttccatattaaataccacattaaatgtatacgcctaccataagtttttccctattagatgtgcatgtcttttataagtctcctcttgttgaattagttgaaaaaacaggtgtcccatctaatctgacactataatacaagaaaactagctgataccccgcgtgttactgcgggatagctagggctgcaggaa

SEQ ID NO: 76425 - DNA, 14372 bp, Oryza sativa
ttttgccatcaccatcaatgtatgtcaatgctgttcttttgtcagtaggattgaatggcaggaaatgaacttcttgaataccagcacgggcctgtgttaaaatgtaggcaaatagtcatttcacaacataaccaaggtgatatcagccaccatttcaaaaaccttcgacaaagcaatatacctcttttggatcagctagcatcccaactattgcagtatcaatagcatcctggttttctgttcgtgatgctctagcagccatgagaatcacttggtcctgagtgattcctctttcaaagacctggattaacaaattgatgctttttaacctagacatgaaagtgttaatagaatagagatttgttttttctcacatcaatgaggttcttgtccacggtgagcttattcaaggtcaaagttccagttttatcactgcaaagaacatccatgcccgccatctcctcaattgcagtcattctctttgtgatcgctccctgaatattttaagtggttagcacattatacaaaccaaaactgaaaagtgacatacataaagcaacagatgcaaacctgttgagacaagcggtgtgacccaattgccatagtcacagataagactgttggcatggctatgggaatgcctccaatgagaaggacaaggaggttgtcaatcccggggcggtatgccctgtgctggatagggtacattacaatgatctcaacaaacattcccacagcaattgagcaaatgcagaaattcccaatagccgtcaggacctgcgataatcagataataatatgagtgaattaccatgatagtttgatgaagaatacacacatgtgaggtgagcatttcaaactaaccttctggaaatgaccaacttggttagttgagtcaacaaggtgtgctgcttttccgaagaaagtgtgaacaccagtagcaatcactatggcttcgatctcaccttgcttgacagtcgaaccagaatagacaccatcaccaggacctttggtgacaggcaatgattctccagtcagggcagactacaacatgagagatagtgaggagaagccttgatggatcatcaaaaggtgaaggcaactttaagtcgagcaatgggaagaacctgatcgatcttcaaaggatctccctcaaggagacgcgcatctgcaggtataatgtctccaagtttaatacttacgatatcccctggtacaaggatggccgcctcttcctcagtccatcggccatcacgaagcacctgaagaacacaaaatatgtctcatggattcagaattgtgaatgggccttacaggcacatgaaacctgccttgagaacatagtgaacagcataaaaggtaaaaccttggcctttggtgcaagacgggccatgagtgcagcagcagcattgccagcattgttttcctcaatgaaactgattgtcgagttgataacaagaagagttatgataccaacaaagtcctgccaatccggtggcttcccctgatgatacaacacaagacaacaaatgtgttatgtaatcaactcctgaattctaaccaacaagctaggcaaaatcggaattggctcagatatctaactgccttacccctccattcgccagcgcaatggccatgatagctgcagcttccatgacccatgagagtggattccacatgaaccccaaaaacttgaggaacttgctctcctgccagtgccaccatcaaagtcccaactcttaagcattttcagacatctcagatgcatttttttctgaaacagtagataaggaacaaagcaaacctccttctcctcaagcttgttggggccaaagatttcgaggcgctgctgcgcctgctgagttgtgagaccctcgcggctgcatctcaggttctcaaacacttcctcgaggggaatattctcctgcaggaaaaaaacaaacaaacaagaattcaccaatccaactccatggacgaaaacggaaacacaagaagcatcagcccgcccaccgaattgtcagccgtcacctattaatgcatgcagccattgccactacaactactatttcgagaacggctgagccagaagcaaacaaggctggagctggagatgccaatgtcgccaccatggaattatttggcagaacgaaccgcagaaacccagatttacaagagcaaataaacgaattctcacagaacgaaaaagggaaagaaagaacggcagccatgcagggtgctaaagaaacgctagccagtcacaagaaacgccaagaaaacaggaaactcgtgagtgattgcaacccaagaaaccaggagcacatgcccgaattccgcggaacaggaaggagcaccaatctagtaaaagaacggaaaagagagcacaaagacgcaagattttggcgccgccggagtagagagtagagagttgagagtgagttccttaccaagtcgacggcctccttgaggacggcgtcgaggttgccctccttctcagccatggaggcacctcgcagatggatctcccaccactgccttctcacctctctctacctgtatcccacctgttcggctcccttccagatttatttatatgtgggataagcaaaggaaatcttgcttgcaaacgaatgaaagttagtatatggataatttacctgtgcaattgcaatctggatggaattggatgggggtaactgaaggtgaaggtgaaggagatgagatggttgtggagagtcacagggagaggagtggtaggagtgggactccactccacaaatgaatgaggaggtagagaggaatgtggaggaacagagaaacataaccttttcaaatacacatggaataaattgtggataaaaagccacatgaggaatgaaacagaaaaaaaaaagggatatttttctggaacagagtaagaaaagggggatttttatctcgtgctgcatttggatttagggtttgttggaaccatgccaccctatatttgtaaaatttgagatatgtcacccgtatctcaatgacatgtatgacccatatgagtcaatgacatgtgggtcagggtggcatatcacaaattttgcaaattttgtgtggcatgattcaaattgtcccttggattggatgggatttattgtagatttgtagcccttccgagaactcgtttgctaaaactccaacttctaaatttaacttaagaagttggatctggagtggagtcgtgaagcaacataaatctaactccacatttctagttcatgtataaaatcgttagcaacaagaacaaaaaattacttcatatgttagacattgctatcaaaattatatataaagttggtggcaataagaaaaaatatagtccactccctagcttaaaacattgtcgctagacgatgctcccacgtgtcagccttttaactacaattaataactcctaataatatgtggttttacctttattttttatttttgaactttcttgtttttctattttaaaaataaacattttagaaacttatttttaagatcaaccaaacaacaatatcacgtcagtctaaaataacctaaaataacctgagagcattacttagctagctgacgtggaagtgttatttgttcttactggcgtagcaaaacaaaactatcatgtccattgtgggtagcgtgacagtattattttgccacgtcaggtgagttggcgtagctaaaaagttcaaatttttggaaataagttttaaaagagtttatttttaaaacaacaaattaaaaaggttaaaaaaataatgaaaaaaactatttaattctgcttggttgtaacttaacttttaaccaagcccgaggaaaaaaaactaattttatccaaatggcatggtcaacatatcaacatctaagggacaaggtttgaattcttgtttagaaaaaaataaaaccgttgataaaattaaaaaagcatgttttgcaccccaaaaaaaacccagcattaccagtccatgaagcatcaaaaaaatggatgctaaaaatgcttgagcaccaacaaatcaatcaactcaacaatatgctattaattctgtgtaaatctctcttgatgttggtaatcatcgaggcaataggccatactttccattattaaactgaaaatgaacagggattctgcctagaactctgtgtatgtatacctaattaacaatctgaaggagattaggttaggtgagcaaacggtgtcaagtttcatcttagcaagtcagcatccagttgctgattgcatgactattgtcgtttccctgtacggatcgtacttgtgggttatcctgaaaatgaaccttccaatgcttgcttgggttacagctaatcccattttcacacatctgacctacttcctgaccatttctcatttgaaatctcacactagtttgtctgttcaactaaatgagctcaaaatgatcctacccttgttatttttcggttattttaaaattttgagaatgcaatcgcctttttttcccgaaggatatttggtcaatcacggtcttaataatcagtcagtcaagacaaaaattgttgtcaggtaaggttcggttgttacttggagactggagaggtgtaactttgtttcatctagaggtaaggttaggttaattaggtgactccgttcaactgtccatggaaaatgaatgtgcagtaaatttgcaggctccctacatttaatctggctgggtaaaacatcagcggattctgaatatatgaatcctcccagaaaaaagaatatattgtcccagcatcaaagctagctaatttcttttcgttctacatctgatccgttttatcaaaacatgcagctatgtcattttgacatcgttgtctcaatgatatgaaatgattacagagtggttcaccgaaagaaacctttccttcaattagattacctgtcaaacggaatgttgtgtgcgtgtcgagtgtttagcatgtttagatttgtacctgattgatatgactagaagagttggatgaaagaaaagggtcggtacgacatgtacgccataaacaaaatcacagagattgtgaaaagagctggacgattagaaataatgagatgccaataatttaagagagaacgaaataatttaaaagcaagcttcttctcgtgtgtcatttggaacctaatcactaattaatcagactcttaaggaaggaatcactgatgaaatctgagtactaattgaacaccatgcggcaagttgtccagttggagttcagaacaatttgatggttttttccatttggagtaattaggtaatccagatagaattgcttccaaatggcgggtaatcatactgagaactttaatcatcgagcacgtaatcatctgtgagaactgaagtgaaaatatatatatatatatatatatatatatatatatatatatatatatccttgggtctgccgctactttcatgcttattagcataaaaagtttctcttcaaagttgttcaccagaagcacaatagaccttctgttagcataaattatagaacgcatgcatgctggagtgctggatacatttccaatcacacaagtaataaaccaacaaatgaattagttatttgctggtcacagcacatcataatttgcaaggttgcatccacgatccaataaaaatactaagcaagaagggagaacaaacttggccaggctctgtccttgctttctttccctcttcttttcagaaaagcaagagcacaacttttccctttccttcttttcaaatagtagcaggataaaaatttccagaaagcaagaaccaaagatgaaactaaagataatctgctttaggtggtgcactcacagtcatgcgtgcaaaggaggtagcaatcttgggggtaccatttctgttttacttttgcaaccatgcattcattcttggtgacttggtctcatccttttcttttatttcaagttaaaccatttttcataatcctaattaattttatttatttcctctcagtgtcttgactaatgcaaaaggacacatactgttaaatgcctttctgaaacccaaagaaacattttgcctgaggtctaggagccaccaaaccaattaattccaactggctaatcaaacatgatatcaggactaagagtaataaccaaaaaggagtaagataaattttcaactttcaggcttctctcactaaaagaaagccaatactactatatgaaaatgaaccaaacatgtaacttgtgagcatacttttatgacaacaatgaagaggtggtaccggatatggaggttggcctttcagacagaaaaggtgaaataagggagttcagaaaggactctttactttgatggacagatcgcattaaattaaatgatgtaatttcagccaaagagtaggagagtacactttggaataaagcatcctattcctaactcatgtgttcgatttatgtaacaaacaaatcactgtctaaaaagtctaacaaataaataaaaggaaaaaaaatgaaggcataatgtttcagatcttggagctaggcatcttacacatgcacctgtgtacgtacacacactaaggctgcgttctttccacaagtttcccaacccctttccctcgttttccgcgtgcacgcttttcaaactgctaaatggtgtgtttttttgcaaaaagtttctatacgaaagttgctttaaaaaaacaaattaatccatttttgaaaaaaaattaactaatacttaattaatcacacgctaatggaccgctccgttttccgtgcggtggagttgggttcccaaccccaagtatcaaacacagcctaaggcagcttcaatttcacccaaaatctcctttagatgttccctagctagccaatcatcatcttaatgataataagattcaacctggatcacatggttctcgctgtcatcgagatgagatagcctaccaggccgatagagctcatattcatatcatcatatgaggatgatgaactatacggttggttgattgatcgatccattcataacactgggtatactatacatgcatgtgatgtgagcattatgtccaaatgtacaatcacctttagattctctaatagccagctactacaaatctcatgcaagcagtttggaatgcccacatggcactaaggcaacacgcggggaaaaattacgagatgaataaaaccacaaagattcagcaccaagcatcaaacaaatcacagcgggtcgccgatcaaactcccaccaaacgcaggatacgttcagtgggttcgtttgtttacggccagaaagaaaagacacaacaatatgaatgatagcgggcaacagccaacaggattccattcgcctaagcaaaggaccaatctacaaggtagtaagtgatattacatggatattcagatagatgtcagtggtgggcgccagcgttacacaaatttatcaggtccataagggtagagtacaatacttcaagagaaacatagcccaaaaacctacgcttctcaaactcctgactatctgctgacatcttcccatcctccgttgggtgatcaatagtaaggtaccaagaaatgcatccacaggtgtcgtccgggtcaacattcgccaccaggccaagcgtttcaccttgctcaagatcaaagtaaaggcacaggaaatctctagtcacattcataccgagaaccaatgcttcttcatgaagccagtggattacttgactagcaacctgaacagaaaaaacagtgagcacatcattctgacaaaatagacttaaaaagcaattgttgtgacatgggtaatattcatgggcagcacagtattacttggaaacaaatccttatgatgatccacttggattaaattaaatagcccatcaagacaaccaaagttgaacaatgacaggtctatcaaagcataaacatcttgctccctttctcgcactgtattcagtgctttcagttttatattacatgaatggccactgccttccagacctcttatgtgggacaatattaacctaaaaaaatgtggaagcatggcaaggcactagaatgtttgtactggtgtcctgttcaactcaacatgcatgccacattcattttgaactgttaagcaaactaatcctgtaggtcaataggcacaaatgaagatttcctcagggaaaaaaactaagaaaaatgcattaccattgtgcatttcacattcaaatgcaaggagtttatgttacacatttgcaatgcaagaaatagtctggctcattgcattatcaatggaccataatgaattccaatggtaataactttaataatttcataaacatgatctaccaagaaataatttaaatagtatcatcagaagtttacctgctgcagaagcattgttgggaggtcctccaagtcacaattgtagctatttaccaaatatccatcggagggcttcccagtcaatgatccagcaatgcttggggagccttcacccattagactaatttggctatctttcacgatcaccttagtattgaactgtgacctggatttgtacttaagttcatggttatcagaaggctttgcaatccgatctgcagcaaggataggctgaggaactttcaagcatagagaccaggaggaagttcgagaatgccaagtaggaagagaacgcaaatggagatatggaaccctgctgacctgcaatacagaaaggaaatttaaataatgatctacatgcaaatatgtagcatcaacaagcttataggagctataccacactctcaagctccacgagtactttgttagaaaatatcctgtgagccactgtcaagcagaaatgacctagcaggccataatcatcacctgcaacctgagcaggactttggtagcgaccaatgttaagggatttctccctgaccttcctaagaatgttctcatgaaacaattgtagcaagtaaatttccagacttctgggattaggaaaccctgtcacgtcttttcttaaagggtccagcttcccattcatagtgaccaacacaagatttgaggcatcctctgaattggcatggtcttcatggtctaccatttctgagtcactaccatctccagaatgagcaagcgagaggcacaatgaacattcctgaccaatagctaattggagaaaatcttcacgcattccagtcacattgatgccttgagattggacaaatgtctcacggatcaccatatcaaatacctacaaaggcatacactaagctaagccacagaacgatatacataaataaataatgataaacccggggagggaggggtggtggtggtgcaagatgtcatcacatgatatacaataattttccatgatgctatagttaaaacttaattaagagcattctatacaggaattcttagcatgccaagcaaacacttagctgacctgctcctcaaatattgacttgtggatgttgcgaagaatagaatgtgcatgtttgatggatttattgacatcatcattgtctgtttcagaggaagtgatgcttgagatgccatctttcagtttatgaccgtagttttccacaccattggcactgtcccctcgaaaattaagactcaagaaacggcaagatttttgagggacttgtacggacaaagtgcctgatgagtcttggtcaattggaatcaatggtaatgatgacagtcgaggcattgctgctgtgtccaattgagaagtgtcgatcagatcaaacatgaagccctcacttcctggaccacttccaccaaaccgttgccgcttcactttccagttctgctgcaatctgccaccaatccgcgagtaattcatggtgcaaacttgggtgaagtggtattgaaataacaactcaagttaagcaacaagacatgcctgattaatgagccatagaacctagactctttttggaactgctgctccattgttttggcagattgtttgaagtagcgtgacaaatgctgcgaggacacaaatgaagatcacaacaggaagcatgatagatgcaagacggaagaggaaagtggcaagcgattacagaaacaaattgagtttgttttaggttccattttgttccttagccgtgaattgaagtaatcaaacataggcagtagggtgacatacccgaacgcgctgaagcttggtggctgcagagactgcggtgtcaactaaggtttcggttggcagcgatttgggcttgagcatcccagcgactgccactgcatcattggcttcgacctgcattatcaagtaggattgtctcctctgtcaggaatacaaacaatcgcatgcaaatagaatggggtttgcagtattgtgtgtgggaaaactgacagtgaagatgaggtcaatgacgacggagagctcctgctgcgcctgctgcaggctctccatcatgccctgccacggccatgcctgctgctgctgctgctgggcggtgtccttcttgggcttcttggcgtccttgtcgatgacccaggagaagtcaatgcgccgattggcggagaggcgatgctcctcgctgctggtgtcgctgcggaatccgaatctcagtgaacgaagaaagatgggggttagggtttcaggggaaggcaaaaggttggtttggtttggtgcttacggcgggtagtgctcgttgccggcctcgtcgatggcgtggaggcgcttgatggggagcttgtcgaggtccacccgcacggcttcctccatggcgaaggcgaggcagcggcggcggagggcttaattagatcggagacaattttttgagtgaaggaggcactgccttggggctcacgagtcccgctcaagagcggaagggatccccccgcgggaagcagaagcggcggccggcggggtgggggcggccgccggcgaggtcgtcgggcggcggagtgaggaggagcgaattctcgatcgagtttgggtgctggactttggagtttcttctctggaagagagtatgatgggccttttttgactttgggccggcctaacaagtaaatgttgctgggctggcctggaccagttccagacttccactactccgaatgggccggagtttctttttttattttccatttctcaaggcccctcgggagcaggaattatctcctagcaatggtaaaacgaaggcttatatcagagagctttttcttatcaatgcctacaagacaacaaggcctgttcttctgttgttcgtccatggatcacaagtttcagggaacaaaactctctttggtgccggtggcaatgatattccaaactcaaccgcaagttgtgatcaatctgcaacgtatcagggacgacggatatttcacaaaataagtagtagtatgtcgattcttcagtccagcttctgaattccaggccttttgaagttgagcaagcaagtaaattcagataatctctctgcaaaccaactatacagtgagtgactgaatttctacttgcgcggatcgatgtgccagagcattgccaatcacagaaacaagttgcagatgagattgtcatactagcttacaatcaatgccaccatccgctcaaaactcacagcaatcaatcacaacctgaagaaacaatgaggacaaaccactgtccaccggatcgagttggcaaaacctggacgaccaagggggttcggagaataaaactccgacccctattcatgaaaaagaaaagcaccgcaaacaattcgtatcataattcttgcaggtaacaccgtaacaccataagtttgagagaaatgcgccaaatacaacaaatttggcgatttgtttgttttctctttttcaaaggtagcatatagatttgccttgataatagtatcaacagatgcagcgctataaccatatatactccatttcttctccattcccttgcttcattgatttatgacatactcagaaagactaaaataagcatcaatttcacacttcacaggcctgttgttcacaactactgagctgctgtgttattgtattgctactaatcaataccagcatctctttagaaaaatcattagcgatacacagcttacattttattggatatcactgtcattgtatcacatccactcctcccagatcaacatatgcaatcatcatgcctatgccagttttttgcatggtaaattctactactaccagtggcccagtgccatgtgatgtcaaccccaacagctttgtatattattaccccttattataaacgcatcatactcactattggggggaaaacatgatttttcatgctgctgcgagagggctagaaaaaagaagttgcagtcttaatatatcacacacgcagcatgagagcagtgacataataacggctacggactaccattcacaatagtttcaatcgttgctgccgaaatcgtcaaaacatctaatttatcattagctcgagattggcagctataattgatgacagcgacaaacagcatagacaataagacatctaactacggatggattagaataatccatgcggtagggggctaatgaggattactagcagtagcagaaggcccggtgagcatcttgtcaacttttgccaaaagcccctgcatttccccaagaaggttttctggcatttgctttgatccatctgatggagttgccttcttgacagatgaatggccagccagggatgagatcatcctctccaggtttttcctaatatccgtaaggggaggctttgaagctggcgaaggcacgctcaacttgattggaggaagataatgaagccttggtgtagcaaacgggggaccaaacataccaagagtttctgcgctgttgtaagccgcctcagcttcagcacttttcccaaacacaacacgagcgctatgggtatcttttacgatgtccgtctcagactcaatcacgagaccaaacttaccaaatgcagagagcaattcctctttggagggcagaacaacaccctttgcaaagtccaaaagaagggctgctgggtttccaaagtgctctgcaattttcttcttctttttcttaggagtagaataagctatatcagggaaagcactattggtagcttcaccagaggaatggtttacattagctccaggaaccatcttcttcaggctaggctgatcggccctctggccctcatctttgagggaattgcttgctgctgctacattagtgccattggcgacctccgctttcataagcatttccggcaccatcgcttcaagggaagcataagattcttggaccgtacgcacttcggcgcttgcatgttctttatttccatctgtcggctgagatagggatacgtcttcacttttaggaagaggtgcacttttgtcagtcacatctacagcagcattctgcccatctctgtgtagaggaatattagcttcagacttcactgcttccaccggaacacatctgacaggcacatctactacaatgccttgcacacctggatctgcttgaatgttggtatgcaactgtcttgcttccagcatacctgcatcattctgttttgcaggttggtcagataaattcttgcaagcattggctggggtcttcaaaacagatccaccatttgctttgtcctgctcctgtcctggttcttttgctaccttcgctgaagctaatgtagggctcttaaagtctggcttgatcttctcaagctgcacaccaactgccataccccttgcaccattctctggtttcgtcgggcttcttatgtcttctgccctcgcttgcctgataggaatagcaggggtaattgttacaccacagcctagggcagccgcaggagatttcttccccctcttctcggtcttggtcgaagaactcccaccctcattttgcccctgttttctggtcctcttcaaagcacacttgcctggtttcagagcagcacgtgaatttacaaaagaatcagatgtctccacagcagcatttgtaaaagcattctccgtagaacactcgtgtgctataaaggacttgtagtcagcatcctcgaccaacaatgaacttgtatacaaagaaaggaaggcatggacggccttcattgaccgtatcctatggaagacgtccagcccagtcctgcgcacaaaaagcaagacctcttgtggagaaacattctcctgcaatggctttggcaataccttgtattcatcatcttcagcggcagcgggtggcgatggctttggcgaatcagacgccttctggacaagggcaatcccgcccaagttggtgtagggcggcgacagatatttgctcttcttgcgctcgcgcttgttggacttggagatggtggtagcgctgtcctggtggtgtggcgtagccttgtcatcgtcattgtccatgagctcggcgacgctgcgct

SEQ ID NO: 76426 - DNA, 2785 bp, Oryza sativa
ttcaatgctatttgtacatggcatggcaagatatacaatgtactcatgctacttctccagtagtatacagtgctatgtccagtcttcctctttcacacacaaaagattcttaaatcatgcatacacacaaaaacatagtatcattttcacaagttacttgtcttctttttaatataaaagggtatcattttgtgcactatacaaaaagataaatagctttcttatcattttacaatttgtttgttgttggtgtaaaacacatataatcgtatatctacacaaaatcgtgtgtaaacatcattttacattctctacatgtacactagtcttctatgtcagtataagcaacgcggcaaagtgaaaagatgtgataaatgtatctgccaaatcttatagctgtataaattagatggacagtggacatgcccagagatgcaacttcacatatctgcctttagtttttgccttagactttaaacatgtggaaatagtctacacgatccatatgttactttcgattgaaatgaagcatataatccatttgcatatgtttatctgacattcataacctattatgacatatgcttatctgacattcataacctattatcagtaaggaatgtaaatcctagttgacatttgaagttttgaacacatgaactttacaaagttttcattcttctcacatgaaaaacctatgcaatacattgtcctaaatctcaccagtgttaatgttgtgaaatatattctagaccacaccttttttcatacaagctatgcattgcatctttctttggtacaattaatgaatgatgtttatcatacctctgtaatccgtttagttcaacaagtcatgagatgcgcctcatgttctgttctacatttttcagagatcaaggtagtcatggagctagccaagaaaatgaggcatgacctcggtgccacttttgaacctgctaagccaccagagaagcctttagctggagttgtgaaggatgggccagtggaaccacctccatctgcagaaaacaatcacgctcctcagacaggtgagactacagtatgttcaaatattgtaaacaatattgtgccaaccaaccctaactcagatggtgcggcagagaagatgggggaaacaccaagaagtgagattgcgcaagggtcttgtgtgacaggtggatctcctatcggctggaattttcttgtgtggcctgggggtgaggtggtttactacgggcggacaaaagaagtgtttcgggcgggtcaagctgaaaattaaaatgtggtgttcaccctgtcttctgactggtaaagtggtaatgtatcattcaattgtggtaggacgatttatagaatgtggtgttcgcattcagtctttctgaccggcaatgtgccaatgtatgtactattcaattgtgcgaggaatggaggatgaatcgtagtagatcttagcattctgttgactgaggtaatgtactactgtattcaattgtgggagggtgatttttgctaaacatctgttagtactatgtactaactgatttctgcatgacattctggtcttgtatgagatgctcttacgatgcaccatcatcatgtttcttaaacttgcatgtagggatgaaaactgccgcagatcctgaggaaggaggacgaactgggttcaacgggttaggctgcgtccaaacgagattaatttgattaattaagtattagctattttttttttaaaaaaaatggagcggtccattagcacatgattaattaattattaactatttttttaaaaaaatagagtaatttgatttttttaaacaacttttgtatagaaacttttttgcaaaaaaacataccgtttagcagtttgaaaaacgtgcacgcggaaaatgagaggggagtgttggtaacttgctctaaacagtccttatctcttcattttctctctccttccttctctttctctatcacctcttatctgtgtgcccttcctctctcggcggtcacagaagcagccaaggcaacggccaagaaggacacgagcaggacatacagagcctcggatgcggtccgacgattcatgggtgcaagtcttacccatagttattaggatcggaccggacatcgaatcggtcgtagtctcggttcacggtttgattggttcgaccagttgaaccgccggcccaacacggtttaaataaattgggacacataatctaaccacacaagcatgcattgctcggtggtggttgagggttcgaacccctcagcccacatttttctcctattttcttccctctcccccacgtttcagcctgcgctttgtcctttctcacctacgttcccacgtgcgtctagtttttcaccggttctttccaaaaatcggcagtccaattggtttttcaaattgattgcacgccatatctttaaactgggttttttcaccggttcttcccaaaaaccggcggtccaatcggttttccctgggttgattgcacgtccaatctttaaactggaccggaccggttgagcccctggttccagtttattccggtcggactgccggcccagtccggtcctaataactagggtcttgccccgtgtgacaacgccctctccgccatgggtcgagtgcatgaccattgaggagaaaatggccattataccctcgccccccgtgcgacaacgccctctccgccatgggtcgggtgcatgaccacaggggagaaggccattataccctcgtcaaaacggggctttgctataataccatcctacaattgggatt

SEQ ID NO: 76427 - DNA, 27931 bp, Oryza sativa
  unsure (1)..(27931): unsure at all n locations
ggggcggaggcgcaggggcaggtgaggtgggcgtggaggagagcggcggcctgagcctgggcgtgttggacggcggcgacgaaggcgcgggtggtggtggcgcgggccatgaggtcggcgtcggggtgggcgaagggcctgaggtcggaggcgcggcgaggggcgtggtcggggtcggggtcggcgaggtaggagacgaggccgtcggggaggaggtgggcgggccaccagggtcggcgcttggacttggcccagacgaggtccccggcggctagggtttggggggttagggtttccgccatggcgcggaggagcggagaggagatcagggatcgcgggtgggaaggaatgggagtagactccgtttgtttgtcgtggaatggaaatggaacggaaggcggcggggcggcgagcggcgcggcgggcggcgggcggcggcgggatcacctaccgctcggagcggtgcggcggtggcaactgacactgactcacactcacactcgtctctctctcagctcaatcaaccgccgcttactaggctttgtggttgggccaaattctaatcacggcccaaaagttcctgtacactcactcgacttgactggatttccttactaggcttttcttttctttttcttgacaggcctctgttccagtagagcttgggcttctcctacgattgtcatatgggccgttggagtttgggcttctccaatgcaatccaacggcctcttctccctcttatctctgcaactttaaaacacagagtcatctttctttcatatgttttattctcaatcatcatttcagtacatttctatttatatagccctgcctcgttacgaacattacaaattacattatagtatgttcttatttgtatgcaaattagggccatattaccggtactataataatataagaaagcaaagagaaagaaagagagacaagtgttgtttggttcacttgagttgggttgcacaccatgccatatatacgtggattagtagcactcaccaaattcaatcatttgcagcatccatacatgtaagcttacaatacaatatttatttgaccgagcacgtacgcaaatgcactctttgacaaattaagcaagatccgagtgatcgaccatgttttccggaggacttaactgaagtagatagatattcagatactccatctaactactactagatgatactatatgcgtacgtcactcagtcaatgggacgatcgactagattaaattattactttcaccatcctaattaatcctatcttagtataaaattatcccccactaactccttaagcttaacatgcaaagatgtcacatcatcatccactaacaatcatcacatttaaatatcatgcaaacatgctatatctttatagtttttataatttaagagatttcaaatacaaacatgttaaattatcatccaacataatttacataatgtttcaatgtatatctttattatgttttatgatatcctatatagttttatagttcatccttatttagttagtgcttaaatgattaatctatggtccaaattatctttctcattttttcatctaattaagtcatatcacatcaattatttttaacctttagatgattaatctactttccaaaccatctccttatttttcttcttccaaaaagtcataccaccttactttttacatttgaatcaccattgtacatactatttaaatttaaattatcataaaccacattaacttacttcttaaactgatgttatctagctatcttacaggttatttttattgtttccatactaaattttccacagcaatacgcgggatttcacctagttaatgagatatgcataccacaatcgttcaattcagtcatatttttactatcaatcacttattaatccattcattttaaattactaatcgttacgttatatattagtttaaatcaaacattttaatctttaacgttaatttctataaactcatacagtttaacatcataaaatttatatttttatataccatagaaataatttcataatatatgaatcacatgctaaacaacacatatttttaaaattggcatatatgtagtgctacataatatttatagttttcatagaaatattacttgtcgcatgtacttctagcaggttttcgggaggaatctagaaattaatggtaccactgtacgacaataaataaataaataatgctattgataggccactcggccagatgtcaaaaacctaacgctactcttgatacatgtgggaatatgtgtacatgcataaaatatttcacgcgagcttcaaataatattttatcctaaacaacttatctagcgcccgtttcgtcatggcgcctagtgggaaaactatctcttaaaaatcctaaatgcaaaaattgtttccttgattattgtccagtgtccgtgccattccagatctcaaatctccaatccatcgtcgaatccaaaccctaatctcaaatatgtcctaaatcaaatcctctcgaaaagtctactttgcctcccttgagtctgtgggccgatctcttctccccggcccatttcctctcagcccatctctccctcctcctccatccttgcccgcacgtgcgaggcacgtgcgacgctcgggcgctgagcacgagagagagctcgctctctctttctcttctccttccctctctgctcccgctaccgcttcctgccgacgccgcccaaatcgccgcgccgttgcttcccgcgcgcgtgcgcgcgccatggtggccgacaggccagtcgccgccgccgtcagcgcctgccgcgcctgagcccgcgcctgccgccctgtagccgcgccctttcaaaccggccccgccgtcatcgccgtcgtcacgacccgggcccaccaccaccgcgcatgcttccaagggttggaggcagagctcctcctcccactgtctcgtcgccctctctctccttccttcttttcccaaagtggcaagaggcaagtctcctttccctctttcctttcttctttttctcccccgccggcgtcatcctccctgtcgccgttttggccgctagccggagcgctagctcgctggcttgaccgcccaatgtcggttccgccctcccaaaccgacattgtcgcccctataaatccgagcccctttccccattccaaactcccttgttttcgccttccgtctccaccgcaccattgtcgctccgccctacttgcacctccgccattcgttgccaaagcaccgggagagccggcgcgtgcgaagnacgcgtgaaggggactccgcgcgctcgtcttcttcctcttccccggcccgaggccggagagatcactcccgtgccgtcggcctctcatcacagcgccccgcctcgtctcggtagggcatccctccgttctccctcctcgctccatctcttccccttagctttgagtagcagctcgagtagtaccccagtagctagttggcgccgccccaagccgcgccgccgctcgcagtaagctcgccgccatcgcacccgcgctcggtagtagccgcccgtcgccggccttcctcggcgatgacccgtccaatccgacgctaaaaacggattcccggagtcacgtagatgctctaactcgcccgaatcgatctcccgtcatgccgtcgccgtttcccccttctctcgccgccggttgccgccgccgcaacccgccgccgtcgagccccctccggcgaatccgagccgttggctcgtctccctttgtcccgtgcaacctcccggtgcgctcgcccatgcctgcatcgctgtagatcgccccgccgctcgccgccgccgtccgccatccgttccggccgacgtcgtcgtcttcctctcaccagcccacgtggctgccacgaaggcggcacgtcggtgccacctcggccgcgaccgggtcaagcagacctcggtccgccgctcccctccgccccgctcgcgcacgcggtccaccgcgagccgtgaggctgcgcgtgggcccgccgcatccgcacccaccgcgagccgcgcgcgtgcatcgcgccccgctccaaaccctagcgccgcgtcgcgtgctcctcgctcacggtgagccgagccgccgacaagcaggtcccactcgggatcacgcgaggtgagcccggtccaccgactccctctctcctcccctcccgcgtgcctttgggccgccttctcgggccggccggcccattagctcggccgagtcgcgcctcttctctcgggccgcgccctagccgcccgagggaagtctgtttcccctccctctttcgttgctaattcaaaaagggtttaaataaatccttttcttttagtccaaaaatccgatgatcttagaaattcaatatcttttcaaccatacatccgtttgactccgttcaacttccaaaattcctcaaatctcgagatctatctaatggcacgcttagaggtcaataatagggctttaatttcgccgtttgttgagtcatctcgttcgcgtgtagcttcagagcccgaagacccggagtgcgcggatttcgaggatcaagctcaagatctcgagcaaggcaagtcaactttgatcatcttgcacctataatttaaagggacaattcgaaccatgccacacaaattttgcaaaatttgtgatatgccaccctgacccacatgtcattgactcatgtgtgtcctacatgtcattgagatacgggtggcatatctcaaattttgcaaatatagggtggcatggttccaacaaaccctaatttaaatctaagtatttcttttccacaaatattgcatgaataggattaacacaagtaaatcggccgcggcttgcgagatagcctgccggcccaaccctaattgttgcaattaccctccttgaattattgaacacttaaacctcctttgtcgactgttgtgcttcgatgcacgggacttcgggcacgcgcatcgggacacctcccctcaaatttaaaatatccaacgatgggtaaaacttggggttttacaaaagacttggaaaaacccgacacctgggtcggtgcttgcgaactaaatgaatttccaaaatcgcggatcgaggaacgtaccgggagtacggtttcccgctcttgcacttaaggaccgttttccttggaatttcatccgaacataaggcaagtgcgaccacatgggtggaatgggatgcccctggctgagtaattagctaatcgaggcagccattatgccaagagacatgtggattcaacggggtggtgccagggagaacccccgggcttcctggcacagtatggtctgggacctaacctaatgtcggtttgggacccctctcgttggcatatggtgaacctgtgtcagctttcgaaatgccttgtcatgaaagcctcaaggtctctagacgtggccgttctgcacgggctgggtgatccgggttagtaatgtcgtgtgggtaaagtgtaccccctctgcagaggttattaaactattcgaacagtcatgcccacggtcatgggcggatgtgaggtgattcctagcgtagttttgtttgactactgcttgtgaaattactgttgtggaatgggttcgatgtttggaaaatctgcggctgatgggatcagccaggcccgggtgcccgtttgaaagccgttggccgggtgccaaccttgaatcaattcaaagactgatacattgcacatactccgaccggacgagacgcactacctcatccgtgtcgtttgagaagcactcacttagttgtttcaaaaaggagtttaaataaaatcaattgcaaaaacaacagtctttccttgaagcctgcattaaacacttaattcccatggcttgctgagtactcctgtactcacccttgctctatataaataattcccccccagttgctgaagaagatgaagtggatcccgctgatgaggagttcttccaggagcaagtcggctacgatgagttttagggtttcggtctagttcccaagtcgcgcctgtgatgattggtccaagtcttggcttccgctttcccttttgtaatgcagttgtgagctcgggatctgtccgcagcccaacatgactttactcctactctgtaataaagagacctctgttgctgtgatattctatcttcctgtgataccagcagtgtttcctgggactggtattgattaacaggttaatttggagtgtcacgggctagttccgttcggggcccttgctctatataaataattctcccccagttgctgaagaagatgaagtggatcccgctgacgaggagttcttccaggagcaagtcggctacgatgagttttagggtttcggtctagttcccaagtcgcgcctgtgatgattggtccaagtcttggcttccgctttcccttttgtaatgcagttgtgagctcgggatctgtccgcagcccaacatgactgtacttctactctgtaataaagagacctctgttgctgtgatattctgtcttcctgtgataccagcactgtttcctgagactggtatcgattaacaggttaatttggagcgtcacgggctagttccgttcggggcgtgacaacttatccaatctatgatccaataacactgttatactcattgcaattaaatgtttgcaacaaggtactatagttaattctttacatatatattctaattaaaaaaatacatgtttttatcatttaggtcggatgtttcacacttcaaactgaaatctttcaactggtctgttactatgttgcacattttaattttgttttataatatgtctttcttaatgttgcatatgaaattatttggatgttttaataagtgcttttcccatgtgttactagttcatttgaaaacattacatggtaattatattttagttaaaatatacatgtttcaattatttgaggtcggatgtttcacacttcaaactgaaatgtttcaactggtccactactgtgttgcacattttaattttgttttcataatataaattttctaatgttgcaaatgattttcttggatgttttaataagagttttctcatgttttaccagttcatttgcaaatattacatagtgttgtttgaatgtttcagcagatattttgtgatgttcttgatctttcacgctttatataaaaatattttaactacaattataatgatatactatttttctccagaacataatcatatgaggtcttactgtaatcatttaattgcaacaaacaaacgatggaatcgatcacataacaaataagtagtttacaagaaaatatattgatacaaataaccgtaataatcaagaggtccatatatgatatatggtccataccaagtaaatatatcacacgactatatatatccctagcagccacgaacacacttcaactaggttattgggatcaagatacttaatgtgttgggcttttttttttccaaacaattatagaatcagttcgtaggatcaaagatactaattttatcaagtatatgatttatgtaaaatttgcaatattgtaaagtttgaagatgataatattagtttggtagggatcgagctaataaccttgagtccaactgcgagctactaaggagtactccctccggttctataataattgacgttttggacaaggttgagatcaaactttaataactttgaccatcaataacttcaaaaatatttagtttgaagaaactagaacaacatatatagatttatctttcaaaacactataataaaagtaaacatgcatttatttattatgtatattataatagaaaaataagttcaatggtatattttgtagaccgtgtcattgttcaaaacgtcaattaaaatgaaacagggagtacttattaatcgtgacgaatatttgcatgtaacagtaacaaccaattaaggcagattaattagtaggactactgtacatggtgtatacaatttattaatgttgttctaggatggatcatttgcatgaatggcagcaaataatgaattaatcccctagctagtagctagctagctgcctactccatgtatagtcttttatacggagtaacaaattaagatgacccctaatataatttttccgttaaaaataaccatcttttatatgaaaaacttgacataggtcccaacacaagctatatctacttaactgtcaagtactgttcatcagccaatatatcattgcatttaattatatatattcgtgatgtgtgtgtacctttaatttgacgaacgtatatatgttgctttctagttgatctcctcgccattagttatgattattgagatattttaaaactgcctttactttactgataacagagttaatctatattgtttatttctttactaactactatcttatgaatcatatttatttatagcagatctatatacagtatagatatcgactactagtagtatagtagtatagttgtatgtatttgttgtactgtattatgtctcgtctcaattctaagaattttttgaacggtgagaatatgcactttcagcacgatgatcactaaaataaacagggaaaatatgtagtgcaaaactaactatgtatcgaaaaaggacgttcaagattcgtccacaccaaatcctggacgtacatttttttgattcagcgtgaattttcagacttccacaacatatatagtttccaccatttttccaaataagcagatactcgtcagtaatgatgttttgatgattgatagataaagagagcaaaaggctagctacatccaattcgctagctagctagagtatatacacgcgtaccgcatttatatggatctgcaattaattctacatggagatggatgtaaatgagtgcttgatcagttacgttaccaaaacgatcttttgataccatttggcgaattaaattaaatggagcagatctaatttgagaatgtatatatgaatggtcgagggacatgcatgcatatcattgtctaaaataaagatggaggtagaagcggtctatctcgggcgccctctgcctctggtggacaaggacgatttgaattgatcgatcgattaattattgaacttttgtcatgactcgagacggcgacggaaaaattgatctgcaggtacggtatatgtatatatctcgtctcagaaaattaattaactaattaaccgcgtatctatatctcattcgatagagatatatatatcgcaaaagtacatgcaatttgtcagtcttgagtttacacttgactacacacgtatacgtgcaagcggtaaatggacgttgctctcagttagtgtatgtggcaacgtgacggccggtaatctagctagctgctttcttactagtactagtactactactttagctacaactttcacaagatagctaataagatagatagattcttctcacttgctcttgtgaaagggagaaactgaaggcatcgagcatgtacatacgttcagattgatccatacaaatacaagtacagctagcatgcatgtatacatatgtacagatcgatcaatataatgtaattaatgcgtatatatatgcatggcgatcgatcgagactgcagacaggccggcatgcctgccgatatccagcttacgactcaatggccagcagtgacaggttttgactatagagacgatggtcaggagagagtgactgtggcagtggtgcacgtaagcatgcggacaagtcatgtcgatcgagtcaaagctagatctatctcatgaaaatgccaacatgcatgcatgttcaaccgccgtatcaacacatagggaaaaatgtttctatctcccgcgacgtcgtatcatgcatgcatcttaataatattcgttaaaatatttaagaaatatcaagattaatatgtgatatatttttttctcaacaaacatatgcaataactataacttacacaaattgaatttaagcttcgtacgtttatagaataatatatctcatattaatttatatatattttatataaagatatgatacgtaaaataccaagagatgtgtctggagacatgcaaatctatctctgtatcgatcgtgcatattgatcgacgacgacgacggtgatgtgcactagctctagtgtactgtacatcatgtcgatcgatcgatcaatcggtagtctatatatatcgatccggaccatcatcctcctgtccactgccacgcgcgctagctacttgttgagtatatatccatcgatgatgcatgtatgataggagaaaattaaaagctactctaggtttgttgttatcctgcagtacgtttattggggatcgatcgatcgacaggccgccgcgcgtacacacatatactaactccttccttaaatgtttgacgccgttgacttttttaaacatgtttaactgttcgtcttattcaaaaaacttttgtgaaatatgtaaaactatatgtatatataaaagtatatttaacaatgaatcaaatggtaggaaaagaattaataattgcttaaattttttgaataagacgaacggtcaaacatattttaaaaagtcaacggtgtcaaacatttaggatggagggagtatatactccatcgatcgatcggtggcttggatatataggatggatgcatcatccatcgatcatgcatgcgcacctgggctagctgcatccagaagctactcatcgctttcatcctgcgggattcctgcccaagagtagctaggactcaactcatatataatttgttcaatttttaaattacataatatgatgctagtagtgatgtttgagtccgttccaacgccataattaaactcacatgtaggatcataagttccccacacgtgtatacttttgctttggatatgacatcatatacctaatcaactaactatactataaacttataacgtttgcttttgctttatcacttataatatttatttctctcaaaaaaaatataatatttgttttgcaacatacatggcctttagctagtataggatgaaggagacaagccaaggacgccccatatcgatctctctaactcggtggtacgtgtcacactacacaaaccatttttctacacacacccatttatatttacaaacaaaacgtataatgacatgacaattataataaactttacaggcaagactcttaatatatctgcataaaaaataacttattttcctaggtgggcttcattcttctttattcaagatagtccatgtatcacaaacccacacaaacctcgaaaaaatgttaagtcatattggaggacatgtggcttcttcatgggcaatggggaatggggaccttggttcccaggtcatcaactttaaattttctgaaaatatcaagtgttcttctgttgtaatcaaataagtatatatcttctgttcttttaagtatatatatattaagttgataaatggctatagcgattgagatgtatctttccattttatcgactaacttttatagcacgcatgatataaattactactcaatcaagagttccgtagaattcttcacctcaaattttgtttgtaattggcaaatataaagaggaagaagtactgtagcagtatataattaagttaggaaggagaggactcatcggatcgatcgatgaccatcgagtcgcgtcgatggatggatcagctagcgtcagacttaattcggccgccgcatatatatgcatgcgacaaacttaatagctactccatccgtttcaaaatatttaacaccgttgactttttagtacgggtttgactattcatcttattcaaaaaatttaagtaattatttattcttttcatatcatttgatttattgttaaatatactttcgtgtacacatatagttttacatatttcacaatatttttttgaaaaagatgaacgatcaaacatatatcaaaaagttaatggtgttaaacattttgaaacggaggagagtactatccagttgcactgtatactccatatatagtggcagtgctagcaaagtcaaactaatttaattaattattaagaagcactcgtatgtatatatacgtacagttgccgcgctcgctgcagcaagttgatgatatcgactagctaagctacccagttagcagccggcaggaccgatatatccgcaggcggctaaagactggagtaattagcaagccagtttgagtagtaactagagtaactaataaacacatgtgcagaaactgagattttgtaatgagtagaagtatgtatctagcttcacgagcaagctaatttaattaaggtagcgtccatttttttttaaaaaaaaagaaatcgtagctagagaaggaccggccgggaaaacaaaatcagctgattaattgacagtatatacagtatagctactgtagtaaattgctttgcattgacgttgaaatctgaaagcagaataatctgcagtccatcggtactctctagctagtctgtacgtagtaatatctctctctgtctactactagtactgcaacttgttttgactgtcattgctggagtatactatatatgattgataataggagtagtaattaataaataatgtacacttgccgccggaatacatccatccctacgtactattcaccagctgcggtcatcttgactccacacttgatcagtagcactcatactcaaactaaccaccatttgctagtacttcctctgtttcacaatgtaaattattttagcatttttcacattcatattgatgttaacgaatctagacatatacatctatctagatttattaacatcaatatgaatataagaaatgttagaatgacttacattgtgaaacggaggaagtaccaattaagccttcttttcctttggtcaaataaagttaactgaaaatgacgttgtacacatacacatccatatacagtttccggccaaaaaattactaacaccgttttgactaatctatgtgtatatcctgatactggccgacatcaacttaattacatcatatcgacccccctgcccaaactatcggacgaactaagctagagtgtagcaaaatcacacggtacagctaccatatattagcttgatccacaagctccccaaattcccattaattaattaacctgcagcctcaattatttggtctctgactcgtgcttaagtatacactatcatgcgcaggaagacagatttacaggtggatggatgatttgtgatgattattcgtgatttgcgataaatggtccctggtaattaattatttgagagtacagacgaaggaatgaattaaaattattaattatccaaaaaaagtagtatttgtaagaaactcatgcatgaaaagtctttttaaaagaaaaatggcaccattatttaagtacttttgcagtgagcatatggtacttaattgagcactgtgcatgtggaaggaaggcaatctcacaacaattaaattacactctgttcatgcagttcagtcgacgttatacatgcccttgaatcgaatcaatatctttgtgtctgtctgtctcttgctggactctgcttctgctaagcttatttataggcctccactcactcatctctccttgcactcctccctgcatgcaagctcctctatctagctagctactctactctactcgatcaagatcaagatctatcatggacgcagcagcagccatggagaagcagcagcagccgggcgagaagaagatcaccggcggcgaggaggaggaggaggaggaggtgatcagcagcgtccggtaccgaggatggaagtcgatgccatacgtgatagggaacgagacgttcgagaagctgggcaccatcggcaccaccgccaacctgctggtgtacctcaccaccgtctaccacctccccagcgtccgcgccgccaccctcctcaacttcttctccggcaccaccaacctcgcccccctcctcggcgccttcctctccgacaccttcctcggccgctacaccaccatcgccgccgcctccctcgcctcctgcctcggcatgcttgtgcttaccctcaccgccgccatcccatctctccaccccccaccttgcactgcctcctcttcctcgtcgtcgtgccagggccccacacacggccagctcgccgctctcctcgccgccttcgccttcctcgtcgtcggcgccggcggcatccgcccctgcaacctcgccttcggcgccgaccagttcgacccgcgcaccgactccggccgccgcggcattgccagcttcttcaactggtactacttcaccttcaccgtcgccatgatgctctccgccaccctcatcatctacctccagagcaacgtcagctgggcgatcggactcgccgtccccgccgccctcatggccatctcctgcgcgctcttcttcatgggcacccgcctctacgtccgcgtccgccccgagggcagccccttcaccagcttcgcccgggtcatcgtcgccgccgtccgcaagcgccgcgtccccgcaccggcctccgccgacgacctgttcgacccgccgcaccagagcaagctggtggccaagatcgcgtacacggaccagttccggtgcctggacaaggccgccgtggtgacgccggagtcgagatcgagcccgtggcggctgtgcacggtgcagcaggtggaggaggtgaagtgcctggcgcggatcatcccggtgtggtcggcggggatcgtgtacttcatcgtggtaacgcagctgggcacgttcgtggtgctccaggcgctgcagatggaccggcggctgacgaggtggtgggcgttcgaggtgccggcggggtcgatggtggtgttcaacatgatggcgatgacggtgtggatcccggtgtacgaccgggtggtggtgccggcgctgcggcgggtgacggggaaggagggcgggatcagccagctgcagcgcatcggggtggggctggtgctgtcggtggcgacgatggtggtggcggcggcggtggagcagcggcggcgccggctgggcgcggtgggagtgaagatgtcgttcctgtggctggtgccgcagcaggtggcggcggggatgtcggaggcgttcgcggcgatcgggcagacggagctgtactacaggcagttcccggagaacatgaggagcgtggcgggggcgctcttcttcctggcgttcgcgctggccaactacgcgagcggcttcatggtggcggcggtgcaccggaccacggggtggctggcgcaggatctgaaccacgcccgcctcgacctcttctacctaaccgtcgcggccatcgcggcggccaacgtctgctacttcctcctctgcgcccgctggtacaggttcaagaacaccaccatcgccgaccacgtcgagctgccggattatcatcatcatcagcccggaaccgccaacaccatagcctccaaggtttaattaattttattatcacaatcgatcactctactgtagatggtagatagatttagaggtacgtcatcgatcgatgcatcaccatacacagtaggagtataatatctgtatgtatcagacgcaaaaacactataatctcttcttcctcctcactctcacgcgttccacggcaagccaatagcccaatactacgtacaatcgccttcctattttatgttaacaagaaaaatgttactaactcactttataggaaaaaaccggaaaataattctaaagcgaggagaaccataaaaacaactatatggagagaaaaacagagaaaaaaaactctgatggcatcaagtccaccactactgcaagcagatatttccaatggcttttcgtagacctgccacaaacgccaacagccaatctatctatctattatattattaaagaaatagaaaaaagagcctccacgttcgctctcatggcctagaaattctcacattaatcggagaaaaagaaaaagcagagtctatatagaaatacaatttaaaaataacgaaaattcggaattaaaaaaataaggaatattagaagaggagactagagtagttattacacattagtagtttcgtaaagttattgcaaaatttaaaattatgttgtcattgtaatatattttaataatataatgagaaaacatatatgctattatatgagagaaaatataatgatgttagccgagcaatctgcgcgggccaccatgctagttatctttggatatcacaattttttacaagcgtgcaccttaaccacgcgtataaaaaatgatttttcatacgacctccttaataaggcgaaaaaatcgatttttttcaagcatgtacttaaagacttaaaacaattgactacacaagatatttgagagtcccattggtcggtctaataagctaaagaaaaactaaaatttaaattttttaacttgattttaagatatttttaacgtaattttttttagcactgactcttaagtcgctaccaataaatatacaaaagttttacctacaaattaaattttattccctattaaatgttttggcttattagagaatatgggcaaccgatgagacactgaaagaaatggtaaaagaaaaaagtgttttggcctcgatcctcatttgcaaaatacaatgataaagtcatcgtcgttgccacgacaatctagtgtcgtggttggatcccccaagccctgtcgggactggcggaactgccaggtcatcatcgtttcgccggtcccaacgaccgtggtagattgaactgcttcctaggcccacgaccattaattcgccgcctcccaagcatgtcgccaccatcgattcgcggcacttggcgaccgccgacgtagtatccatcaggctctgctgcgcctgtcatcgatccaccacttcccaagccggcctccatcgatctatcgcacctggcctccgaggacgttggatgcgccactcccaggtcccatggatgcctcctcttcatatcaccaaccgatccgtaggttagagagaggagaggggagaggtggttgctcctattgttgagattgacatttgagacggatgggggggagctagtgaggagaggagagggagagaggaccggtggattcgatgtgtgggagagggctggggatttggtgcgtgtcactacccttgcgtgcacctagcccgattttatatcaatagttgtttatttctagcaggcagacgtgtattttcacgtgttgttgtctaagagacccgcatgtaaaaatggatctatttttacaggtggtcctcgtaagacgaacacctacaagaaattattttcactagcgggtcttgacagggatcccctatgtatttttgcaggtggatttgctttttttaaaaaaaaacacatcaactttattaagcaagaatagaattaggggataaaccctgttacataaccaaggataaaaattgaaagcaaaagagccacccctgagaagggagggttaactgaactacagaagcaatcttcctgaaataacctaacagcagaaaaaggagcaagtcaacagggatctgtggcgaagccgcgacgactgctatcctgggcctcaaaagatgtgcactccgcttggcaaaccgttaatccccatcggctgcatctacggaaacggcacaagactgaggtttgttgctgagccgtagattttggtgtgtgcgtcaccggactcagcgaaggatccccatgaggctcatcattgaatctaaggagctctaacatcgaccctgtcaaccgaaattgcgcaggtggtccgagctcaacccgaatgacaaacccggtatggtttcttctgttagggaacaacaggaagggtgaatccgaagagcaaccaaccttcaacgatggagcacttgaatggctgcaaatcaacttctgtcttgctgagatgatggagatggttgaggaagaggtggatttgctttcagcccgcgtgcaaaagtcaagagatcatcgggtgtccgcgaaaaccatttgttatagtgtattaagacccgacatagatcatcactgcaccaagctcatcacaatagacaagcaactctaacttattatgacggacaactgtctcaaaccacccaaatatcccaaccgtggagtagaaacttcaaagtgaagtccaccttccatagagaatacaaaaaaaaaaagagaatacaacatcgatctaggatgctggcaacacccgaacactgaacctgttatttacccgaagagagaaccaggccacttaaaactcctccatcatcgctaacaccagtcagagactgggaaaagctagctttcacccgcctaccacaattgcttcgtctgaagtgtagcaataatatgtccctgtttggttaactgatcagtgccaaactttgtctcgatcacgtgtgactagctagcaagtttgatcaatcgaattgaagttaattagcgtttcatgtaacagatacgatgtgccacacggtcttaggctgcgtttgacgtaacgatttggtagagtaacttggtggcacgtgaaataagataaattgttagtatataattaattgagcattaattattattaacttaacaataaactattttttttaaaaaaaatgcatcatgtcgtttagcggtttggaaaacatactatcagaaaggaagtaagttgtcgttttgtgtagctggaaagaactcggtcttatccaataggctcatacgtcgtagacacgttgctttgacgcaacttaacacgagtgtcttggcacattatacagaagtttgtgtggcaaagtgtggagatgtcattaaagcagagtcctaatcttgggatcgatggaatatatatggcgatgagatcgactagctagtgacaccatcttgcagtgaatgaccgatggtgatcttcatcaaagatcacaattgggaccaagatactgtggtccgaaattaagcaggaaaatcacttgccaacggacaaattattttatttaagcaagaaatttcaatccattcctgcctaacaactccacccaacactgcaatctgcacttatgcagtggagatgcgacgtggctgcaatcataaagctttattgtagctaggggtcagctttgtgattaagcccatggttgtctgtagcatgggcacaccatggttgctaggatgggactcaactattcattccccttttgcgtcaaaaagaaaaaaaaatccagtcaaatacttggaccacaataaagtgtacatgaatataaaaaatggatttttcttttacactttaaagtgtaaaaactccaagtatttgaaatactaactactactagtaaagtgtaaacactttatataattaaaaaagagaaaaagaaaaagaataatgggcagtagacgggcccctttggttggcccagtccagtagtacaggtagaaactaaagcccattccattgaacaagaaggagtagaaaagcaaaattgaaggagaaacgtacgagcgtgcgaattggatgcagctgagaaggtgttcgtccgctgcatccgcatccaatccttcccggcgaccgaataccggccgggaaacctccaaaatcgagctggccggcaaggccgaatttcgctacatcggtttcatctatttaagttgagtaagagggaatcatgcgctggactttgaactatgtaatgaacttcattatcattattatgacgatgaactttaaggttgtggagtatgtaggactttagatctgatcgttgttgatggctaaacatatagtttctcaatatttattcatcaggacaatatttcgttagaatattctactagtgaaaaattttagtcttctcaactgttcattagtaccaactaggaaggtggcccgcgcgtatgcgcgggcacttatattattgaaaggtaagatttttattgtttgttcaaagattttgtctcatagattaagggaaaactaaagttcggataatgtaattttataataatttaaggtttctatttttcttaaagtatcttaaaaatccattcacaaatttttaagtaggagatggattaagtacttacgacttttgaatcatgttattttctcgagtaaataataaactatatattgcttgtagtatggctacaaattaaaaatgtgagagcaagatactcaaaattcttgtgattaaatcgtctcatgaaggcgcatgatatagtaagaaagagagggaagcgtatacatgaagaaaagaagaaagggaaaaatgataaaagggaggggaagcataggtacccacgcgtacgtaggtgcgtatcgaaggtggagaggtgggaccttgtagtatttagtttcttctaagatcaatttaatctaatggtttataatattgaacccaccgatttaagtgaaaatcaagtaatagataatttgctttttttcttagaatttctaatatgttctctaatttattagagcaccaagtggtagcttgagggtatttgaaattttaatggacttaccacatgtaatgagaatattaacatgtaatatatatgtatgggatatatgttaatattcattctagctttgtccatgtttatatacatgtagagagaaattaaatatgttgctagcaaaccattagatgtctaattaatagcaaataattttgacacatatttgcaattgttcatagtagctcttaagattcatgttaccactttgattattcgttgatcaccatgattcgcacgaaaaaaatatgtactacttagggtttaggacaacagaaattgatgaattatctgatttatgtgatagctatttgagattataaacaaatgaattaacttctaaatagttaaaaagtcgtttaagaaaagcaccatttataaacttggaaaagcgtggagcgtgcaaatgaaaatgcaaaagatggaatcaataaaaaaaatagggccttaaaactcccttattactcttatcctagtacgaattctattaatatgtgttaatattatgctgaaaatagggaggagattggagaggaatgaatagcatacaactcgagccagagatgggttggcagtgtaacagtgttatgcacatgtgattggagagggaggtggaggggacattgtttttctaatgtttctaaataatgtaggtgagaactcgttgttttctcattctaaaaatctttaacagttgacatatatgtggtggcttaagattttttattaacaaaagcggtagcgttgcagcgatcgtgatcacctaagatgcctcagacacgatgctttgtcacacgtgcgaaaggcaaaggtgtagacgtgcattgtgcagcggaccaaaaagagaactttggacactttagttattaacaatagatatgttgatttaaataatgggtccaccggttctagtgtaaatgtaaattagttaatatatattttaaattgttaatttaatgggtacacaatatgatggtgtagaatttattttaaaatagtacattatttgagaataatagtccaaattaataaaaaaaaagatcccatgatttaaataatgggtccatctgtttaagtgcacgtataattagttaatatagatcttaaattatttatttgataagtacacattataattgtgtaaactttattttaaaatagtgtattatttgaaaataatagtacaaattaatgagtacaccggtttaattggaaattatattgatttaatgggtaaacatataatggtgtaaattttattttcaaagattgtagagctaatttagttaactgtgtttataaagaattatatgatggtatattctttgtttgtaaattatgtttatttagaatatatatatcaattatataaatggaaaaaagaagagagaaaaaggaagaaataattggagggaggcgtacatactacataccaaaataattggaaggaggcgtacgtactgcatacccatgtacgtacgtgagttaggtgggacccatagtatttggtttattttaggatcaattttatctaacggtgtataatattggacccaccaatttaagtgaaaatcaaggggtagatgttttgcttttttcttagaatttacaggattttctctaatttattagagcgccatgtggtaacttgagagcgtttgtaggaagtttaatggacttttagtatataataatagaagatagataatagatagatagattctacctccgtcctaaaataatttaaaataagtacagtgggtatccgtatctaacgtttgaccgttcgttttatttaaataatttgtagaaaaactaaaaaaattagtcacacataaaataatattcatattttatcatctaataacaataaaaatactaattataaaaaaattttaaataagacgaacggttaaacgttgcacattaaccgtgtaaaattacacttattttaaaacggaaggagtactggtcctaatgaacagttgagaagactaaaaacaatctgctacattctctcattcaaagctagcagtgtattcatttatgattatgaggtggagtagctacctacagtttatagaatattgtccatatatattgaaattttcttaactaagggtgcatttgggaggaaaagctcataacttttattttctcatttttcatgtgcacatttttaaactattaaacattacttttttaaaaaaaatatagtaaagttgctttaaaaataattttaatttttttttattttttagctaatacttaattaattgtgtgttaatgtgtcgctttgttttatatggggaagaagttttcaaactttacatttgaacacagcctaaggcggctgtgatctaaagagaagctggggtgagatactctatcattttttgtgagcatactttttaaactgctaaacagtatatttttaataaaaaatatacaaaagttttgacaaatcaaatttccaagtttacaatagctaatactccatttaattaattatgcttgttttcgacgttaacaaaagcgcagccccaacctccattttaaacgtattgtatactaatttagtataggttgaccggcggttggtgtactaatattgcttgtttcaccggtgaaaaataacaggcaaaggtcgcaaccgtcacagcaacctatatatgaaatgaatgcatatatatatatatcgtggaaaatgttaagaaatgcactctataaactaaagtgagtggagtgaagtgacaagcagctagcccatgcgttggttcataaattaatattgcggccccgagggccacgagctgcggactccacacgaaaatgaaagtgatgcatgcatgatatctcactcagattcagaatgcatgcatggcagctaacctagctaagaaattaatctttctttaatttagacaacaaaagaaagagtgaaggagctgaacaaaacaaagaaaacgatcgaggagcaatatttgcagtgacaaagaaaatccaaggtggttgttaattaagaaagtggaaactacatataattgaagagagatcatatctagtggtaggaaggaattgaaggtcgccataagcaggcagttggttagttggggatacgtacaggtacacacacttccttccttgaatcatgcaagtatggcaactacagatgtacctctgcttccgggaaaaaacgagcaattgccaggtcaatcagcaattacaatcgcaaatatatgaaagcattgaattgatgtcaaatggattagcaagtcatcaggatcggagtacagtagcagtatgtaatgggtagttaatcatcatacatatgtgtcaacgttgtcatctcacattaacatcctgcaaatatggagggtttgcctctgtcctattttaagtgcagttgatcttatttaaatttttttattaatatttttattattattggatgataaaatatgactagtattctatgtgtggcttattttttaaaatttgtttataaattttttaaataagacgaacggtcaaatattaaaaaaaaacccacaatcatacttaaaattagactgatggaacagcatcttgttggctacgccctcctactcctgccggccttcaattatttgtccatgagttcctgagtagcattgctaaattactgttactcctctactgtaggtagatcctctgctcgtctattcattcccattcatgtcatgcccccataaatacttgtatacgtacgtacgtacgtggcacactcgtatacatacatatacgtacgcacgcatatatcatacgtgaaattatttggatttggaggtgagatatactagtccagtaggtttgtaagtttgtagttgtagtatataaatggcaggtggaggcagggatgagccggcgcccggccggccggagacctcttcttcttcatccatcctttctttctttctttctttcctaggcctaatcttacataaattattcacacggacaaatctagctaagcacaaggtatgccgccggcgccgtcgcaggagcaaactaagctggcgccggagaagcagcagcacatctccggccatggcgagcaagccgtccggtaccatggatggaaggtcatgccgtacgtcataggtatgtactactgtatcttctagctcctccatggttatatatatatatatatatatcctcccggcctccctagctcttaattagctcctcaccctcagctctgttcttctcctttaactctctccggtttggatcctactcttctcttctttgagcatgcatgtactgtatgtttttattttgaacacaaaaaaaagtaagatggaaatggacatccaacatggctgcagctagctatagcagatgatgacctcctgtagtttagtgaagtgcatagtctcctacatcactagctagatctcttccttttagttagttgctggctccaaatctcagctatcaattcatacgcaatttgtgcgcatatatgcttcagctcgctggatttgcattattgcttcatccatacaccaaagtacacacttcctcttttttttccatctcttttttcccaattaaacgtcaatgaaaaaataaaagcttagtagagaagttagatggtaaatgtggtgaagttatacaatcaaggaagcaagttagtccaaaggcaaccgatgaagcaggcagatggagaggagccatggaggtagaaagaagaagaaaagaagaagaagaaagcaagaaagaagatagacaagatagaagcactgtgcactgcagctgcacatgcctgatggcaccaccaacaatcaattgcattaaagttacccaactgcactacgctagggaagtgtcctcttctcagcccagcccagcgtggtagtaccaatctcagcacctctctctttttcgttttgctttttcaaccacctactggtttcaaactgatttttcttttctttccccccattgaaaccgtttcaattccagtagaagtagggaaagggttcatatgcgttccaaagcacccccaaaaaattatcatctgcacggtgcagtttttaagaccttggaaaacaattatcatttgcatagaggagtatttctctactattatgtcatccatatttaagttggtttttaagttttttcgtttttggaaatacatatccgtgtttgagttgtattttaagtttgttttctttaattgaagatgttttttgtggtattttggtatgccatctgtatttgagccggtttttaagcttgtttccttttggaagcataaaaggtgtcgtataacaaatcttttaaaaaaacttgcatgctaacttgagatgaaatatggactaataattgcaactcatgattttctgaaaaaatatcaagagaattcctaaagtaaattttatcctaactaaaacgtatagcaataataaaattttaaaaaaatatttacatgttgtaatgcacggacattttttctagtcaaacatatataaaagaattactgacaactccctattcttttaaaattatttaccggattatgaaataaattattcgctgcacacttcaatttttctataaacttttttctactgcattatttagaccacttattactaaacggaggagtattttgttaagtttatttattacaatatttcatccatccaaataataagtaaataatgtgcgataattaattaatccactcactaatctatatcaaatggggcctttaagatgatgccatgtctagtagatcttataataccattttgcaaataataatttgtaaataaaaaaagagaaaagtacgaattacccctgaactattggatgagtatgaataacaccactaaactcgaaaatcaaacatcgctcaccccgaactttcaataccggacaagaaaccccctagcactattgcgagcagtttagagttcgtatagcacacgtggcagtccagttagtaatttttttctaaaaaaaatagcgggcccacttgtcagaatccccacatctatttctctctcttctccctctcgttctaaagagcgcggcggcggtgggccggccacgcgtttctgaaggagagggggaagagaaagagggtgtggattctgtcaagttggcatgctattttttagaaaaatattgctgagtggactgtgccacgtgtaatattcgaactccaaaccgctcgcaacattgttcccggggagggtgggggaggggggtttcttgttcggttttgaaagtttgaggtgagcgatgtgtggttttcaactttagaggtgttattcgtactcacccaatagttagggggtaattcttacttttctcttaaaaaaaagggatggagtttgacacgagacgatggatcagggaacgagacatgcgaaaggctggggacgatcggcacgacggcgaacctgctggtgtacctcaccaccgtcttccacatccccagcgccgccgccgccaccctcctcaacgtcttctccggtacctccaacctcgcccctctcctcggcgccttcctctgcgacgcctacctcggccgctacgccaccctcgccgccgcctccatcgcctccttcctcggcatgcttgtgctcaccctcaccgccgccatcccatctctccaccccccaccttgtgcctcctcctcgtccacgtcgtgccagggccccacgcaccgccagctcgccgcgctcctcgcctccttcgccttcctcgtcgtcggcgccggcggcatccgcccctgcaacctcgccttcggcgccgaccagttcgacccggccaccgccgcgggccgccgcggcatcgccagcttcttcaactggtactacttcaccttcaccatcgccatgatggtgtccgccacgctcatcatctacctccagagcaacatcaactgggccatcggcctcgccgtgcccaccgcgctcatggccctctcctgcgcgctcttcttcatgggcacccgcctctacgtccgcgtccgccccgagggcagccccttcaccagcttcgcccaggtgctcgtcgccgccgcccgcaagaggcgcctccctgccccggcgtctcctgccgacgacctgttcgatccgccgcaccggagcaagctggtggccaagatcaagcacacggaccagttccggtggctggacaaggccgcggtggtgacggcggaggacgcggtggtggacggcatgagcgcggcggcggcgacccgtggcggctgtgcacggtgcagcaggtggaggaggtgaaggtgcttgcgcggatgatcccggtgtggtcgtcgtcgatcgtgtactacgtgatgctgacgcagctgggcacgtacacggtgttccaggtgatgcagtcgga

SEQ ID NO: 76428 - DNA, 1259 bp, Oryza sativa
ttcctgcagcccaggcgttggccgtacgcagctcgccatcgtcgccctttaaagtgcgccattgccgctccggtcgcggcccctccctttcccaaaagcaaacaagggataggtttgccgttcagcccccacccagagccagcggactgcacctcgcagtccggcatggctggacagatgctaccgccgattgcgcttgttgctgtggccatctgtatcaccgcggcggcggcggcgaaggtgccggcgatatacgtgttcggcgactccacggccgatgtcggcaacaacaactacctgaccggcgccgccgtgccgcgggcaaacttcccgcacaacggcattgacttccccacgtcgcggcccaccggccggttcagcaacgggtacaacggcgtcgacttcttgggtacgtacagcttcgccgcccgtctttcctgtgctgtattgcctcgcgactctgcttgccatgcgatgcgagtatacttcggcacttcgcggtatagtagcggctggcatcgttgcatatctgacaaccacgtatatagccggtgattgtttcgttttttctgcatgttttttgtcaacttcggcattgcaagttttgtaacggtgctagagttgagtaggggtgaagactggagacgattaagtcttcgtctctatactatttccgcggtccaattaccgaaggcaagaagtggaaattgctttgaaaacggagagattgtcgcatactccctccgtcccaaaaaaaaccaacaaaggttgtgccatactacctttgtaaaaaaaaaaactacggagagtatgtttagatttgtttttgttttatggatcatatcttatcttaatataacaatattttgagagggagtaaatagaacataaaaaatgttttgaagaagaaccccatacttcagaactgtgaagtgcgcaacgccagggcagtgtgccactgtggcgcacacattccagaggtcgcctatgcttaaatcgatagttggctcgttgctgcccgaattaaatttgaaaatatattgttaattcattttatttttagaaatattcgagatttattttttaaaaaaattataccgttgatcttgcacaatcattatgcgaatgtgaggtggtgcgacttcgcgggcggtatcgcgcgagactgcgcggtcttgcgaaatgaaagaacgataccagatttcaaaatggttaattagtgattaattattatgattagcaattattaagtaatcatt

SEQ ID NO: 76429 - DNA, 5173 bp, Oryza sativa
cgccgatgccactgcctcccttgcctgccgcggggcgtcagacgaaggcgcgcgatgccagctagtgcgcgcgccggtagcgatcatcgccgatccagtgaaccgtttctattcaagcctttttttttcaaaaaaataaaggtatgaattaccccctcctagcgaactcttacggtcaaccgaattatctcctctgaacctaaaaaatataaaaaaacagacatattcaccttgaacatttaataccggacaaattaccccctcaacttaatatagagcggttttgttttacgtgtcatacgtgtagaatttcagtcaacattttctgattcggggttaatccgtgtggatttgaccataggcgtatctgattttcctttgaattgaatttctctatttttctatccaaaattccatgatccaaaggagtctgaaaaggtttcagggctctggttgcattttaaagaaattttcaggattttggtgttgttcatgtgtatttggaacacaggaagagataaaattaaaaacacaggaattttagctacaccgatcatttcacgggataaaacgtgggaaaagaaacacatccggtcaaaacctctttctttttttttttttgaaaagagagaatatattaatgactgaaattggggttacattctaggttgagtagttcagtgagttctgcaggagaacttaacaaccattcaccgcagattcctgaacttactactaatctaggtagcttatgcgctactccgtttgattctctctttatcttgtgcacctgcacctgttgtagacactccatccatcttagtgcctccctgatcgtcccagcccactccgatctcaactgagtattgtttgctagtattacaacatactccctctaaaataagttaatctaatattagatgtgatataacatatatataacactctctctgttttatattataacttgtttaatttttttaagttaaatttatttaagtttgaccaagtttttaaaaaatataataacatttccactacaaaataaatgttgtatcaaaatatattgaatattaaaatttaatgaaattaatttgatattgtagatgttactaatatcttctataaacttagtcaaacctaaataattttgactaaatataagctaaataacctacttcctccgtcccaaaatatagtaatttttaactatgaatctggacacgaatcccaaaatatagctaaaaattgttatattttaggacggagcagcataatatgaaacgtcggtaatcaacaactaaaaacatgatttaatagaagtagataggacagttctcacttatacattgtcgtgctattttttatagtcctaacatcacgtcaaccacgtcaaatgagtgatgtgcagggtttacagtaccaacggtagccggttgattaccacgaaaactattggctaagtaggatcgagagcataaaataggcagttttctgattaagtttaaataaattcaaattgaattttaattcgactatgagttttcacttctatcattgattttctttttgttgctatgaagttaccgtttcagcttttagccacgcgaatcatcgatattgctttgtcgtaggttttcatgaaaaccgagaattcttgtctcgacatcggtttggtgaacctttggtgatgagatcgttggctcaccatatttgcaagggggaaattgctgcatgccgcacggccaccgtgacatcatttgattaagagatccactttaatttggtgcggtacagtacatggtgcaatgagaggattggagtgggtgatgctcactcatgagcctggtgagtggtaactgacggcctgacggggcgccagtaactgggtgaggggatggaatggtccgaagcctacccattgctacgtgactcgtctgaagctctgaccacgggtcggtgactcggtgtaacttctgattacagattcccgaagcctacccattgctacctccctccaaaaagtataagcatttttaacactaatataggagtagatattaaaaatatatattaaaatgattggataaaagttataataattaagaaaagaaaatatataaatagttaaattcaattcaattggctgtgattggttgagagtaatttggatgtttggttgatgcctaaccttaccgtaactagttgtgtcatgatggcataagtgcaacttaaaaatagttagtcacaagtgtgatatacttagcttcaactttaagagaatgacataaggctaaaaaagtatggcataacatagttgcgataacgaaacaaatacatatataagaagctattgcataactaaaatatgacatggtaaagtacggtaaccaaccaaatacccttagatcagtggaaaaatagtttcattttaacatatgctattttattagaaatatcttcatcttgtcaacataggcgtgttcataaatggagaaacaatatccaaccttcatgcaacaaatcggcggcctatgatgggaacatggttcttggggcctgatccaaaaattgttggaaaggactatgattgcctttgttcgggagctgaagaatgtgtggcccatacccgtgaaatctctacatagtggcatagtgcggcataagtccagttaacatcccctatcttttcatctttactcctcaatttataataccgggttaaattaggtcctccgacaatatcgatggctggttttagtgaggtgggaagttgacccggtccacctgggctaactaggcgttcacgtgacaaaaacaaagtggctcccacatgtcatactcttctctctacccctctttttctcttgagatgtgccgcaacgccccaccgacgcatggggagccgctctagtccacgtgcctggatccccaacaagatgtcgccgaggacatggcggagtccattattggcttgagcacccacaattaggcgctccgctcagccagcccgtgctgcaggcacacatcggagaagggacaataccgcgttgcggcctctaccatccgcccgatggtgccatcggttgcaaccactccacccaccgcgtcgaaggcaccccgtagggagtagagtgtcgggtgtaacgacacatggccgcaaaggtggcgggagacgctgacactactgagatgcaaatggattgctgcaccacaccattagggagtgcgtccatgccgttgtcaccaccacgctcatgcacctcagaggcgtggctaaggggaggccgtgaggcattaggaggagagtactgctagctacggccgtgcagagcaataggagcacagggtgtggtggaggaggcgtgatggggttgtggcgaccaccgctgtagccatggcggcgaggagaggtgggggcgtgttgatgtaaaaatacgaggcctgtgagatctacttaactcgattaccaaatttggtcgttaacagggtgtctcggggacggccaggaacacggcagcagacaccgacgacggcacccttaatggcggtgagctcgacaatgccacggcatccgtgcctaaaaccatcaagccactaactcggtgatggcggagaatagaggggtggcagctaggtcgcatcctcatatctcccctacacattccttaagatcagtgcacagctcagtcactaccaagtaccagcggtgtcaacaaactcgtcgtaggcggcaacacatgttgaggctctttgtcggcctcgcccaaaggatgtggatgagagcgacacgagggagtgggctgtcgccgccgtcagaaagggaaggagctcgggaggaggcggccacagcttttagcggtcatggaggggtagatgttagtagggcgatgaggccgttaacaccgacgagaacctcgttgttcccacccacctcattgtggccaccgaggggaataacggggaacatatgagagagtggatagaggacgatgttaatgacatgtgggccctatatgctacgtaggtgcaacatcggctaaaagaaactcctatactgctttaggatttcttctacatcggtattgtaaattaggggttaagatttgtcttgtagtttagaactcgatggtaagatgagggatgtaaagtgacttactccgccccatagtgctgataggaattttcccaaaatatgcatttcttctttctcgtgtagaactgaacattactgtatattgatgacccaataaggaaatactccaaatataacgatacaatactcgatcatcttaaaatataacacacaattagacacacacaatcatttgaatatattattacattttaggacgaataaagtatataactaagcttgtattaggggtaccataatggtaacagtacagtaatcacaattcaagcatatttttttaaaaaataatttttaattattttttttaaaaaaggctatttttgagttgccacgcgcattaaccaaaattattgtcgatgtaagagcaagaataatagtgatagccccatcgtttggcctaaacaaccaaagaataagccaaaatttgaatttttgaagttgattttaaaatgcttttaacgtaatttttgttaatgttggcttttaagtcgctacgaacaaatctacaaaagttttacttataaattaattttaattttctaataagccaaataagccaatttggaccaaatgggcaactgatgagagcctaagtatgtatgaaggagagagaaatatattaaatgcttcaagataaataatgctctctacccttcatgataaatacatgaaatacataagtatgagaaagatataggagaaaaaaaaaaccaagtttatagctactaatattggtgtactaactttcacatgaactaatacaatgagctctatccaacagcaaacaacggacttcaacaaaggcggcaataaaccaatcggtgaagcagtgaccctgcccacagaaaggctcccgttttccatccatgggatcggtcacccaaaacccaccggatgacgacgcggccgcctcccctaccccgcgccacgccaatccatcccacccccaccgtgcccatcccaaccgaaaatattcccagcatattcccccgagatcccgcatcccccctcccggcc

SEQ ID NO: 76430 - DNA, 4650 bp, Oryza sativa
aacaagagcaagcttgcgatgaatgaaacggttgaaaagacgagtttgcactctctgaccttgaagttgttttgagaatgccagccaaagatatgtccatgaaatatgctggaatccatgatttacgaatgtcaaacctatttgacagccactcattgtcctccaagtgaaagtccaaaatgatagatttccactgtgattcgaactcagtagcagtttctgatctccaaacacatgacttcatcatttcccttaaatcgcagtcttctctccatagtggtccgatcttgtctgacattttttccatgatatgccacatacacaacctatgcaccgtggttggaaaaactttttcaatagctgctttcatgctggcatcttcgtcagttatgatgagtgtaggggctttccctcccattgctcttaggaaggtcttaaacaaccaaacatatgctggaatcttctcatttgctaagaatgcagcaccataaaacacactttgcaagtgatgatttaccccagtaaatggtgcaaaaatcatgtcatactggttagtggtgtacgtagaatcaaatgatacgatatcgccaaagtgactatagttcttcctgcttgtagcatctgcccaaaacacatacttcaatctgccatgttcatccacatcaaaatcataaaaaaaggatgaattgacctcattttttctacatagctgggccacaaacatttgagcatccgcattcttaattttctttcttaggtcccgatagtaattctgcaagtctctcttagtgcatccaacattctgaaatcccccatcactcacgtgaaggagcctatatgcctgggaggttcctatgcttgctctgctgcatgtgaagagtgtagtttttgccctctcactaacttcacgatttgatcttatcaaatgcagcttatctggcgatacaagtccatgactatggtgctcaaccaaggaagctatcgtgtacttgttatcagaacatagcttcacgtaaatgtgtgcatcacatccacatctagtttctttcaatttaatcttttttttcttcgatggatcaacaatctccttatcattcacatgtttccatccttgccttgagcacacaaagtgcttgcactgaaccacgccatccaacttcttttgctgcccaatacgcactgagaacccaacttggtgtgcatatgacttgtaaaatttttcaacagaggcaatatcttcaaatgtcatccctaccgcaggccttatcttatcatcacactctggtgtaaaaacggagcactgcaaaatcacatatacattgcaataagcattttaaagcacctcagtcataatttttaaattgccagtgtacttacattgagtggaattcttgatattttttttggtgtactggtgttgtcatcctctattactggagaagttatatcatcatttgaataaatatctgagttatctcgcacatccaatctatttattgcctccatctgcaaaaaaaaaaacagatagcaaacaactgagattaaacctttaatttccttgagtgaacaattatgttggagttacctaccttaatatgcagtaacaacaatacagtgtacttgccaggttatggaaatctgtagctagtctgaacgaaaattagtgcaatctaatcttgtctcttgatgtatgcaatatggagcagccgcacgccagcaccagctatccctaactagcctgtatatgaacgatatgaatgagaagaaactaaaaataccgtagcatcaggttcgaagtagtggaatgattcgtctcttgatggtgtagaatgattcgaagtagtcacaaggttcggatgaacagaagacatctgagagcaaaacaacgatccccttcgcctcgatgaaatattttgccggcggcgcgccgcgcatggaaccacaagaggagctgaagaggcgtagcatatcagcgccgtgattaacgagatcagctgaagaggcggtaccagatgggctgttctgcaaaacagaagtggaggaggcgggcgtgtattcgtaaaattgccacgctaggagacttggccgtaggatgtcgatcgaacggatccggacgcacgtgtacacgagtgcagctgtactcccgtgtgcacaggatacccttcctacttataattggcttgctatttgtagagttatgcatactattgccaaatatagtcttagtcaatgaacaactaacattaacaactcctagtacctcgaggggcaagaggattggagcactgtaaaaacactaataatagtcatgggtcgtgctaatagaaattctcattttacaagaagggcaacaatcatgtttcttccgccttacacacttaattaacattggtcacacgacagcggaacagctagctcatggcattcggtccaagccaagtgcacctcatatgtacgcgtgacaaagagggtagcatatatgtctggctcaaacctcactagcaacgcccgagatacgaactcttttgcttgccctgttagaactcctattctattgcatatcaacatacttttgtttgccggttcattctatttatcctcgtcgacatcacatatttacatccttcagaaatgggttaaaggacggtgatatgaatcaatgaccaggtcgtcatagagctaggttagttggcatggagctcgagaagaacggcaggctgtttggttgatagtcgaattttaccatgtcaaatcttaggtgtagcgtaatttcttatacagtgtttgattgtgtgttacacttggagttaagtcacactttattagtatgttagctcacacattatatatactcttattttcaagacaaagtttatcacaattgtgactaaccgatagtgataaagttaacctccatccaaacagtctcagctagttaaatgaggaaatgaacataatagatagatagatagaggatgaaggaggaggagaatagttatacacggaagtattatgaacaagataaaaattaagttttagttcctccatcccacaatggggttgatcgtttgtgctactttccagctgcaggcatctggagcaacaatagtagcaatcgaaaaattaattgtggctgcagcagctgctacggctgtgctgccacagctagcacaaacaaacaacccaaatataaataactttggatggatatgacacatactaaggctatgttctttgcccagggttcccaacccctcttcttcgttttctacgcgcacgcttttcaaactgctaaacattgtattttttgtaaaaagtttctatattaaagttgcttaaaaaatcatattgatccatttttttaaaaaaattagctaatacttaattaatcacgcgttaatggaccgctccatttttcgcccggagggaatgagtttccaacctacatgaacgaatgcaacctaatactacgaatctgaacgaactattcgcttggattgagggccctcttgatgcttaggttaagatttagttaaacttttaattttctaactatcaataatttttgaaatgcttagtttgaaaccaaaagaattgttcagcatatatttgtcttaaaaaacctataatcatcataaaatttattagatcttaagcttattttgatataaaattgatattggaatttttttatgctttaccaaatctataaacgtcaaaaaaattattgaagagaataatatcgaaaataaatatgtttttattgaagggtataatattgtaaacttgttttcgatgataaatatttaggacgtcgaaaaatgatgagataccaacatcgttgtcattgatacatggttatttggccttagagcccgtatataattttctcttttcaaaaagaaaagaaacattatacttcattcgtcttagagaatttagattaataagacacgtcgtattactacgaatctaaacaagataaatatttctatgtgccatccaaaatccttatatttcagaaggaaggaaatacaaacgtacacgatcaccacgcgcacactgacttaatgtacacatttacatccctacttatatgagcacttttcaaagactgtgatgtgtcatgatgattacaatttcatatactttttacacttgcaagttggaactatccaaatttttccataaaaatgtaggaaaacgtgttcgcggtgagcgtgccattgtgcatttgtgctgccaccacattcacacgactaacatggttagcgaatgagaaattgctggacaggttcacacgacacgagtgcactccactagtagtggatggttagcgaataaagagaagagcggacggcgttatcaaatccgtcaaggaaaccacatctgaagttgtgaacccccaatccaattccaatctccccctttcatcagcgccatggctctctcctccttctccatgtccctccccttcgccaagctgccttccacctccaaatccacccgcttccttcccatccgggcctcctctgccgccgccgccgcctccccttccttcgatttgcgcctctattggacatccctgatcgccgatgtggaggccgagctcgacgccgcgatgcccatccgcacgccggagagaatcca

SEQ ID NO: 76431 - DNA, 1114 bp, Oryza sativa
cctgcagccccaagctactcgcgggaaagttaaataggatgatgggaagaataactcacaacgtatttacgcttgcgccttgcgtggtccgtgttttcacgctgatcagtagtatatgtttgcattggtttgctagtcaggccgtctcggaccaactgccgtccggtgattatttctcgttggtttggtcgtaacaaaaggtcacggctttgtctaaaagaatccgaaaagtgtttttatttctcgagagatatttagtttaactttttttacaacttatatatgttgaattttgccttttgtggattggtatatttcatattaatctatattttcatatattgtttttaaaaaattttctataactatttagatgacataaaaaaagaggggacatcttctggaaggatgaaaatccatctacaaaagaacttgatgttggatgggtcaatcaaagcatgcttttggttaagggacgggattgggttgggtcgaacctatttatttatcagggtatttggtttaaaaataagtaagatggaattgtacccatctaagattcggattggccttatccctaaaaagttgacataccaatccaactcacttttcttccttgctggcatatgagctgcaatataaaacataggatcatcaactctctcgtgccttacggatagacggtatcaccccaccctaaaaacagtgatgaatttgatccaacccaccccacccacaaaccaaacatatgtaaatgaacttgagtaataaactttgttttttatcaggtggctcaatggaccaatatgtcaggattaattattccaccaaggatttctttattaagacccaaatttctccaaataatagatgattaccccgccgtgttgctgcgggaaattaagttgtatagtatgtacaaataagctatattatattttgtaaaagaaaataaaatgacttcctatgttttatataatttacacatgattgcaaatataatgcaaggtgaacatattttatataattgatacatatgaattttgaagaaaaaaacgattgaaattgtatggttttatgatagaagaaagaagagactattttagggctgcag

SEQ ID NO: 76432 - DNA, 991 bp, Oryza sativa
tatttttggttgaagtttttggcgagggttagttttcaaaataagttttttaaaaggaccaaattgtcaaaaaaaaaaaacggtaacaacctcaggtccacggcatatgatccatatccatgttccagctcttggtcagcacatacactgtttaaacgcttgcacaatcacggccaaatccataacaacaaacgctagcactacgcttgagctcgcactggtagttcacagcatggagtctccaacttcaccggttaccttctcgatgccgctcatcctccagccattggcctgcggcgctaccgttaccatcgtcaacaactgcaccttcacggtgcgcgcgggcgccctcccaatcgtcggcggctaatggctcacctcaccccagggctcgtgtgggccgtcaacgtgttcccccggcgtcaccatctggcgagcaccggatgctccctcagcggcagtggcaacacggtctttgcccaggccagctccaagtccggcgactgcggcggcaggctgaattgcaccgtccctggcaccccgccggacggccggctctggagcagggccataagggcgatggcctagggcccagccaaaatggaggctccgatccaggtatataccctatataggtatttagcccaatagcttagaattgatccttctcactgattagaattgatgatccaatccattgatccttctcactagatcaggtgatgatccaatccatcgattctcttcactgattcgaattgaactgttcttttaatttattttttgttccccattaaattacctagattagggacttagggttctaccattctggttcaaccgttcaagggatcaatataagtatacaaccattcagtgcaccataagtccataagctaattaaattaagcgtatatggtggattagttttcattaggcctaggcccttgattatatagatttttccctcactgattttggctgcaggaat

SEQ ID NO: 76433 - DNA, 2372 bp, Oryza sativa
ataaaatcaatcccatccaaattcactacacgatcagcagcaaaggaaatgatgaaccttttggctgcaggatcctccgctttagttctggtggtgaagttgtggaaattgtgtgttccaacatattttttgagaattctattaaacctctctttgacttcatgagtgtaagaaaatgcacttctcaggggcatctcttctagactgctgccttcataatccacatcttgtttcttttcatcttcagtaacaacatccatagcttgtttctttccatcttcagtaacaacagtctcaatactacctttcttttcagccacaaatgaaggatcaacatcaactgaatctgaattcgtgttggaatctgaattcaggatggggcaaacagtctcactattgctagctggtacagcttcagaacagagagtaccacctgacagttgaacatcacatttttctgcaccatttgatctcatttcagtgatttgggtattggtttcattatcagggataggtaaatcaacactacgatcgccagtgcttgcaggatcacaatttgcatcctcatttgaacccactgcagcttcctcccgggaagcctcaacagatttctcctcctgaagggcaggatcgggtaccttaccctcccggcccatgacaccgggcaccttcctacccctctctgagcactcaaggcacttcgtaagctcgctcccactcccaacgctcgccatgacggcctcacggtcggggtgcgcgctggggtcgagcgcgaacacgggcagcaggtacacatacctccggcggtcgcagaacttcttcgcgttgaacgagttggtgacgcggacgtagccgaaggcgcggatctggggcgcgagctgcgcattcaggcgatcagtgaagacgggcgggtcgacgtagaagcggccggagacgacctgcgccgcggcgctgacgcccttgtcggtgcgcgccgcgcgggcccagtcgtagcggcggggcgcggcgcggtcggcctcgggcacggcgccggcccggtagagcgcctcctccaggtccccctcgatggtgcgcgcgcccgggttcttctgcatgccctggtaccccgcgccgcagtagccgagcaggatggccaccttgcgacgcttgtaccggggggcgcggggctgcgcgccgtcggcgccagcggcggaaggcgaggtgggctcctggtcggggtcggaggaggaggacatcttgcggcgcttggggtgaggcggggaggccggtggcgaggcggcggccatcggagccgcgggggttttagatggctagggtttgggtgcggatcggggcaaagtgaaggggagaacaaaggaatcgaatcgggtcacagtgctgcagtttagaaatggggacatttcatttcatcaagaaaaaaaaaaggaaaaataatacgggaggcaaatttgcctaactgggccgaattaaaagcccatgattatatagaccgtgggccgcgaaagaacggggaggaatactcttgggattacgaaggtcggttgttgacttcttgttggcttgtttagtaccataccgattatgttggggaattatagatgcggaaggcgctataaaacgaggaggtgagcgatcgttagaactcatctttgcgcttggggcaatgacgcagctagtgaggttataccgaggcgcgtcaattgctggttgaaaactatttccaaaccccctttgcggcccatccgggcctcagagaatttctggaagggctccctaactagggtaaagcccacaattctaaacttaagtttgcatttggaaagttatcccaaagttaacgcaattttgaattcggttttgtgatatccaaagctaaatactctctccgtttctaaatatttgatgctgttgatttttttaaatagactgctcgttttattcaaaaattttaagtaattattaattctttttctatcatttaattcattgttaaatatacttatatttatacatatatagtttttaaataagacgaacggtcgaacatgtgctaaaaaatcaacggtgtcaaatatttaggaatggagagagtatcaattttttattctaatttgtgatgctacgaccaactttacctttcatacgtataatcactcttaacaaccaccgttttttgacaatttggtactttaagaaaacttatttcaaaactaaccctcgtcaaaaacttcaactaaaaatagaccgtggacttagcgtcaatcccgttggtgctatggtccaacgtctcagcgccagtacgacgctaaaatttgccacgctagcagagttgattgtggacgtggtacataataagtaggggctgcaggaat

SEQ ID NO: 76434 - DNA, 9591 bp, Oryza sativa
cccagcccaattctactggggtccacacactcgggttggtacaagctgttgggccgcttttcacgtgtcgatcgccgcaacaagggttgctttgaatcttgtctcctgccttgctcttcgccttcctgagatggtcctgaagtagtgcatgccatgacattcccccttccttgaaacgaagctgttcccaagcttttgtctgaggaaaacgttgttgtagttcttgtagattttcccatgtcaccacagcagagtctggacctgaccatcggattagaacctgctccaccatcttagcacctttatgcacagatcgacgatctatcacctgctgaggaacaggagtaacagcatctgcatcatccaggattggcaatttggaatgaacttgatctgatggagctactgccttattgagttgtgagacatgaatcaccggatgaataagacaggaagggggtagatcaagacggtaggccactgatcccaccttagcaagcacctggaatggtccatagaaacgaaatgacaacttcctattggtgcaagtgaccacagactgctgcacaaaaggttggagtttcatatatacccagtcaccaacagcaaacgaacgctcggaatgcttggtatccgcctgatgcttcatgcgcatttgtgctcttagtaaatgctcacgaataagagtctgcatcttgtctctctcatgaagccaatctgataattccggtgcagaacatgcagcagaggccgtcaacccaaaataacgaggtttatgaccataaagaacttcaaatggagtagtacccagcgaagagtggaaagatgtattataccaatattccgcgagggctaaccaacggctccattgtgaaggactagcatgcacaaagcatctcaaaaaggttttgagacactgattcatcctttcagtttgcctatcggattgtggatggtaagaggaactcattctcaactgagtgcctgcaagtctgaacaaagtagtccacaggttactagtgaagatacggtcctgatcagagatgatagcctcaggcaatccatgtaatcgatgaatgtgttgcatatatgcctcagcaacctccaaagttgtaaatgggtgtgccaaagccacaaagtgtgcatacttcgagaatttatccaccactaccaagatgcaattaaaggtagaagaccgaggcaaaccttcaatgaagtctaaagagacaatttgccaagattgctctggaaccggtaatggctgcaacatcccaggatacttcacatgctctcctttggcctgttgacatatggtacaatgttgaatgaacttcactacatcagatcgcagaccaatccaagcaaataactgtttaatcctttgataagtcatagtaatgccagaatgtcccccaatggcagctgtatgcaagtttgctaaaatctttcgctggacaataggattatttcctatccacattttatccttaaaatagagaagaccatttttcaaagtgaaatctgggattgcagaattattgatacataaggtttgaaccttactaagagagtcagagtcctgggcatagccttcaatcacttcttgagtccattctggaatacaaactgagagagctgacagcaccacagtttctttatcaggataccgagacaaggcatcagctgcactattttcagaacctttcttatagagaattttgtactgaagaccaagcagtttggtgagtgctttgtgttgccaaggtgtagtgagacgctgttcatctaagaaagccaagctgcggtggtcagtacgaattgaaaactcggcatgttgcaagtacggtctccaatgatcgattgctagcataattgccaaactttccttctcataagtggacaatcccaaatgtcgaggacccaacgccttactaaggaaagccacaggatgatttctttgcattaaaactgcacctattcccttatccgatgcatcagtttcaaccacaaaaggaatagagaaatctggcagtgcaaggaccggtgccgacacaagtgtgtgcttaagggtgaggaaagcttcattagtcattgaggtccaagcaaacaactgacctttacgcaaaagattagtaagaggcttactgatgatgccgaaattcttgacaaatttgcggtagtaccctgccaagcccagaaaactgcgcaactccttgaccgattgcggtgtaggccaatctctaactgctgcaattttgtcagtttctgtggccactccatttggaccaatgctatgccccaagtacgataacttttgttgggcaaatgagcatttactctgtttaaccttcaaaccatgtttgttcagaatctgaaaaactgcccgaagatgatggatatgatcttctagagttctgctgtagatcaatatgtcatcgacaaaaaccaacacacaacgtcgaagtaatgttgacaggatgctattcattattccctgaaatgttgctggtgcactggtcagtccgaacggtagcactctaaactcgaagtgcccatggtgagtacggaaggcagtcttatgctcatcctctactttcattctgatttgatgatatacagcgcgtaaatctaactttgtaaaccattgtgcacctgacagttcatccaacaactcatcaattattggcaaagggcatttgttcttcactgtgatggcgtttaggtgtctgtaatccacacaaaaatgccaagatccgtctttcttcttcactagtaagactggagaggcaaagggactagtgttgtgttgtatgatgccattttgcaacatttcagtgacctgagcttctatttcatcctttttgtgccggtgtgtaacgatatggtctcacattgatcggttgtgccccaggtagcaatggtatagagtgatcaaagggtcttgtgggaggtaacccttttggttcagcaaaaactgtagtaaactcctgcattagttcctgtacaggaactggaatggtctcaggctcaacatcatccgtgattgaacaaagttgaaccatatgtgccacagccttgcgttgttggaactgttgcatttcatttgccgaaagaattttgcaatgagccaattctgaatgcaccccttgcagtgtgacggtagttccctgcaagcttaaagtgatagttttcagagaccaatccactgacattggactgtgtttcattagccaatccattcccaagatcatgtcatagctggttataggtaaaacccttagagttgtctgaaatttatgaccctgcacttgccattcacagtttggaataattgctccacaacacaatgtctctccattcgccactcggactgacaaccttctagagagaggctgtattcctgtcaatccttcagctatctgtgaactaatgaagctgacagaactgccggaatccactaaaaccaataactccttaccctgtaattgccccaacattcgcatggttccatctggttcagtcccttgtactgcttgtaaggaaatggccataagttccctagtcaaagaaccattctgtccagcattctctgattcaacatgactgtcttcttctaagaacagacatagtaactcttgtaccacattcaattgcactgatgaagcacacttatgatttggagaccacttctcagcacagacataacacaacccttgagctcgccgataagatttcagagcagacactttttcagttaggcttgtcggactgcgaacagtatctgaactgcgtctctcatctgcacgattactgacaggcactccccctccttttcctggtggtaatggtaatggccaagccccttttccattaatcttcagagaagagcttccatctgatttcttaaactctctgacagtggtaggtggagaattttccatcacttcttcctgcaacaaggcaacagcaagggcagactcgaggtccttgggacgttgtaacaaaactgcatttctaatctccctccttaaccctttagtaaatctatgagtcaagtactttgagctaagagttgggtcataaactaacagttgattcatcaattcatcaaagcgttcataaaactcccaaactgtaccattctgttttatgctatccatttgcctaatcaaattctcatgttgatccctatcaaattttgcagaaacagcagcacaaaaatcttcccacattggaaatctcaaatgagctctagaagatctcaaccaagatgctgctcgtcctaggaagtaaatggttgctatcctcacccataaccccgggaaagtattgttaacatcaaaatagtgctcacacttcatcctccactcctgagagtctgaaccatcaaattttgggaagtctaacttaggcacccgatgattgtactgtctatcaccatgctcagaatcaaattccccagactcccaacctcccccatcaaatttagaagtaaaattcggggtgaaatcaatcgtacccttgcccggggctggaccctgagtcgaactgaccaccggtgtccttccccggaaattcatctgaacgtggtggcctgcagcccatttgcttcctccttcggctgcggcgagttgggtggaagtcggcggcgtcggaagccgcgccgccttcgcctccgatggagtcggcagcagcggcgccttcctttcctcacccgtcgatgggactcaaggggaagacgcagccggtgcagattgctgagatttgccgacgaggtcgagttactgacgaagttcgctgacttcctcgcgcaacccctgaattgctgattccacttgaggtctccatccactcactcccgcatccaacttcaccacggctgcttgcgtctccgcctgcttggtgttgagcgatgcgagggattcctggatgtcgccgaggattttgccgaagtccagattctgcttttccatcgcctccacttgcaattgcaacctagatgtatagcgtggcttctccaggatgattgctctgataccaaattgttacgtctctgaagaatttgtgccacaacaagggaagaaattgaggatttagggagagaattgagagtttggggaagaacagctaagaacaggtagaggcagcaatagaacagggagagatttgaattgatttccgaatatttgtttctacaatgtttgattcgttctcttccctgccggtctcttatagcgatgagctatggacctctctccctcactgtggcccagcccaattctactgggtccacacactcggttggtacaagctgttgggccgcttttcacgtgtcgatcgccgcaacaagggttgctttgaatcttgtctcctgccttgctcttcgccttcctgagatggtcctgaagtagtgcatgccgtgacaataatactttaaaaaatcaaataaaatctatttttaaaaatttcaataattaatatttagttaataatcatgtttctcgttttaggtacagttaatcggtaaaaataatctacaaaagaagtcggccttagaatgatttacatactggagtactagtagtaattctgctgttaggaggcccaaggtgtgtttagtttgagaaaagaaaatttttgagtgccacatcggatgtttgatcggatgtcggaagtggtttttggacacgaatgaaaaaactaatttcatatctcgcctggaaactgcgaggaatttattaagcctaaataatccgtcattagtacatatgggttattgtagcacttatgactaatcataaactaattagactcaaaagattcctctcgcgatttccatgtaaactgtgtaattaaattttttaatctatatttaatgctgcatgtatgtgtttaaagattcgatgcgacttttttagaaaaaaaaattgggaactactcaaggcccagtttgtttatctgtatggaggttattgatgcagggttgcagacgacttgtcttttatttatctctcaccaccaagcaaaaatcaaagatctgaaatactttttacagttttactccactgctagtgtggtgtgcaggatgaacaagcaagaagccaagaagaggataggagaggagaagaaggcaaagacatggaaaaagatggggagaatcggagcagaaaaaagccggggattgggggctgccatgtcgacccgccattgctccacttcctctgcctctgcgtctgggagtgggaccccactcgatcgatcacttcccgcctcctcgcctctctctctctctctctttctctgctctctctgcacttgcagagttgcagcagagaagcgcttcttcttcttcttcttcttcttcttcaattcttggaccattcttcccttctctcctcctttccccaacccaaacacaacccagccgcagcagcaacaaacgaaaccctagcctagccaggacggcatcatgtcgctgcccgacctcttcgagaagcttctcggcgacggtattgcgctgcattcatcatgtcttcttctcttcattctttattcttaatctaatctcttcctcctcctcctcgatccctttgcctgccattcacgcgcagatcaggacagctggcccgcggaggccaacttgctcctcgccgcccacgacggcaacctccgccgcatcaagggtacacttctcttcctcgccacccctgaacacctgtacttgtacatgcaagaaaacaaaacaaaaaaaaaaatctttttttaaaatctttttcgggcttcttgattccgctcatggaagtgatagaacgagacttgcttgcttgctgttgtgctcaatcagagatcgccgcgacgctggacgacgacggggaggggatcgcggccaccgtggcgcgcacggccttccacggcatgaacgcgctgcacgccgccagaagcctgcacgtctaccgctacttgctcgaggtggccaacatggacgtcaacaagccggacaccactccaggtgcatgtcaagattcatcctcctcttctgcttccttttgtcctcttcgccagctaggagtactagctagctatttcagctggatgtctcactgttattgtgaatctggttttcattgccttgccacgctaggtaggaagactcccctcgagcgagccattgccggtggggacctgccctctgtcaggtatctcattgatcatggtgctgatatccatcatgaacgtgaaggaaacatcacttttcttcattcagctgcaaagaaaggtataaacaggggaaaccaatcctcagatttagttcaacttcttctttttctttttttgtttttattacaaaagaacaatctgagttatgctgtactacccggcatactatgtgtcattcggaatactgcttcaacccaatcccgttcagtggaacagcattatgcccttggatttattaggggaatatcctatcttcttgtaggattccctgctacatccaatctgcattctgtcatgatgagcagccttacgttgaatgtggagaaaaatgcagacaatactgtaagggcctcattgtttgccctatggcttataagctaaagccaaaatctgaactttaaaacttgatttttaatttgattttgatgttttttttttcaacatagtttttttttcagctttgacttttaagtcgctaagaatatatatacaaaagtttttttcgcacaacattttttaattgctaataagccgttacggcttataataagttgtaagcaactgatggggaccttagcgtctagcaaatgtacaacaaagcaagcctaatgcagcatttcctgacgcattttgtttttacaggtgttgtttaagtgatatagaccttgctgatgtacacttttcatgttcatcagcctatacatattaattcatcataagaaaatgttaaaatatatcattcacatcatcatagattatctgcactttaccattcatcctagtataactgttggactgtttctacttcataaacctcatatttatttatcaacctgctgccagggtttctttttgtgtgtgtgtgttttgttctagccactgaaacatgttcctccaagagtgaactgctctttttgtgtgttatttaggactggtttgtctttttcttttattatcctccagttaagcagttaagtgttaaattgcctctttgctctggcttctcaaacttgtctgcccccaaattgtttctctcatacatcagtgaccttcaatttttttatgtgattgttcagggaggactgaaatagtaaaattgctgctttctagaggagctcatgttgatggcaaatcagatcatgggacacctctgcattttgctgctattaaaggatatgaaagtactgtgaagattttgttggagcaccaagcagatgtacgatgcttatacttttcttatgttggggcttactatttcctcccactgttccatccttactctcattttggttattgatgtgtgagcactgagctagcccaggtctggctgagccgtgatccacacattaacaactactccactgaataatcaataggaacaacggaagaaacacaaacaactttcttaaattatctctttctctaggaactgtcaaatgtatgataatacatttctttcttttccagcccaacaaggttatgccttcttctcaagcaacacctttatctgcggcgttattcactacttccttaccttgtgtgaagctattgatccaggtacaatattttctcctttggactgctgcaataggataaggctaaataactgatactatatatggctagagctgttataatcatcaagttatgtgaagaaaatgtataatcattttgtattatacataaacatttgtaggctggagctgatgtaaatgctacaaacaaccccctggcgagagctgcagggagtggattaactgaagctataaagttgttgttgaaggctggagcaaacccaaattgtcctgacacggtgagccttctgttttgcttatcacaccatcactatcagcagattgagtttgtagcttcaatgattttaggcctgtggcattgatatgcatcactagtatggaacaatgaaatgtattcctgaaaattcacatatgtggcacacgcttatttgtaaaagatactaggcaaaattggttatagagcatcgaaagttcacagtttttggttataggaaattcttttttctttcggaaacaagattatgcaaaagatttggagcatttgagcatcagttgaatagtgtgatttgatttgtgagacatgtgtacaccattctgtggtgtgtttcgcagaccactatcatctgcttctagagttgacacaagcctgctaaattccctgttttcattttcatttagctttttttgttggtcaggtgcatagagataattaatagtcggtgagcataatgctaattggtcttttctaatggcaacatgtttaaaaagtttaggacaacaagaactgatggtagcaattttgaaaaaattattgataaaacaagtactattccatatt

SEQ ID NO: 76435 - DNA, 16681 bp, Oryza sativa
tctcaacgaaagcattttgattattctttttggattcttttgttttttgttcttgttgtgatcggctggctgccacatcttcttcatctgattgagctcaactgcttgagcatccatggccatggcggctgatggtgatcactgccgcctccccgacgactccctcttcctcggcttcgattgctccacgcagtaaccaatttactcccaaccaaatctaatcctaatcctgtgcttgctaatgctaattctagttctaatgctaatggtggtaggtcgctgaaagccacggtgctggacgccggcctcaccgccgtcgcccacgacgccgtccacttcgactccgacctgccgcactacgccacccatggcggcgtcctccgggacccatccggcggcgacccgggccgcgtcgtgtcgccgccgctcatgtgggccgaggcgctggacctgctgctcgccaggctcgcgcccagggtggactacgcccgcgtcgccgccgtctccggcggcgcgcagcagcacggcagcgtctactggaagcgcggcgcggcggcggtgctcgcgtccctcgacccggccaggggcctggcaccgcagctcgccgcggcgctcgccacgacggagtcgccggtgtggatggacagcagcacggcggcgcagtgccgggaggtggaggcggcggtcggcggcgcgctggagctggccaggatgaccgggtgccgcgcgcacgagcggtgcacaggcccgcagatcaggaagatgtaccaggcgaggcggcgcgtgtacgacgacaccgagaggatctcgctcgtgagctcgttcatggcgtcgctgctcgtcggcggctacgcctgcatcgacgagaccgacggcgcggggatgaacttgatggacatcaccacgcgcgagttgcgcagggacgcccttgaggtttgctgcttgcaacacacacattttcagactgagaaatgcaatctttttttttttgtttttggcaactgcttctgatgcatttcaatttacaagtttgtaggctactgctcctgatttagaagacaagattgggaagctagcaccggcgcatgctgttgcaggaactttatctccttatttcgttcagaggtagccattgatcaatctgttttcctccccttttacagtgtctgctaaactggtgtttgaaaaaggagttatgttatagtgaacaacatcatcaaactacaagattgaattattatatgtataaactaacttcagacacttttgcattggggtctgactcgacgaattactgatatgaatatgcttcatttttcatcagatttcagttttcaagcaactgtctagttgttcagtggtcaggggacaaccccaacagccttgcaggtatataagttctcccaattttcctactaatatcttacaacatatggcatgtctgtttggtcaaatcaaaagatgatctgattcaaagcatatgccagaaactttggtcaaaagaatattttcggatcactcctatgtgattatgcaggtttaactttgagcgatcctggtgatctagcaatcagtcttgggacaagtgatacagtaatcatctatcaccttgtttttacaaaatctgctccatttgttttcaagggcaatggtaccaacaatgtctgggaacagatacattagaacctagttcttatctaccaataaggcaataacactaactgctgattgaaccttgttttacttgtacttacactgaatacaggattcacaaataaaaaacaactcacaacacaaagttgttctgtacatctatgaaccatcgggccctgtttggcaaatgagttatgggaggttggattgggaaacagaaataataaatgaggcgaaaagaaagaatggctaggattgaattttaccctttggtgtggtgggaaatcttttcccaaacccatttgccaaacaagcccttgttgcttattctgatgcctttatggtccttcaggtttttgggataactgatttacctgaaccatccctggatgggaacatcctccctaacccagtggaccccaagacatatatggttatgctttgctacaaaaatggctctctaacacgggaaggtaccatttggattctttttatctcactgtttaccattactaatgcctatatttttgtttttgaaactataaatgcttatatttttcaccagatgtccgcaatcgttatgctgacgggtcatgggatgtgttcaacaagcatttggagaatacagctcctttaaatggtacaccaatatagttattctttcctttctattttactaaaaggatgccagcccatatatttctagaacaaacaggctagctgattggcactagaaatcacaaacagcataaggatattaaactctgttttataaagcttgtacattttggcaagatgataagccagtataattatgctttaaatcccatcaatgtttttttttgaactgtagatcatccaattgatgtttagccagttactatcacacagttgcctttcctcccattcatgatagttacttgcgttgaccacataaaggtagctttcctgaggattcttgaatccccctttttctttctttgtaccaggaagaaaattgggatattactacaatgagcctgagattctgccaccacttccaggttatttctgaccttacatttcatttcccttcaacgtgtagtttttatgtcattactcatgtgctatgcttataaatctgtagttgggtttcaccgttacgttgtcagctcctcagccagtggatctttagatgagatggtggagcatcagataaaccagtttgatcctccttcagaagtacggggacttccataactggtcgttaaacgatctaataaactttccttcaggctgttcactaacagttgtgatataggtccgtgcaataatagaagggcagttcctgtccatgaggggccatgctgaaaggtgtggtctgccagtgcctccaaagcggattatagcgaccggtggagcatcgtcgaaccagatcattctcaagacgatggcatccatttttggctgctcggtttacaccgtccaaagaccaggtatatataagacatgtgcatcacatatggattcgaattaatctgctgttatcatgttttccatctggttgtgagcataattgtgtcctttacatagcaatgctcaattgatacagactctgcctcactgggtgctgctcttagagcagcccatgggtggatttgcaaccagaaaggcaagtttgtgcctgtttcatgtctgcactcggacagactgaatagaacatcactaagcattaagctggctgctccatttggagactcggaggaggacattgaccttctgaacaactacacgttgttgatgaagaaaaggctggagattgaacagaagcttgtcgagaagtttggtcgacattcatgaagcatttgtgtatttgtgctagaacttaatgcggcggtcccaaagtctcaacagtggactgttctccagcagagtagttcggcatttctccgattattgtcgccttataaacaaaacaaatagaaaacaatgggctactgtaaacagagattgaatcaaaagtaaagtagttgtacaatatagataccaggttacagttgtcatgaaaattatgagttaggtcagcagtcacattttgtgaagtgtttttattcaatatccaatggatcgtcaaattcagaccaaattctgaatcagatgttgcctctcttactctttttggaaatgctgtccttgtacttccccattccagtggagaaccatacttagcactgtcctgaacaatatcacctttgtcgatatgtagtctgactatgggttgaaaacttgaaatccaatgagtatgtttcttgaccttttcttgtcttactgttgataaatcaccaagtcaaatggcatgcatgttctgctggtgaatggcatcctactcaacatgaacatggtgaggctacaccaaggatggccaccaaatttgcaaaatctactagtgagctactgctatttaacactgcatgcacttgtgccacttactgaattagtggattcttcttatagacaccacagtccagcatacgtggccactatgtatggttaatgatataaaggctctagcaagcttagatacctatggcaccaagttcttgcaacttgctagcaaacactttttttcttttaacatattgttgcctgtactattttctgctttttttttcctttgttatgatatgcctgtttatgaaagggtaccttagggcagagcacaatctgatctgaagtattatgaaaattccctatttttttcagaaaagaaggtaagaaatttgagtttctctaagacattagaattgccataaattgagtgattacatgcacattctttacagaaaagggacttctggttgtgggattccataatctggctacaaaatcatgtaagctatatgaaaatgaagcaatgaaagtgacaccaatagttttgagacatcctgtgattggcatatagatgaaaagattaaaaaaaatgtggtatatccttttagctttactctttagtgctttaagctttttcccttgaaatggcactgtaccataaagtgcttcttggtaaccaaaagcataactgagggttttgtttgttttgcatgaaagaattttatttttatttgtcatataatgaaaaataaaatctctcgctctctctctgccccaaggaaccattattatttttattgtgtgtaactttatttaaatatatgagagataacaacttttcatacgcttcttaagatttctttttaagtaatttgatgtctcattatgccagaattttggcacgtggattacaagattagtgacttggatgccacagtggcactaatcatgaacctattataaatttataataggctgagtcaacttccatggcactcgtacgctaatcattcccttgtatcatgcaaatatgcaatgcactcactgccacgtcactgttggggccccacaaacagaatctaactaccttttcaactgcacatgtacactacacttgcggccaaaaacttcttccatgaatgaattttcctcagctgaaaaaaggaaaaaaaaggggactcgttatcatcttagctttagttcagaaattttaatcccttgagaaaatgttatttaaagaattatgaaaatttagaaaaaaaatgataagatagatttttgatatgtcactcaacaaacatataagtttaaattcaatccacaagttgtaacaaagggaacataataaacttgtactagcatacatgtgctcacaatcgtatttttttaaaaaaaaatatagaattcaaatttaaacttatgtgtttgtgaagtgatatactgcatattaatccaacttgttagatattttttcataactatttgtaaaacataccaaaaaagagggagcatctccttgagagattaaaagagtttcccttcagttcatgctccacgctgtcacctcactcactcagcaaaaacaaaaggttggagaggaaaacaaagaaagaaatgaaaaggtctccatcgatgcaaagagaaaggaacatttcaaagctgaatgcactaattaatatatagtatatatatttgcatccatgtatacatatatttgatatatatatttttatattggtccatccactgagagcatcagattctgcttaaacaccaagcagtatatgtgaatggtacgtgacccaaacccaaaaaaacaaaaaggcagctacgactctacaaatactagccatatatatcccctagtgcaagagcgaacaacctttgcaacttgcctcttatgattctatctacataattagtattattacatgtaaatataattagtagtaattaatattttccccctaattaattagttggagctagctagctcatgaacaatctctcttcttgcttatgatcactagctactaatccggccggataattacacagtacgtttgcacgcattagctagattaaagatgattattacagctttggctcgccggaggagtccttcttgttggcggcgtccttggcggtccggccggcggcggggccggcctcggcgagcatctgcacgacgtcggccatggtggggcggaggccggggatgctgcaggtgcagcggacggcgacgcggagagcctgcaccatctcctccttgaaggggctccactcgagccgcttgtccagcgcctcgccctcgccgccggcggccaccttgccggagacccactgcacgatgtccctcgtgtcgccgaactccggctcgatcggcttcttccccgtcgccagctccattagcaccaccccgaagctgtacacgtcgcactttgtcgtcgcctttgacgagtaggcgtactctgtatgcatgcaccaatcagttcaactcaaaattttaaccaaaaagtttaaaccgataagaatacatatacatatgtatatccatcaatcagtttaaccgaaaagattaaactgatatgaaaagacaaacaactgatcagaggttaaactgataagaaaagattaacagctcaatctaaaagtttaagctgatgagaaaagacggacaattgatggatgtgttacctggagcgaggtagccgtaggtgccggcgatggtggtggtggaggcgtcgcgatcgccgcgggcctggaggaccttggcgatgccgaagtcggcgaccttgggctcgaagtcggcgtcgaggaggatgttggaggacttgatgtcgcggtggacgatggggaagaggaggtcgtggtggaggtaggcgaggccctgggcgacgccgagcgcgacgcggtggcgcgtcggccagtccaggaagccgaagccccacccgccgccgccgtggagcgcgtcccataggttgccgttgggcatgtactcgtacaccagcaggttgctgtcggcgccggagtagcagcagtagagcttcacgatgttcttgtgccggatgctgcccagcgtctccacctccgtccgcagctcgcggtcgaggcaccccccgccgccgccatggccgtgctcctgcttggaccgccgcgacacccacagcttcttcacggcgaccagctcgccgttgctcagctcgatcttgtacaccgtgccggagccgccgtggccgacgatgttcttgtcgatcagcgcctccacgatctcgtgctggtcgaagctcagcttgtggaagctcgtcacgtcgtacgacgagctcgacgccggcgacgtcgggagcccgtcgtgctccccgtcctgccgcgcccgcagcacccaccgcctcgccagcgccagcgtcgccaccacgcacaccagcgcgcacaccgccaccacccacacgctcccggcgagcccccgcatccgcagcctcgccggcttggggcacagcggcagcgccgggtcggtgaggttcagccggaacgccacgcacagccccgggttgccggcgacgctctccaggagcccctccctgatcagctgcagcggcaccggcccggacaggttgttgttggagaagtccagcgagttgggcagcagcgtgcacagcgcctccgggatctcgccggcgagcgcattgtacgacaggttcagcacgttcaggctgtggaggtcggcgagcgtcgccgggatggagccgttcagccggttgccctgcagcgacagctggttcagccggctcagccgccccaccgcctccgggatcgccccgccgatctggttgttgctcaggtcgatcttgaccagcgtcgccgcgccggcgatctccggcggcaggacccccgacatgcggttgttcgacgcgaacagcgacgtcaggttggtggcgccggcgatggtggccggcactggcccggtgaggtggttgtaggagaggtcgatgatggaggcgtgcgggagcgcgaagatgcccgcggggacgtcgccgtcgaggtggttgttgctgacgcggaagcggagcagcggccggcacgcggcgtacgacgccgggatggcgccggtgaggaggttgctgagcacgaggatgtactggagctggccgttggcgcaggcgtacggcggcagcgggccggtgagctggttctccgacacctccagcacgttgaagccggagtagcggccgaggtcggcggggagctcgccggtgagctggttgcggtagacggacaggatgcggagctgcgtggagttgccgagcacggccgggatggcgccggtgagcttgttggtgtacatctggagcacgcggaggcgaggcagcgcgcagatggactccgggatgccgccggtgaggttgttctcggagaggtcgatgtcggtgagctgcgtgaggttgccgagctcggcggggacgacgccctcaagcaggttgtagtagagctcgagcagctgcaggtttgggaggcgcgccagcgacagcgggatgtggccggtgaggaggttgccgctgagttccaggtcggtgagcgacgtcatgttcccgagccacgccgggacgccgccgtgcatgcacgtcgtcgacaggatgagcacgcggaggcgccgcagcgccatcagcgactccggcggccaccagatgtcgaacccggggttctcgttgaagttggccacctcgagcgtggtgacgttggcgatcgacgtcgggaacgcgccggagaagtagttgttggacacgtcgagcacccgcagcgccggcatccgcgacaggtccggcacggcgcccgacacgccggagcagctgaggttgagcacctccagcgacgtgcagttcaccagcccgccggggaacccgccgcggatgtcgttgtacccgagccggacctcccggagcgccgggagcgcctcgcacacgccgccggggagcctaccgctcagcctccacgacgtgacgtcgatggccgtcacgttgccggaggcgtcgcacccgacaccctggaacttgcagtagtccacggccggcgccgagaagtcccacctcgccatggccggcccggcgaactcctgcttcatctgggacaggtacgccgcctgagcatccaatgccgcctccgccaccaccgcgccgccatcgccggccacgaagaagacgacaacacaccacaagaagaacaacaagaagattggaggagaagagagattgatcaccatagcatgcacagatcagatggtggcttaatttgctccttctttttgcctcttcttgtgttgttgttcttgagatgtagtatatgtatatgatcaccaactccaagtgtagtgtagtgtagtgttattatgttagattgagaatatgtgtgtgtttgtgtgtgtgtgatgtggtagaatagaatggttcataatattgtgatgagaaatggagggagtatataagtggagggagaatctgtggtgatgatataaagagtggggccccacaccagagagatgcatggctttagcttaaagaccctttctttcttggctttattttgcattggggatatatgcccaaacacttacacaagctctgctagctgattatcactcactcatgcaatgatgcaatatgcagtgacaaccttctccagcctcttcttctcttcaggaccagtcaaaccaattgtgacatcttctggaactgtggatgggcctcacctggcccaaactagctgtaggcccggtatccacctaggcccggcatccgcataggcccggaccgaacccggtctctcactttcagttgtagccaagtcagaaagccatgcccattcagcactttctcatcagacaagccatttctcaatgatgaccacacacataattatgacataatgcagtaagcattgcattttctcctctttttgctgaaatggatggcattgttactgctaggctctagattcttcactaacactaacactactactgcaattgagttgctgcatatacaggggagctaagattgcacaaatctgattgatagacagttactgtagctaatcctgcaaactctatggggaacaaaggaactgcaagttggtgcctgtcccaatcattgccaacactttaggaggagatgaagcaaggagctgacaaatctgaggcccttttcttcctaaaaaacaattcagtagtaactaacaaacagtcagtgatcagtgatcacacacctgcatcagaaagtaggagtagtagtagcaactaagcagctactgcatatctgtgcttagtggcctgaatgatgatgtgtagctcattaacaatggtcgcatacgccaatctgcatctttttccgtttagtgtgtacttgctcataaattaatcatgggggtctccatctagttttattatattcacaaaagtagaggagtaaagcctgaaagcatgcatgttcgggagatatgtaagaaatcttttgagggggaattttacttcagagagatttgggaatttcattcaaagtcacatagtcaacattcttcttttgcaacatggaatgtgtaaaaatgtaaaagaagtaatttgatttatccactcttaacattagtgctacctagatcatttctagaagtttggcacatattctgcacagttattaaaaatctcacttgaacaacacaagcatatgtatgaaggcacacgtgtgctccactctgttcttttatcttccatctttccttggtaggaatataggtatttggatagcaccgaataaaatgagtaaatgacatttcccattatattgatgtgtacaaacatttgaaggaatttcacatatatttaaaaaattcaaaaatgagtttctccacttacttttttggtgaaaaatgaacaggaacaatcctttttgtgtggcagtgggtccatttggaggaatccatagtggataagcaggtatgttatgtgtgccatggtgtcatggtaaggtggatgaacacacatagatgctcactcaaaagggagcatttgtgattagataaaaaaactcaccattgtggggaggtggaaaaggagattttgacatgccaaaaaaatccccattttttcacatacacactcatgtgtttcttgcttcaattgattgctattgacattagttagttaggtccagaaccacatcaggccactaattctctgttaaacatagataagcaacacggttcgccacatatggaaaaaagttggctagtttgttaatcttgatgatgactgactgacctctaaacaaggttactattaatctattatatatgaatacaggagctaattgcatgcccaaattaatgcagtgtttttgtggatgctgacaaggcatgttgtacaagtgatgaagtggtgagaagaattgactgataggaacagtaattttcttattgacgagaacagtaaaattgctatccaataaagcatgaattataagttgtaatgtggaggactgtgtgtttgcaatcaattaaaaacaatacataatcttcaattgcacttgtatatatgggactcttgaatttgtatgcttcaggtttttggtggtgcttgtcaaagttgccagcaatctctggaagctgagtagatatacttagtggtgtgtgagtgtgcttattgtgtgacatgaagattattacagcacatggtgaaaacggcagagttaggtatacatggtaaaacccttttaattttaccctttttcaccgtggaaataatggtgttaattaatcaacaagttataaaatgttctagtaaagaagcttaggggaatgaatgatggtgtggtggccattaacaaggcgaggtgaaaacacctcacatagcattacctattgtagtggatagagaatgagaactccttttgaagactaggcaagcacaaaagttgcatcaattcgaacgatcatcctaattaacaagtcaatgttgaagtcttgcaaaaaataccaaagaaacctgaagtgtgcggtttagtgcctacattcatccatcctttttgcaacagctggagcatctaatcctgcaagctactagtataattatgagtttaatttgcactacacgtcagtcatccaatgcatttttcccatatattaaaggggggcaatggtgttttttcccaactttgaagctcaattgtgattttgccctgtttattttaaactgaagctacagtttgtccctagtttactttaaacttctgttagttggagctagattaaaagaattactaaaagaaaacgttgaaaaattgttgattgactaaactacacatgccttatctctgccatatatagcctctcatcgtttgctcaacagttgataagcctcggaaaaatgaacgaagcaacaaaaaataatttatagataagaattttatatttgtgttatatgtgattggttgccatatactccctccgttttttaaatatttgacaccattgactttttaagtacatgtttgaccattcgtcttattaaaaacttttgtgaaatatgtaaaactatatatatatatatatatatacatataagtatatttaactatgaatcaaatgataggaaaagaattaataatctattatatactaaaagtccattaaatttcctacaaacgctcccaagccgtcacgtggcgctctaataaattagagaaatccaaaaaaatctgagaaaaaagcaaaacatccaaccgttaattttcacttaagatggtggacccattattcttcaccattagatctatcttaaaaaaatcctaaaacccaatccataatctcctcccaccccaaccccaccacctcacgtacgtacatgacctcctctccccttcacgtacgtacgtacatacgtctctccctctcatgtccttcctttcgtcttgccatttacctttcaatcacccaattttctacctagcaaaattcaatatgtaaataaaagcaaattatctaaatgattataatttttacaatatatttaatttatctgcattggccatgtttggatatacaagaatatatcatttggaaaaaaaactcctatcttttacatgaaaaataaaaagtaattaaatattaaattaataacatatatctgatcttcgctcctctctctccttgctcactttctcctccctattttttagctcgcaactcagtatacaaacaaaaagagtaaatttcacaatactatatctatctatctatcatatactctctccgtcccagaatgtaacaacctaggatgggatgagacctatgctaggacaatgtatatggatatgagctaggatggatctcatcctatcctaggttgttacattctaggacggaggcagtactaaaattctattaaacttcctacaaatgatactaagccaccacgtggcgctctaataaattagataaatccaaaaaattatgagagaaaagcaaaatatccgagatgaaccaccaaacctaaggcagctaaggtgatttaccaaggtcatcacgagtgtcgcagcagtactgatttgccaaggtgaagatgaatcaaattatcagtgtataatggtttgttttgttaataacatgaaaacaaattgaaggtgtggtgatagaaaaaaaagaatcaagcaccgaggtttgaaccattggatccatccttttgttttcttatgttagtgaaaaaaaccacatctttccgactctcttcggtttatcacgttatctatgtacatatatatatacacacacacacgtacatcggtacgtgtattgacatccctacaccatcctaattatgcaagtctctccttctgttctatctcttatttttatgcaatattaattatctcttattttcatgcaatattagttagacgattagaccaacttttataagaaaacaaatccctttcacctccaccattctccgtattgtcacgaccattattttttagaaatttctttactttttaatttatttaaattgttacttaatttataattaaagcaacctatattgctcatatttttgctatatatgaaaatacgtcatatgacctagaacatatcctttatataacaaccaaatagtaatgaaatatcaatctatatattaaatactaaaagtctatgaaacttgctacaaacgctcttagtggattcctgcaaaaactttttctccctgcacggaaaatgaggtagctcatcaacgcatgattagttaagtattagcttaagaaaacttgaaaatggattagtatgaatttttacgataacttttatatataattcttttgtaaaaaatgcaccatttaacaatttggaaagcgtgcatgtgaaaaataagggagtagatgttgggaaattggagaaagaacacagtggccaccacgtggcactctaataaattagtgtaattccaagaaattttgagagagaaacaaaagtctaaccgtcggttttcatttaatctggtgaacccatttattttcaaccatgaatcattttgtaaaatacccttatcccctgctggccctacaaatgctcacatactcggtttgaaaaaaaaatatgcacatattctgttatcatggcgcaacacacctcttctcttctgtaaggtggttaattgagatagaaacctaccatttaatatttcttggatgaatgagaaatattaggcacatgccttcgtgtggcttccaccacacatgcaaagaaacgcaagtatgtaatccaatccctccgtgactcccacccgtgccctctaatccccttccaaattcttaatagataaccgattagaaggagacctagcttaatggtataaataaaacacattatcagtaatagtagttttccatgatttacttaaaaaaagagaccctaaacattcgacaaaaacaataacacttcaattttaatttacacttaatttattaaaaattatttcttaataaaataagtcgaccttctttctcgataacgtggacagataattactcgtagggatgaattaaatattttgttgcataaaacaaacaaatagcttataaaaattatcaaagcaatatcgttgaaaaacattcatagagaaatactacttttgaaatttgaagcgtagcatgtactatctggttaatatttcaatcttataagtttctttaacacatattacgatacatacccgcgcatacgcgcgggctaccttcctagttacttaaatttgtttgaataagacgaacggtcaaacatatttaaaaaagtaaacgtcgtcaagtatttagaaacggagggagtatgatttttgctcgaacatgtacgcaagttgtttcgaaatgttcccagcagttatttttttacttcttagtccgagatgaagtcaagaaagatacacaggtgctcttctagtcatttatcttcctaatagacacaagccaggtcaaataactgcgaatatgactttgaattgagccttctcgtgtattttgaatgatgctaaagggtatatgaattagtcaatggttgtcaaatctccaatcaagaagatatgtgcattgaaggaagcacaaagatgagtgccaaagttcagtgggtcacactttatgtacttagattccaatttaaagatcacttcagaatatctcattttcccttgctcattgtgacatgctaaagctcatttgagagctcaatcaagttcattagacgttaagaataaaagtggttctaaacttaacttttcactgcaaggacatagatctctgtactctactacttcaccgtaataaacattgtcctaaaaagtttatgacttgacttccactcaaattagcttagatctctaaagaaacacgtgaattctggctttgtgctacaaatttcatgagtattaatcttgggctaaaaaaaggtttgaatattactttatccaaaatttcgtgattttaaacctttggcctaaaaattcttgattttaggctttggctaaaaaacacccataaaggattagccttagtcataaaagagcgtgattattagacttttgctcaaaatttcatgattataaacatttggcctaaaaattcattacttttagacttcggcccaaaacataccggtatttatttagcgttggactaaaaaaaatcatgagtactgggcccaaacgagagtgaatattactctcctgtccgaaaatgaatctttatcttcggcccaaaaaaatcatgcatattaaccaagagttgaaaaatacatgtgtattgaccttgggtcttaaaaaggcatgaatatcagggtccgctaaaaaattcgtgattattaacctttcacctaaaaattcatgcattttagactttggtgctaaaaacatatgagtatataacgccctgtttggggagcttaaaattatgagaagcagctactgagaagctagctggtgagcagtggcggatctagaaaaaaatagtagtgggggctgaataaactacatcagcataaatcgaacctccagtccccacatcctatagatctatggaaaaaaaattagtgggggcttaggggggtctccactgtctcgggggcggtagtgggg

SEQ ID NO: 76436 - DNA, 57150 bp, Oryza sativa
  unsure (1)..(57150): unsure at all n locations
cagcttcttcaactggtactacttcaccttcaccatcgccatgatggtgtccgccacgctcatcatctacctccagagcaacatcaactgggccatcggcctcgccgtgcccaccgcgctcatggccctctcctgcgcgctcttcttcatgggcacccgcctctacgtccgcgtccgccccgagggcagccccttcaccagcttcgcccaggtgctcgtcgccgccgcccgcaagaggcgcctccctgccccggcgtctcctgccgacgacctgttcgatccgccgcaccggagcaagctggtggccaagatcaagcacacggaccagttccggtggctggacaaggccgcggtggtgacggcggaggacgcggtggtggacggcatgagcgcggcggcggcgaacccgtggcggctgtgcacggtgcagcaggtggaggaggtgaaggtgcttgcgcggatgatcccggtgtggtcgtcgtcgatcgtgtactacgtgatgctgacgcagctgggcacgtacacggtgttccaggtgatgcagtcggaccggcgggtggggaggtcggggttcgaggtgccggcggggtcgatggtggtgttcaacatggtggcgctcacggcgtggctgccggtgtacgaccgcgcggtggtgccggcgctgcggcgggtgacggggcgtgaggaggggatcagccagctgcagcgcatcgggatcgggctggcgctgtcggtggcgacgatggcggtggcggtggcggtggagcagaggcggcgcggggcgggaggagggtcgtcgtcgtcgtgggcgtggatggtgccgcagcaggcgatggcggggctgtcggaggcgttcgcggcgatcgggctgaacgagctgtgctacaaggagtcgccggagagcatgaggagcgtggcgggggcgctgtcgccgctggcgctggcggtggcgagctacgcgagcggggcgatggtgacggcggtggagcgggcgacggggtggctggcgcaggacatcgataagggccgcgtcgacctcttctaccttgtggtgggcgccatgtcggccgccaacctggcttacttcgtggtctgcgcgctctggtacaggtccaagaacatcgccgaccacggcggcgttgagcttcttcagaccagctccaagcacaacgccgacgcgccgccggccatggcggtctgacgacactgacagctactacacacgtacgctgacttttcatacttactatatactacttgatgcatatgcatgtgtccactccatgatgaacacaacagagacagaaagaagagagatgatacttgtacgatccagtttggaattggactacattaattacattagggatgaatgaatgtaattgtaaatctgtattatgaatgtatgggccggcccatatcatttcttcttagggctgaaacgagcccaccgaaagcccaaaatcgccccgtaacgaagggactcatgtcggcaacactgacaggagcaaaacaacacgtttgggagagctgtaactctaagataatgagaatttccgttccaatctttgcttcaaataagctacaacctttgcagtcaacataacttttaattgcaaagcacaatttaatgaaaaacgagagaactaactgaaacactagcctaaagacagataattgctaaaccttcaccctgattgacaaaatgctacttacataaacaacatttagtttttgtcatccacaaacctttatagcaaggtctcaaagttaaagcccaagttctgaaaattgaattcaaaggtgcaagtagactcaccgaaatttaagcctaaccgttcagtcgaccagatctcgcgcgcaccaaccctcgataaaattgtcttcgagccgtgtgaaacatattactctctctatttctaaatatccgacactgttgattttttatacatgtttgatcattcgtcttattcaaaaacttatgtgaaatatgtaaaactatacgtatacataaaatgtatatttaacaatgaatcaaatgataggaaaaaaataattacttaaattttttgaataagacaaacggtaaaacatgtttaaaaaaaattaacgaagtcaaatatttagaaacggagggagtatcaaaaagtaactactaactgcaaggcaatgtctctcttcaccggggagagggagaattggatggtgtcgatcgccggcacgacctaacgagtacacgacacactaaggtgtttgaaactaatgaagataaataaatttatttgatattttaaagcaacttttatataaaaagttttcacattagcagttagaaaaatgcgctaacataaactgaaagaaaatcttatttgatagtgtagatgagtaagatgaccgcaggaggtcaccactgctgcactgcatgcaacggcccaagctaggacggtaacgaggagtagtagctaatggtaatacgtactgtataccccttgtgatgattaatccaacaaaacattggattctactagcagtaacgaagaatttaatactcctgacgatgcgtggtgcatctagtacggctctcactgcacctgcgtttgtcttgttgttgcaaaatttaacgttgggctcagatgagtttcaggacagatcgatcttgtttgaacttattttattttaaaaagggtgtatgtggatcgaatcgaattggagttggtatgggcgtgtctgtggttttgaaacattcatcaaatgatcaacaagttattgtttgttcttcagctactgtttcaagtttacacgtactagtagtattgaagtagcaactcaacgggattgtgttggtggtggtgggccatcgtcattccattatcaacggctactccagttgctaacattatttttgtcattttgtattttgttgtctctgtcttgctgttccctcgatcttgcacacaccaaagttaagttaatgcatgcaaggagtactatacttacatggtgctcatcttgttagtacaggcaggttactatgctagtgatgctcatgtagtaattatcttcaatggcaatgcagcagtatttgcagtcagctagctgtctgtattttttgacaatccggcctttcctcctgatcctcatcgtataccatcgcacaaccaacaagcttacgtaccgtagctcacatatttacatctccaacgttacgtacctacctggcttgtagtatctgtatctacgtatttaagtctgtctttacatacctacatacgtgtatttgtatgtatatacaggcggtacaatttgtctgtactgtacatacaggaggagtgctgaagaaagaaaaagaaaggaaagcaaaattcagtgtagcttgcgcgtgcgaccagtgtcgtgtttggcggcttttggagtagaaaattgctacggctaccaccacacatccttactcgccgacatgtgggcccgggagtcaggctggagtcccacatgtcagatgacagcagctcagactagtcctcggctcgctcgctacctttcaaaatccaaccagcaaaagcctccctcaccctcactctcactcccactacactctagagagagagagagagagagagagagagagaccaagccaaggccaccatggacagcacaagcaacaagatgaagaagatggagccgacgagcggcggccgccacgggactccggggcaggtggtgggcctgtgcgctgccctcgtcaccgccatggctgcctcactgctctgctccacctccatggccctcaccccggacggtaccctctctctctctgcgctgcactacgcatccatggatggatggatggatggatgagagaacgcttcctccaatctggctgtctcaccggggtagttgtgttttttctgctccttgcagggcaggcattgctggagctcaagctctccttcaatggcagcagccagcggctgacgacctggaagcccaccgaccctaacccctgcggctgggagggcatctcctgctccttccccgacctcagggtccaatccatgtccgtctccaatttatctctatctttccttccttgcatttctccattttgcacccagattaattagccttatctttcatttttcttttcccttttgcatctctctctcaagtctcaagcaaaatgtttcatggctcggctacccatgtgctcattggattcctcgccccctgaataatctcttctttcatgttttccttttctaccagaaatctcccttacatgcagcttgggggcatcatttcacctaacattgggaagctcgacaagctgcagagaatgtaacattttttcttcttcaccacttttgtgcaacacttcccatttcaacaccatcttcatttacactatccgcattggtctttctttaatttctaaccccttttgttcagagcattgcaccagaacagcttgcatggcccaatcccttctgagatcaagaactgcaccgagctcagagcgatgtatgtatgctgctacgatctagtacttgtttggttccatctccatctgtctgctaatgactttgtagagctgaaatgcggaggtttaatttactctgtgtgtgtgcagttacttgagagccaactacctacaaggaggcatcccttcagagattggcgagctcattcacctcacaatcttgtaggttcttagcaaaataccctgatctgattcactgcttattcttggtctaatgcgtgccatctgcagggacttgtccagcaacctgttgaggggcacaataccggcgtccattggaagccttactcaccttcgtttcctgtaagtttcttgctgtataaatttccttatgccatcttgtcggcattgctaaaaccagacgagtaaatgctgttgcaaatctctgaaagaacatatgcttatttgcattgcaggaatctgtccaccaatttcttttctggagaaatcccaaatgttggtgtccttggaaccttcaaaagcagctcgtaagcttttagatttgggcccatcttcctttctactttctttgatgtgtcattgctctttatgatgtgggagcataactgtagcaaacatgaacaaatttgtgcatttctgctacttcttgagcacaacctgtattcaatgccatggtgcatttcttcacatgacaattcaatggcatttgcaggttcgttgggaatttggagctttgtggactgcccatccagaaggcttgccgtggaaccctcgggtttcctgccgtgttgccgcattctgatcccctctcctcagctggcaagtcttccatttctaagccatcttctcagtgttgaagctcttctcaccaaatttggtgcaatgtgtgtgtgactaactgatggtttcatctctctgtcgcaaacaggcgtttcaccaatcaacaacaacaaaacatcgcacttcctgaatggcattgtgattggctcaatgtcaaccatggctcttgcattgatcgcggtactaggcttcctctggatatgtcttctgtccaggaagaagagcattggtggaagctatgttaaaatggacaagcaaactatcccagatggtaataaagtcgacacagctgctatcactcgttccggcctgtccaggccctcacttaatggaaactaattgctatctgtggtgttctgacttaggtgcgaagctcgtgacataccagtggaaccttccgtactcatcaggtgagatcatcagaaggttggagctgcttgatgaagaggatgtggtcggttgtggcggttttggtaccgtgtacaagatggtgatggatgatggcacggcatttgctgtcaagaggattgatctcaaccgtgaagggcgcgataggaccttcgagaaggagcttgagattctgggcagcattaggcacattaaccttgtcaatctgcgaggatactgccgtcttcctacagccaaactactcatatatgatttcttggagctgggcagtttggattgctaccttcatggtaagcctattgtctttcttgcatcttgctgcatattgtttcatcatcatggttacaactgcttcaattgtgcaaaaacttcttacattacctgatgctcaaaaacgccttgtccctgatttcaggagatgctcaggatgatcaaccattgaactggaatgcacgtatgaagattgccctgggctctgctcgagggctggcgtatttgcaccacgattgctcacccgtgattgtgcacagggacatcaaagccagtaacatccttctggacagaagcttggaaccccgcgtatcagattttggccttgcaaggctgcttgtagataatgatgcccacgttaccactgttgtcgcgggtacttttggatacctagcaccaggtacttattctctattccacactgtgatgctttcaatcaaaacaaaagatcatgctgtcctgcataattactgctcccccttttgtattgtacagagtacagactaacagtagaagcttatgactgttaagcactttctccgtcctaaaatatagtaacctaatattcgattagacaccacctagtactaaatccagattcgtagtagtttgtactactttgtagtcaagctactggagataaatcgagacaaatcatgcttttttaagacaacaccaatgctgcctgtttaaatctgtgttgagcaccttccatccagactgacattggtcatttttaactttatatggacagaatacctgcaaaatggccatgctactgaaaaatctgatgtgtatagctttggagtgcttttgctcgagttggtgaccggaaagaggcctacagatgcatgcttcctcaagaagggactgaacattgttggctgggtaagaagaacctctctatattccctccctcctatgaatcttacaagtgacaaaagtaatctgaattgccaactttcttctgcagctcaacaccctgacgggggagcatcggctggaggagatcattgatgagaactgcggtgatgtggaagtggaagcagtcgaggcgatcctcgacattgctgcgatgtgcaccgatgcagacccaggccagcgtccatcgatgagcgctgtcctgaagatgctggaggaggagatcctgtctccctgcatgagtgagctctactacgagcagcacctggaactctgagtgagtacctcctataatggttgctactactcatgattgcagtgacaagcaacaaattttgtagatacatgatgatgaaccgtgtaggagtgtagctggacaagtgcagcttcacatcttcttcttttgtgcccagctggttctttgggcagaaccaaatcactgtggtggtctgtacatagtggagaccttctgttcatctttttttttctcatttatctgtctggctgctgcaaatccacttaaaccaaaccacagaaaaaatgctgtcaactagctaggtactgatgcaagccaaagtgataagttaacaacactattttggaacaagaaaatcacagacagcactaaattagttaataaataacttgaggatcatcagttgtgtagtatagtaacatacaacagctgggtgagtagctccaaatattccaggcttgcatggcaatccaatcttggttcttggtagatgtggcactagttaccagctgcaaacaaacaagatatacagtcaagcaagcacgggtgcaaaacttgcacaatgctccaggaattgaagaaggtgaaatgaaagaaaatatactactgggatggcaagaactagtggagttttgcacgcttccattcttccatggcacttgagaagtgagccaggcgggcctcatcaaaatctccatccctttcgaaagctttcacaacagactgactagaataatgaggagcatcgtatcatccttcttctttaatccctaatatatgcagattaatggttgagatctgaaccctgtcaatgtgctactagcatggtaatagtatagtagcttttcaagtaactaggtactcaaggatcaagatcaagcatgcgaaatctaatctttcagaatcagagcaatgttaaaatccaatctttcagaaccagagcaatgtgaaatcgctcagatagaagctaataagaaaaaaaaaggaaaagaaaaatgtgcattgtcattgccattttgccatgacattatggtggagccacccagtacatgtcataccgtgtttagtaaagcgctaataaagcctttcaaaaggctggcctgaagtgacaaatgcttccagacactggtatggtagcaaaacacaacacatgcatacttttacatgcatctatcagctgctgatgctgcatgctactacagcactgcactgatcatcactagtggatggtagtagtgagagaacactgtaatggcatgaattttttcttctttttttatcaaaggaatggagggacaacgctctccatttctattagagaaaaaacaattttacgattcttgagaaggtatcattttttctattctaaatttaatacctattgatatctaggtactataagataacaaattttacattaaatttttgataccttctcaagtactgtaaaattacttttatagaaatggtaagcttgtacggtacaaaagagtctttgcctgagacaagtccatggtagcacacacccttgaggctagttatggtagagacgagagatggggacatggggtacatgtacagtaataatattgcacagagagagagagagagagagagagagagagggcatgcatactccattttactcccacgagttaaaattgttggagtggtccacatgtcgatggcctttgctgtgttgacagcctggtaactggaaaaagggtagtacagtaagcaggcagagtaactgtagttcagattttgggacccacaatctgaattgtgaagcgaggcatgagacacgcgtgaaagaatgattggacggaccacatactaattgtcactagctagggtgtgttattcttcacttcttagtggagtactatgaaatactcataacttctatcgtcggtttattgtattaggagggatcacatccccttctagaatacattttctttaggcggagggtttagaactttaaattagaaagcaattcatacaggcatgatgagtattaattccacataaaaaaatcaagggacagaattgatactactactaacttctcgttcaataaaagaacaacttttagaagcgattgtaggacgagtttgtataagcatttgtttagatttgtctgttaataaagttgatttttttttcgctaaagcacgattaaaagagctataaggaatcaggccaaccatgcactgacctgaccttggtaaagcactcttgcagttgcccttgctgtcgtgccggaggcgtcgatagttggtcgccggcgtgatctaagcctaatagggttagagtcaaactgagttgtgatgtgtttgtgttggactggttcgtcatgggctggacgtatgtgcgctagctttggtgggcctgcagccgaccaaggcccggcccactatgtacgttgtgtttcaactgcctggtactactagtatagataggtgtacatttactgcaaccgcgagatcagcggagttcgtttctcaatgtcgatcatctaatctcatcgatggagataagaagatgaaattcagcccttccttcaccgaaaagaaagaaaccaatcatataatatactgtatcttcgtcgttaattaattcgttatctccatatctctctctctatatatatactcgcagccctatgctctgcccgcgcactgtaaacaaattactaatagattctccgacgatcgtagttgattgttcgtcaccgagatccgacaaacgccatccatgggtcgcggcggccgcggtggaggttagattcttcgatcgaccttaattttgttcttcgatcgatcagtcgtgcattatttggtagatccggccgaccgatcactgggtcaatatatcgctaataagtagtagcaacagcttaacttttgtgaattaaattattagtataattaagctagccagtaactaaattgaattaattaattggtgcgtacgtgcaggaggaggagggaggtcaagcttccgcggcagcagcacgggcacgaaagcagtaccccgtgctgctccggcgaccacgccggcggcgaagagcacaggcacagctccggccaccaagaatacttcctccggcagcaatgactccgtcataggatccatcggatctgctttctttgatggtcagttagttattcaatttgcttactaaggctctattcactttgttgcaaaaaaaacattatcaaattttggtattttagcatagttgccaaaattttagtaatttgtcaaaattttggcatgatttcttatatagttatcaaaatttggcagcaaattaaatgtagccattttttttgataactttatcaaaatttagtaaggttgaaaatgcatcaaagtgaacagaccctaaatttctagctagctccacaatgctatatactgctatatatacacttgctctccatgcatagatgcaaattaatctactagccaaataccgtgctttaatttgctaccgattaaacaaagtaatagtaattttttttagaataatttcatttatattgtataatactgatgaaatgtgatagaatcgtacatgtgcagagattattttataacattaaagtacattattaggtagttaatggaaaatatgattgagtaggtgataaataaaaaaaatactatactaaatggagtatagatatttgaccttagtttttttaatcagatttttgtcactggattatttgcttcgtgcttctgagaaatatgcatgatttatcaaaatacttttgtacctattgtattggtcgtacacctaccacttaattgcgaaatttattttccataatattaatttttcatgttaataagtaaataatcgagccgctctcaaactggacggcataatcatgaagtgaaaatgcagggtggggatggggcacgggttacgggatggtgcagagggggatggacgccgtcttcggccctcgcaccgtcaacgtcgtcgacgccacgtccacttcgtcttctccggcgccggcggccgccgctgcggctcatccaatgttggatgcgtgcggcgcccacaagaaggcgttccaggaatgcgtcgcccagcaagggatccacgtcagcagatgccagccctacctcgacatgctcaacgactgccgccgggactccgccgcctccgccgccgtcggcgttgccaccaccaccagaattctctgatggatggatcgcctgccagcctgatgcatcatatccatgatagcaatgcaatccatcgattgattaaattagtttgattgcttgtttatttatatccgttttgcagccacacgtaataataataatcatgcgacgctgtatgctactgcatggatggaccttaataagttaagttaatttatttgcttcgatcagcttgaaccaacgaagtaggattacgtaggctaaaactactacaccgacccctctgtttctcctttttaatggtgcattcttattctactgctactatcgttttctttctagtgtttgttcctttttgtttaattagatcaccttgaataaatgaactattacactagtttcgattatgaccgtatatatcaaccattactgttggcagtcaaattgagagtcatagcttctgagattagtattgtgttatctgacttgtcttgatggatgagctggaccgatggacatcatttgtgatggatagatggatgatgcagaaatgtcaaacgtacagcaattaaactggacaacttaaaagaaaataccggaggataacgtttacagatgcatgatcgagggggttcggagattaaaactccgaacccctctggaatctggatattcttttctttttaacactgtgtgttactctctcttttttttttcctcatgttcgtcgcgtgtcgaaacacttcattggcaactggcaagcgctaaccagctgacagacaactagcaatattcactgaaatcttaatttgttggcctttggtaaaaccattcagctaattcagtgtgcctatgctttgagcctacttactactcagttagcatttctttttgataaaaacatacaactattcctttcaaaaagataaaacatacaactcgaccagtagacggcaatgtcatctgatcatgcatatttatcgtcctactcggtcccctgaatcagacattcattcaattagatatctgatcatccgattaaagcacataccaaacacttttagaacaattcttggactgcatgtgaagttgggcctcggaattatttagtcggctcatgcatgcattctccttagggtttagtcaccagggatgtgtgagttgtatccctacttctgatcttgtgttattggttttgtcattgatggccttatgatgcgaaatgacatacaacaattaagcacgattaagtggaactgaagagaaaatagctgcgataacgcttgcagaagcaaggttgaggggttcggagattaaaacgacgaccctttgtttcttgttttttaacggcacattttctactatatattctctttattttttctcatgttccttgctttcaatcgccttgaatgaactattactagtttatgcaattatgaccggagcaatgaaccttgagtgaactagtattattttctttaccttttttttccttctatcttaatactaacatgcatttggatattgtctgggtaaaagaccgtatcaatggccatgtattaatggaaaattattgcaagcaaaatgagagtagcttgtgattggcttgtcttttttatgggctggacctggacaaatgtgatggatgatgcagaaaggtcaaacaatgattaacctggacaaatgaagagaaaatactgaggataaggcttacatgagcagcatcgataggttctgcgattaaaacgccgacccctctggatcttatgcagttttgttttgttttgtttgtccttatatatatgttcctcgcatgacgaaacacttacaagcagatagtcactggcagtgagctagcgatattcactgatatcttagttggcctttggtaaaatacttgtactaaaattgttcagctaaatattaagtgtgccaaggctgctagcctttaaagcctactgcccaattaccgttgatactcaatgaggttacgaaccgggactaaaaacgatttctccaccagtgttatttcgtcttaaaggatttagctcgatagatagcgacaataacttccatttattactagccacgtagttatgttttgcgtgacttttaatcccgtttaacaagttctgtatctgatctattagtttatctcagcttttaagaaagttataacattagcacagtatcaattagtctagcaaattataaatttagctaagttatacttatagatatatgagagaaatcactataaacctctttttttttcattatcttcgtctcctctctctttatatcatctgtccagtagacagcagaaacctctagagatacatgttcagcctatttatgattttttattatctatatacccttttatccaactatcagtaatttcttttgcgagaaatgctcagtattgtttacacaaactttctattcggctcatatggttttggtaaaattggttatataacattaaaagttcacgttttttttatagcaccaaaaaataccggttcactttagtagttatccgttctaatttttaacacttccgtcaattctcgatcatttttcatccgccttgatcgctattgatctagccacacacgcgatataatatttttactcacaagcacaggtagaatgcagaatgcatggcaataagagataaaaacgtcgtatcttgaaaaaaaaaagtttattactactctactttcacgcgcgttcgacatcacactacactgctgcctggaatcatggcgcatggagccaaatcccaaccttttgtaagcttttttttttctcttcctcctgtagcagcacgtgcatcaagaccaaactaatcagctcactttttccctttcaacttaataataataattcagtctcatatactgttcctagtcctagaataacagaaaattaagctaccggtcaaatcactgagacaattaaatataaatcaatcaaatactactcgtcagcttgtttaactacatttcatgcattgcctagtacattagaattagctactcctagattgcactgggttactgacatcttgctctgttttggccctcgcagcatgcattttgttgttaaaaaataagctattcgatcctacttcttgtatacttttactgttaatcacatcctttttatccaccacatctcccacgcgcatgctgtaagtgttcactttcattggactactttccaactgatatcctatactcagatgtggctgcctacccaaacttttgaactaattaacttaattaactgcattttttagcctcacctcaaaggcaatctaaacgggagagagaagaaactaaaattgtactgctacggtacctcttgtacgcttcccactcttggatcaaagttactgcatctgttctaaaacgtaaaagatttttatggttagacatggttactttaaaaaataggtgaaattaaaaagaaaaaatattataattggatgaaaagcaaagtaggtgaaaaaaatgaaatgatggagggctataattaattgggaagataatattgatagagatattgttatttttttcgtgaacacgcaaaatgattgcacgtcaatatattagaaggaaaaaaggtatttttttacacaacgcaatcagtcagaccggcttatgccaggggaaggaagaaaaaacaaaataaaagctgtagctaggaagaaaaactactacagcagctatacgtaactccgatcagcaggaagaggcggtgccacactacactcccaagaaatctttaaaagcaacaatgccagttaaagaccacagatggccctccgagcggatggactccagaaccactgagaccgaaggaagtgcggagttgaaaaccctggagttctattccttccacagctgccaagtggccaggagaactagggagtcgaagccgacatggagatgctcagataaacaggccctagagattggctaccagtcctggatccatctcagcgccacgtcaactggtgctgaatgttgtgccaccgcggatgggaggctagtcggcgtgccaatgtgcattcagcgccgtgttattcggtgctaaggtgtctaagttcagcgccacaaaaggttcgtattttaaataagttttggccacgattcatttgtaaaattagtttttgtaaagggttaaattgtcaaaatttgtgttgttgaagagactttctaccgtcttcaaaactgtcttaactttttttacaaagtagtgcaacatttttttttgagaactaggttatatcatccggatccgggaggcaatcacacgacgtgtctaggagtagtatattcctatctacgtactccccttgtcgtcgtgtacaaacatttactgtaccagctagcgctccagtccagcctccaaccggccatgcccatggcggcggcggcggccttcgcggcgcatgtgctgcgaggccggtggttcatggcgtacggctccttcctcattatgtcggcggcgggggcgacgtacatcttcgccatctactccaaggacatcaagtccaccctcggctacactcaggagcagctcaacaccgtcggcttcttcaaggacgtcggcgccaacgtcggcatccacgccggcctcatcgccgaggtcacgtcgccatggttcatcctcgccatcggcgccgccatgaatctcgggggatacctcatgctctacctctccgtcaccggccgtgtcggggccaagaccccgctctggctcgtctgcctctacatcgccgtcggcgccaactcgcaggccttcgccaacaccggcgcgctcgtcacctgcgtcaagaacttccccgagagccgcggcgtcatactcggcttgctcaaaggattcgtcggcctcagcggcgccatcttcacgcagctctacctcgccttctacggcggcggcaacaccaagccgctcatccttctcgtcggctggctgccggccgccgtctccctggcgttcctcggcaccatccggatcatacgcacgccgcgctcgccagccgcggcgcgccgcgaataccgcgcgttctgtggcttcctctacgtgtcgctcgcgctcgccgcctacctcatggtcgccatcatcctccagaagaggctccgcttcacccgcgccgagtacggcgtcagcgccgccgtcgtgttcgccatgctcctcctccccttcaccattgtagtgcgcgaggaggctgctctgttcaagaataagtcgcctgaagaagaggaagccgacgacgtcccgcgggcgctgtccgtggtgaccgcgcccgcgaagccggcggcacagccttcgcctgaatcccagagaccgacgacggcgacggcgaggatcctccaggcactgaggccgccgccgcgcggcgaggactacacgatcctgcaagccctggtgagcgtggacatggtgctgctgttcacggcgacggtgttcggcgtgggcgggacgctgacggcgatcgacaacatggggcagatcggcgagtcgctggggtacccgcagcgcagcgtcgccaccttcgtgtcgctcatcagcatctggaactacctggggcgcgtcgccgccgggttcgcgtcggaggcgctcctggcgcggcaccggctgccgcggccgctcatcctcgccgtggtgctcctgctcaccgctccggggcacctcctgatcgcgttcggcgtgccggggtcgctgtacgcggcgtcggtggtggtggggttctgcttcggcgccgcgcagccgctgatcctggcgagcgtgtcggagctgtttggcttcaagtactactcgacgctctacaacttctgcggcacggcgagccccgtcgggtcgtacatcctcaacgtccgcgtcgccggccggatgtacgaccgggaggcggcgcggcagggacatggggtggccgcggccgcggggaagaaggcgttgacttgcatcggcgtgaggtgctacagggagtcgttcttggtgatgacggcggtgacggtggcggcggcggcggtggcggcggtgctggcgtggaggacgcgggtgttctacgcgggagacatctacgccaagttcaaggacggaaaaacggagctcggagtggacagcaatggcagtggcactgccaaggaataatatactaggatactgtactcgtatttgtttgaggaaaccaaggaatatactgtacatattacaaactttatggaataatggtcctgtgtgtcgtcttccttcctggaagggacgactcaccactctggccggccgttctgttttggtctagtctgttctctcctccattccggtccatgtgtctatggcgatcggccttccagcctgagtgatcaaggccattaataagaagcgtcgcgccttcttgtggacgggcatggactcggctcacggtgggcagtgccggttttcttggacgaatgtctgttgtcccagagctttcggtgggttgggaattcatgaccttaggttggcaggtttttccctgcgtgttcgctggctttggctccagcgctcagcgcatccctactgggacggcctgaaggccccagccgagcaagccgtctcttacatgtttgaggcgttcaccttcttcataccatgtgatggtgagacaattcttttctggtctgaccaattgatctgcggccgctcggtagcttccttggctccggatctcctcttcgttgtgcccccgcgtctgtgtggttcgcgcacggttgcttctggcctggcaaacaacgcctggatttctgacatccacggcgccctcactgtcccggtcatctcccaatttctccttgtttgggatgcggtactccacattcagcttatgccgggtgtcggggatcatcttgtctggcgttggacgagtgaccagcgctactcgacgcattcggcgtaccaggcgttcttctttgaccagcactcctttgcttgtgccgattttctctggcacgcgaagggccctgctaagtgcaaattcttcctctggtttgcatttcagcagcgctgttagacggctgatctccttcagaagcgcggcattgatagccactcggcctgccccttttgcgctcaagagcttgagacgacgaaccacatcctccttgactgcgtgttcgctcgttaggtctgatgacgggtgttgtcgtctcctggctgggctgtcctctctcccctccgtggcagctggctgcaggattggtggccatcttctagggcatgtttaccttatcatctccgtgccagcttcaactccctagtcctcctagtctcatagcaactgttgaaggaacgtaactccagggtctttgactctgtgttctcttcggtcacagtagtcgtagagtccatcctttcggaggaccggctgtggtcgttagcggccgttgcttcctttggggaattgttgggagcgtagagtggctctaccccctccccctgtttggagtagagttaccgtcgtttcgagtttttttcctttcctttctttgtttttcttccttccttggcataggccggtctggctgagtgcgttgtgtatcaaaactctatttttctaatatattgacgtgcaatccttttgcgcgttcgtgaaaaaatgttcatttttgcacaaattatttacacagtttttttttagtgtagtacgtagaagattaagtatatcacaaactcatcaagtggatttttaagcttggggatttgaatttgtgtaactttaagctccaaaatttaaccatgcaactaaaaaactgcaactttgtagacagggggaaagggaaaatgctgcatagtccactgggataatatgaagttgatactgtcaaatcacaacagtatctcccaaagaagtggtcttcggacttactaaatggcattgttagggattgagatcctctaacttctcggtttcaaaaataaaagtttcatgtcaaccctctactcaatgatctcacatacccacataccagtgactcaaagttagagggaagtaagtaagagaatcctctctcaattgttagatggtgcgatctcattgaggcctctttagagcgtaggatagaaaaacagctgaacagaaaaaaaaatgcagaaatcaaagtgacatgttttttttatgatacagaaactgagaacacaagaagagaaaccttttgattgcatcacgggaaaattgaaccacagaaaaatttaagactaccaaatcttttgttttttccctttaaattctaccataggaatacaatccaatagagaacattctattgttttgctatgaatgaaagacgtcttttggagaaattcataaggaaattgatcgttgaaaagaagtcctccaacaatccttcattttaaataggccctgaaatggagcaaactcactcaagattcccagctttcgctctctgttattttagttcaagttggaaatttcaagttttcaacgccaagttgatactactacgtgttagttgtatcccatgagtaatgtacgagtacaaccccaagagatgagcacaagtgcacaacagtaacacaaccaactcaattgacagcgagctgtacacaacgtccacatgcatatctgcttgcttgcaagcgacaaatttgacagcctattataggtcatcggacacatccaagattcatatgcatacagtatgcaacccaaagctaaccatcaattgaactagtatatccaagttgtcaaacaagaagaagatccaagaagaagaagaagaaattgggtgttgcaatgttttttagaggggaggccagatggcccagctttttatagaaagcataagtcttacaaaccgttttacataatactggggctgccagttttcaattaaaggcattaccatcaggcatcagaacataagcatccaaagaaggatgactctaagaagaaggatgactctaagaaagggtaaaggataaaggttatctagcagaacagagacgaaaactaaacagatgggagcagaattatccaatcccagctcttcgtaaggacaccagtactccttgcatagcttgagtcttcatttccaggtcatgggccttctccggctttaatagaatcttccactgtaaaagaaaaccaatcaagcggaaagagataatcaggggtgaggagattagtttgtttctaaaaatcatatcattgcgagcagaccaaagagtccaaatcaaagcagccaaaatcatggtattaagtctagaggttttagaagtatcaaaaccatagagtctaaagaagtcctcaaaattaaaagggatccttccccagtccaaagcatcccgacatacacaccaagcaaaagtcgcaataggacagttaaaacagatatgaactgcatcttcacttctatcacacagttgacagaattcagagccttcccaattaaatttcttcagttgaacagccgattgaatctttccccttatagccagccataaaaagtgtttttgttttggaggaatcgggctagcccagataagttgaaaatgtgggtcaattatccctctaaatgtgggtgttgcaatgttgtagtatagcacttcttaaaaactaaaagaacagttataaagaaaaaaggagtcctttttgctcctctatctctcagatcttctgatcgagcagcagaattgcagctcaggtgctcgtcggcgtcatcaccgccttctcctccttggattccaccttctcatcttctccggcgccggtgccattgccagcgccaccgccaccggcagccgcctcctccctgaagcgcgcgtagatgtccccggcgtagaacttcctggtccgccacgcgagcgccgccatcaccaccgccgcggccaccgtcaccccggcgacgatcaagaaggaatccttgtagcacttcaccccaatgcacgtcagctccttcttccccgccgccacggccaccgccccctgccgcctcgcctcccggtcgtacatcctgccggcgacgcggacgttgaggatgtaggaccccacggggcacgccacgttccccacgttgtacagcgtcgagtagtacttgagcccgaacacctccgagatgatggccaggatcatcgggtacgccgccccgaagcagaacccgatcagcaccgacgccgcgtatagcgaccccggcacgccgaacgccaccagcaggtgccccgccaccgtgagcagcagcacgccggtgaccaccaccggccgcgagatgccgtaccgcgacagcagcgcgtccgacgcgaaccccgccgacacgcgccccaggtagttccagatgctgatcagcgacaccagggtggcgatgctgcgctgcgggtaccccagcgactccccgatctgccccatgttgtcgatcgccgtcagcgtcccgcccacgccgaacaccgtcgccgtgaacagcagcaccatgtccacgctcaccagggcttgcaggatcgtgtagtcctcgccgcgcggcggcggcctcagcgcgcggaccaccctctccatcgccgtcgctggtggcgtctcggcggccgcgggcgatggtttcgtggccgcggacagcgccgggacgtcgtcggcttcctccttggggggcgtcttcctgaacagggcggcctcctcgcggaggacgatggcgaagggggcgaggagagccgcgaacacgacggcggcgctgacggcgtactcggcgcgggtgaacttgaaccgcttctggaggacgatgaccaccaggaggtaggcggcgagagcgagcgacacgtacaggaagccgcagaacgcgcggtactcgcggcgcgccgcggtcggcgagcgcggtgcgcgtatgatccggatggtgccgaggaaggcgacggagatggcggccgggagccagccgacgagcaggatgagcggcttggtgttgctgccgccgccgccgtagaaggagaggtagagctgcgtgaagatggcgccgctgaggccgacgaaccccttgagcaagccgagcatgacgccgcggctctcggggaagttcttgacgcaggtgacgagcgcgccggtgttggcgaaggcctgcgagttggcgccgacggcgatgtagaggcagacgagccagagcggggtcctggcgccgacgcggccggtgacggagaggtagagcatgaggtaacccccgagattcatggcggcgccgatggcgaggacgaaccatggcggcgtgacctcggcgatgaggccggcgtggatgccgatgttggcgccgacgtccttgaagaagccgacggtgttgagctgctcctgggtgtagccgagggtggacttgatgtccttggagtagatggcgaagatgtacgtcgcccccgccgccgacatgatgaggaaggagccgtacgccatgaaccaccgcccccgcagcacctgcgccgcgaaggccgccgccgccgcgcccgccattgccgccgtctaccaagctcctcgcttaattagcttgttggatagataggagtgtgtacggtcggtgagatcgcattaattgcagacttgtagcagtaggaggagaggaaaatcgttgaagatgcatgtgactcactcaagtccacttcactgattgagtacacggtttgagataattttgacaaaagttttggttcagcgtcaaattgccagcatgatattgacctttgctgcgatggtttgtcccaaagtctgatgatcctatccaaatccccaattcccaaaatctcatcttttatgatggatattcttcagcattgaggaactctgctgtcttgccagttgctactgtctgaaaaatgcagataattcactaatctgattctgttctattccggaaatccggatttgatacttatctgttccagtctcttactcctatcaacattgacatacagattatgccaaaactaaagaaaagatcaactctttcttcagacggtatggcaccaatttgttcaagctggtagggataggaccagcggcagcaaggcagcaagcaggacagtttttgttgactttggtaatgctacttcattattgcacctctagtttgtggaagtgcaactataactgaaaatttatgtcggtaatgaagaaaaggttgaaggggcagctaaagagtactcctctgttcaaaaaaaaaaaacacaatcctagaattggtttttttattttttttttacagagggagtacccctctgcaaaaatgttagaattattttatatttcagtttttcttaatatgttagttatatttgtagtattcaagtatctaggatataaataaaaaaatatttgatcaaaacccgataagttatcttaataatcattggttgcatgcatgtattttttaatctatgttacatataagatgagttaattttttcttaatcttagtaatgaaagtaatatgtctaagggcattagtatagtatactcagtaagtaaggtggggtctaacaaatgtagatttttgtcgttggaactttcataatgtgtgaggcaataaggcggtcccatgactatataaaaatccaacggtgtgcaatggcatggatggaaaggagagagtcaacacataggtgagaaaatagtgtttttttattccttactattctctatccaaaagtctaagatatattttattttttgttatttcaaaagtctaagacctatttgtaacctttacatatccaaaagtctaagatatattttattttttgttatttcaaaagtctaagacctatttgtaacctttacatgctaaatttctcttaaaaaaatctttatgtgctaaattaaattgttgacggaacacaagaaaccatcttaatacttattggttgcatgcatgtgtataatttattggttttgtcacatggtggatgtgataattactcattggtcttggtgacaaatgaaatgtcttagaattttgaatatagcaagtactagggagttattgttgcttactacttccacaatgtttgtattattgcttactacctggtttttaagcatattgtggatgccataactcttttggatggagggaatatttcatacttcctccatccaaaaaagtctaagacctatttataatctctatgtgctaaattaaattgttgaccggaacccaaaatgtcatcttagtacttattggttgcatgcatactataagggttattgataccacatacccaatagtaatcgactaagctcggtgaggcccaccacataccatgttctatacggaaacaaacctcgtaatctcgtatatagaaggagttccggataaggaataacaaatagagttctatatggaaacggcaaggactacttggattgtattcattttggtctccctagttttatttggacaagaggacacctatggatataaatacaaaccccctaggaggagaggaaaaagaaacccacaatacacaagccaatacgccgctggatattaacatcagagataagcctagacataccccatctggtgcctacgaaagccggcaagagggatctagcgccatctctgatctcgacgagttcgtacttgaggaggaagactaccctgtcgtcgactacgagttggttatctagccgccaagtcgacgacagctagataggttatcccaaatattatatttgtgtgatccagatgaataaagagtaacaccggctttggccaacaggatgtagggctattacctaccagataaggggcccgaacctatataaaaatccctatctccatctctctttacctcaatcccgcatataccctggtgccaacgatccccataccatataaataccgtagtcgcgatctcaaacgtcaacacatgtgtatagttcattggctttatcacatgatggatgagttaattactcactggtcttactaacaagagaaatatgtcttagatttttggatggagggggtaccaggctaccagctactccctccgatttcattttaattgacgttttggacaatgacacggtctacaaaatatatctttgaccttatttttctattataatatatacaataaataaatgcatgtttactttattatattactttgaaagacaaatctatatatgttgttcttgtttctttaaaacaaatattttgaaagttattgatggtcaaagttataaaagattaaactcaaccttgtccaaagcgtcaattattataataccggaggaagtaagacacaaccaccactaacacaaataaaaagaaataattgttatcaccttctcgtttcgaccgcctcaataaacacgatgcatgcaccaatgagattagggtggatgattaacagaaaatttatggaagagagaagtattagtgaattgtatgtagacatacgcacatcatattatgaaatacttaaaaaaaagtggctacaccttagtatattttaggatggatgggtataaagtactagctttgaaacccccaattttgaaaagatatgtgtttttaagtgtggctgggaatcaaaagaaaagtaaggttttggtgtacatatccatcgtgaaccggaaataaaatggcggccactgtcaaggccataactgataggttggatataatacgagaatgacactgcacagctctcatttacttgttgacagcactttcaggctgtgcaccactatatctatatgtagatcagcagacctttagtaaagtgaagggaatgaaaggagttaagttcacacgtttgcatgtatctacaaatgaaatcattatccaatggtgagaattgttacacgtgtgagcacactcaactttttctcctaaaaataattaaaaaaaactttatctgcagcagcgtataaactcattcgcgggaagattttagtatgtgtgttaactgtgtaattgaaagagagagatagagaaatctgaattgtttcccttgttgcggggaaatctgaattgtttgccaaacaaacaaaagagacaggtcctcacatctcgcgttcaaaactaattgggccaattagataagcccggcccaaagagagtccgtgctgcatgaccaggcagaagtcagatccaaccggcctgcctgtcaatctacaaaggatttggattcataagcatttgtttagttggaggacggaatggatcggattgagacgaatttattttctcagggtgtttattttgggatacgctaaaccaagcatacgctaagaattactacttataactgtcatttgattatgtagcaataaggtatagaaaatccaaaggaaattaatttccttttctaacagttgtagagaaaaaaacataaaaaatttcccatctactcataccttttttttaattagtatggatttgtaattatgcattcctgttcctacattattttctatttctgtggagttgaaatcccggcctccaaaccaaacaagcctgcgctgttttgagtatctttataccttacaggttcttatatatgtctatatctcttagggctcctttggatgcaggggaggaaaccccgggaaaaattcccgtacagagatttttccctgcaccaaccgatccccttccacctccaagggaatcactcctgttaggggaattttccctgataccatttgggagtagggggagagggttgatgggggaagggggatttagacaggcaaactgctaaacagtgtttgaacaacatgtctctagaaatattatagaaatttcaggaaaaatagaaagaatatagaaaatccatataaataggaaacaacctacaaaaattccagaaaaaaatataaaaacataaaaaatcaacaagtattagaaattcagaaaaatacaaagaaatataggtgagtttatgtggaaaccaacttcgtgacatgacataagttaaactttagaatcatccatatcatacaaaatttaaaatctttggaatcatccttgcatccacaaatatagaactgtacattatatttatatccacaaatgtcttgatcaagaatgagacatgggtccatttaaatctttatctcttctatcttcttcatcatctcttcaacaaatcttcatatattctaataaatctgtcaggatgaaaaagataatctgaaatttaagtaataaatataaaatagtgatacttcagcaatcaaatttgaaggatggccattgatactagcttaggaaaaaaatgcatgcacatcaaccaacatattgcaattgtcagctacatcagcgtaaacaaactcttggtataagcactttctttttagatcaaacatcctacatgcagatacacaccattatttttaaatcaaacacatttgaagtccatgtttttgtattgatagttttccaacaatactctatttcaagtccatatttgaaagtaagttgagcatgcaattcaaattgaatcctggcaagaggaagaatgcaagagcacaattatgaattatcattatggacatgataaggaaaaaaaagtagtagtagtagttgttgttttaattaatcggtactactaggtcactttgtttggccagtgtattgtgcagtgagtgagagagaggagattgaaacatctgtgtgtgcgtgtctttgtatataggttgctgccaaagcttgtgtttttttgaatgcacaatgccaccttgctcattttctgctagtgatacatgacatgaaactaaagtttggactaatgtataagtatagagcataaaagacttcattttgtagtaagtatgagttcctatcaaaaatatgattgttaccatttatttagtcccaacatgtatgctaaattgaccactaattctacagttccctgacagagactacaagaatggatcagactaaaaaatacctccagaaaaaacaaaaaacttgatgctagcagctcaaccagtactgagatctacctctaggttaacagagctgacagcatccaactaaaagaactgcatctctaattaactacaaaaaactgttactggtttgcagactaaaatttctcatatacctcactagttgaatgatcctcactgcatgtgtgataattcctcatttcttgggattggcacattgatctcacatatttagactacactaagcatgataattacactgcagaaaaaaccagagcacaacctactccatcaaattagaacatcatcttaccaaaactcattcatgatctaaaacaagagcaccatacgcccacccatatccccttctgaatcgcttccataacaaaatgaaatgctactgcagggtacaatatcacaatgtattagaaagaacaggagaacagattacaactctcccaaaccaaatcaagaaacatgccatacatacaccaagaaaactgaagtactgaacgaacccccaagaatcaagcagcagctacaagggcacgcacaaacctagccgggcaaccgccggcgggcgtcgcgcagcgaggaggaggaggaggcggatctgcgcctcagcgcctcctctaccggtgagtcgcgccgccttggatcccccctgtccccgcctgcttggagccgtgtgcccgcgctgccggctcgccgcctcgtcgtcgttgcaccggctgccgcggtgccacccgccgcgcccacgcgtcggtgcctgcgatacaagcgctgagaccggagagcgagattgggagctaactagaggaggcggaaaccctagaggaggaggagaacggaaacccaggaggaggagaggatgggaataaggagaagggcttacccttctcgccggaggaggagtcccggcggtggcgcgtctcgccggagaaggaggcgcggcggcgcccgctgttgttcgcgcgagagagaagcgactccggttgcgcgagcgagaagcagtggcggatcgagagagcaaaaattcccaacctccgaaggtcggggacctttccctagggtttccccgtggattgggccgggaaatccctgcctcgtgggcttccaaatggacatggaataaaacccgtgacaatttcccctgcaggcctttctcccagggaatgggctgggatcccggtgggatcccgggctgccaaaggagcccttatatgattcccacgccccatttaaacggtcattgcttaattttcttgtaagttttcaatctaatggatttgaagcgatatgacactttaatcctgtaccttttcagaaatcagaacctgtagtgttccaaagagccctagatcggtggaggctggagggagagaaacatcaatgaagtgttcattatagtattgcacaacatgatattttttttaatgaaagaatcgagtggcatatgtttttacacgtttgtttgtagctttactagtactataaaatgtaccactagtatataggagtaccaagtcactgaaatggacagacgacagttgcgtcttgtccgtatacattgttacacacacccgttttgttcttcagctggtagttgttgcaaaatgtgcagtgcaaagtaaggtgtaagttaatctcaagaccctagcttggatgggtacagcgtgtgaaaacagacaaaataatggatgatccgaaacgaaacggacagacatgtcactagctctgtcgtcagtgaattaattatcacaaacacgaataatgtggtacaaaattaatcgtgacctcgatcgtgtgtgtagtactgtagccgaccgtcgatcgatcgacgatgaagatgatgacgaggatatcgtatatatggatctcctgcagcccaatctcaataatatgcagaagatgagagtacgatggatgcaatgtcaatctcatctcatcaatggtgtcgctattacagcacgtggttttaataataatccacggtacgtacggtgtctagctgctacttgcactgtgcccctcctctacttaaacgcgccatcgtctggatagctagctacgtactgagctcgagcttaattagctctagctagctgcagcaatggccatgggggctcgcctctgcagcagcagcattattgttgtggtggtcgtcctgattgtggcgacggcggcggaggcgatgcggtgtccggggacgacgagcgtgtaccggcggccgaagaagaaggcggcggacatggtggacatgccactggacgccgacgtgttcgcggagccggcggggaggaacgcgccgcagcaggtgcacataacgctgggcgaccagacggggacggccatgacggtgtcgtgggtgaccatggaggaggccggcaacagcaccgtcttgtacggcctcgccatggacaagctcgacatggccgccgacgccaccgtcaccacctacacgtactacaattacacctccggcttcatccaccactgcaccccactactaggaaaatgatttgttgccacgaaaaaaatcgtggcaatagatacatattgccaccattttaaaaccgttgctagccgtggcaatagaaacagtagcaataggttattgcaacaatttttatctagtggcaacaaactttgataatgccacaaaataatcgtggcaaaaaaacatattgcaacacttaacatcgttgcaacaaataattattgccaccacttcgtgcgtggcattagttgtgcttgccacaaaatagtttcgttgcaatatctaatatatgttattgccacatagcattaatcgtggcaatatatcatatgggttattgccactaaaatatttttgtggcaataagtattattacaatgaaatgaatttcttctagcttttatagaaaagaaattgtgttacatcagtaattggatggatcatttggtactattgcaacatgagtagaaatatatgttaaatggcaaaacccttgcaactcatgcgcacaagaattatgatgtctgatatttccgcgaataagacataatatatttcagatacccaaagtaatgatgacaatatgagtatgttaaatttccaaatgctgaaatacaagttgtctgataaaactaaaagttctgaaactaatgagtttgtaacattgttgtcgaaactagcttttctagccatcacttgtttgattttgtcgtggtttgctccagccattcaacagtaacagagttgattgttcctcctgtacaaatgtatggacatatagttacaagtcgtatttaaagtaaagaaagtcaccatgtaaaatgcagagctattttatctagttttctgctagcatgtatagttaccaaaacttcataatttcttcaaataaaggacattgccagagtctgcagtgcaactaattttagtatctaacatgattaaattgagttagaagtcatatgccataactatcatgccactgtatggacatgtgtgttctttggattgatggaaacataaacaaatgtgattagtgctcactatatctgacattttttaagccatgcccctgttatttactgacttgtgagacccactgaaatatatatgctttgttacatatgtggtggctatatatagtactgtgttgctaatcatttatatggcatgcatgcttatcttagttagctcagataaacaaaacaaaggcctatggggcagtaacagaagcttagatgccccatatactaataaactaaacaggcaactgtttttgtcagcaaaggggacgtgccaaatactaatacaatccaatgagttaagtagcaaaagtaccagatcattacctggatgctacaccaaaccccgagctgatttagatatttctttcattcattcttccattttctcctctggcctgttacaggatttggccatacacaataagaaattattttttttacaaacagaccatgagcaggaaaacatattgtaaaattttttgcaaaagatcatttcaacatagcagcttgctgaagatttgtaattacctgatcagttcgggaccgtacaaaatttctagcaacattcctaagatgttgtgaagaaatattttgccgggtagtacttgttgttccttgcaaattagcgctgttaaaaagtgctttcacaactgtgttgttctgaatgcttcgagccttctttgttgtgtcatgtggttctctattctcagttggacaatctattgccagatcagacttcacaccataaaacaagaaatatatatattatgattccacatttgacatatataagatatcaaatattggtgaatgtgaacattttggcaatcattacctgttgttccgatgctacgctttgcgtagtaatcattttgagaatatcctcccgtagcatttccctttccttacgttcttctgaatcttcccgtgacattgtcatcatctgaatcttcaccgtggtaaacccactgtatgtaactttcatcgaatccattccttagcaagtcactttgcacttcggagcgtgttttgtgtaccacattaaggcatcttctacatggacagggggcattatccccaggattatcatcttgaaatgcaaaatttaaaaattcctgcaaccctttttgccactctgcagttgccctactcatgcgcatccaactcttatctactgacatgcttcctgcttatcactatacaatattactaatagtatcaaaccacccatttaatgaaaaaaaaacaaggaaaatatggttggcactttatgatcttaaggaaaatggagaaactgtgtgaacataaactcaccttgccagaacttgtctctgtaggctgaccagaaaaaatattcctgtacaaagatatgaacagataaattagaactaaacaaaatcatgaggatttgagctgaaaaatagacattggacagtaacagatatattggtattcccatggaaggtgtttcttatttttcaaaattcatatgagaaattggacaaactgaagaaattaataaatatgagagaccgtgtatagcaaatttggatattgtgcagtataaccaaggtaaccttgtgggagacagaaattcagaaacaaagacagaaattcagaaacaaacataactcatctgagctattctacgctagcaatgctcgccctgcctgctctgcttgcctactaagatagctaatctgaagttctaaactactcactgtcgctgccgctgcggccgtcaccccatctgcagcaagcaacatcctttgctctatgttaccgagatacagggatacggatatggataggatacatcattttctgaaaaacatggatacgggatacgtctatatatgtatacaaaaataatatgaatttatgcctgggaaatcaatagcactagtaaaaaaaataaatcatgtcttccagtctgatttctctctatcttctccaataactcaatttaattacctccacaacccattggatggcagctttgtgccctggcctacgtggtagtgtggtggcgatggcatagggcgtccggcggtggaggcagtgctacgcccagcggcggcggcggcagcggcgcgacgcggcatattcggcatccgacgatacacccggcttccgtcaacggcagcgctgcgctcggcttccatcgacggcggcggcgctgcgttcaacttccatcgatggcgccgcggccgacccccccatctgcagcaagcgacatcctccggctccgcttcctcgtcgacgccggggccgaagccgaccctgtgtaccctcgcatccttccattgtagtggctctctcatgcgttgactgaaccctcgtcttccccagcgaaccctcgtcttccccggcggatgtggcgcctctagccaggcacctcgcttggatccctcccgcacacatctccggcatgttgcttgtggaactagggctggaggatcagatcgggatgaggaagatgaattggaggggatgcaggcgtcatccggtcgccggcgcaagtgaggcggcacagaagacggtgagcgccgacggattgggaaatttggctagaccgtgaaaaaagaaattgtgtattcgaggaggatgaggggatgaaaacggaggatacctgaaggctgaaagctgaatcactgaacggagtggaggaattcctcgtgacgcggttgacggcggcaccgtcgcggtgaaatcaccaggcgctgctcctccgtgagactttggaagtcacgggagcactgcccagccgtgtgaatggaatagattagattgataaatagtactaataactgaactaactttttcgggagttaatcgatcttttcacgcgcccaaaaccgcgaaacacagaaatatttcgcgctaaattttgggaggttcggctgagtcgtggcaaatattgtgtgcttattgccacaaaaatcgaagtcgtggcaatagggcttgtacgttgcaccgatattttttttgtggtgatagcttagtttttattgcaacgatattttatttgtggtgataacttatttttgttgcaacgaaaataaaagatattacaacgattatacatcgttgcaacagaatatacttatttgccacgaaaagttttatcgtggcaatagtatgatatattgccaccaattatttttcatggtaatactttcgtggcaatagctaatttttcttgtagtgccctcaccaacctccaggtatatatcaccagtttaccccccacacacacttgttccaccccaaccgtttcacctccagactacggtggtgtttgaatctcccgaagatgaagataaagataaagattaagtgtttcatataaaacgagatgataataacgtgtgattaattgagttttaattattacaaacttgaaaaatggaccaatctgatattttagaacaactttcatatataaagttttcgtacgaaacacaccgtttaacagttcgaaaagcatgccacgaaaatccaagagtttgtcctaacttttgttggagaaaagaacaacttttatattattgattataaaccgtaacgcttattaacattaatatataatttataagtaaaacttttgtacatatgttcttaacaccttaaaaacaacaataaaaataaactaggatttaaattataaattttggttacaacttataagctgaaaaacaaacgatagagctatatattatgaatattactgttctattgacaaaaatatattatcaaactctgacaagtcacaagtctaccagaaaatgtaattgaggaaaatttccgtaatgctcctgttcacatatgtataagtatttctaactagtaattgaaatttttatataagtatttacccaccgactccatatatcaaccaatcaggtgatgaaaaatatatatggtataaaagtaattttacctcaatcttaatttctcctaaaactccagaaatatttagagaccatgttcataaagaaatgctccattagctatgaaatatatactggatcgaacagtggtgcagtgtcttgatcagtcgaacgatatactggatgtttccaaacatttatacattctcaagcaagcggatcgaatggagtggccctattaattaattttgtttgcaaagttaatatattaatatgaactatcaaaatatgataggtaaataaattattggcgtttcttccaaaaaaaactattggcatcaaacaagtggatattggacaggcatatgtagatgtatgtgcagtacctgcctcaaggcaaaatgaagtactccctccgtttcgtaatgtaagtcattctagcattgtccacgttcatatagatgctaatgaatctagccacatatatatgtctagattcattaacatctatatgaacatggacaatactagaatgacttaaattatgaaacggaggaagtaccacctaaaaataaattagaaaaatatttatatgcaagcgtacattcatgtcaagaaaaatatcagatgcaagtgtccaataagctgacataattagctgaacattatatgtatatggattaattaattaattagagtggaattattaattacgctttgggacgcagtatggcgtaaagtactattacgccatgggtttcgggttcacggtgcgcagcttctggttcacgacgccgcctcggccgggtcccgacgtggccttccggctggggctcatcggcgacatcgggcagaccttcgactccaacgccaccctcacccactacgaggcctccggcggcgacgccgtcctcttcatgggcgacctctcctacgccgacaagtacccgctccacgacaacaaccggtgggacacgtggggccgcttctcggagcgcagcgtggcgtaccagccatggatctgggtggctggcaaccacgagatcgactacgccccggagctgggggagacgaagccgttcaagcccttcacccaccgctacccgacgccgcacctcgccagcgcgtcgccggagccgtactggtactcggtgaagctggcgtcggtgcacatcatcgtgctctcctcctactccgcgttcgccaagtacacgccgcagtggaagtggctggaggcggagctggggcgggttaaccggagcgagacgccgtggctgatcatggcgtcgcactcgccgtggtacaacagcaacaacttccactacatggagggggagtcgatgcgtgcccagttggagaagatggcggtggacgccagggtggacctcgtcttcgccggccatgtccacgcctacgagcgcagcttccgcgtctccaacatcaggtacaacatcaccgacgggctgtgcacgccggtgcgcgaccgccgggcgcccgtctacgtgaccatcggcgacggcggcaacatcgaggggctcgccgacgagatgacgtggccgcagccgccctactcggcgttccgggaggacagcttcggccacgcggtgctggacatcaagaaccggacgcacgcctactacgcctggtaccgcaacgacgacggcgccaaggtcgccgccgacgccgtctggttcaccaaccgcttccacatgcccaaccacgacgactccacccccacccccaccaagcgccattattatggatgattcattcattcgcatccatccatcgcttcctcttcatcgtcgtccatgcctgcctacctagtgtgattttgtacacgtacgtacgtgtgattttataataactatatatataatcgtgccaatcaataccattaggtgtgtaagtagtaacagtttactgtaatctcttcctgctgctgctgttttctgaataaagaggaggcaggatatatctatcgatggaggagcacagagcactgcctgctgcttcctctgaaaatatatctgaatatatatatacacatctgcagtttgcaggccaattatatatcatcgatcttagctagttgaaatccgaccgactcgactcgactcgattcataccccaagatcgctttcagtctctggcgcaatcattgtcatgcggaatataatcctctgccatggactattggactgagaagaaaaaaaagatcaatcttttcgggcgactcacacctcacatgtagagccactgcgagctgtttctttctccatcgctagctgctttttctcagctgaaaagaacatgttcaagatgccaatacctttcacgctagcctctcactcaaaggtacttcataaacactggaatatcaaatttacgaatccggattttccgtacgaacatcaaatgagccgagcagaatgaatgactgactgaatgagtggttccagtcattcagatggatcgagtcagttcactaacaaaagtaaaaaagaatcgaacatttgaggggcatgagggagtcttgaatatatatcatgtgtggttagccaaaacttaacggtggtcgcactaggcagaatcgacacaagcaagcactgaactgacattattgatgaaagggttagggcctttttgaatcataggaatgaaaaaacagaggagtagaaaaaacataagattcagataggaatacaagtgtaaaacagaggattgtaaaacacaggaaaaatataggaatgaccgtttgattgagtcgtaggaaaaacacaggaatttgaggagagataaagactcaaagtattcttaacatgaggtagaacctcatgctaaattttctccaaacttgcatgggaagtggcattccatagaaattttatgggattacatatgattcatttctttaattcaaagggctatataggaaaaattcctataggaatgaaatcctttaaaattcctatgaatttcctttgggagcggattctaatccctcgaggggatatcccatcgtatatctttttcttttaaattcgatgtaaatagttgtgaaaaattctgaaaaaaattgacaatgtagagtataatgatacctactaatccaccaaaattcaagttcaaattcgatttacacgtcgagaaacaaaaaagacaaatttagatataaacagtacgctactatttatatgctgaatttgtcttttttatattttgacgtgtgagttgagtttggacttaagattttgtggagttgtatatatgtattgtatgaatgttgtcaaatttttctagaatttttcataaccgtttagatggtttttaggtaaacgaggaacatcccctcgaggaattagaatagtttcccatttcctttgaatgaaaggggccttagctagtagtgagctactagtactagttgccatcgagaggtcatcttctccttatctttctcttcttcttctcctctcaattaagatacatgcatcatgtgaaagcctcatgataataccaggtcaagcagggcaacaactttatttctgttgattacaagttagtacaatgcgaactaaagaaaatttaggcattacttattcgagtcaaagcttgcccgtccacgacgccgatagccagtgagcttgacacgcgacctgccattgccactgccaaattttatggcattattcagaaaacttatactatatgctagttgattcagggaatgaaagtagctagactgctcctaattcagagttcagaaagttaagatgaatgggtggtcggttttcaaaaaaaaaaaaagatgaatgggtggtagcttattcagatttcacaaaagggaagagcaattgtggtattttaactcggatcaaccctctgaatgatgctgtcagttactggcactaacggttttacacagaaattaaacaaaagtagaatctataaaggtgaatctgctgtctagtgcagcacataaaacgatatgaggcaatcattttgggggcaaatctgtgaacaagtggttaccaaatcgaccaaaaggtggcagcatgcttctctgtggcatgcttttggctagatcaagttgtgaaattgcgatctcctagctagctttttcttcaaggccaccactgtgtttcaaagatgtagcgagtgatacatggatgggcaagtaacagtatgtgcattatactgaattctactagtaaaaaagtagagagctaagtttcctttgttgaagaggtctgaatgatatgatatctttaacatatcttaacggaacaaatataaattgtgttatgcttaatatcatctggaatatactggcatatgataagcagttcacattacatcatttaaaacgatatccacgggtgatgtttcgacaaagaagaactgcaagcctgcaatgccagcacacatgtcgcaatcttttgtgaattggtggtgtgttttgtcagtcaaagtaggcgcccatacaaatcagtagaaggcaaggcaaagcgatgtgagatttgtttgtccctcccttgcttggttggttgtacatgctgcgaatcgaagaataaatcagtagggatagaagagtacttgtgttcaaagtcaacttgcaagtccttaatctccaagattgatccgcatctccaactaaaccctctcctaatctaatcacggtctaatggcaccatctatggatattccccacaaaccattcagattagttcaagtcaacattaagatgcacgcaacactctcctatttaagagatgtatcctttcttgcttgtccaacgaaacagagtagcacaagaagcagagtgcggctagctcacagtcaccatggggatgctgcggtggggagctcacctcctcctcctcctcctcgccgcggcgacgtggacgtgcgccggcgccggcgccggggtgacgagcgagtaccggcggaagctggaggcgacggtggacatgccgctcgacgccgacgtcttccgcgtgccgccgggctacaatgctccgcagcaggttcagtcttcttcagtctccacaaccacacaacgcgcgaccatctctcatctctttctttgtcatcaggtgcacatcacgctgggggaccagacggggacggcgatgacggtgtcgtgggtgacggcgaacgagctggggagcaacacggtcaggtacgggagctcgccggagaagctggaccgcgcggcggaggggagccacacgaggtacgactacttcaactacacctccggcttcatccaccactgcaccctcaccggcctcacccacgccaccaagtactactacgccatgggcttcgatcacaccgtccgtaccttctccttcaccacgccgcccaagcccgctcccgacgcccccttcaagttcggcctcatcggtgagtaacattacgccatgaattcatcaccatttcgttcgtttcagttcatcatctcatcacatcaatttaaacaagtcattaggagttgtgaacaaagtagatcgatcacatatgcaaacaaaaactggttcgataggatttaggttaggtttagtctcacagtaatccgttgcattcaatgttgaatggtttcttgtcaagtttttgcattaattatatatatcgggagactccaaagtcgctgcaaaccgccctcatcccaacgtcagtcagtgtcattactcaagtctgaatttcctctcgagtactcctacagtaccgtactcaatcaagtaggtcagccgtgttgactatacatgcttcaaagtcatcaaaaaaaccaaaaatgtacgcagctggaattgatgaccatttgactgtgatgatcgtatggtatttgaaaccaatgaagatgtagattacgttaacgcacataaaacaaaaggtcattattatataattaattaaattttaattattataaaattttcaaatggatatatttgacattttaatgcaatttttatatagaaagttttgcatgactatttaatagttttaaatacatgctaacggaaaaaactattaaacattttgtttcgtgtaaaaaatttctacatataggccgtgtttagttcacccccaagtccccaactactctaaactttcaactttccattacatcatatcacatccaaaactttcctacactcataaacttttaattttttttcaggaactaaacacactcataaattgctttaaaatatcaaatatgttcatttgacaaaatagtattagtaggagtactcccctacctcgcagtaaccgtttcagcgtgttactaatgtatgttagttgacttttttggaaaaaaaacaactgtacgagttctgtcaaatgtagtacttagtacaaatacaaacgacgaaggacctgtttagttggcaaaaaaaaatctctacatgtcacatcagaacatcggatatacggacatatattttattaaacatagtctaataataaaataaattatagattctgtcagaaaactgcgacatgaatttatcaagcctaattaacatgtcattcgtaaatgtttactgtagcaccacattgtcaaatcatgacgcgattaggcttaaaagattcgtctcataatttcctgccgaactgtgatattggtttttttttatatttaatactctttatatgtgtccaaacatttaaaaaaaattgtttggaactaaacaggccctaaattaatgaaatgaaatggatgagtgcacgcaggtgacctcgggcagacgttcgactcgaacagcacgctggcgcactacgaggccaacggcggcgacgccgtcctcttcgtcggcgacctctcctacgccgacaactaccctctccacgacaacaaccgctgggacacgtgggcgcgcttcgtcgagcgcagcgtcgcgtaccagccatggatctggaccgccggcaaccacgagctggactacgcgccggagctgggcgagacggtccccttcaagcccttcacccaccggtacccgacgccgtaccgcgccgccggcagcacggagccgttctggtactccgtcaagatcgcctccgcgcacgtcatcgtgctggcctcctactccgcctacggcaagtacacgccgcagtggacatggctgcaggaggagctcgccacccgcgtcgaccgcaagctcaccccgtggctcatcgtgctcatgcactcgccgtggtacaacagcaacaactaccactacatggagggggagacgatgcgcgtccagttcgagcggtggctcgtcgacgccaaggtggacgtggtgctcgccggccacgtccactcgtacgagcgcagccggaggttcgcgaacatcgactacaacatcgtgaacggcaaggcgacgccggcggcgaacgtggacgcgccggtgtacatcacgatcggcgacggggggaacatcgaggggatcgccaacaacttcacggtgccgcagccggcctactcggcgttccgggaggccagcttcggccacgccacgctggagatcaagaaccggacgcacgcgcactacgcgtggcaccgcaaccacgacggcgccaaggccgtcgccgacgccgtctggctcaccaaccgctactggatgcccaccaacgacgatgtataattattaatcgactccaaccatctcaaacttcttaatttgtatcactgctatgctattgccattcttcttcttctttagctttggataataaatactcctactatgcaataacaaatactactagcagagtctatcttgttaagccgtgagataattaatccccaaatgggacacttgccaacacatttggctaccaaattggatataattaaaaatgtttatattttggagcaaagagagtagtacaatctaaaagggagtcacaaaaggattggtttctttggaatatttttcatgtggctttgtttgtaacaaaagagattgcatctaaagttctcaaggaaagttgagaatttttgtacttcaatggaaataaacagtgagattatccagaacagagattttcttctatttgattgatttgattgttgtctcccttttctctattcttaagtttcctgttacttttccaaacagagacaccatatataaaaaaaaattaagctgaagttttactaaattttagtgataacaaaaagagaaaaaaaagtctttatgcagagaaaaaggagaacaacctaacaagttcttatctgtaaagttctctcttgaaagttgctatttatgttatgtataaggtgaagaaaatattattttaatctttttaatccttttttctgcaatttttttgctttccttttttttgcgcttttttattacttttttaatcttcacgcatgtttttcaaatgttttgtattgaaagtttttaaatcttgacttgaatcaaatcttaacttttaaaaaaataaatctcaagttgaaagttttcaaaattgagttgaaagcttttaaaatctcgagttgaaagttttcaaaccctaattgaaagttttttaaatttgagatgaaaagttgaaagttttcaaattttaacttcaaaattttgttttcaatctgttacttaaaaaaaatcttccaaaaaaagaaaaaaattatcttaattaccatcgtgatctaaaactaacatgttagttacgttagatatactcgtcttagggaaaaaaccacggaaaaaatccaccggtatacgcgataataaaaccacagagaaaatagaactccggaaaaaaaataaatctactgtggtgaagaaagggaaaaaagaaaacccacccccaggctacgtgcgtgttgccggtgtgcacgcgccaagcggcaatccctgcaactgcaactagtggaattcgagaaacgcgggaaggttgttgatggatgaatcgttcattccatccatcgtattcgtgaatgccgttgcatgatccagtgcgtgacccgattatcgtgaaaaaaatgcagcatgcatgcccctcctctccaactgatcgatgtggacttggactaatctatttgctgctcctccgtcaagtggcaatccctgcaactagctaagctagtggaattcgagaaatgcgggaaggttgttgatgaatgccgttgcatgcgtgcgtgatcgatcccgattatcgtggaaaaaatgcaccatctgcactatatatatactcactcctcatctagaacacaacaaattcattagattagattagatcatccatggtaatggaggcggcgtgcgtgctcgccgtggtggtggtggtgatggcgttcttgtccccggcggcgcgcggcggcgtcacgagcacgtaccggaggagcctgcaggcgctcccagacatgccgatcgacgccgacgtgttccggccgccgcccgggttcaacgcgccggagcaggtccacatcacgctgggcgaccagaccggccgcgccatgaccgtctcctgggtgacgccgaagctccccgacagcaacgtcgtccgctacggcctccgcgccgacaacctcacccacaccgccaatggcaccttccggcgctactccttcgggcgcaagtaccggtcgggattcatccaccacgccaccctcaccggcctcgactacggcaccaagtaccactacgccgtcggctccggcgacaccgccagcgccaggtccttctccttcacgacgccgcccaagcccgggcccgacgtgccgtacaagttcgggctcatcggcgacctcgggcagacgttccactccaacgacacgctgagccactacgaggcgtgcggcggcgacgcggtgctgttcatcggcgacctgtcgtacgcggacaaccacccggggcacgacaacaaccggtgggacacgtgggcgcggttcgtggagcggagcgtggcgtaccagccgtggatctggacgacggggaaccacgagctggacttcgcgccggagctgggggagacgacgccgttcaagccgttcacgaacaggtacccgacgccgttcggggcgtcggggagcacgcggccgctgtggtactcggtgaggatggcgtcggcgcacgtgatcgtgctggcgtcgtacgcggcgtacggcaagtacacgccgcagtggaggtggctggagggggagctgaggcgcgtggacagggcggtgacgccatggctgatcgtgtgcgtgcactcgccgtggtacagcagcaacggataccactacatggagggggagtcgatgcgcgtggagttcgagcggtggctcgtcgacgccaaggccgacgtggtgctcgccgggcacgtccactcgtacgagcggacgcggcgggtgtcgaacgtggcgtacgacatcgccaacgggatggcgacgccggtgttcaaccggtcggcgccggtgtacatcaacatcggcgacggggggaacatcgaggggctcgccgacgacttccggtggccgcagccggactactcggtgttccgggaggccagcttcggccacgccacgctgcagatcgtcaaccggacgcacgccttctacgagtggcaccgcaacagcgacggcgtcaaggtcgtcgccgaccatgcctggttcaccaaccgatactggtttcccaccgacaccaactagctacccttaatttcctacggcctacttcctctgtcacgtaaaaaaccaatctagtataggatacggcctactttctctgtcacgtaaaaaaccaaatcagtataggatatgatacattctaaaccaatctagtataggatacggcctactttctctgtcacgtaaaaaaccaaatcagtataggatatgatacattcaccaaatcagtataggatatgatacattctagtactccgaatatagatatacatctattcagattcatcgtattagaatatgtcgcatccgattttagattcgttttctgtggacggagaaaatacctgcttaattttttctttattactagtacttttctttttctagatttcgacctgaattctatttagtacgaatgcatcaacagcaaaacagattagcacactagagagggagatggattaataaaatcattcggttctgtttggagtttgctagtataatatattcttggttctgtttggagtttgctataatatattctttcttgacgaattatctccattcgtaagcgtgcgttatcctcgcctcaactaatattggaattacagttcttctgtccagaatagtagcttggctatccctttgtcttttgctctgccgaataaaacagcaactgcagttgttacacaatttttctaaaaaaatcttagtccaaattccgaaacaattcattctactacttgggacctgggagtggaaaagcagttctgactgaataattcatacgcgtgataaattgggatattgagagccgtatagcgaatcagaattttgatataacgtactgaatgaacaagaatgacctctgtattgggcatatccgcatatggcaatttgtcgaccatcatggaacagtttgatcaagttgatggcatgcgtttttagagaaagttgatgcaatgcactggaaatgtaatgttgtactccaaacagaattgggcaagccctgatatgctattccgccctttgcacacaattcggccatgatagtatgccttgatggtgactcctatatatgcaaagttcatctcttttgttttctaatagtccccttcactgtttttttttctgtcgtcctatatatgcaaagtcctttttttttcttacctcttaattaccaaaatccaaaaaaaggaactaattgaggtttctttctatacaaatttgacatccaaaccatctactttgattttgactattttcaagagatgtaaatttttttttcacaccagttaaagaatagctgcacaaatttatttggtttcaagatttgctatttgacattcgaggatgctcagctgacttcttttgactataagggctgtaaatgcaacatatattgtaggagattcctgttccgcgcatacgcgccgccaaacgaaatcgtgcgcacgcggtttcaataccatttgctataggacttcttttattttctgggagatgcgcacatctaacgtaactaagcttgctagctagtttagatgtaattaaggtgacattttcctttttctcgaaaggtttttttttactaacagaatgaaggaaatctatacgtgtaagaaactttcaaataaaatttagaactttctattaaaaagttaaaagccatatacctaataaattttacaaatttcaacttacaatttaaaactctaaactcaaattttgaaaaatttaaactcgaaatttgaactttcaagttaaaatttgaaaaacttttaactcaaaatttaaactttaaagtcaaattttgaaaactttcaactctataattgaaactttcttcagattggaaaactttcaagttaagatttgaaaacttttacctaaaaatttgaaaacatgtgtgctaacaataaaaaaaaatcagaaaaagggggaaaaaaagaaaacgcgcgaggagaggcaccaaaatagggaaaaagatagcgagaagaaaaagaaaatgcgtgcgtggggtgccagctgacgtgcgcaccagatagcaacccccatattgtatgttttagatacaaaagaaggcatcaaattcactatatagatgaaaaagaagatctaaatcattttaatcatggtacagatctactgataatatagttatatatataaaatgtaactaatttctatatgttgttgtaacacgagttatacatcaaatccatgaattgcattacccgaggttattttctagacactaataacagtaatatagagaaatacaatagtctttgctaaatagtatcatattggctccgttcaacagcaaattctttttactgtactgcggccaacaaaaacattgttttgtatttgtagttgcggcagcacaacggccgaacagacccattactagcaggattttagacgtggtttcatgagagatagatgacacgtcagaagccagagcgaattggattctttgtaaaagagaaactagaaaatgatgcaaagaataataataataatgcaaaaggaaaaaaaaagaaagaaaaggtagccgacccgacgtaaaagagaaggcgaatagccgaccgagcccgagcgcccttcctcccctcttcttctccttcgactttgttcgactcccctccttcccggcagaggagaggagaggagaggagaggactcatccatcatcatcaatcaacgccatgacgagctcctcatctccttcccgaaaggtattattctactccttcctctctctccccaatccgtctgattctcgctatctgtgaacgttttggtctaatttccccccctttttttttgtacctgcgcgcaggcgctgagcaagatcgcttgcaatcggctgcagaaggagctcgccgagtggcaggtcagccctccctccgggttcaagtacagggtctccgataacctccaaaggtcgtcatcttgtcttctactggttgatttcttgtttcttctcctgtggatgaaccgcgggatcccatcttacaattgattccttttcttttcttgactgtatatgttcttgattttggggatttttggtgggtttttattattagtattgttgttaatctgtggagatggattcgtacgattcgcctaataggtgggtaatcgaggtcaccggagcggcgggcacgctctacgccggcgagacataccagctgcaggtcgacttccctgagcattatcccatggaggcgcctcaggtgagctttcttttcacaacagattactttctcatatagaaacctttaattaatcctttcgtttcttctcatctgttccctgcattcgatttggttgcaaactaatttaactctttcattccaggtcatttttctcaacccggcgccgatgcatccacacatttacagcaacgggcacatctgtttaggtaaagttgttccttatcatctcaaaaataaaataaaataagttgttcctcatgtcggcctcttctctctagcagatatttgtttaggcttccatgttgattaactgcatgttgtatgagaatgttctttgcctaacctgatgttctatctagctgtcagttaggtgctaagattccatctgttaggggaaagccaccacctttgccaagtgtgcttttccacttcctagagtagctgtacaattgagatgccccgacttaacttttcattctatttctcttttactatgttagtagacaatcttgatgggatcacgaaattcacgaccttgttgtaaacattgtttcttgcttctgctttctaagttttcttattatctagatattggaggtttgtcttgtttcctcgctattaatacagctgtcaccagtgcttctacttctatgattgttagccatcagagggaagctttaaaattatgtagtttatttggtactgaatcctgagtgataacacctttgcttcttttcttgtcctcaattctccttccacctctgaaatttgatctatataagctgtttacgtaacttcttatcacccttttgtcttcttgtacaattagctacgagtctaatggtatgatagcacatatgtacagccttcctttttggttcctttcagagtggcatgcatttgctttttttggtaattcgttctagtaagtatttcttgtttaaatcttatcttgtgtagtgatcacacagagttgcagttgtgcttgaaaggctttgatttgtgatgcagagaatacaaacaagatttatacttctatctgttatttcttttgcctgatatatatatatttcttgattctagttgagtgccaaagttagtaaaaatataatactaatgggaattaaaacattccttaccttgaactgtttgaagggagttaggatgcatgtcagttaggttcgtgtctgggtggtcgagggtgttttcttaaatgtcctggaaaggtaatgaggattagacatctatacagtagtacaaactaggatgatagcatgcttctattcatattttaaactattgtgcaaatataatgttggccctcatgtttccaatataaccttgccatttccactttactaaaatagctgcaaatgcattggaacaatagattgttatagtttggcagcttatgaagtgagacacttaaaagtagatgtgctgaaaagtttgttctttcatcattgcccttcacatggaaacatatggtatccgtgtcttgtctctgttggatgcataaattatgttaaatggtcaaatcacaacaacttaaagcaaacaagctattgtataattagttgttgccaaatttgagctgttttcagtagacttgtctacctgtatgcaataacatagcacttatatcctttggcaaacggaggtagtcaaatctattttttgtcccccaagactcggcgacatgctttcatgttttaagttatatatacaacaattagcatcttgaatctgttacttcgactatctaactagtctagatgagctgcttgagccaaagggttgttaattttggagcaactttactgctcagctggtagttgagtgtgtgtagtattgaatttgagtaacttggatcactgattctgaaatacagtgcagcagcagctgaaaatcattcattcaggaaaatatgtttctgagacaccttaatctctgactcgtgatttcatctttgagcatttgatctgtccttttttttttaatgttccttctccatagaaacaggactacttcttgatccttgtaatgatgatttctctgtgattgtgaaccaaaagagagatgagatacagtttttatgcataaatataatggccattaagaataacagcttgctgctggtcatatatctgcagatatactgtatgattcttggtcacctgcaatgactgtcagttcggtctgcatcagcattttgtcaatgttgtcaagttcaccagcaaaggttattatatataactaacacccttcccattttctttcgctgaccaaaaacattaaaaggtatcttgctataatgtggtgtttgcagcaacgccctcaagacaatgaccgctatgttaggaattgccgcaatgggaggtcgccgaaggagaccagatggtggttccatgatgacaaagtgtaagaggaactagttggcacttttgccattcagtaatcgtaataccttgaaatctcttgcaaggggaaaatgagatgaatgtaggcttactgttaagcatcactctattggaccaccaagcttaactgctgggttggtttgtacatgagctgcctgcacacatgtcaagtcatgaatataatattaccataaatgattatacagaataagcaagtgtaccatgctgattctctgatacgatcgagcacaaaaagaatagcgtattgaactatgagtctgatgatttgctaacatgagcttgctgcatgtctgcatatgaattttttgctatgattgtctttctatgatgcggctgtgaacgaatggaagcagcgcagcaacaagaagcaatagcagcatttattcgtgtgaaatcaaggcgatttatttgattctttatatggcttactgataaaagaactccaaaaggaatagttttacccttgtaaagatattattaccctttatttaattcttaagtcaccaagaacacccttgtactacctccttccctaaatgtttgacaccgttgacttttttaaacatgttttgatcattcgtcttattcaaaaacttttgtaatatgtgtaaaactatatgtatacataaaaatatatttaacaataaatcaaatgatagaaaaagaattaacaattacttaaatttttttgaataagacgaacggtcaaacatttttaaaaaagtcaacggcgtcaaatattttgggatggaggtagtaactctttccggtttgcttgatgatacaagtattgattggtgggatgggctgaaaaggcttgaaaacggaattgggccgttccttccaataaaagggctgacacgagtggagtcgggtcgttggcccgttaagttccttccgatccgctcgctctcatccgcctcttccgccgcagcgcgcgccattgcctctcctcctcgccattgccggatctgttgctgctcctaggttatctagacatcttcctctagagggacaactcttgttagggctccatcgcggacgatggcggatggtgaccgtcaggaggccgaggcgcccgtggccgggatcaagagggtgaaggaggaggaggcgaccgcgtccccaagtggtggcgagaagaagaagatcctcccgaattggaggaagtcatcgatcccgtgtgaggggagtgagatcctgaagaagaagaaggaggcgattgcggcgaggcctctctgggtgtcgagggatgtcccgggggcgatggagtgctggattgaggagcgcgagaaggccttggcggaggaggaggccgacatcgcgtccgggaagaagaagaggaagaaggtggtcaagtacaagatgcctaatgaagttatccaacagatgatgagatacccctacacctacccggagtgcaccgaggaggagctggcccgacgttctgcctcaaatcgccagctccaccgcctcagaatgttcatcgatnnnnnnnnnnnnnnnnnnnnnnngaccctcatcgaccagtacctcaaacatggctatgcgttcgacgaggcggagatctccgacgaggaggaggaggaggaggaggagcagaagtagcaacctgtctgtgttgtggtgcaagatccatctaccctaagtaatatcgcttgcttgcttactggagtagtatcttcgtgtccctgtgtctgtctgtgtgatccaccacctatccttccttcctaagtgaagtgtctgctcgccaatgactctggtcttggtgtgtgttatcatctcatatcttatttgctactgcatgctttgctacttgagctatatattttcctgatattacaccttgctatactaattgaaccagctatcgtattggaatgaatgagtcaatggatgtgttttatgctagtgaagtacagttttacaattgctgctgattggaacaattctagtattcttagttgagattcccccatctcgatggtcagataacacaaacgatttactctagtcataatctgttttgtttctgtatgtacggttgaatctggctactctttcacttctcggtccatgttaatcaatttggctttaccatcctaagctgttacatgattctgttttcctcgtcaaataagtaagttgttccatcaccaatgcaagagtgcacacatttctaaggattgatctcatattgccaatgaattgaaattttattgtcttgtgtggccatcagaatgtttgattccatcactgcatatttggagggaatcaattatgggcaattcctctgtatgaaatttgccgatcctgtccattacaggtttttgcattcgtgtccatcactgcagaaagtcagcattagttgcattatgtctgttcaggaccaccattgaatgttttgctcatctattagtaagagttgccaagttgtagttatggtgacatctcttcttttcagtcttcctctgttcatcggttacatttcatatctcctatgtggatcgatctaaacatttctgtgtagccagttaattacctgagagaaggatctaattacatttggcctcatgccactagataattattttgcttatggttattagttttgcgtgcaacaaaattacaaggagattaggctgtctagcatatctgagctgatgactacaggctatttactcaccatctatgaggtgtcagcctaccagtatttggtcgaggaggtcaaaatggacgccaccgcctgacactgctcagggtaatcatgcccgattagttcacttggcccttgaaaacacaggtcttggatgcttgcttggctcgacgagcttttatttgttcaactgtgtgcgcgcgcttgttgctaggttatacacccctggagctgcctgcctgcatcagatacctccttgatcatggcgcttatctgcatcaagttcgctcaaatggaaatgtcactcatcttcacaccgctgcagtgaaaggtatgaacagcgtgcttagcctctggtatacccttaggattatctttttccaattacagttactacttgtctgccaacccatcctgctagacgcatgactgtaagaaacatctagtctagcggcctttgccattgccttgatttattcttctgtgatggatccacatatgaaatcatgctggagatcattatatggaaactagggagaactgtaaataataaaaagtgtgttattctaatagctattcgagcctaatttagaatactataatatggtgattaacttgcgatccctaaatcaaaatgctcattggtgcttctattttcctttttaaccataaattacaataggctctggtctaatctaatatgctctcatattgtcacgccccgaactagtcccgaccggaactagcccgtgacgctccaaattaacctgttaatcgataccagtcccaggaaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcatcgtagccggcttgctcctggaagaactcctcatcagcaggatccgcttcatcttcttcagcaactgggggggggattatttatatagagcaagggtgagtacgggagtactcggcaagccatgggaagtaagtgtttaatgcaggcttcaaggaaaggctggtgtttttgcaattaattttatttgaactcttttctgaagcaactaagtgagtgcttctcaaacgacacggatgagacagtgcgtctcgtccggtcggagtatgtgcaatgtatcagtctttagaatttaaacaaggttggcacccgatcaacagctttttcaacggccacccgggccaacaacttttcaaacggccacccgggccaacaacttttcaaacggccctagctgatcccatcagctacagatttttcaaacaccgaaccccttttcacacagcaatttcacaagcagtagtcaaaccaaactatgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaagaaatcggtccttaagtgcgagagcgggaaaccgtacacccggtacgttccccgatccgtggttttggaaattcatttagttcgcaagcaccgacccaggtgtcgggttttccaagtcttttgtaaaactccagttttacccaagttgttactcagatttttaagtttgaaggcgaccgtcgatactcgcacagagtgcacgaatatcgaggcgcaactgggtggttacaaggggacatagtatagcaattaacaatggaaggatcaaatgcaacaagtcaggtaggtccgccaatctgccttgcagacgggataaaagattaagtgcgatcctatcaatgcataatattttgcaagcaatataattaaatttcaaatataggctcaagatgttcgggtggcttgccttgctcgagatctggagcttgatcctcgaaatcctcgcgctacgggtcttcgggctccgaaactacacgcgaaacgggacaactcaacaaacggcgaaaataaagccctattaatgacctctaagcgtgccattagatagatctcgagatttgaggaattttggaagttg

SEQ ID NO: 76437 - DNA, 2420 bp, Oryza sativa
aacaggctagtaacagattatttttttaatgggccaccttctatgtattgtatacttcggggcccacaggtaatccgcgggtaatttttagtccccgcccccgcccccgaaaattagcgggggcccgccctgccgcacccgcgggttagaatttccacccgcccccacccctgtaggggcgggtccccgccgggtccccggtcccactggggaaattgctacccctagcccccacgaagtcggcaaaacgtacttctacgaggttagtacaggttcgtgcgccgggggacgagcccgaactgaagctcgtagcgaggcgagtacagatttgcgctgtgcgggcatgtggcctggcatcaagtgatgcgcccctcgcgtgcctcccggctgaatcgattcctggcgcccgtgtcctcttgctggtacaaaagccgaagcccctgccgcccatccaggctccccccgtacgtgggacgcgggcacatcgggcaggatccgatgtcgccgactagtttatccgcaggctcgcccgagtccccacgacgaggcgaggccagaggctcgtcgtggtacaccagatgcaacggttggaacacgtcgtcctccttgatttcgcaaccgttccacgtcagaacagtgctggaaaagaacggatccatagagagttcttcgtggccgtcacgatttcgcggcgccaaattaccttgcccttatggttaggggcggcatcttgtgtaccgaaagtcaataatgactcgagctaaacccgtactacagactagagtgtggccccaatgcgtttcgcaggacaggacgggcgaaagaaatcaaaaggccgacatgccaccgacatttccccccacgaaagctatcatcagctatcatcaaagcgaaggaaagaaagaaaaataaaaggaaaagaactggctggaaattagagaagccccggacgactcgatctgggggtggcaaattaatcagtgtgatcaacagggataacttatcccgtccgaccaaatccaccaaccaaaccaagacccgatttgttaggctgtgaaagacggatcagtgggaccctgatctacggaccccatatgtcaccgtccaggtctctggatctctcccgtcgtcctaatcagacaccgcgcgcgcggtgccgtcgctctcgagccgtgtcccgctcccaactcgtcacaaaagcgatcacagactcttccttcctctgctgggagagaagaaaaattggccgcgatgatgccgataaagaggaaaaagggatgagaatccgatggaaaaaaactgatgttaatctatcgctactgctgcgcactaagacgaatcgtatccgaacaagaaacgcttacgttactgttcctaaatggatcgctccgctcatcacttaaccaaaaatcgattaggaaattgacggacagcgacgcccgaagccaagtgtctcgtcgcgtaggcgtcgaggcctcgaagcagagggagcggagaggcggacgcgccgcccacgcctcctctccctcggtgacacggccgtctggctccacatggcgccgacctctcccgatgcgtccacccgtcccgaggcaccgccacgtcggaaccagccggccgccccacgcgattgccgacacgcgtcgcggcgccactggctcacccgctgcctgcctctgcctgccccccatctcgtcgccatttcccgcccacgcttcttgtcctcgcgtcgcctacgcgtacgtacgatacaaacgccgcacctttcgatcccctccgctatataaggagggcatctgcctcgccaccttcttcatccgaaagcaaaagcgactcgtcacagctcaaacaagtcaagagcgaatagttcttgctgatctgttgtttgattactttagttctcgagaggctttagctgaatccatcgatcgatcatggaggatgagaggaacacggagagccaccagggtggcgaggctgcagagcaggtggaggtgaaggacaggggcctcttcgacaacctccttggcaggaagaaggacgatcagccggaggagaagaagcatgaggaggagcttgtcaccggcatggagaaggtctccgtggaagagccaaagaaggaggagcaccacgccgagggcgagaagaaggagagcctcctctccaagctgcaccgatccagctccagctccagctcggtaagtgcacacatgcatgatctagctttaattagttacagactttttagtaattatagaaggtttcatgacctttaatcgttgtgtgcaacagtcgagtgatgaggaagaggaggtgatcgatgacaacggcgaggtggtcaagaggaagaagaagaaggggctcaaggagaagatcaaggagaagctgcccggccacaaggaccatgccggtgagcatgc

SEQ ID NO: 76438 - DNA, 3178 bp, Oryza sativa
cagggaggcgtgcgcgcggataggatcgaggtctcctcctccctcccgctcctctctcctttaactcccggctcctcctatctaactctttacaccttatctcttcctctcctcctttctctcccttaaactcccggctcctcctatcctctaactagctccttacgtacaccttatctcttcctctcctcctttccctccccaatcctccccacttcttgatctgcaacgcagaggcccgtcagcgcctctcctcctttccctcccatcctccccacttcttgatctgcagcgcggaggcccgggcagcacggagggccgggcagccggcggctttgcggcggcgcgccagcgggcagagggccggtcggcctcgcggcagcgtggcggtggtcgatgctccggcgggcggcctcgcggcgggcagcgcagcagcggcagcgagcgtttctttttttttttgagaatttgtgattcggatctgagatgtatttgatttgtgtgtgatgtgaatatgtgatgtatttgtgatgaattttgtcgaagttgtgatgtaatttttttttaagattttgtgatgtatttggatatgatcgatttgaggattcaaggatttggggatgattgatttgggattttgggatggggatggagtgaaatcaatatattaaaaacaatgaagaagagaatagaataatggagtaaccggatctagctagcttagctctatctttagtcccggttgataacaccaaccgggactaaaaatggatttttactaccggttatttcacccaggactaaaaccgggactacaaagggttataaaccggtagtaaaaagcacttctccaccagtgtaaagtttgtacacaaattcaaataatatacagaatatttttgcacgtatacaaaacttttatatgtaagtagaaaaattgtgcacagaaagtttgtacaatattttttctatatgaaatgtattttttacatataaagtgtttatgtctaaagtttttctatatttttttgtccatcatattatttatttggctaaaaggcaatggcctcggttttaaacgggctaaatgtagatacataaatgggctatacgtgtacctgtgggctgcacgcggcccgggggagcaagcatcaatggctaattattgaaagaataatttcactttaggtctttcaatatgttgccgagtctgaaatttaaatttatctctcacacgaaataccaggtatagtccatcccgtaactaatagtgccatgttaactttaatctcttgttagtatagtgtctggttttggtttacgtgataagtgggactcacgtggaccccacatgtcagcggccacctcaatgatagaaaagtacttatcataccctaatgaaataacggtgcagatcatttctactgtttgtataatactactagtagagagcaccagactttcactaaaagaagtattatctctattttttaataaatgatggtgtttacttttaaaataatgtttgatcatcgtcatctattaagaagcggatggagtatttgttaaaaaaaataactagagtttataaggagtcatttgttaggagaaacctgcccttcagataaaaaaaacgtgtaatgaagttcagaacacctgctatgagcatctcaaatatagttaactgaattaaataaaaaaaagacaaaaggagcgagagagagcttgctagtgatcaaatagtactctaaatcatagtcgaattttaaattataagacttaatttaagttgatcttggagttacttttcataacctattctctaacattagcttttaaatcggtaatattacatatgtgaaagatttattataatttttttattgctttatttaattttttacatgcttatcgaccatagctcttttttttaattttagagaagagtaatttttacccagcctgtacatccaaccagatatatacagcctctttttatttttatttttttttattttgtgatatctcgaatagagtggccacgtgtcaacggaaaaaaaatgctggacgaacttggcaggggtggagggcatatggtcttctttctcatgtaaccccctactcttctttctctctgtcatcttcctctctcctctctcatatttctttgaagctacttatattttaggaccgaggataagattataaaagtggttttctttttttatagatcggagcgtgatttttgaaaggaaatgcgtaagggacaattttggatgaaacactgttcagatgcccctctttccttttttttaacatgtacgggatgacacaagaggataatgcccagatcaagacctgtttacccataggtctgcacaaggcctgaatgggccagcaattggaccatactaaacaagcctaagggcatttctcgaagtaataagtctgtcttacctccctcaacacttgccgctgatgaattgtctccctcaaccgcaatatcgagtacaatgcattcccgatcttaaaaaaccagagcaaatcgacttccttggccattttgatagcagtttcgtcatacatggtgctcataaatcccacatgtcagtgagaaaaaaaataacgccccaccccccctctttaccctttatctctatttatgattctcgccaaaccggagtcagatcagtgatgcgtagtcgatgaaacttggaaaggagtgtcccgaagagcgtgttcccaagcacaagcggcttgttgagtttctacatcgcgaacaccttgtcgaggatgcggccggcaaggcggttcttggataggtcgatcggcggtggatggtgtccacatagctccccgtgctggacccatcgacctccactgccgctgaggtctctaggaaggtagacagtggccgacatcagcgagctcgtaggggagctggggtaggatcaaccgggagctactctagaaattgtcatcgctgccttgctcctctcctgccgaccactagcctagacatcacgaggtggcatgggatggggaggatgccggccacaatagccatctgtcgcagttcggacgagatgggaaggcaccaacgatgagttccacacgtgacaaggagggccatggcagggagggtgtgacggtgaagctggatctgccttcgggccct

SEQ ID NO: 76439 - DNA, 3808 bp, Oryza sativa
aggttgaggactcctagacggctaggagtcgttcctgagccaccgatctacttgtgattggccgggagaagtttgtgaaggccagatctcatcttcgcaagggaagagatacctcttagtggaaggaggagtgcttagtgcaacctatcgaggaaagggttagctaagacccagctcttagtgagctcctcaacggatagtagaatcccctcaaggatttgaacatcgggatcaactttgtgagctatatcttggtgatatttcttcatccctctcctctagctttgcttgcttgtgccgctattggtctagttgccgtttgtgccttgtttgccctgttatagacttctagatctagagtttttatcctgtgttcgctgctctgtgcattttcggaagttccgaaaattccagcctagttccgaaaattcctgcttccgcttcatttaagtttttaaattagcctattcaccccccctctaggcctaattgaccctttcagtaaagggctaattgaccctttcagtagctaagagtatgtggtcgtcaaatgttgtggcaagataggctttagatgttttactcctttccgttccctgtctcctttctctttttttccctttcagttggcatgtaaataacttttatttctatgtgctcctaaaaaaactcttaaaaccaagtcaatttacctctaaattaaagtggtttggataacgcttatgtggcactagacgcaaaaataatgataataatattaatgggagccacctgtcagtaccagtttgaaaaaaaaaactaaaacaacttatgtgactatgtgagacccacatatcacgcttcatcccttcctcggtctcttttacctcctctctcaaagaagacttggaagcaaagtggaggcggaagcgaagattgtaggcacgtgtggagaaggaggtgagacggtgctcggtgatgcgctgtgaaaaactcaaggcttgacacccttccatggtcttcctccacaccatcataggtcaaccctttcttcggttcacgtaaaaaaattgaaccagagtttcaggttatcgggtatccatatgtatagagaaaatccatgaaataccatcgacaagcgcaacttcctaaaaatgtcatcgtacaagcctatttctcccagaaataccataatagtcaaacggttgttaacaactcttcgttaagttgtatgaaaagacattcttaccctccagacaaccatttgctcacacaatatcattttgtattgtttgctcacacaatattattttgcattgatccatatttatgttagcttccaaattcacggacatcattattttgctatcaatcaaattatttcataatgcccctgtgtcgttgcctgccacctcctcgcagcccgtcacgccgacgcctgggaccgtcgggcggacgcctgcggccgacgcgccactgcctgggagccccacgccgccacctgggaaccccgcgtcgcagcctcgccgtcgtcgcccatcaagagagttaaatcgggttaggtttaggtttttatcttttcataatttttttcctttaccggtggattgggatagaataatttggagtgagagcaatttggttattattgtaaaaaaaaattctaatagtgtggactaaacggtatgttgactgtgatggtatttctaggagaaataggtttgtacgatggtatttttaaaaagttatgtttgtcgatgctatttctagaattaaaatgcttgtcgatgatatttcatgaattttctcatctttataagttggtgccattaactcttggcaagcgaggtgctactgaagtaactgaaactgagcttttgctgctgcccggctgcttactttgctctgctgccttgctgctgttgctgcctagcaccgctgctagtggctaaatggcccaaggccagctactgcagctcgctgcgctactaccacttgaattgctctcctagccggcaaagcccaagcagctagctgctagctggagtacttttcgagaatgggccaagccccagtatggcaggcagcggctgctctactttgcttcttgctctgctcatttctttatttctttctcgtttttctattttagaaaaagtccactttgactcccttaattgtacgccgaatctaattcgtacccctcaaccagaaaaccggataggacgactcactgaactattgaaaacagtgcaatttaactccctcggcggttttggaggacggttttgctgatgtagtgctgatgtggcggtgttgacccggtcttcgtcccacgtggcgcctacgtggcattagaattaaaaaaaatccatgggacctatttgtcattaaaaaaactgggtgataccgcaccagccggaatgcctaccccgccatgccacacgcggcgaccgccgagccgcagtagtggaacagcgccgccaaatcatcagcgcagcaacggtgacgttgacgagccgggcgatgagctcctccaaatcatcaccgcgccccggcgccgtcatctccatgcccaccgccgcgtgtggcgccgtggcggcggcgtccagcagcagctagttgttgctatgcacagcgacggcatcgttgaagcgggctatgagctgctccatctccatgctcgccaaggccaccgccgtcgacgtcgggccccacaatatatatttgtgtgtgaatgatagatgggtcccacatatattttttaaattctaatgccacgtaagcgccacgtgggacgaagaccgggtcaacactgccacgtcagcgacacatcagcaaaactaccctccaaaactgctgaggaagtcaaattgcactggtttcaatagtttgggagtcgtcctatccggttttctagttgaggggtacgaattagattcggcgtacaattaagagagtcaaagtggatttttttccttctattttccctctaattattctgggccatcacagtgcctctcggcaaccttgaggccgtctctgcaccgactcagcccatatcgtttcccttcatcaccaacgggcatagctgcgcgcttgtcgcatcttgcctaccatcgatgggtgggtgagatcaatggtggcggagggcggcagggctcagatcgtgtgggtgggccctaacgctaacgcaacccgacggccaccacccaaaatatttcttctcgacggcagcgagtttctcctccgcttgttattccctccttccaaatctagcacaatggttgagcttgtgctcggggcccactcatcgagtactcaagttgccaccgcctcactcctcggcggtggcctacttgtgttccttcgtcgtggctcgagcgaaacttctagagccacacaccccactctgattaatctcgtcgacgcctcactcctcatagcagccaactcactctcctccgtcgtggcttgggcagagcaacctctagagcctacgtcctcctctgactaccctcaccatcgccaccgccactagaccttgggtcccttagctcatcatctactgcctctctttcggcgctaaggtgctgatggatgaccatgactagcacctgctagagctcctcctcaaccgacgctacggtttttatatttttctaagagcggcaaatccaagctagacacctgccccatgttgactcaatgggtcaatcacggttagtttgttacttcagcaaaaagtacttcccaatccaatcagtttgcaccagtttttgaagacagggatgtattatattcgattgtatgattgagagagaagatt

SEQ ID NO: 76440 - DNA, 1419 bp, Oryza sativa
tctaatgaccatgctcattgtactaatgtttactgaaaaataatttatgaagcaccgtactgttcattagttaggtatagaccttgagctatgcggtgtgccccattacctggtggagtggaacctgatcatgaccaaaactgcaagtgcaaaagcaaaagaattgcctgcgaaaaagaaaagagaaaaaggagatttgactgctgttgtaccctcacagctttcagcatagaagtgtaaaaaagatacgactggtgtgccctttgatgccaccttcttaaatgtatgtttaatgttttcatctgaaacaaaagtgtccaaaccctacaatgctgcttcatgtcgatgaactccagtaccataccatctcttttgattggttctagaagcagcctgttctgctctgttggcaagttgtattcctcatgttatctgatatgtcatgcttgagtcttttactcgggcaatatgatctaggtgaacgtatgtaatccacacctgagttgttaagcttatcttttgctactaggtgaagagaacggtacatcatggagctgatatcttctccttttatcagaggggacaaaacagaaattggaaccggagggagaaatggcaaaataaatgatcttatgccgacccaaactgtgccgtaagccggcccgtaacttcttttgctggatcataaactgcaacctactccactccaggccggtgtgtcctgtacttgtgtaggtttaacttgcaggtacttgctgtgactaccaagcgacaaccagttaatcaccggtaacatcagaccaaaatttaacgcaggcagacggtgatatataagctcagcaaaagcaaagaacattatggccaatgaggtacctgacaaaaacatctagaacactaatacacagcactagttagaattgcatacgtgcctgacagcaccagacgtcaaataccacgagtaaaattattgccacaactccaagtctccaatgtacattttcgacacaagtagagacggtttcgggtttcccaccaaagcttctatacaaaaccagctcactaggaatcaattatacctaatttgaaaaaaatggtggaactattactaatcagggaagcatcccccacaatccacagcaacttgcctttattagatctctgtaatagcttccccacgctgcacgtcctggtctcacgatgaagaactggaggccttaaaagacctttccatgctttattgtttccaccaaatattgttttctttcctacttaggctgtgtttagttcctgaaattgagaagaagtttggaaaaagttggtagtttaaaaaaaagttgggagtttatgtgtaggaaagttttggatataatgtgatgtgatggaaagttgggagttgggggggggggggggggaaagttt

SEQ ID NO: 76441 - DNA, 665 bp, Oryza sativa
ccccgcccctgcaggacccgcctcaccaccgcggcgccgtcagccgccgccccggagaacccgaagccgtcgtcgtcgccgctgccgccgccgacgccgaccccgagctcccagccgagcggcacctcccccgcccccgccgcggctccccacgccagcgccaggagcagcgccagcagcagcgcggacgacgccgccgccacggtagcggctctcgccatggcgcgcccctgcttcttgtggtggtgggggattatttggtgaggtcgccttcttgctttgcctcgctctcgctcgcttgctcgtggcggatagcgtaatggttgtggtagagtggttggtggtcaccggccggccgccggcgcgcgggggatttataaaggagaggagagggggaatgcgtatgcgcgtgagcagcgctgcggcgcggggcgaaccgtgcgtcgcgttaggtttcgacttgtgtcacggaagcaggttggacctgaatacctggctgggtggctgacctgagtacctgagtatccggcagcgagaaatttcactcactcacctaatacgctggaccttcaaaaattaccattcaatccgtgtgtttttttaaattagccaccggagatgtgaattctttcgttccgtgctattcaattaatccgggctgcagg

SEQ ID NO: 76442 - DNA, 2226 bp, Oryza sativa
ttcctgcaccccaaacggatgtagtaatgaccaatccgatccaagtctcatactatacgggcagtggagataaattattaaatatttaaatccagttgcaagaaaaaattaaggtgtctaatggagtgcataattcggtaatcagtgtatgattggtggcttgattcccattctgttataggagaccgtaccacggttttagtgtccgtgatcagcagtagcgttttttttttctgaagcagatcgaataatttgaagttaagcacgtgggttctatgtaatacagcatcttttaatacaaacgatgtggttgggactggaaatcctatggttaaggattaaccttttctaatttttggaagttttcagtagttaaaaaaaatcgatgttttcctgttgaattggcaactatttggtgaagtttcatgtttacaaacgaaatccaagccaaaatgagcattgatccttccatgaaaaagtgtaggagggagggacggttggttgatagaggtacgtactacaaggttcatagcctccatttctgagtctcggatatctgtataattaaagatacgaaatgcctgaatcttttcgttgctcgggaaatgttcagttcttaactgaaacaattcatttgcaaggcaaattgtgaagaatatgtaaaatattgtactagattaattccagtacggatctccaagtttatagtacaaaagagaaagtgggttagtgagaaatacctgtagtcttccagctagttccatgagatggtgggctagccggcttaggttcaaagtatcactccttatatttatttgatattagatcattctctaatattcatgttttttagaaagtgggttagttttctcagtacaccggctaaaccattagagttatccctgataattcataaatgaaaacgtaataacaccatatgcccaatgatcaattataccatgattctaaattcactagtccactgaagacaaagtgagttggcacttgcgatctgtaaagaatgtggaagaagacaattcgcaaagtacaaaaggtagtagttggttagttataattcagaatagtaaaattctctgcatttttgcatcccaaacacccttagagcttattttgtgaaatgcatgttctccgggctcaaagaagacgagcggttaagttctgtaaatatgaagattgcacaaaaaggactacaacatcactgttcgtgaattttgtcgcttttcctttctatatagcacagaagctagttcgagaaagacaagtgatatgttgaggcctaggtgactaggtatagggtaataggaagaggtagatgaaggctttagtttttcagattcagaaaaaggaaaagggaagagatagcatatagtagtacagtatgcttaaggaatgatgtataagggtgaagcgatgagtacacactagttccatgtctacacagaccatatgattgtgagtcagacaaggaatacccagtacagaatgtccatcaagtgatagaatcagctagtgtaggatgagaattccaactcctgtttctttaggatattgtacaccttttttgcctagcaaattataaggtctaaacaaaaacctagtatgctccaacataatactgtatgtcaattttggccaaatgtatgatgatagttgtacaaaaagaattgtataacattgtctgatttttatgtctcatggggcaactaccaagtagccagttttactatagttatactcgatctcctagagtaaccaaggaaggtgccaacaagacgaagtgctctagagtttttttttaacaacatctcgagttcttaaaaataagatctccctcaattgccataccctctcgcaaatacaataatcctcgttttggagtttttgtgagtgaagcatacaaaattcatgatctgaactggttctgataatttcatatgcttgcaagcactccagtgtacattctgtggcgctgtgcctaagaacatagggaaggcaataatttaactggtggtcagttctggattcgaagcttctaaatataccagaacggcggaatccaacgctaataaattttacttcacagatatgagtgcagtattatacaagagtttgtcaggtatcaatgcaggtaaattccagattatgtcaggcatggaattttgcatcactaggataagctgatataatgattaactaccatgcttg

SEQ ID NO: 76443 - DNA, 1244 bp, Oryza sativa
aattcctgcagcccagagttgtcgatgaggaagtgaagccgatctcgccgccgccgaggaaggaagaggaggaggaggagccgatctcgccgccgcaaccactgaagcgggagatctggcaggagaaggcgagtgcgttctcgtcggtgggctcctcctcctcggggaagagcggcggcgccgagagcagaggtcggcgtcgcggaggccacaggagacggcgatggcagcgtccggctggagatcgaggagatcgcggcgggggatcgccgtcacgagaccaggaagcggaagaaccacctcggtgcgcgcgcgcccctcgcctctcgaattccatctccccctttcaccactgctcatcctcgacgcgatgtccatgccccctgcaggtggtggtggtgctcggcgacgacaacggcgccaacgcccctcccttgctcctgcgtcgtcgccgccttgttcccccgccgccgccttgctctccttcccacctgttggctggcgacgctggcctgcccagaaccccagagagaagagtgagagagatagagagagagaggagaaagggagagaagagaggaaagagagagtaggctgacctggacaagctgacacgtgaggcccacgtgagtcccacggtgactcagccaccgatgaccgtggtcaaagcgccacataggataaaaccggtatcagccgagggacctattgcgaccggttttgtatagttaagggaccccgcatatctggttttgtgatttgaggatgttttttatttcgctgacaagttgagggaccttcggtgtactttttcctaattctggccccaagtcgtacacgttacctgtggcggtatgcttctgtgggcttttctgcttgggccaatcctgagcgtctcttactcttctcacgagaacccaaacgacgccgcattccccttttcctcccttcccgggaaccccggccggcggcgaccggcgacctcccctccgagtcggcgactggtgcctccttttctcccctgtgctccttctcccttatccgttaggtctacaagcacctgatttggcagcgttgatccccattgttgtagggtgccatagaggaaggaggcggtggagacaccggcggtggcaagggcgacatcggcgaagagttcgcctccctcctcctcccatcctatcccacggaaggtgtgaaactctattcgcacatgtgtggcaaattttggtaggtcgtgaagt

SEQ ID NO: 76444 - DNA, 1779 bp, Oryza sativa
  unsure (1)..(1779): unsure at all n locations
gtttttgttgaccatattggctttggtgtttaatctgtctctgaatgccagccagaggaaaaccttgcaattttgcgggatggtgtggagccaaatataatctgctggagtccaaagtgacccatggaaggacatcatccgataggcatttgctgttgagactttgggttccgggtatgaaaactctcttgcgtttgtgttgtctgggtaggggtggtggttttgcagtatttgcagcagttcatgcagctctgactctgcttggtaggataggtttggatggagctggatgtgccaggaattgtgcctgtattgcgattcaaccgtgcaatccttgtgtagggcaaaagagaataaaactgggaaagcgaactctatgtgcgctgggatagccacttatctttccaaaagagggttgttttgccgttgccaagttttacctgggtcgagtagcttagaatctggaattgcgactggatgagtttccaagttggtgtatcactggctctggggtttagctgtattgcgttttgcagatatctttctctaaaccagatagccattggatcatcttctgctgagagtaccttgtttgctagttttaagagtaacgctgtgttatgtgttcttaagtccttgatccctaatcctccttgttgtccctgatataggtctgatactctgatgtaatatcattcatgatttgtgtctattgccaaggagcaccacatgcttgtgtacgttgccagttcacggagtttctaaatccaacaatatcagaaaagagttgcatgcagcctcttcatgaataatttacaaacttatcttcaccgcatctaagcaaatctctattgaatagaagacactgcagcttaattgctgaaaagttctttnttccagcatggccctttcaagttcaggataggacaaaatcttgcatctattatattgctcagtttgacaccctgtcaatagaatcatcaatttcttctgaggtttttgcatgggtaaacagaagttgaaaaagagcttattgtttgcactgaaaccttggcactcttaataacggtttccatttactgtttaccacagatttggccttcccatggaatctgatgaagatgctaagaaggggtatgctgattttgaggagagggtaaagagaacgatatatatcgatcacctttctcctcaagtcacaagctcagtaattgaagcagctatttcccagtgtgcacgcgttgtcaatgtggacttcattgttaattacacaatcccatatgatattccttctgctgcgttggtggaactagatgatgaaatacaagctaaggctgctatcgacttgatgaataatttccctttcataatcggtggaaagccaaggcctgtaagagctatctatgcaaagcatgaaatgtttctggatcggcctcctcgccctggaatcaagaaagagttccagtgggtgaaacaagaagatggaatagagtatgaaggaatgaacaaactgcggctccttgcaagaaggcaggaaacagaaaatatggcactcataaaggtaagttggatgacttttgagttttttcggatgagtgacttatgtattgtgctttatgtccactaccatgaaacagcaaacttttctgcttaactccctatgaaactgttggtagaacaatagctcagaattcactcagaagaatgctcaagggaactgggggcaggctccttgatagcgcatagacaattggaacctagaaaatgtcaacctgaata

SEQ ID NO: 76445 - DNA, 30373 bp, Oryza sativa
catcccatataacatctacttggcacttatagtaaaggaaagaaaaaagatagagcccacgtgggtcctatttaccagtggctatcgtctttctcctccacccttctctctactctattcccctatctgtctccacctctccccttttctctctttcccgatgatctccaaggcggcggctcccattggaagatataacaaaatgagaaatttgaaacaaagcctttctcaattgttctttgagttatttttaatttcttttatcagcctttcttcttctatgatacattaatttgtttcatttatcacaactttttttatgtatatattcaatatactaactttcggaggagatcaggtacagacgtcgcacaatttgatacatgttcatcatgtgacagctttgctaaagcatactgttatctgtgttctactatgaaacttcagaatttcgcctcaagatgaacatcaatgatacatctacctactgatgtacatccttcaatttctcttgcaaagataacttgtaacaacatgatcaattgcctccaaccgattaaaaaaaactgacttggttccctatgacgctaacaaatggatttgcttggaaaaattaactaattaattaacggtaaacattacgctgacgttccggattgggcaagaagacttttgaacacgccggctaagaactgcagccgtgtagtctagtgttgaacagcaacttgatgagtaaacatgacttttaaggatcacaaacaaaaaaaaaaaattatgagctttcagtgtactgttgcacagcaacttgaggagttaaatacctgcagatacacactgtcatctcatcttaacatccggacaagaaatcaggatggacacaagacaacttccaggtcttagggaacgttcgttcctgggcaatctgggggattgagagagattgtctctcgttttccgcgcgcacgcttcccaaactgctaaacggtgcgttttttgcaaaaaatttctataggaaagttgctttaaaaaatcatattaatccatttttgaagtttaaaatagttaatactcaattaatcatgtgctaatggctcacctcgttttgcgtatcttcccaatctccccaatctccccaatctccccaatcctcaaacacacccttaaggtagaaatactgtactactatctgataaattgttctgttgagcttaatcatgcaagggagtctctggcttgcattaaaacgtggactaatctctgcaatgattcccggacaagagtaccatccaaccttgatggcgatgccaaccttcctgtcagcacaattcaaagccgaattgttcaaaccatctagaacacgtgcaggtggtttgtctcatctgattattaatctaatctccagcatccagtactttatttatctgcacaaagttgagcgagtccaactgtccaagagaatgtttggcagagtattttcaccgcattgacctgaaaatgatttagcaaaatttactgttttacagttacacgcatactagtattagtactaactacagattccattattctgtggaaatctcacttgtgcacacatgctagtatgctactgcatcattgacctggaatataattcatgattgattgtcctatctacatatatattttgctaatttcatctcatctgaagctgatttgctaatgtaataactacaagctttggaaaccatccgatcgatgaagtacggttgagatcgagccacgacgatgaattatccgtgtttgatcacgcttgatctgagccgttgattctctgatcggacgaccaacaaggacccacgttgttcactcccccttatggtccaaatgcctcctagtcctaggggatcaccttgaccttcaccgaagtgaccacggcgaactcccggccgatcgccgccgcctcgagcatctgcacgacggagcgcatcgacggcctcatcgacggcgtcctgctggtgcacaccacggcgacgcgaagcaccctgacggcctcctccttctcccattcctcgccgatgctggcgtcgaggagggacatcaccttgtctcggctatctaaccggcgagacacccactccacgatgtccctactctccccgtactccgccatgatcgccgtccgccccgtcaccagctcaagcagcaccacgccgaagctgtacacgtcgctcttctccgtcaccttccacgtgtaggagtactcgggcgccatgtacccgagcgtgccggccaccacgcccgcgctggtggtgtccggcgtggcggcggcgccgtcgaggatcttggcgaggccgaagtcggcgatgcgcggcttgaaggactcgtcgaggaggatgttgctggacttgacgtcacggtggaggatggggcggtcgcagccgtggtggaggtactccagcccacgggcggcgccgacggcgatgtcgtagcgctccggccacccgaggccgccgcggccgccgagcttttgcccctcgtgcaggcgctcgtagaggctgccattggggaggtgctcgtacaccagcaggctcgccgcgccgtcgtcgctggtgatgctgcacaggagcttcaccacgttcacgtgccggatcgagctcagcgtccccacctccgagtcgaactcgcggcaccgcaccgacgccgtgcgccgcgccgccgacggcgaacggagcatggcggccgacgccgccgtgctcctcgccgccgccgccgccgcgcgtgtccgggtgatgtgcttcaccgcgaccaccgcgccgctcccgagcttcacgcggtacacgttcccggacccgccgctgccgatgaggttctcgtcgcggacaccgtcgatcacctcgtgctcgtcgaacgccaggaccctgaacgacttgaggtcccacgaccccttcttgccgaacaccttgccgccggccgcctcctccgcctccgcctccgcgcgccgccgcttcttgatgtacatcaccgcgccgagcgccgcgagcactacggcgaggccggcgaggaggcaggtgaccacggtgcgcgcggtggccgcggagtggcctcctgatcccggcgagcagcggcggaggaagtccactccgttggtggcgcacagcccggggttccccttgaagctctcgccgtaggccgcgatggagagcggctccggcacgggcccgacgagcttgttgtcggacatgttcagggagctcagcttcagagcggcgaggctcgccggcacggcaccggagaggtcattcccggacaagtccaaagaattaagccgcggcagggtccccagctccgacgggatcgcgccggcgagcttgttcccggtgaaattgaccgtactaagcgacgagcactcgccgatgctcgccgggatggccccggtgatcccattcctagcaatgttcaagctgccgagacgtgccagcctcccgatgctcgccggaattttgcccgacaacccgttcgacgaaatgtcaattgtctcgaggttgctggcgtcgccgatcgacggcgggatcgcgccggagaacctgttcccggccaggtcgaggctgctcagcaaggcggctctcccgatgccgtcgccgatccccccggtgaactggttgttggcgaggtcaatgatgtcgacgttggggagcgcccacaacccgtcggggacgtcgccggacatggagttcttgctcaccctgaacctcaccagcgtcgtgcagtttgcgtaggtggccggaatctggccggagaagttgttctccagcatgagcagcctggtcatcttgccgcgcttgcacatgaacggcgggatcgggccggacagcgcgttggtggacacgtcgatgaagttgaactccgcccagctgccgagatcccgcggcagctcgccggtgaggttgttgttgtacagggacaggttcacgagctccttgaactcgccgaactccggcggcacgtcgccggtgaagccattgtagaacagctgcagcgacacgagctgggtgagcgaccggagctcggagaggctgccggtgaggtggttcatggacgcgtcgaagaactggagcttcgtcaggttcccgaaccccgccgggagctcgccgtggagcgagttgttgtacagctcgagctgcaggaggttggtgagcttggtgatctccggcggtatctcgccggtgagcgcgttgtcggagagctcgaggtcgacgagcttggcgaggttgccgatgccgggagggatgacgccgccgatgttggccgcggagaggtagagcacggtgaggttggtgagcgcggtgatctcgtcggggaacgtctccgtcttctcgaagaacccattgtcgccggcggcgagcacggtgagacccggcatggacgccagcgcgcgccatgggaaggcgccggtgaagctgttctgcgacacgttgagcctctgcagcctcgtcagcggcgagaggtccgggacgtggccggagaagccattgaacgcgaggtcgagcacctcgagggcggtgcaccccgcgacgccgccgatccccccggcgagcgcgttcgacggcagggagagcttcgcgagcgacggcagcgagccgcacagaacgtcgaacgggacggacgttgcggccacgcccaagccctccacggcgacggcggtgacgccgccgccgccggaattggcgcagtcgacgccggtgaagttgcagggggaagccgcggcggcgtcccaccgggcgaagaaggcggcggcggtgggagggatggtgagggcgttcttgaaggccatgagggccgacacctcggagacggcggcggcggcggcatggaggccgaggaggaggaggagaggagggaggagaagggagggcggtggcatggctgccgggaagaggaggaggaagagaaggaagaaagatgcttcctttggtgtcagtgtgtgaagctgactgattggctttaaggtagtaagtaggtcagcagcctgttccaacgacagcacacagatgctattttaattagcttagcttagccaatttttgtactgttccaaacagagacattattgattaatggtggttaatttaacttgccactctctctgttcttaaatatatgaagctatttacattatagatgagacttaactttttacatgaaaaatcattacggaaaaaaaccacagacgccaattgccaataagtaatactgaggagttgattacgaacacatagtatacatctagccatcgtatccttcccatgccgtttacaaggatataggtaaaaaaggaaaaagctaagagtcataatagaaaaggactaaacgaagactaatcctaatatattgtatgtcgatattcgcatcacatatttaataaacttttttatccgatatctggccattcattttattaaaaaaatctatgtaaatgtcatttatttttgttgcattttattttatcattaaataattttaaacatgattttatattttatttttatttactatttattttttccataagacaactggttgacatggattgttacggtacaatataggagctgatcagtacatggttgtttatttgagataagtagctagattgttaattaatggagggactaacaactgtgttaagctagcgtgctaattagccagtgtaattgaccattgctttgcttccatgcacggcaacattgcatgaccaatgggcaaaaggttcagtccagatagcactagtttgtggaaccctgtttcttgtctaatgacggtcaagcaaatgcagaaatgctaactactccgtaccaggcttggactaattaatgaacgtttgtataactgtaaacccacttcaattaagatgtactatctctgtcccaaaataagtacagccgtaggtatccgtgtccaacgtttgaccgtccgtcttatttgaaaaatttatgaaaaaattgaaaacaattagtcccatataaagtactattcatgttttattatctaataataataaaaatactaattataaaaaaatttcaaataagacgaacggtcaaaggttagacatgaatagtgcaaaattacacttattttgggacggagggagtaatatataatgtattgagacttaattccagtagtgctagcctgtgcagcattttttttttgaagaatgtcacaaaggtagtaatattaatattcttatattactagcatccattggtgcaaaacagctataggttggacgagcgtgtgctggagtaatttaactatagttagatggaacggatatgcagggtcaataatatatatccttaagcaacaatcatggattgagcccttcaacgcacacaccagcatctagctatatatgattaagcggcagatattaattactattgtcttataagtcgtctacatatatctgattaataataatggaagaacgatgaaaatatattaaatggtgagatagatatatgatcaagaatgatctcagctggatagatataggagtatactactacatcatctatcgatcatcattatcttaaaaaaaatcatctatcgatcatatatttatccaagaatgggagaaaaaaatgagtccaacgacaacttggcttgtggggagcggagacgaggaactgatgactgaattctgatgattcagggagcactatctgtagcaggccaccaaaaatgtaatggatctctgaattttgaggctcaaattttggcagtttttgagaggaacaggtagctaattatctgacgtgggagagatcgcatacacacacatatacgatcgatcgtggacagatgtgatgcgatgattcggtcggatcggatggtgaattgctgaagtatatatcttcagtgtgactcttgaatgcaaatgctcgcaagttgctgcagccgccgcgtttgacctctcaccaacgctttcccacacactgcattcctgcacgcatcacactccatttcattatccgctcacagatcatatttataccgcaggattacattagttaatttcttctagaatgtaataatagtcctcctaaaacctgaattcctctgtagtttttctctctgaagaagacacactcaactgttgcaattcagagaatcttccgaaattaagcagagtgatatagtatgattgaggtcaaattgattatccttggatccaggtcctccacagtccagcagagaggaactgcagctacagtattctgagtctgctacagtgaatcaatgcgccgaacactgttcgggtactgtagcaaagtatttcgtaaacagtaatctttttgctgtttgattggttactattcccgtttactgttcccatctactgtatcgatttgttttagaccgttggatgtggatccaacagcaaacaacacaccctaatgcaaaagcactgtagctccctttgcattctcttctccactgcagaggatccaaattgattatccttggctttcctggtaaccttcctccgatcctctgctaatatatatcagtccactggccagtggacctcaacgactgatgatgatgaacctacgtgtgtgttgccaaatgccacacgtgctctcatatatggccactcttgaacactgtacttgttctcttttttctcctttaatttctctattgctttcttcttcctttgatgttgctgtcccttgtgatttgatgtgttgatggcttctttttgtcatgcatccatgtccactgccgattcttttccaacctctttctccctagcttccaagatggagatattgagctgaaacgcaaccagtgcaggacacctgtctctgtccctgtaatctctattactcctactacttctttctctgcaggaattacaggatcgtcgatgcgatgctatatgccgtccaattacacatgcagaaaacgaccagcttacctgcttctagatgattaagatagctgctcatggtaattactactaccatgttactgtatactccatccgtttcttaatatttaacttttttttaaaatatgttttactgttcgtcttattgaaaaaatttaagtaattattaattctttttctatcaatttgattcattgttaaatatacttatatatatacatatagttttacatattttacaaaagtttttgaataagatgaacggttaaatatgtgctaaaaagtcaacagtatcaaatatttaaaaacagaggaagtatgttttaacaagtaaatttagggccccctttgaatcgcagggttgaaaaaatggaggaataggaaaaacataggattctgataggaattgaagtgtaaaatagaggattgcaaaacacaggaaaaacataggaatggtcgtttgattggagcgcaggaaaaacacaggaatcggatgagagagatagactcaaaggaaattttctaagaggttgaagctcttgctatatttcctccaaaatccacatgcaatgtgtcattccataggaatttcataggatttgaaaagcttcaatcctttaaatcaaagagccaaataggaaaattttctataggatttgaatcctatgaaattgctacataaattctttgattcaaaggggcccttacattattatgacctcagggttcaaatttcccaaaattgtggggctatgagaacccttcatccgtacaatattatgtcagtcgaaatatttaattttctgaatcaagcaaattatattcaaatttaaccaaaatttgttcgaatactgacttatttcggtccgtaattccttttctatcggtcccccagaagaaatgcgcaagccgatatacagaaccctgatctcgtcatgaactgtaaaagatcccctaataataattaaactgctgctttatttgttgtatttcttttctgtttgtaaaattttatggtgggtaaatgttattgtcagtctagctatatgtgggcatcacaatcacatggatgccatgcaatctttgttagtttcatcttggtgctccaccattttgtcccacttacatgcatgcatcacaaaagcagacacaatgctcttttctttagtcaattttccaggtattgcccactaaggaagtaattattaacttaattatcttcctcatgtgccatatatttacaatcaagtcaaaaaggaaataatcacaaggaagactaatacaatgtgacttccgtgcgtagtggattttttttaaaaaaaaactggaagaattcctcaccaaaaagatgtgataatgaaagtacaattaataaaatggtaatgaacatgatataggtagcactagcagcttctgttgatctgtgcaaaaattcagatgatatgatactacaaatatatatatatatatatatatatatattcatggaattcaattagtcctatggttgagaaatctattactcgttttttttttgttttaagaatgttttttttctttctcttgccacggagactaaatattcagagagcgtatgtgaaattaaagaaaactcgtatcggtattatgtaatgatgtacagaaattaaattaggaagaagaacaagactatagcttgcctacgttagtttattatgcatcatatataaggatcagggtggctgcaggctagtttaggacagcatgaaaattagacgtacgtgcaagtcaacaaagtgcatgtatgtattatttatatatcctcatggtggtttatctcatatatacatgcatgtagaccctataatttctagatatatatgccggtggtggtgcttaacagatcatcactgacaaatataattaacgcaattaaaaaacacaattaatataaacaactactacaagtgcaaagctgatgagcatggcttgaccacaccactatagccatatctgagtgaccacacaagcttccaaattaacaccgactagtgcacgcatgcagtttgtatgtcgtcatgccaactcaacatatatataactgcaaattaaaactgtagcgtgcatagtttacctcattattaattgtgtgcttttgatcttcaactatatatatatatatggtgccaatgcctaccccgtttataacagacttgattattacaacatgttatttaattaattatagtaataaattaaatgttttagaaaataagcttaataaatatgttagaataacaagtgaactgaagtgcgctagaagaaagttttataagaaaatatgtatttgaaagacgttgagcaaataattcacgaaaataatacggtgaagtagctgaaagaacacgcagataaatataaatctcagtggattaacgtgcatgtttccgaacatctacacggtgtgatgttttcaaaaactgtttatatatgaatttattatgatattgtcttaaattcatttttaacttcatatataataattaatttatttgtttgtgccttcagataattatcacaaatcatgtctatttagtcattcaaaaaaaaaataacacatgagtattaatctacttcccctatctcaaatatagctactacaaagatatctttattttgggatggagagagtacctgtagccatgcatatatatgtcagtgcacgagagcattttaatttatatagaagttaatttagtctagttttgaaaatataagttatataagcacaagcatatgctccctctaggctctagccatatgtaatgtacgtaggtttgcatatgcttatatttttttatagtacacttgcttcatattaattggttgtttgattccattatctaaaattctaaattgttgcttgtgtgctggtatgagagcgacagtactgacacattcgatgcatgggatcatcctcggaagaactagtgtaagaataatcccagcaagcgagtatatatattcttaattagtttggttaattaatttctttcaccactgggttaagttttgctatttgatggagtacatagaatgcatgggacaaattatattaaacaagcaaaatatgctataagtatctcatatatatactgatgtgtcgttttcgcactaactaaaaggacactagtgatgatcctatagatatatctagcaccacatgtgcatgtaccccactattacaccttttctctttttaatttctttgcaaacaagacccttttttgactcttgagaacatgataaaaagatcaagcaactaacgagacgaccctcgtcaaaatttcaaaaagatataacggcaccttgctagcattcacacattgatacatacagtatatatttatatttatatatcaaccaatgttatgttctgtgaaatgtgtgtgtggtgatgtgtattgatgtgtgcgcgtatgcatatgttatctaataaagaaaaagggaaaatcaatgttgcgtttcgctagctgtgtttgtatctctcatttccaaccgcacgtttccgaactatttaaacagtgtattttttaaaaaaaatcttagaaaagttattttaaaaattcatattaatctattttttaagttttttttaattaatatgtaatcaatcatatggtaataagttattccgttttacatgggtggaaagagagtttctatacttaactaccgaaagcatcaacacaacctggtgttctattgatcgtgtcgcgcttatgcatgccagctccaacacacttcatgtctcaagatgcttcttaaatttatattttttaaaataatcggttccttcatgtatattacagtataatgtgatgctatatatatgtactgccacccccctttgtgttagtaatccttgttcagttaattaattagcaggctgctggtgccacaatataagtttgcagagaaaatgtacacaaatccagcagaaactaatcaacttcgttaaattaattaattaccttgaatgtaaatggaaatatgaatacacaaaggatgtgtttagatccaaagtttggatccaaacttcagtccttttccatcatatcaacctgtcatacacacccaacttttcagtcacatcatctccaattttaaccaaaatccaaactttacgctgaactaaacacaaccaaacatgaatgccacttgtacacacaatttgttcaggccccatttcccgtgaatttgtcgcaatccaaactgatcgataacatgcatgtgaaagtgaaagcaaaggcccttgtttgaaattaatctctgagatgcagcgcatgagatgtttggccggctgcagtgttaagcagtagcttttgtgtctccatcagtttgcagaaattctgcaactactactccactattaagcaagcaaatagtagtagacagacagatcgatgctgatgagcaaccctacataagattcatgcatattgatcaggtttgaccagctagctgatcctgacagacaaatgaattgatccatggatctgtatgggttattattatttcataaattaattaactagtagtaggcaataataacgaataattaagttagacttgctcggacttactattgtttttttaatccttgacactgtatatactatactagagttagcaatgttgggagatggatggatgggataatcagataataactattaagcacagttaatctgagcataataatacactacttaagcatagtagtgatccttatatatgtggaaaaaaaaactattgttggatgcttgcgattcagaaaatcagaatcgctagtggtagtagtactaatcatcatcaagcactgatcttagagtagcaggctgggcctacctgatttccttcgcagcaatgattttgggcccatatgccgtaggcctccagctccaggtgattatatatcaagttgggctataattaagcccatcaaaattgaacacccaccggcactagtggcccaactatatttgttcatattttttgtgaaaaaagtttttttaacaatggattacgtcggaccaaaagttaaaaaaaaaagtaataaaaaactatatatatatatatatatatattgattagttacctgacaagttaaaccagctagctaactacaaactaagtatacattgctagaaataattatgattgtattgtgtatgctggatggagtagacgactgcttatctatactatggtagtaaatatgtgaattttttttgaaaatatacaattttttttaccggaattgcaagaatatactgattaggggaagatttgagaaaatataccgccgtcgcactttggttaagcgagagcgcgatatcgcataatgaattagcgaagatgccagcgctatcgctaattgaaacagcgctatcgctaattgaaaccgcgagagcgctaacgcatcggtctcgcattccaaaagcgcgagaacgactcggtctcgcacgatcgtaccgcgatttcgcggccgtctgacgtgaaccaagaccggcgggccccaagcagtctcgagagcgcgtcccacctgctaatggaatgcatgagccatgcacatactggtatatatccatctatatgtgtgttcagccatatatagatgcatgcttggccaatgtataaacgtatacatgcatgagccaacaagaagatgatatatttgacggctatatatatgtgtatgcatattcgtatatacgattcagcgcccggattcactaacgatatatgtacgtatccatttttgattgagcgatagcaaagcgctctctcgctttgccagagcgataccgcgcgtcggtcttgcacattcggacagtgataccgatatcggtctcggtctcacgctttgcgcttgcgagaccggcggcccactcgcgtccggtcgtttcgccaatatgggtcccatgacatgctcagtctcgtgcgtcgggattacgagaccgatttcactctcgctcttgtacaccgcgataccggcgcgacaacgggtcggttccatcacgtggcactctcgctctatgaaagagcgatatcgtggtggtctcgctgtttccacaagcgacaccgccagctcaaatgcaccctcgcgagttgatagtgcgatagcgtggcggtatcgcattttgttcttgcgaacctcggtatcgctcttccaagccgcgataccgatagtatatttgtgcaaatcattctccatccggtatatttttgcaaaacaaatccataaacagtatattttcaattttttttcgtaaatatgtcacctcacctatttccattgtaaattttacaagttaccctttgaatttcttaatattaaaaggatcaaatagtcacataaaaaatcatattaagataaatattttctataaaaaaagatggataacatattaatacattttcgttaagaacattttactagtttggtcataaaaatctcctacccgtaatagtataaagtatacaaaaacagatagactaggctatgacggcgatgatgcacatactggcaatattattcatattgcgtcacaccaaacggaacggaaacgtacacgacacagctagttatagttatccagcaagagtacgcctccctagtgtagaagacgtatcccacccttacacgctctctatcccactacttttacaagaaagccctccagttttctcgtatttctcttgccgttcccgcgccaccaaaccaaaccaactcttcgtcgtcgcgccgcttccgttcttccggcggccatggaggacgcagcagcagcagcaaggcggatggagaggcttgcctcccacctccgcccgcccgcttctcaggtcagcaccccacacgccgcccagatccccatctctctctctcccccaccctctttttcttttccacccgatttaattcaggtttagtttagtttggtttgctgcgcgtttgcttttcgggaagctgcaagatgatcttgctcatctagtatccgaggttaccttcttcttgcaagcttggggattacggggagttgagattggggaggtggcgagtcaaccatggggatggctggacctaggttactactactactattcagttacttttagtttggatctccttcttgaattacctacgccgcggggtaccgatttcacagtgcttctgatcgaattatgttttagtttatcacttgcaatgtactactagtgtaaagctaccaactttactggacttggaggaggtcccgttagctagctttgggggaaccaaatctctggttttgctacttcccacagattctcaagtgaactgaaaattgacttacatttttttctgatgatatgctctctggacgacttgttagtttctgattgaaactttgaaccctgatactaggatcttacccttatagctatttgctttctactagtgatagtgagtagggaatgtgatcgacaattatgctactttgcaccttctctgcttagccgtaagttttcaggggagaacattttgaccagaaaccttgttagaacagcatttgttcaataaacagcaattgactctgccacttttgtagcgactacaaccatgctcttcctttattatgtatactttaaaacgatagttagccattgatctaggaagtttacaagcatacacggtatgcaaatatggccggaagataaaagcttacccttccatgttctctgctctctgtttataatctgttttatcctgcttaattttctctgtttggtgtatgtgaagatggaggaatcacccctcctgaggggctccaattgccgggcaaaaggtgccgctccgggtttcaaggtcgccatcttgggagcgtctggtgggattggccagcctcttgcattgctcatgaagatgaaccctcttgtttctgtgctccatctgtacgatgttgtcaacactcccggtgtcacagctgacattagccacatgaacactggtgctgtggtatgttccttgacattatgtttagtatccccctattcataattgaaataccacattctgtaaccgttgcattttgctactacttttatggtcagttgcaatttctataattttcagttgtatgtcttgagggagggtacatatgcttcatctatattttccttacataacatgtgaatcatccagaagacaatctagttctgacaaatttaatttttcaaaccattgattatccagaatgaaagaaacaagtaattccaatgaaacttgtctatctgatagtcatatcttaataacttaaaaggtactaagttggtgtctgatcattgagcggctactgttgatcaaaatacagatattatataatactgctagcaatacgtcgtagccttcatgcatatttaaagtattttaactattattagatttcagctttgtagtttccagatatcctttttttatcaccatgtggtattcctatagttattcatctgtttattgaaccgtaaaaggtatttcgatcattgtatttaattatgctaaggtctcaaatctacaggtgcgtggtttcttgggccagccacagttggaaaatgcccttactggaatggatcttgtgatcattcctgctggtgttcctcgtaagcctgggatgacaagggatgatttgttcaacatcaatgccggaatcgtccggactctttgtgaaggaatcgcaaaatgctgccccaatgcaattgtgaatgtgatcagcaaccctgtcaattctactgttccgattgctgctgaggtttttaagaaagctgggacatatgaccctaagcgccttttgggggtgacgacacttgatgtagtgagagccaatacttttgtggtatgaacttcaacagagtttgctttgtagtatatcattgtactaactttacatggacagtttctcattttttttttttgtctttgttttgtttacaggcagaagttcttgggcttgaccccagagatgtaaatgtccctgtcattggtgggcatgcaggagtaacaatattaccactcctttcacaggttaggaataccttccattgttgcaaatctgaaatctgagccacatatgtaggacaaattagtttttctggatatagacaattagtattggatcaatgttaccctgtttattttttcaaaagattgatggaattttactactattccccctaggtgaatcctccctgctcattcacctcagaagaaattagttatcttaccactcgcatacagaatggtgggacagaagtagtcgaggtatgattttttctttatcatctaatgatgcatgtttagaattgtattcataaagaagaaagggaagttggtttcacagtccctgatatgtatcatgcataatggttgtagttgtttgacttgaaagttaataaatctggaaaagaatcaacatgctaattttgtttgaatataagtgaccacttatagcatggatactttcaatccttgtacatatgcatattagttaaatgaatttcatggtgttaacaacaaagtcaagtattaagtgcatgtcgaactttaactaaatatgccttgaatgtctgtttgcccatattgcatacatttcatgttgttggcagaaaactactagttcaatgcatgtttaagtgtcgaaatccccctttcttcatttatcaatataaaggcctcccatgttctagatttttctgcttacgtttgcttttgctaggtgaaagtttaacagtagtctgtctaacggtaaatgtttttctatggaggttacagagttgtttgttggctgaagtttaatgtgttgttccctattggcgattcctgtgtactgttggtttctcaatgtttatatgttgctaatactgagcattttaattccccccttcctattatccatgtaggctaaagctggagcggggtctgcaaccctttcaatggttggtttctgtcacatgcgtattagcgtatgaaggttagttcttttatcagaacaattaagatttaacatggacaatttttcttgtaggcgtatgcagcttctaaatttgcagatgcttgcttgagaggattgcgtggcgacgctgggatagtggagtgctcttttgtagcttctcaggtttcttttctcccttttatgctggttatatttgtcatttgtgtgaacatatatttctaatttgcaaattttgcttgcggtgggtattgaaggtgacagagctgcctttctttgcatccaaagtgcggttaggtcgctgtggcatcgaggagatcttatcacttggtccattgaatgaattcgaaaggtttgtatgcttttccagtatttggcatgcataacatgcactcatatttagtgctacatgctcttatatgcttttcaatgatgttgatcctaaatccccacactgtgtaattatcaagctatcttctagtagcgcacaacgcttatatcgccagctcataacagtctttaaaaccttcatgacttgattgccagatcagtagatactgactggaagtctgcctaatggtttctattggactgggctcaagtactattacttgcatttagtagctcatagcaaatactgacaagtcccccttttgaaagtgaaaaatactgctgaaaatatgaatgcataatcatggcagactgcggccgtataacagtgcttagaaagagtcctgaaagtagagatgccccactacagattgtatggcttcacattgcaatataaataatactattgccaagttatctcttcatatccatactgtagaactgcaggatatatgacccctccgacaagaacacgctgcgtctgaattgaaagcctctgcggcatatatatgacaatatatgatgctgcattaggtccacagccaattaagatttgatatatcctactgctgtattgacctgcattactgattatcttcatacatcgctgtcatgcagagctggactggagaaggctaagaaggagctggccgagagtatccaaaagggggtcgctttcatcaacaagtgaggccatcttggaatgccccaatttagttcaacatggaaatacacaggctgtgtctttgcttcctggggagtgggaagaacacttgtatcatcttgtctcaaatgtaaaagctgcctacacgatgtttatacagctgtagcagatgcaaaaacacaagtctgctaataaaagttgcttctgaataaaaaggaaccctgctctgatctctgccttgttaattatgtttccctggacagtgaacatctcatcaggtgtaatttgatcttgtgatggacttgcaaattatagaggaaaaagaaaagcggaactaaattttacttcctccgtttcacaatgtaagactttctaacattgctcacattcatttaaatgttaatgaatctagacatatgtatgtatttagatatatgtctagattcattaacatctacatgtatgtgtgcaatactagaaagtcttacattgtgaaacggagggagtacatatcaagtaaccaagtggtgagtcttaaacagtatgccatgcacagttaggaacagtggattgtttcattgtttgttcatgcaccaatgcagaacgtcaacaagatcatgtgacgtgtgagacatttgtgatgtttggtagggttgttgctttcatggcaggagaaaacaatattatcttggaagcaaggttacttgttttgggtctgaacaacactgtgctcctaaatacagtataaacaagcctgcgtggttgggacatcaaactctcaagaaagcagcagcagcaaatgaccttcaatggcgacactgacgctgtcgtctacagttattttcaataaacaaaaacagagttgcaaacgtacaggcatgaaagccagtggcctgaaggttcagttcatcaggtagattactgtgttggtcacatcaaatccatcgtcatggtatacgtgcattaccagttgctttgatactgttttctgaatgagtatcaagcaattgcagatatatggcagcttgatgcgtgaattatcagttgcttgatactgcagttgatcaggtggaatcaatatatattatggaatactagctgcaagtagttaaccatcatggaaattcaggttcaaggcctgaaaattcatcaatctgagatctgataatattaatccctcaacaaataattgaaggcatcgatctggaccaagaaaaacaagagaaaacgtgccttttacagtcagaatgcatccattcagaactgaacatacaccggccagcagaaatgactaatgagacaattaattaatataaagttgctaatattataaactgctagctgctgcaacctccaagcctttggcaattaataaactatagacaccatgtcgatcctaatggatcgaccaattattgaagcctctcaacttttcatccatttatccatgcaggcaggcagcatgtcatgtgcccaattacacattgaataataattaattgtcgcgttgattggcttgatcagctaattaaactaaagtttacctagacataaaaattagtagtatatactttcctgagatatgcagcgctgtctctgatatcaaattgtaatttttaatgttgcttctaatcataattaactactactagctagcttgatactctactgcatccttaatatgaaattggaggactttgtctgggaataaccggacgggtccccgaaaaagatattcagtgttcatcgatcgatcgccctaatgcttcaaatcgtcactaccaaattaaacaaaacacacacacattaatacactcatcgaatccctcgaaatcatcgttagcatgttcttaatatcacgctttactccatgatggggaacaaggacgagatcgagctccttttgtgtattgatgatcactttcacgtgtatgttcgtttaattatatatattcatgtgtatatatatgtatacatgattatattaaatgggtaccaacaacttcgatcatgtagaatatacatatacttgatcgatcagatcttcatggctttgtgtcctaccaactaaagacatgctgcattttatgcgaacagcaatgtgccaactttgcactgcatgcatatctcaacaactttaattgtgtactcacaaaactttgatatcttcttccttttttttagagaaggatcatatcgatcgagagaggatccttccatgaattgatatctttagtgctgtactgtagagatcacgcaatatcttttaaacaaagagggccaattaaaatagtcatgcagaactaactgaaaccttaattaattagaaaaactatatatatccgacagcttagtatgaatatatgtatagtttttttcctgcatgcatgactcatcatgcacgagtcaggatgatatgtaccagagaatatggtgcgtgcattttgaaaacaaaaaatgtttgagggtttctaaataaatataatagcatatatacctgccttcagaagaatcacaaaagtcccaattatttagatatttatgaaattttatttagaattagatatgatcgagttttgaccatgcatacacgatctatatcattattatactacattattagctcggggtagatatatactatgatgcaagtcattatgcaacttgcaaattaaaacatattataacatgataccgaaggcgtccaaaatttgggaaaacagccacagcaagatgcaaacaaaagatcattttggtttcttcttgaattaatgatttggattgatcaacaaacatcaagtaaattaagaccaaaatttgcagcttgtattggctgtgcagtgcatggttgataaagtaaagtctcgtcaccatgcatcaacctcatcaccatttacctcacagtgcttttgctatatatgccggccgatcatatcatgaatgtgatgtgaaactagctagtagatcatgcacgagtgcttgacgaggaattcctcaccataagttttgtcgtctgatctccagagttttttttttatagtcgatataagattcctcaccacaagtaccatgcatgcatcaaagataagaggattaattaatttgcatgctcagatgtgttcacttggatagagacatgcgtgcatgggtgcatgctatagcttgagatcgaccaaacttcttcttcttcttcttcttaatttagctactctcttcttatttcttgatctgtttcttcaacactaccattattgtattggtccagtagtgctgagttaagcctcctcatgatctcatccactgtggaattgaatccctcttccacctgaaatacatcaccagctagcactgatcaaataagatgttaattaatttttatatatcctgatagagtggtagaatatcataaccaatatgacgcaaattaaattaataacagagagagagagagagagagagagagagagagagagcatgcactactatgccatattgtttctgacaaatgtacaaatccaacttggttaatttcagaagaaaataacatgcatacattttttctataggcagcttatgctctatataagtaaattgatcaaattgtaatcacgttggcctctcaccaataacatttataaaatgggggctcaaagaccgtacagatcgatcaaactgatcatagaaggggatgtgaatgtatggagtactagagaaacttttatttcttcgacctagctcgctgtcgatttcttacctgtcaacaattttcacactgcatttcgactgatttattcactaaatgactcaaccacaaatctagtaacaactagttttctctactactttaaaagcgcagtcatcctccttccatcttctcaccgtgggcttcttcgtaggatccactacttaattccaaccaaatccgcccagccagccaatccctaattatataggtctagcatatgctttattttcaatccatgcacccacccagccaatccccaattatataaaagaacccattctgtagacgaaattcacatgctatatatatctgcattccttgctctctcccatgctagctagcagcctagcacatgtttgagtccaacatatatatatttaccctgaacaagggcctctcactctagatacattgctaccccttattagtcagcagaattgtctttgaagtcatataaatatttttaaaagcatgaagcatgcctgcatggaaactacaaagtcttcattcatattatttattctatttggtccatttaggatgaacgcatgcacaactctctcttcacccctcaatgattttttagaatttttttgatcccatgaatggagtaccctgcagatcagaacaaagtacacctgcccatacaaacatatgtacatagttaattgtttttgagggatgtatatagttaattaaatggagaaaaatcttaagaaacacgtacatgtgcactagtattttttcctcagctgcagcacaaatgcagttactaatactttacaccataccaattaattttgaggccctagcttataaatatagcaggaatggagtgaattgtatgtatggaatggaattgcactcagagtagtcttaattttcagcagctgcatgcagcaacatgtatatatctttatatttttatatagcatataatacatatctcttcattattattgtagaattggtagaaattctatgtatgcaaaccatgtagagatcgatctagcttgatccgatccatcaataatcagttggagtccggactccggatcaagtaattactaataataatcaaggttaattaatttgctatatatgtagtatatgtgttctagctggaaattacacatggtaatttgatgcatatatataagcaaagcaatgcaggatggttagagagcgagcttgccttagcggtgatggtgatgatgacggtggaggccgggaatggcatgacgctggtgtgggtgatgcccagccggagctcctccacctccgacagcaacctcaccagcaaaccccgcgagttcccgcactgcacccgcaccagcacgctcctctcccacacccgcacctcgatctccggcacccgcccttcgccgtcgccgtcgccggcggcggactgccggccggagcacgacgacttcctcaccaccatggccgccggccgcccgccgccgtcctcctcctccagcgtcttcaccttctcctgcaactccttcacatacttcaccgcgtccccgaggatggtcgccttgtccatctgcacgaacacacgcaatattatctcattaattcagtgcaattattaccagcatccatcatatctagctaattaatcactgtacttgctgcttaattaggcactgcctttttctgtagattagacgaccgactgacacggtcaacaacattgtgatttcgatctgcagattgcaaacgtgtgatttctgtacttcatttggtttctttcgggtttgtctttcaatttgcccacaaatctcttggggttaatttttgttcaagttaattagatgatttgctcactgaacagtagatcagtactagactgtgcagctagctagtaataataacatgcaatctactagctatcttgttgttagcctaatcatgcatgaaattagaggagaattagaagaagaatgcatccatggattgaaactatagttaacctttttgaggccggggatgacggtggagagctcgatgaaccgctggttgatcttctcccgccgccgccgctccgcgattatgtggtcctgcacgtatcccggcgccgccgccgacgacgacgacccgccgcctcctcctttcttcaccgccgctctcgctgtcgcggtagtctccatcgcctgcagcggcgccggaactactccgccgccgcctccaccgccgctatcctcggtggtcggctgcgccgacgccgcgctgaagttccagctcatcggcctgtgccccctgccgccgccgccggtgacatgcggggaccacccggcggcggccgtggcagcgccgccgcctgggctgtcgctggagctccagctgttggcgcggtggacctggtccacctgcactgtcaggtcccggaatccgccgccgccgccggccgccgaggcgttgcggagagcttgcagcgacgggaaggcgccgctgtcgccggcgacgtcagtggcgtaggctgcggcggcggtggagtcggaggggagctggtgcagcgtgtccatcgcccactgcatgaagaagctcgagtcatccatgtcgtctctctctccactgcatcaacaaccaaatttatccaatcaaaatatatatcaacaaaatctgtgtataaccaatcctatctggaacagatcaagaaaattgtattcaatccgcaaaacaaatcaaatcggataataatttgtgatgagagagagagagagaagagaaatgaggaataatattaataatcaatcaacaaagacaataagcagcaggtccaacaaatcaagattaaagcaaaagaggcaaagacatcaatcatatggacgagacagcgaacaaagaatctgatttgagaatttgagatcgaggaggatacatggatgtcacggatgaatcgacatgagagaggaggccagccagctggagggaacaagatgtgacccaaatacatgtcgtctcatccttttccttcctttatttcttttgccgcatcgaaagcaagaagcgagaaacaagcaagcaaattaagctgatgcatgcatgcatgtagatttacctgaaattaaacaccttgagatttgctttgctttgctagcttggagatcaaattaagcaaagcctcttgctcaaatctggaggcagattgatctgttgctgctcctcctcctcctatctagtatagtagtattatgttgtagtagtagtagtagtgtgtatatgtattattgccttgatagcatttgcagctgaagcataagttgcatctggatcgatctatactaggtagtagacgatatatagtgtgctcattttttagcatatatggatggatccttgtttatcagcgtcgacatattatgcttctccctctctttgtctactaccgcacacggccaaacgttcgacacagaaatccgcaactacaattaaaatagggcggatggagtatatgtatgtttttcctcgttaattatttctctccatcacacacactacacatctctttctacaaaagagataaaactagttagccagcaaaagctgaagagaagaacaaacagaagaatagttttctctctgttgttgtgtggcctaatcctggcaattaattattatagaattggttatactgtgtacttcgcttttacacctacacaccccacagagaaaggtgtcctagtagtcgctataattgcagtgaactgttgatctgacacgacactatccatatatttataaactatagccatgatttaaccgtcctcgccctagccttaattattcgatcgagtagattgcaactatttatatatacggtagtactatataatatatagacgtagattatacatgtgtgtgtatttgtgtgctgatccacgttccaagtcaacttgagcttatattatataatacaaataagtttaattaatcaattaattagactagctagctacgggtagcttgttatagttaactgtggaggctcagtgaccgtttctagggttcatactggcatcatgtgcattatgcatggggagctgatcaaaagcatatgcatgagacacatatgcaagagatctctagaattcagactgtaggtagacatagtattatgtcactccaatatggcaaaattgcaaaattaaatcaaatgcaattattggtagaagcatcttagctagctagcgttcacaactatggagttaaatttctgaaatttcaggtttaatggtgtcctgggattttttttaaaatttttgaacttttttaattttaaattttaaaaataaactcttctaaacttagtatagaattttaactaaaaccttttagttacgccagctcaccatcttatttcaataaaaaaatttcaaatagtttatttttagaattaaaaaaataaaaaagttcgtgtcttggtggttcctggtaggatgatcttctgaccaaaaaatgactctttttagtatttcacgattttttttaaaaaataatataacaattttcctccaaattgttacctggtatgttgaaaacttgacctactttttatatatctatcaattagtattgcccccatctaataggaaccgctgcttttaaattaattttttcaacgaactggtacaagacgatgctaatttatcaaatagaggagtaaaagtatttacaggtataaaacctaaaggagaatatacagggcttaaggtaaaatttcctctagtctctttgctcccacgcgctcctaagtcttcccttcctcttttatcttggtaataaacgacatcatcgagagttctttatgctggaagattcattgatttctttctttccatatttcccatatttcccaataagttagcagtaggagggttcgcgttccttgtttgggcactcctttgcacaagaccaaaacttcccaccactcatgaaacatcgttggcttccatgatgccggtttgagttgttcttgtgtgatccaagttgcaatcatgtttcagatccttattgtgtatcttcactctacgagaagatggaatgatgcctttaggacacgctgatatagtggacaatatgttttgtttgactatccccttgccgctagcctgtaggacgtcaaaatctattttacatgagctaggcaaagaatttgcatttgcatgaggcctaaggtttccatatcgaccattcatagtttctcttgatcgagccaagggattgtgctttgtacgctgaagctaccgagtatatcccattgtttgtgatgttccatgcatgttatgttgtttggaaagagttccacctatttttctacgtttgaaaggaatctgttcagattcgttatattaagatatgtcacatttatcttttttttttaagatgaaggaagtatacaacaacatttaatatatagtttattattgcccaaatgattcaagatgctgaaaatcaaggagatatatttacgttaaccactagccaattttattttgttctgatgagtagtttccatcaccttgtcatctcaataaatataacatgacatggacctgaggcttcaccgataagtgagatctactatatatatttggtatgcagatcgaggatcggagggaaaaaaggaaggagaagaagaagaagcattaatatataatattatgacttaaataatctagaaagggatatcttgtcccttgattttgcagtttatttatactaatttttattggtatagccagcgataatatatatgacacatgtgcgcatacgtacatcgccatctagcgccaaacttaatacatgcatactttcataggtaatgtatttttctgagaccagatgaaattaagataatgaaattgcattatggtcttttttacttgttataaaagttagacatcgatcaactcagacataacaaataatgatataggaacacacggtatttattaacgaagttcagtcgaactatacatcttcagagctctgattatataggaactttttcaatcaacattacacctagctgctaagagtccatggcctcgccaccattctctctctatgtatcgccgtatttatactgtggcacctttctctttatttaaaatgttatcgggttatagagttcaactctaatttcacccaccaaatttaactgtagttaataagatcactagctaatatatccaaacacatattctaacattaaccactgctccctccgttccaaaatataagcatttttaaacttcgacacggtctacgagatactactttgaccaacaatatctataaaagtaacatgttttaaataaaaagagttgcgtattatgatagtttgtttaatgataaatctagtaacatcaattttacatgattgatcttttttattttttttctattaatagtcaaagttaaaaatgtttgacttgtcgctatgctaaggctgtgttcgcatctcaaggatggaaactcattctcaccgcacggaaaacggacggtccattagcacatgattaattaagtattagctaattttttaagcaactttcgtatagaaattttttgcaaaaaatataccgttagcagtttgaaaagcgtgtgcgtggaaaacgagggagatgggttggaaaaatagggtgccaaacacagcctaagaatacttatattttgggacggagcgagtataattcattgccacagggagcgagctgagactgaccaatatatacagacatcaggccagcttgtactcctcagagccagcatcgcagcaaccatactataggtctacagtactatatatgtacagttcacttcacggctcagcttgagctggttggattttctttttctttttcaattccttcatgtttgatatagcccgtgcttaatttaaggggagttttttttacaccgaggcgccgttaagaaaaaaaaccattaacatgtaattagttgatttaaacctgaaaatgatttattagatatttttgagtaacttctaaatagaaaattttcacgaaatgtattgtttagccgtttgaaaaatatgctaacgaaaattaagttagaatccgtatcttaattaagaaaaagaacggagtatgtctcgtactgtgtactttcggtcaaaatggatttgtgctccctttattatcggcaggaggagtttccgcgcgattgatcagctagctgattgatcatcatatcggcgatctagctagctacttcgagtttgactaagtttatagaaaaaaatagtaatattttgacccaagataaatttattataaaaatatatttaattattaatttaataaaactaatttggtagtgtaaatattactatatttgtctataaacttagtcaaaattaaagcaatttgattttgagtaaagttaaaacatgttataatctgaaatggagggagtagtttattaattattaattgaaaagagttgtaacaaacgatgtactgatgcaacagtactaaggtgcaaggggggttaaccgaatctgcagagcttttttgtcgcctttgtagtacaacaagataatgttcttgatcagttagtactccctccgtttc

SEQ ID NO: 76446 - DNA, 1467 bp, Oryza sativa
gtgaggaatttactttttgtgatatgatggcttttgttttgtgacaaaccaattatcttttctcttgatcatctggcaaaccatgaaatcgtttgtcttgaacccaatctttatttttgaccaatggtcctttcctgagatctgctgggaaagtataagctttttctgcctttcacagaagctatttctccctgcgcattttactctctttatgatagctcgatttttttttcatcttacaaataaaatgatgtaatgtgcattccagggtcgaacagtactctctttatgatagctcgatttttttttcatcttacaaataaaatgatgtaatgtgcattccagggtcgaacagggttgaaatgttgttgaggaaaatgacaaagcaaaatagcacgtgaaggcgtgaagcgataaatcagggagatggcagccccactgcacgtttttctagtggaggcaaacctacctacaagatgtaaccgaagtaaatcatatccttggagaaacattatgccggtatgtaacactacgagataactaagcgttgtgtgatcatgtatttggctcatcgggattcaaaattcagacttaacagtagtatactccctccggactgataatacttgtcattttataaaaaggtaaagtcaaactttagaatatttaattatgaatcatttctaaaatatttgtctttcaaatatggtgactacatgtatagattagtcttaaaaagtactttaataaaatcatatatttgttaatatttttatacatattataataaaaaaacaatggtcaaacttatttttttaagaccgtgcacttgtataagactaagtattatcaacccgaaaaaagtatatcggctttactccccatggtaaaatgagggagcaccggtcctaagtgacttaaaaaaagtatatcggctttactccccatggtaaaatgagggagcaccggtcctaagtgacttaattaggcggtacctatcgagtaccgattcctagatctagcctttagctggttgtatccaacgatagcatctttcgcttttttattgaaggaattgtctggaattactcctcacggtgaaaacttgtagtttggtcttaactgatagtgtcatggcaatgacggcgcatgtacactttgttacttttttaaggtattgtgtcacgccccgaactagtcccgaccgaaactagcccgtgacgctccaaattaacctgttaatcgatatcagtcccaggaaacagtgctggtatcacagggagacagaatatcacagcaacagatgtctctttattatagagtagatgtacagtcatgttgggctgcagacagatcccgagctcacaactgcattacaaaaggaaagcggaagccaggacttggaccaatcaacacaggcgcgacttgggaactaggccgaaaccctaaaactcatcgtagccggct

SEQ ID NO: 76447 - DNA, 664 bp, Oryza sativa
ttagctatctacgagtaacgtgggggtttctaaaaaagggtcctggagtatagtgtaaagaaagccaaagtttcactttccagttcttgctatcttttgcttgaactctgaaatttgtcattccaagctctttgatatgcagagcatacttcttatgacaatttatttagcatattcctaccttttcttaaagtgtaaacttgtaggaggttccaaggaaattcttttcaatgcccgattccagcatgtttgtctaattcgtccaacttgacaagcttgtaagtacttctttcttaggtgacattttccccctgatggttggcaaggccaagcttgtcatgataatttgtgttctaaatacacatatgcagacgaattggtgatattgtaaacgggagctcttcgctggcctttatcagtaacctgacgtctttgaatatcctgtatgtgacatgttttaaagttttattaaacatcttacagctttatacattgaaaacttgaatctaagtggggatcttttgttctttcagaatattgaggaactgcaagatatccgatcatctcagaacagtaaatttctcttagcttggaagaataaccttggtgtaagtttttcttgacataaacccacgtctattgctatggcctattattctcgtag

SEQ ID NO: 76448 - DNA, 603 bp, Oryza sativa
tttttttttatgatgattgatggagcactttctgttgcactgtcaaatagttgaacagtatttttgcagtaaatattgatccaatcccatgttttgactaatcaattttcagttagcaggaaaaaactggattaatagtaatcatacctcgtgtgtttggctaatttgtttgatgattcttgtgttgtttcaggaacctgcagcaaaattacttgactggccctgtgccatcattcattgggaagcttactttcatgcaatacctgtaagagtttgatttcaagttatatattcttctacatcagtctgttggagctttctcttagacatcttctctccttgttattttttcgtttatgaaaaaaggaccttatcaatcaattcgctatctgggccccttccaaaggaaattgggaatctcacggatcttcgatcattgtaagagatcttcttgcatgtcttctcattctcaacaattgattagtgtctgaagtaaattaattgcatatattctcaaggagaagttctaaaaaaacattactcatatgcaagtcttgtcggtgcaatttaccttttccaaatggtgttcataaccttaatcca

SEQ ID NO: 76449 - DNA, 567 bp, Oryza sativa
catatttgatctgttcatgttttactgcttagtttacatgtgtagatctaatgatgcgttaatgctagtatacatctgcaatgccatgatttatttatggaatatattaaattattatatgcctataatctcaacagccccaagtgcaaaattaaagctaatccaattatccaaacaagctaagaaatggatttaaacccattctgaaaccgtcgtcaaaccaaaatcaaaattggatgctgttgcctgcttgctgatggccacactaccaagttcaacggccgcggccgacgcgttgcctgccaaacagatgcagcacgacacggcaaggcgaaggaggggggcgaaaaacgagggcaaagcagcgcgcaccaccgcgttctacccggccgccggcgcggggtacacgacaatgaggtcaaggtcggagaaggccgcgcgcggcgaatgggatggacttgggggcggccgccgtacgttctcctcgaagcttgcgtggaggcggccggcctcctgctccgctgtggcttgacgtcgcggtgtgacaccccgcgcgcgcgcgcgcgc

SEQ ID NO: 76450 - DNA, 554 bp, Oryza sativa
ccttaatgattaggcttacttggagtaatgcttaatgctgagatcaatggcccgtagtacctttgaataggaatgcaacaagtgccctttccagcccagaacagatggatttcgagaaagtttttcgacacagttgccgtgtaactcttgtaaccaccagtgaaagattttccaccagccatcttccttatatcgaagtccttttcttttaggtcaccctataaaaatgtcaataatccaatcagataaagaagaaaaggatccagtaaatatttttttctgtttttgcttttagtaaacactagcatattgcccgtgcattgtaacggtatttttaattaaagaaaattatcattaacccgttattatcatctcttaattgctgtacaaatctgttactgacatgtggaccctttggccccacgttgtccttttttcattcccgcaaaaattagagagttgttaggagtattttattcttttttctcttcaagaaaagttaggaattggttgtggggtggtagcagaaccaccaccaccactagtccctttta

SEQ ID NO: 76451 - DNA, 566 bp, Oryza sativa
agctaggagagaggaagaaaaatttatctggaactggaagaacaaaggaagtgaggtggtggaggggagcctgatcccctgatggcctgatttagggttggcgtaggctgcttgagtggtttcgtgcttgactgcttcaatcggtgtgtttgccaccttccattgatggcaaggatgaaggatgggagggagagcaagagcagcaaaggagggggaagaacgtggagcagcagaggaggagagggaagaacgtagcggcacggtggaagatcgatgggcgcggcaacggagtcgtcgctcgtggcggtgtgaaaaaggggtaggcagggattgcgctctctctccaggctctcaaataaggcaacctaaatccccttctataccgagtcagtcccacgtggtgcttctaaattttatcatgcccaaattttgatttctatcacctagtcgccacctagacgcactgtcccgttgtctaattgcgcccaggcaccgtcctgtccaggccgtccaggctgcctaggaccgactaggaccatctaggcggtaaatcgactaattcactg

SEQ ID NO: 76452 - DNA, 633 bp, Oryza sativa
  unsure (1)..(633): unsure at all n locations
tattcttttttttaagacaacatctgagaatttccctctagtcacaacctgaaagtactctcttgtcaaaagtaagtgatntgtttatcctttagtggtcagtcggctgaagagctggtctgtagcatttttgggtccgttgatgctaatcgaatcatacaaatagcacttactcctggtagcgaggaactcaggatgttgtagcatggcaacatactaaatctggtatgctcactgttcgatcggtttatcatgcacaatgcaatcataagttctgcaatcaggataggcaatctgagaaggtagagcaaacatgatttagataaggtttattttgttatgcggcttacaaaaacatatttaattttgaattgattcttttattggtacatgcagtgataatatgaacttattccttttgatgatagtacctgttcatctaattaattttataccacacagtatcctgagggaaggcttcatatttgctaagtgagttgcgtttttttatgtgtgctattgaattgaagtgagcaaatattgctgtcgcacatacaggtctgttgttcttccatccttcttagtgatttttacctccagatgtttatatatagatagaatagccaattctaa

SEQ ID NO: 76453 - DNA, 13852 bp, Oryza sativa
tagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagacgtcagtggtagtaaagatgccatcaatcaaatgtaataaagttgcataaccatggagacgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgatgaagtttcccatcaacgacagcagagtaggctatgttgaagaggcttgacaagatgttgatgaagatgatgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgctctgaatcaaagatgaagataatgactcctggagttgactcgttggttgatgaattgatttcttcagcttgacataaaatttgtcaaattttgagccttgtatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagcctcttgttgtagtaaaataacatggcatcgcatgccgagatgtcgaggctcacaaagacgtcgtggttggtgaagtagcaaaacttgcgaagtagcagcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaagataaaaacaccagtcgacggcggcataaccagtcggcgacggaagatgatgatgtccatcagtagtggtagcggtataaaccagacgtagaggcgagggcactagtcaacagcagacgagatgaccggcggtgaagaagataaggccaatcaacactggtagaatcatgcagccatggaagtgcagaaactagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggtggcataataggccagccgtgcaggcggaaacaccagtcggcggcggcgaaggcaagccagtcggtgaagacgtagatgcccaacaacggcggtcataataggccagccgtgcaggcgaggacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggaggaaacaccagtcggcggcggacgaggcggccggtcggtgaagacgtagacgcccaacaacggtggcataataggccagccgtacaggcggaaataccagtcggcggcggtcgaggcggccagtcggtgaagatgtagacgcccaacaatggcggcataataagtcagccgtgcaggcggaaacaccagtcggcggtggcgaaggcaagccggtcggtgaagacgtaacgcccaacaacggcggcataataggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagatgcccaacaacggcggtcataataggccagccgtgcaggcgaggacaccagtcggctgcggcgaaggcaagccggtcggtgaagacgtagacgcccaacaacggcggcataaaggccagccgtgcaggcggaaacaccagtcggcggcggacgaggcggccggtcggtgaagacgtagtcgcccaacaacggtggcataaaggccagccgtgcaggcggaaacaccagtcggcggcggcgaaggcaaaccggtcggtgaagacgtagacgcccaacaacggcggcataaaggccagccgtgcaggcggaaacaccagtcggcggcggcgaaggcaagccggtcggtgaagacgtagaggcccaacaacggcggcataaaggccagccgtgcaggcggaaacaccagtcggcggcggtcgaggcgagccggtggtgatgttctgactgatccattcctggagcgtaagagataagcttaaagccatgaatcccttttatgcatatctggatctggatcctgtagaacaaacatataggatgagtagtatctgatataaatataatactcgagaaaaaaatcaagtattttaaaatatttataaatatgtatttctcctcttgtcaattttgatttccccgagcagatgattcattacgtttaaacgctctgtccgactagtcatagcccccaagcaacgggagtcggcctaggcacttcccagacatgcatatgagtgacatgagttcgccattaatggaacaaagtttcacggattagaatttactactcaggtacttttgcaattattaagagcaaaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcacaagcaatcaagataaatattatgaaaattgtttaaaaaatacgatataacatctatagcccccgactcactattcaacggcgaaccagttgatgtagtgaggcaaaggaaaagacaaaatatcatataaagaataaaataaatgatgacttagctttgtcgtattccctcgatgacagcagaagtagccgatgtgggaataaagcagtccatcaatagtgacaaaaacaccagtcggcgccagtggaaccaagccagtggtgaagtcgtagacgcccaacagcagcagcataataggctagccgtgtaggcagaaacaccagtcggcggcggcgaaggccagccggtcggcgaagacgtgaacgcccatgaacggtgatgtgaccaaccaaccgtataggcgaggacaccagtcggcgacgacggaggcaggccggcgatgaagtcgtagacgcccaacagcggcggcataataggccagccgtgtaggcggagacaccactcggcaagagtagtgccgcagcattacatgcaaacagcagaaaataccaagagattaatctgaaatttaaagatcaatctaataaacaacaataagttgaaagggaaaaaacccggcgaagtcggagattaaattgttgaactcgccgagattgatctccttgatcggactgactccgagacggagaaaattagtcattggtgttgcactgtgttgctaggactgatcaagcgatccatagctcgtcatgtataaagttatggatgtacatattgcccgtattctcggcagcagatggctgtttaattttgatcgatgtccggcaaacaaccacgtacagctcccgaatatatgcaaaacaagcgacaaagtttatcgttagcctgttattagcaagtagagagataatgactatatatggatcaatttgccctgtacgtatccagcaatattgaatgcatgtatggctggattaattaatccatgcatggcgattgaatcgatacgtcctgtacatctccagcgatctcgtctcgtgaactttcgtgcatgtcctgccagcccacgacttggattcgctacgagtggacggcttcgccttgcgtagctgcggcttaccatgcccaattgagcacgttgcgccagcatcaagcaatagagaataaaaagaagaatagcatcaagcagtgactagaattaatccaataaataacggattgggaagaaaaagctgatgacatcgaagattaaatctatcaagttcgccgagatcaatctccctgtcaggattggatcttggagcaacagtggtgccggtgattcctgagataagttccatcgcacttcttgatagataactcggcgttcccctacctggcgcgccaactgtcgaaacatgatttcggcaataataaaaaggggtagcgcacgagacctaaaagtggatggatgcagagacaaaggatttagacaggttcaggccctctcaatgagaggtaataccctactcctgtttggggatttgaatccgccgggtgtgtattgatctgacgatcaggttgtctcatatgccccctagagggcctcctacccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctgttacatattacataaatataagttatcccctataactagtcggataaccatgccgtgtgggtatggggtacccataatctccacaggttaattttcactcatgctctctcctctgttaccttgacatacttgtttgaatggtgaaagcaaaatgccataacacttgtacgaacacttgtttttggttgcgtcagccgaagagcagcacacgccgcgccgccgagatgccgcgccctgcgcctataggtgccgctgtggtgtttttttccattttattttttttttcgtgtgtgaattgagggcaatttggtcatttttatgattataacggtgtgcaatagacggtaggttgacggcgatggtatttctgggagaaaaaggcttgtatgatggtatttcttgaaagttatctaggatcagggtgcttgtcgatggtattttatggattttctctcaaagttgtattaccatctcctatccaaggacatcactccaagcaaatacactcagattgcaggggttcccaactcctttacttcgtttttcgcactcacgcttttcaaactgctaaactgtgtgtttttttgtaaaaagttcttatacgaaagttgcttaaaaaatcttattaatctatttttgaaaaaaaaattagctcaaacttaattaatcacgcgttaagcgctatttcgttttgtgtcggaacacagcctaagatgcagatagtgggaatctaattggtgcaagtctagacaaactgggcaaactaacttttaggttctagtttatttttaactacagtttttcagattttgaaaaaaaaaactatttaagatatctttttattctataaaataggagtacgctgcagctaggccgtatacgaaattacgaacacaaacaggtagtacgaccttcaagggccaaggccacctcgccggcttcctcgccctcgcgcgcctcctccgccgcgacgccctcctgcccgacggcgacgtcgacgtcacgctcgtctgcaccccgcgcaacggcgccaccctccgcgcctccgacgacgacgacgacgacggcgcgtgctcttccgggatggccttccacgcgctatgccgttcgcgccggccgaccacggcgcggcctgccggacggctgcgagtcctccagcgacctcccgctccgggagttcatcacgctgctgttcgaggcgttcgagtcgctcgagcccgccttcgatggcttcctctccggcctggttgatcaggagggcaccaccgtctgcgtcgtcgccgacgggttcgtcgcatggacggtcggcgtggcgcggcggcgcgggtgcccgcgcacgcgttcctcgtgtcgtgcggcgcgctcggcacggccgtcctcgtcggagacaacgaccagcgaacacgacgccgtgctcagctggcttgacacgcagcggccggcgtcggtgctctacatatccttcggctcccagaactcgatacggctgcaccagacgacaaagagctcgcggcggcgctggagtccagcggccgtccgttcatctgggccatccgcccgccggtggggttcgacatgtatcaatggccagttccgcgacagtggtgcgggagggtccgagcagcgggcgcgcgccacgtcgttcacgggtgggcgccgcgggtgagcatcctcgcgcacgcatgacgcatccactggcgcgttcctgagccactgtgggtggaactcggtgctggagagcctgacatgcggcgtgctggtggtcggctggccgttgtcggtggtggaaagggtgatgggggacacggcggaggcggcggcacgggtgagggaggtcaagaaggtgatggagatggcgtgggcggagggcgagggagatggccattccccatttcatatcataagttattttaatttttttctagtcaaatttctttaaatttgatcgtgtttacaaaaattttagtaacatatatcataccaaattagtttcattaattacaatattaaatattttgatagtatgtttgttttgtgttaaaaatgttactatacttatcttgccatcttagtcgaattgtcaaatgtttttgttaggatacttgtcgttgtcgaatgttaagtgcatccgttgcttcctttcaaagtttgtatcaaacgatcttaatatatttccttggagaaaaaagtttaaaatgaaaatagaagttgatattgaaagttcctgacctcaatcgaggaatactccttcctgtcactataaatactttgttgctctgtttttctttccctccccctgttctgctctgttttccattccctctcctgactcctgttctgctctgtttttttattattgttagatcgagtcattcgcatggctgaagattctgtggtcaaaagcgtgaagttgagctcgatctgtgcaatctgtttgcacgagagcacgtcgcacgggacgatctgttgcgtctgggaatgcattcacgcaaaggagtcatgcatgcagggccaacgtgcgcatgttcttccgtttccaggaataacaggagtagaagaatgaaaattatgctagatgtatgcagcacccaaatccttgtttttttgtgtattgtttccaattctaataagtggtattagagcaaggcgatcgaccaccctaggagcaatgtctgctacggtgagtcgtcatcatgggtgttgcaacgacttcggcggccgtgaggacattgtcgagcgtgcgatcgattgagaagagcttggactcgatcgtctaccccattctcacgcgacccaactacaccaaatggtccatggtaaagcacattaacttgcctccgtaggacttttgtggcaggtgtttgaggcaaggaccgatgaattccgcaatgactacaccgcgctcgttgccatcctccacgcggtcaccggagatgttgacgtcgctctcccttaagagctccatgagagaagcctaggaggtgattcgagcagtgtgcgtcgacattgagtgtctgaagaaggcaaatgctcaaaagcttgatcaaaactttgctgcgatcacctttaatgtgggaaggagcattgaggatttctccttacactcaccggtctcaccaatgagttgtgcatgcttggatatgacatcactgagaaggaggtggtgaagaagttgcaagtggtcccccagtaccttgaacaggtggcctctccatcaaaactcctctcaatcttgatctaagcataattgagcagcggaagaagttggagtctgcttctaccaggggcaacatcagcacccttcttcttatcgaagagaactgactcacatgcatttcaaagctccccaagcaggataaccaatggatggtggtcaactttggggcgcccaaccacatgtgaggaaaccagtccgcttcctccaaccttgatggctcactcatctagattgatgtggcacattcatcttcgactacaagactgagaagattgctccttcattggtgtctactacatccctagattgatgacaaacaccatgagtgtgggctacagggctagctcgacgagatcagatttgaggccctagtttgaggcggagtcatgcgtgtccgacgcagaaaggtatctccatgccaagattccaagcaccccgaaccagctatatatgctcgacctcaccattgcgcaacaggtgagccttctggaaggatgcccagaggtggtacacacactttagtcacctcaacttcccgatgtaatagaagctagccccagaaaggctttgaccaactctgcaacaggtgcctagctgacaagtagttagaatgttctcgaaacaaacatagaatagtgcaaaatgcatcctcaagttggtttgcggggacctttgcaaccaggccatgtctgtgatgcctagtggtaagaagttgtctctattgcttgtcaatgacttcagcaggttcatgcagattgagatcctcctgtcaaaggactatgtgctggtttcgatcaaacggatttgggcggcagcacaggcccaaaatggacacaatttgagctccctcttcactgagcatgggggagtttacatcggcaaactttacagagcactacactacaaccggagtttgatactaacccaacgcaccgtattcactgccaaaacggtgtgatagagcagtagaaccaatccattgttgcgtcatttgtagtatgctcaagaccaaggggctcctaggttatttctggggcagcaagaggattggaggaagaagaggaggcaagggtaatttcgtctggaatgacattatagcatagacacattaattgaaagtggtattttatcaaatcccttttaagtggcatttgcgtgaagcccacttctgaggatggcataatctcaagattctcatattgatcagcctgttaatacatcacttccatgatttcgtggggacttttccccaattaggccttgttcgtttaatcctcaccaatctcttcctgatggggattaaacggataaggctttacatggaaaacacacatactcacacacccgtgcaaacgcccataacatcgtttaggaaacatgtttctgctggccgagagcaagatcaaatgaagtaaatgagtaaggaccaaggaaagcaaacatctcttctccagcattgggtagttctcttgtaaccggcacgacctgcaagcattgtttgtgatatacttgttagataagaatagagaagatgggaaatcctcaattgccaattgagtgtgtggtaaatcctcaacttcagaactaaatttgattctcttacaggacaaataatctgttccaaaaatcagtaaagatgatatattattggtcaaaagagtatatagtttgagctacttggttattagaagcctatgaagaaacttcaacatgaataatccagtttcgtagtggagatcttttagggcttacatgggaagagtgaaatcccagcacatccacatggattgactggaatttcaggtctgccaagcaggtcctcaaggaatacaatcgaatataagaaatgccctttactatatccagtttataatgcatgaagcagaagtttttaataactgaagtaagtaactgcccttacattagtgggtttactgaatgaattttcgtctgacagatttttggatgtgagaatagtgattgttgatttccgcatattgaccaaagcttcaagaccagttgtggatactatgaggttcacagggttggacccaatgtttacaatctgcacaagaatatctgtaaatcagtatgaggttttaaacacattcttccgacagtagaaaccatatctgcgtgagattttattgaaatatgccaatgttcaagattgtggtccatatgtaaactgggccatttcagtaattatagaatcaaactactcaggccatgaagaaattggaaactattggttttaccttcactctcaagaagctactgttactggctttccaggttattgcagaagctgctaatgaattagaatacatggagttgattgtcactggatgcagcacagcaccactcgattcgcggaaaattgtctgcatccagtaactaggacttccatactgtttccatgagttgaagacgacagcagctgggttccacctgattggattaattcagatacagttatagtggaaggttaacaacacaagaaatgtagaaatcataaggccatcgatactgacgagagatcattatcattcatgaagagcggtgcatagctggccatctgaacaacatcactgcaaagaacaagtaaatagccatctcaatagtcaacagagtgatctttgcgatagtaatataatttataggataaattccttatatgccactggcaatagagaatataaccatgtggtgaagaaatttgtgtgtgcatgtggggaatagatcgatcacctattcttctccagtccagtgaggaaagcagcctcagccagtgaggcaagaagagttcctctacctacaccattacttgaaacagcatactcactgacaaaggcctgcactcagaccatattcagaaatatatttactgtcaaagtgtcaaggcatctataatgatgtaaatgagcaagagaactattgtaaataaacctgcactgaaatcatagtactgcaaaggcatctaggttgatgtaagcaataaagataaccaatgcaggttacaagcttctcaaaacctgttttttttttacttgtaatatttttgctttttttttttttgcattctaaactgtttggatataatgacaagatttaattgaacaaaaaaacttattgctgagggagtacagactataccgtaatagcttgtacacatgaaaatagcatagtacattatggtacaaattacttaggcttctcatattcctgactttcctttgttttcagagtaatagataaagaaaaagaaaacaaaaactaactaaatcaatccatctaataaagatccataaagatatgaaaacggacgcatacctttgtcccattccgaggcgtgctgtcaaatttgttcctcatagaaaacaaagtattagaatccccgtagacctgaaaagaacatatattatcatattttcagaaaatccaagaatattaacagcaataaataagagaacagattttgaacattaacaacaggaattacaagaatgttgtggtttacatggaagtcatatatgtcagcaggatggtcaagtggtttagatgaaccatcacagtttgagatgatttgaatgtctggataagcctctcttatagcacgatggaacttgaggtaattacctgttcaagagaattgaagaatacctacagtttaagtggactttgtgcagtgccacagaattatgatgacatagagctactcaaaatcaacaaaacaaacttgtttaaattaggagaacaagggcagaatgcagataaaaatagagtaagaataaattgcattgtatttttttatgaagatccatgtgagaaaattattgaattaattctacaaaaaaaaattcttgtattgatgttttttttgcaaaatatgcccaatcataaaaataggtgtttatattttgtgtttaaaaactacaggaaaaggttgagtaacttatctgcttataccaaaattatttatgtttcctttttcttgacaaagaatgagcttaatccttgtatacataaacataatcaacttgtagtgggaaatagatttaatccataagaaactaactgatatatttaccatggtaaaatttttttgtacagtcttcgtttccaattgtaacatatttgactggaaatggttcaggatgccccattgcaactctaagagagccccatgttgagttggtacttccccttgcaaattctaggctgtccagtatatcctggagaaaagacaataacaaaagatatgagcctcagttataacttatccaagtctggggaaaatatgggcaacgtgtggtgagataattagttgttactaacttttatccataaaaatgaacaaatttagaaaaaaaattgtaagtaatccattaataattttgggaaaaaaacaatctgaacttaacccaaggtgttgtatcaatttgtgcagtacatgtaaataaaccaaagaaccatcttaataatgtcccaatattgattatgatggataaacatctaccatcatttgagcagacccatcatatatataatagctgtctcagaaaggattgagcaacaaaatttctatttctaatccttgatatatgtacaggaaaagtgagaattgctacttccaatgtatttacaaatggaattcattcactgcatcaagatatgtctatgctggtataaaaatgaattgggagctcaaaacatgcctttacaaatggagcaatagccgtggtattaatctcctcattgtggctgaaacctgacatttaagaggcaaaattatttcaataaaggcagacggtagtggtgatcaaagatgcaataaacacaaaaataattaccattgttgaacacccagattggggcagcacccagatcctcagaaagcttagatgttcaattcaaaggaaaatatgattatggaataatcaagaaaatgtagagctgaaataatgccaattggtacctgaagaaactcataatatccaaggccatcatcagtccaataaccccagacatcaccaaagtgtccaggcctctcctcccacggaccaacagactcacgccacctgaatgcatttcttaaccactggccttcaacaaagcagcctcctggaatagttcccttcaatctagttaactgtccaaaatatgtctgatcaaatatgtgcaacgatggaaagaataattcacataccaggaaacctcatgaattgtggttttaaatccaaaagcattgatacaagttctttccggaaaccatgaccctgtacatacaaagaaatggaagttaaatatggaaataacctcatggcatacgtcataagcatgactactagaaagagatcaaactcaatggattaacaaacaaataaatacagacagaaatg

SEQ ID NO: 76454 - DNA, 913 bp, Oryza sativa
cggcacttgaagatggggcctcagttccagaacttcgcatagttcatatctttggagttaacctcatacacgttacccacttcatgtcatgcgtcgagatcagctcgtcattactaggataccatgtttgtcatcataagaatatcatgcttgtcatttacttctatcttgccacaaactgcctcatattagttttcctggtctccgggtgctagctacttctgctattcgatgcgagggtcgataactttgcctttgaattatgtttctcaacagaaccaacttatcccacttgacatgctttgacgtcttcctaaatgactttactgctgaacttgttattgtctgatcgttaccccgccaattctgaagcttcgctgttacatgtgattttaatctgacctctgtaaactatcttcgaacatatcacttggttcataactgggaatagttcccacgaacaggcaactcggatttactttctttacattcagtttacttcccactatccccttcatgttgtcattatttagcattcaaagcattcctttacacattcaaccctgacatccgaaaaagacacatctgaaactcttgtccaaacaaatgtctctttggttaatcgcttgattttcttttccctcaacaggttgtttattaactcgaggttagaacatagttcctccgaaatgagaccctaggtctcctttgacagtaaacaattatacacataatcccatatcagcatcttccgaaagaatcctcatagaacttgtctgtattacacatttctcccttattacatgaatacaaggcactgccttaaacaaaaagggaaggtgcttaacatcggtacattgtatcctcaacatgaatcatccataaacatagcaaactcattgttcataatcat

SEQ ID NO: 76455 - DNA, 9094 bp, Oryza sativa
  unsure (1)..(9094): unsure at all n locations
caattcatttgctgccatacggtagggtcgcttgtacagaggagtggttcctggagcaagatctatccggaactcaatctctctcttgggcggcataccgggtagttcttccggaaacacgtctccgaactctctgacgatggggatttctgacagtcctatctgatgaagttctgaactactgacagaggttgggggtgcaaagaaaacaaccggttgttccggccctcggtacagagtgacagtgcgtcttgcacaatccactactccttggaattgagccaaccaattcatcccaaggatcacatccaagttcttggtgtctagaagaatcagattgtcacaccctaaaaattttaaatatataaattgttgtttaattggaatttttagaaattaaattaaaagcctacaagctaaaccctaattttctaggaaaattttcaacataaaagtgggctagataaaattttattaaatactatgcttgctcctctattttctagaattttctgggaattatttgagcaagggaagtatttttaataattgaaacaacatttcataaaatgttttattcaaaaaagttcaaaagttcccccttcttggtccttgggccgatttcggcccgtctctctctttcctctctctcctccgcgcgcggcccaagccggcccagccaagccggccgcgcccgcgcccctctctcccggaggctgacagatggggcccacctgtcagggccgtcttcaacctccggccgccgccgcgccgagccgccgaaccctagcgccgctttcccgctccaaatccggccgaatccgagcccgattccttcgattgagttaggggttttgttcctctcaatctcctctttcttttcccccaagaatcaaagaaatccgttgaggattcgatccgaatcgaactcattttgatttatctctaaaaaccgagttcgtgttcttcccgatccgattcctctcgtttgcggcttggtctcttcgattcgagctcatataaaccttccccgtgatctcctctttcgtttgcccttttcccgagtcctcccgtgcctcctagcgccgccgcgacgcgtcgcacgtccgccgccgccgccggccatcttcggcatcgccgccgtgccgtctccgccgtcgcctttggtcgccgccaccgccgttaggtgcgccgtgaggagaggaagctcgtccgcccctccgtttgcgccgccgatcatcggagctccctcgacgccgtcgacccgagccgccgcgccgcctcttctcgtcgccggccgccgtcgtgcatcgtttcttgtcgtggtgagtaccaatgagttcgtctcgtcgcccgctacgcgttggtgccctccaatcccgccgccgaagtccctagcgccggcgagctctccttcccgagccggccgccgtcgctgacgtcatgccgacgtcaaccctagggctgacgtcatcagggccagggctgacgtcatccttctctctttttcctttttctcgattttcaaatagattaaaactttggaaaatcataactaaataaccgtagatccgttttaggtggttcaagtttctaaatttttctaaaatcaagatctacatgataaaaatatccacatgtactgtttatgcttgtttttgtactgttttgttgattttatttatttgctttagttttcgacgttccggaggagagcgtttccgttgaggaaggttccgaagcgtttgtggaagctcaaggcaagtcacacagatcccaaataaccctttgagcatgttgatcctgtttaaagctattattttatttcaactatgcattgttttcgaatgtcatcgggtggtgaacttttcccagttaattattggccgaagttgactttattttcctatgggttataatttgattagcatgaaccttatatattggattggttcagctaaatgctatctataggtttgcttagacatgcctagaaacattagctaattaaatgggttaattataaactatgttatactattatttaatgatggttattttaatggtagctcatgatggtcaatcgtgtgatgataattaattgataattaaaacctgattaaggtgggttgtgagcatatggttttgatggttgtgctcatgacaattaaggaccggttcgcgagctactgttgtgaaacatctatcgtgccaaccacaagccagcgtgggcaacggctttatcttttgtatagcatggttcattatggtgtgccagactgagaagtggcgagaagtccatgggggtcgctggggagtccatgccttgtttataagggggtgattatgatccaggtacggtgcactgtggtgaattgtgttatgcgaggggtattgtcacgactcctttccgaggtatcgtggtggtactgaggcacatggtaacatgatgtggggttgtgtcttgtgggtacagtggtacacctctgatcagagtttaatctattcgaatagccgtacccacggttatgggtgagttgagcaatgtttttcgtgattagtctcacacttctcattaatggtaataatgtagtaattaatttatttcctggtttggaatggttaattcctggtatggagggttaatttgttcaactggggttggttgatcaaatgtggttgggcctatgcaacacgggtgtgttgtatggtgtttatttaatattgattaattattcaactgttttacttctctcttaaatatttgttaaatgctgttttctgcaaatgagctatattatgccatcctttgctatcctgtgcacttgcatatttgctgtgtggcttgttgagtatgtcatatgctcattcttgcaatattcattcatcagaggaggagtacttcagtgaaggtgatgatctggaggaataggcttgttctggttaagttgcctgtggagtggagttgccgtcgctgttccgtagtttgttttagttttgttttccgctgcgtagaatgttgtttttgtttgagaggaactatctacctctgtaataattttattttgcgaatatttaataattatttgtactctattatcaatattgtcattgtgtgcctcggttgattcctggacgagggtttaacacacatgtaagcgtttggaattttggatagaaattccgggcgtgacaagttggtatcagagccaccttgaccttaggataagccaaatggtaaaccttaagtaaccttcaaaatattttggaaaaaaaaaatagaactgctcttctcttttctcttttaaattaactaagttggcagcatatgcaaggttatgcacaaaatttattgaaattcaaattcttttcttttaaaagcaaaaagttgttcttctcgaaatatttttttttctctttaccaaattttattgattggtcggcactgtacatttattatggtatcgaattaatcatgttagcactagtactactgatctttcctatggtgacactgtaccgtgcttataatagatcataattatttcagttttattttaattatttgtcaaaaaaaaatatatttgtttctgtttaaaaagttaaattctaaaaatatattttataaaatagctttgtatgtgtcttttcttctattttcttcctttttggtcaaaaatcagttaaggttagctgcaccaactagacttagctaacttaaaatatgctttaattcttctcttctatgtctctttagatgccgccccgttcaccaagaaatttgatcgaggtgttaggactcgtcagggagctgaggttgatggcttttgaagtaggctatgaagttgctcccgagtatcgccagattccccatgaccccgacgaggagaaatgtcgtgttcgtgtgacattggctagtgatagtgaagatcttccatcttttaagtttgaagctggaggaagatcgtactgccatgcttgtcaagaagtagctttggtggccattggagagttgcgtcaacactttgaagaagaattggattcatcagctttccagtatcatcctcacaagcctcatggtcaagactatggatcttatacctgtcctgatggcgaagagagtgctactctgatgcatgtggtgcatatgcttagtgctatggatacagtaagtgtggagcgagacaaagcagctcatgacagggaaaattggaatcgaggcaagatttgcaagttgaagagcaaggtgcaccgtctacagaaggaattagctgaacttaagggagagatgccgccgccaacatccaagcttcgcctcactgcaagaaagagaacctgtccgccccctcgtctccagttagcttcgaagattcgcgtgatgggtgaagctgtgcccgatcgtgctgaacctgtcatcgacatcataagtgatgaggaagaggaggaagatcctgaagaaagagagccagctactccagaggaagaagattcatcgcttcgttccgacgcaaggtggaagtagtcgtctagttagatcgttgccttagatcgttgtgttagattgtttgcttaagtttgcttgtgagtgtgtgggttttagttgttgcttacatcatgggggggatgtaacagcatgagtctagttctttgcttgtcagagtggtgaggtagtgttaatgcaacttaaatgtaatcctacacagttaagagcaatatagaaatttaaattaattaaataactccgttctaagggtgtctctctgtctttctttccttttgtctctgcttaccgtcagatggtgaacacgcgcactggaagtggaagtggaagtggagctaataacaatgagggagaacctacgctagcccagattttggcccaacaaacacaactgatcaatctgttagtgcagcaggcacagaatcagcagggaaataatcagaaccagaatccaccccctcctccccaaaataagttggcagatttcttacgtgtcagaccccctaccttttccagcacaaccaatccagtagaagcaggagattggctgcatgcggtggagaagaagttggatttgatccagtgtactgagcaggagaaagtttcatttgcttcgcatcaattgcatggacctgctgctgaatggtgggatcattttcgccaaggcagggctggaggagaacctatcacttggcaggagttcacagctgcttttaagaagacgcatataccgtcaggtgttgtagctctaaagaagagagaatttagagcactcaatcagggatctcgttcggtcacagaatacctccatgatttcaaccgtttagcacgctatgctccagaagatgttcgcactgatgaagagcgtcaggagaagtttttggagggactgaatgatgagttgtcttatactttgatgtctacggaatttcgggatttccagcagttggtggacaaggcgattcgtcaggaagacaagtataaccggatggagcagaagaagcgcagggctgctcaatttaaggcacaacagggcagtaatcagaggccgcgactcgttactggacctcaagttccatcgtaccctcaaggaggatcttcatcagttgtccgtccccagcgccagttctacaacaacaatactggtaatcgtggcaatgacaaccgcaatgtggttgctcgtcctgcagcaacttcagttcagaaccagcccgtcaggaaggaacagggaagcaagcccgtgatatgcttcaattgtggtgatcctggacattatgctgataagtgtccgaagcctcggcgtgtgaagaacgttccagcccccgaacaactccaatgttccagcaccgaaggcgcgtgttaatcatgttgcagcagcataagctcagaatgcaccacatgttgttttgggtacgtttcctgttaactctatacccgcaactgtgctttttgattccggtgctacacattcctttttgtataaaagttttgcaagcaaacatgggatggaagttgttagtcttgggagacctttactagttaataccccaggcaaccaagtattttcgacacagtattgtccttctgttaccatagaaatagaagaagttcctttcccgtcctctcttatcttgctagaatccaaagatctagatgttatcctagggatggattggttatctcgtcacagaggagttatagattgtgccaaccgtaaggtgactgtaaccaatagcaatggggaaattgtttctttctttgcatcctctcctaaatctcatggtgtggtcttaaaccaagttactttacaagagattcctatagtgcaagactacccagatgtgtttccggaggatttgccaggtatgccacctaagagagatatagagtttcggatagacttggtacctggaactaacccaatccataagagaccgtacagaatggcagctaatgagttagctgaggtgaagaagcaggtggatgatttgcttcagaaaggatacataagacccagtacttcgccatggggagcgccagtcatctttgtggagaagaaagatcatactcagagaatgtgcgtggattatcgagcgctgaatgaggttactattaagaataagtatccgctacccagaatcgatgatctgtttgatcaattgaaaggtgctacagttttctccaagatagatctccgttctggatatcatcaacttcgaatccgtgaggaagatataccaaagactgccttcacaactcggtatggtttgttcgagtgtactgttatgtcatttggactcactaatgccccagcctttttcatgaatctaatgaataaggtgtttatggaatatctggataagtttgtcgtggtgtttattgatgacattcttatttactccaagacgaaggaagaacatgaagagcatcttcgtctagctttagagaaattacgtgagcatcacttttatgccaagttcagtaaatgtgaattttggttgtccgaagtgaagtttcttggtcatgtcatctcatctggaggagtggcagtagatccaagcaatgtggagtcagtgttaagttggaagcaacccaagacggtttcagaagttcgtagtttccttggacttgcagggtattaccgcaggtttattgagaacttttcaaagatcgccagaccaatgactcgtctgcttcagaaggaagtgaagtataagtggacagaagattgcgagcgaagtttccaagaactgaagaaaaggctagtgtctgcgcccgtattaattttgcctgattcgaggaaaggtttccaagtgtattgtgatgcatctcgactcggtttgggttgtgtgttgatgcaagaaggaaaggtggttgcttatgcatctaggcaattacgtcctcatgagaataactacccaacgcatgacctagaattggccgctgtggtgcatgcattgaagatttggcgtcattatctttatggtaaccgtacggagatatatacggatcataaaagtttgaagtacattttcactcaacctgatttgaacatgcgtcagcgaagatggttagagttgattaaggactatgatatggaaatccattatcatccggggaaagcaaatgttgtagccgatgcccttagcaggaaaagctactgtaatatgtcagaaggtagatgtttaccttgggagttatgccaagaatttgaaaagttaaacttgggaatagtcagcaaaggttttgtggccgctttggaagctaaacctactctgtttgatcaaattagagaagctcaagtgaatgatcctgatatctaggaaataaagaaaaacatgcgaagagttaaagccatcggttttgtagaagatgaacaaggtactgtgtggttaggagaacaattttgtgtcccagaaaataagnagttgaaagatactatcatgaaagaagctcatgaaactttgtattctattcaccctggaagtactaagatgtatcaagacttaaagcaacaattttggtgggctagtatgcgacgtgagatagcagagtatgtggctctatgtgatgtatgtcagcgggtcaaagcagaacatcagaagccagctggtctgttacaactgttgaagattccagagtggaagtgggaagaaatagggatggattttataaccggtttacccagaacgtcgacaggacatgattctatttgggtagtggttgataggttgacaaaagtcgctcatttcataccggtcaaaacaacctatacgggacataagcttgcagagttatatatggccagagtggtatgtttgcatggtgttcctaaaaagatagtgtcagatagaggtagccagtttacttcgaagttttggcagaaattacaatcagaattgggtacccgtttgaatttcagtactgcttatcaccctcaaacagatggtcagacggaaagagtaaaccaaattttagaagatatgttgagagcctgtgttttagatttcggtggaagttgggataagaatttgccgtatgcggaattttcctataacaatagttatcaagctagtttgcaaatgtctccgaatgaagcattatatggtcgaaagtgccgtacgccgcttctttgggatcaaaccggagagcgtcaagtttttgggacagacatattgcgagaggcggaagaaaaagtgaagattatccaagaaaggttgcgcgttgctcagtcgcgtcagaagagctatgccgacaatcgtcgcagggatttggctttcgaagaaggagattatgtgtatcttcgggttacgccgttacgaggagttcatcgtttccaaaccaaagggaaattggcaccgcgttttgtgggaccttttaagatcgtgagtcgaagaggtgaagtagcctatcagttagagttgcctccgtcaatggcgggaatacatgacgtgtttcatgtgtctcagttgaagaagtgtttacgtgtaccaacggaggaaacagatcctgatcgtatagagcttcaagaagatttaacgtatgttgagaagccagtcagaatcttggaagtaagcgagaggaaaaccagga

SEQ ID NO: 76456 - DNA, 616 bp, Oryza sativa
ggagctccggcggtcggcgggcgaagcgaatgggcggacggggtcggcgacaacgcgcttaagccgatggaggtgacgccgagtcgggaggaagcccggagcgacgttggcggcgaaccggaggtcgacggcgacggctgagagagaggtgcacggcgcgagcactaatccgactgcgaaagcgatcggcgagcggcggaaacggaagacggagctcgggggacgattatatagcgtcgggagggggagagcgcggccggagaggaaggaaaccggcgcggagatctcggccgccattgatgacgccggcgaggattgcgggcgcgatttcggacgaatccgagggagagagagaggggaaagaggggggaaagagggagggaatcacggggagtgatttccccctctttattgcgcgcggggacggcgtgatgcggcggattcggcggcggcggcggcgctagggcacgggcgcggcggcgggcgcggcgcgaggagggagatgacatgtgggtcccacccgtcagcgagagtggcgggcgggcccgcctgtcatctgcgcgcgcgcgctgtgagggcctattggccgcgggtgagatgagagagggggagggag

SEQ ID NO: 76457 - DNA, 765 bp, Oryza sativa
tatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtcttcataaaatggctttgggcaactaagtgacttttaaatgctgctttctgcaaaacttaacccctatattattatccccttgtaccctcccttgcattaattatgcatctccggtgtggctcgctgagtactgtggttgtactcattcttgctcaacctttcccctcttcagtaagagaagctgtggagaagatgtcttaggtggagtcctggcttataccccagttgagcgcctgtgaagatggagccgtaggcccgctagttcgctgctgtttatttttgattgtcaggcctgaagcgcctttgtaataatgtaaatattatcgatataataaagatgtgccttttgtatcatgtttgtttggtgtaccccggcttttcctgggacggggattaatacactagcgttcgggaaaaggcaattttcccggtcgtgacaaaccagaactcacacttgctaagtttggcatacaattgatgttcccgcaactttcccaacaccagacggagatggtgctgatggtcttcctctgattgtgagtatacc

SEQ ID NO: 76458 - DNA, 2779 bp, Oryza sativa
agaatatgcatatgagctaatggaaaatgaatccctacaaacctgtgttatctttgctcttacggaatcgtttaaccactgaatatggtaaggatgtggatgtgtatatgtggtcaagccaagcttcctgaccaaatcagaactcaccaaattgttgtagctacatccatcaatgatcatacgtgcacgacggttgttgatgacaaagaaaatctgaaacaaattatggcgttgcaacctctcaggctgctgtacctacatgctgagcacccgctgcacaatgatggtcctgtaggccgttgtgtcatcacgaccaaagacttcgccatcctcatcctcaacttcttcttcctcctcttcctcatcatcttcaacattggaggtggtgatgtagccaacttctgtagcaacatatgcccgttgactagggtaatctttctgcacatgcccaaacccctagcaacggtggcactgaatgcgtcccgtcgaggcgacagatgaggcactcttggcaggtacctgcgaagaacttttacctgactctgctggtcatgggggaggtggttttggtgctgcagaaactccagaagcagctggttgcttgcttgttggtaggggaggtgcccggaaagagacggccttgggcagtcccgcagatggcgtcgtgcgaggagtgtatgtactcgccctgttcttgccctgctactcacgcccctgcaattccttctttgcaagcatagcaaactgaaacaactagttgacagagttaaattccttataatcaactatgttttgaatttccaccctcaaaccagaataaaaacgacaaatggcatcctcgatcctctccactatgccacagcacttcaaacccttttgtagctcaccatagtaatcctgtacagacttatccccttgttctaaacgcatcagtttttttgcgtaaatctctatgataagatggaggaacaaatctattgcgcatagctaccttaagttcttcccaagtagtaggtaaaactcccccgtcagataacccatcccaccacatgatagcaaaatctttgaactcactactggcttgtcgaactctatgttgctcaggcacaaggtggacattaaacttttgttctactatcatctcccaatcaaggtatttctcagcatcataatatcccgaaaaagatggtattttaaacttaaccttagcataaggttcatcgggcacacgattattattaccttgttggtagtggtgagtgccaccgatacctgtgcggtttgtccaagatgatgttgtagtcgtgcttccttgtagcttgtgcattaacattgccactagaatcatacaccgtgtcttcaggatgaccatcatcgttgctgccgctcactttctcaacggaaggttatgtgtctccaacgcaacaacccaatcagttagcatggatatccgcttgtccagcctctccatgtggtttaggaagccaattttattgaaagcatcttggacagcctttgcaacggcctccatcatgtccttttgagcattttcttggaaagttcgtgtaacatcctgaaaattcccgacaataaaaatcacttaaattttgaactttttaaaacttttgcatcatgctggttgttatggttgatattgcttgccgaaatgtaaataatcacaaagaaagcaaatccaaacaaagggaaggttaattactaatttaatttatagatcaaatattaaatattcgaaccatgctgatagcttgatgccatgattagctaaaagaaacagtaaaatcaaatctaaatcatttgaatccaatctcacatgaaatataagaacacatgaaatgatgatcactagtataatgatcgtgtttaaaaataagtaattcaccggaatatatagattgatacttagaacatttcaccgagtccctcatgacatgaaaatcactcatataaaataatggtcatataaataaattaagcattatatataaataagaatatgtgagtgtttaattaaacaattagattaatgttgtaccgagtctcaatttatatttatagaatgactagatccacgtaaaatacattgttatacaaataggttcattcgatgtgctattgcaataataatggccacattaggatattttaattaattttagaaccctcaaagcctccaaaattatctaggttaattttataattagacctcatttaaataatgcaatagaaatatatatatataaataaaatatgggtaatattaaaaattgagtaaactttcatctaaattatcacatctattgggtaaacatcaattgtgtgaaatctagaatttatgggacaagttttaataggaaatatgccctaaaattggataaataggaaaaagtcactgttcattatggcctaggtgctcgatgtggttccatagccctgcccctccactgctgcgccgccctagccggcctcgagccccgcccgtaccggcgccgtcgctatcccgtcgcctgtcgcgtcccaaaacgactctaaaatacatcctcgaaattatgcctagaataattaaaatccgtgtgaaagcctccaacaattaaaatgtgcaaagttaaaagtcaaaaaaaggcttggaggatttttgtatatttcctaaaagcctaaaatgcataaataaattttagtggaattttcagagcacaaattataattaagaagaaataaacaaagttaaaaaggttttataaaaagaaaaaccctaaaaaaa

SEQ ID NO: 76459 - DNA, 6325 bp, Oryza sativa
taaaatttatttacacattttaggcttttaggaaatatacaaaaatcctccaagcctcatttgacttttatctttgcacattttaattgttggaggctttcacatgaattttaattattctttgcacaattttgaggatgtattttagagtcgttttgggacgcgacactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtgattcattttatttaaccaacaccaaagcggtggtactaatccaacattaccattagaactgacagtctaaacattaatatgattttccccattgtgaactagttgaactaagcatggctaagcaaccctagtcctaactctattcatgttataacccaagctaacaaaggagcgtggtatcaaaatagtatggccgtaacaataggtaaccatcccatagtaatattgcaaaacaaatgcggtatttgaaagaaaacaatagagcatttgcaatataggatcaatatgatcaagtgacaagcatgacttgccttgctctgctgctggaggaacctcggcgactatctcgaagtacaccggagcgtcggaggaaccggaatctagcgacatacaaggcaaacattgcaaacaggctataagactactgaaacagagaacaaaaccatttttaatggattctacacatttttcttgatttactgagacatgaatgggattaaacggagctcggatgaattagttatgatttttagaagattcactgtgtttattactataaaagaaaaaaccttaaatcatttattgcgcaatattaaccagggctggaggagggagacgggcccgactggtgggccccacctgtcggcgaccccgagagaggacgcagcggggcggcctggctgggcctcggcctgcggccggcccagcagggagggggagaaagaaaggagggaatgggccggcggcccattcgaaaaaaaaaggaaaaagagaggaaaaagaaaaagaaaaagaaaaaggattttccctggaattaaaaatattgcttgctcaattttaattggttaaaattatttctagagctctgaaaattccactaaaaatcctgttaatgaatttcgacatatagaactcaagaaaaattccacatgtcaaatccgattattatttgcattactttcttagggttttctcctgatttcacctgcattttcttggggtcatttataaattacaattttggcttggggggaaaacttcggggtgtgacagccacccgcgcccttaggtgcggctgacgcgtgggacccacggcgccggccggtgtgagcccgggtgcgcccggtccaccgtggaccgtggggctgccgcgtgggccccacccccgtggacccggtccgcgcgcccctcccctcggctgacgcaataaatccatttttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgctggttatatggagtttattagagtaaaagccttttcttttccgttggtcgtgttgacgctgcagcttcggatgatccgctcttcgtggaagttgaagccggcgtttgggaaagcgagcaaggcaagtcacatcatccttgaacatattgaatcccagtttataaaattatgttgctttaaattattgcattatcgctttatttaaattcccacgttatcactgttttatctagccatgcctatttacctttgttatgaccttattattattgttattgttattattaccttgttcaccctagattaaacaaaaccccaactagtggacactctactcatggtaccactagtatgattttaggtagatgcttcgctgtttaattaggtaacattaggtgattttacaactttagactttgggatattctcatcacctggacactatggaattgttggattattgtggaattggattcacacctccccctctgttcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggctataaacaaaagtacacggatggagatggacgaagtcgggggtcgatggacatctctaggacaaatgaaggctacacgagctgcggcccggtagtcgagatgtcatggcatagggccggtgtcctgctgctaggggctcagtcctgcctacctgtcccgggggtttcggccgtaggtgggattgggtcggtactcttgtctatggctagggtgggttggaaactatgtcacgtctcccgtctgtataccgtggtggtatgtggcacgtggctacacgtgaggaagatgtgtcttgtgggtaaagatgtacacctctgatcagagtttaacctattcgaatagccgcgccctcggttatgggcaagccgagcaatgtacccaagttagtgttttaattcttagaacctgcttaacaactaaaatgtggaatggttggcctgggttggcttgggacgagctgggacccagggtcaggttgccagttcggtctaaatcatcgtcggccttgggttaaggcaggttcgtgtgggttcacggccttgattaataatattgtatagctctaggaccgtatttgcaaaatagctttgagcaactaagtgtcttttaatgctgtttactgcacaccctaaccctttatattgtaactcccttgtactcccttgcattttattctgcacttgtgggtgtgtcttgttgagtacggtggttgtactcagtcttgctcaatttttcccaaacccagaagaggagcctctggaagatgaaggctttggtgtctagctcgtgcctgccgtcaagcgcctgtggtcgtcgccctagtcttccgctgtttcccgtttgtctttgtgtgtgctgggccttcgctgcccatgtaataaattaactatttacgcttccgcttgataaactctgaaatgtatcaactcttggtgtaccttgcctcctgggacaaggaataatacacgcacgtaaggaacgcccgttgggttaattccggtcgtgacaagttggtatcagagcccccttgaccctaggacgagccgtagatcccaagccttagcaatattttcaaaataaaaatcctttgttatttgtgaaaatcctctagtctctctctgtcctgctgcttcatttatcgccaaaatctgacctttaaaatgttgcatttctttttgtttttgtttgtagatggccagcagcatcaaccgtcgtggtctggacctgactggctttgttttggagctgcggggcatgtgtgttgtcctggggtatccgcatggagtggactaccagggcaagcagctcccggagcaggagggtgacgatgcagagccccacgctgcttgggaggttactgcagtgatcctcactggctcacccgagaggacttcgttggcagtcaccgcgggtggagattctttctccgccgcttgccagaacgccgctctcctcgccatcggcactcttcaccagcgctacccggacgagttgcagcactcgccctaccgctaccaccctcgccgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaggagaatctgcagctgaagaaggacctagacgcagtggaggcgcagctgctgtcacgtcctgataaattcatcccgaaattaaaaatcattctctaaaaggaataatagaattaattaaaattcgaaaagaaattggcaaacactaaaatacgtacaagaaaaattcgaatgtggcccggagaatttttgttaaattctccttggtctaaaatgagccctcaaattttacttgaattttcagagcaccggaaataattattaagcaacaaaaacaattatcaaagtttaataaaaagaaaaacctaaaaataaccctccttcctcctttgggccaattttggcccaaagtcctccctttttcccctcggcccgcggccgaagtctccctctcctccctctccttctctccctcctcctcttgggcctcctcccctcccggcccagctccctcccctcccctctctctcccgggcctcctctccctcctctcctcctgggccgcctcggcttcgcccggcccaagccgagccgcgcctcccgcccgtgccgcgcgcgtgcgcgcgctgacgccgcgcgcccgaccgcatggggcccacgcgccaggccggtcgtccccttcctcccgcccggcccccttcctctctctccctcccgtgcgaaccctagcgccattcctccctcaaatccgcgcgattcaagcatgggattcccaaattgattagggggaattaatcccctttccctcctctctctttcccccttaatttccccttgaatggtgcccccaatcgccgggaacggccgcgccattcccggccgccttccattgccgccggccggcttttccgccgccgttccccgctcctcccgtggccggctccctcccctccgctataaaatgggatcctcatcctccgttctatcgttttaaccccatcccgagactccccgtggtccctagccatctccccgccgtcctcctctctctcccgtgccgccggccgcctccagccgcctctcccacctcgccggagcgccgtccggtcgcgccgtcgcctcctccagcgtcgccgccacctactcttcgccggcctgccctccattttccgcggagacccccggagctgcgttcccgccgtcgcccttccctttcctccgcgtcggccgcctccagccgcctctgtctccctgcctgagcgccggttgacgtcgccaccacctccctcggctccgcgacgccgccctcatccccggcatcacctcctcctcgcccgaatttcgccggaacaccgtcgcccgcgccggcctctccttcctcctcgtcgacgtctcctccggcagccccttccgccgcgcccgtgcatcagccggcgctgccgtcccctccctcggcgtcgccgcatcgccctccaccccggctgctcctcggtttcgccggaacgccgtcgccgcgccggcctctccatcctcttcgtcgcctgcgtcctttcggccgcctcttcctcctccccggctcgtcggcttgccgcaccactaccatcttcggcatcgcagccgcgacgtcgtcctcggcctcgcctcccctccgaccgaacaccgccggtgtccgtcgtcgtcttcaccgttcatcctcgccggctcgccgcctcgcggcgccgccttcgtcgtcggcatcgcagcagtgtgttccacgccatcctcgcctccgtgcagccgctgtcggctgccctcgtcgcctcctcgccggccccggtcgtcgtcgtcgtcgtcctctcgtcgttcccggtcgtcgtggcgttcgtccctccgtcgagccgttctcatccgtcgtccgcatcagtcaagcaagccgctgcagccccgtcctcgtcttcatcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccctctccctcgctgccccgtcctcgtcctttcggtgtcgcccgtgctcgttgtgcggttgtcggccctggtacccatgtaccggtgtcggtagtcgttcacgcgtgcgggtggtgaccgtgtagtgtccgtgttagtgtgcccgctcggtagccgcgtggtttccacgtgtgcaggccgtgtggtgtctagtggagtccgtttgtcgg

SEQ ID NO: 76460 - DNA, 4956 bp, Oryza sativa
tgcaaagttttattataataatccgcaaatcgccatataccagcattaaacttcggatgatcatatcttggtcatacgaactccgaatcgacccgttcaagtctcttaatgtttgttataacctaaagaaccctgtgctttgtttttatgtattgttattgcttctttataggcttgtagctttgcttgtgtgcttcgcgtagcttctgtcgttccggaggttcccgaagcgtggttcgcggtcgtcgccgaaggttcggaaggccgttctctctgagcaaggcaagtcacatcatccttgagcatattgaatcccagtttataaaattattttaatttaaattaatgcattatcgctttatttaaattcccgcgttatcactgttttatttagccatgcctatttacctttcttatgaccttattattattgctattgttattattaccttgttcaccctaggataaataaaaccccaactagtgggcactctatttatggttccactagtatgaacttaggtagatgcttcgctaattaattaggcaacattaggtggttttataactttagactttgggaaatctcatatcatttggaccctatggaattgttggcttatggtggaattggacatacatctctcttcctctttcaaaacccttaaaacctattttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctccagggcaaatgaaggctacacgagctgcggcccggtagtcgagatgtcatggcacagggttggtgccctgctgctaggggctcagtcctgcctgcctgtcccgggggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataattttgtgtagctctaggatcgtctttataaaatggctttgggcaactaagtgacttttaaatgctgtttactgcaaaacttaacccctatattattatccccttgtacccccccttgcattaattatgcatctccggtgtggtttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgccaggcctgaagcgcctttgtaataatgtaaatattatcgatataataaagatgtgccttttgtatcatgtttgtttggtgtaccccggcttttcctgggacggggattaatacactagcgttcgggaaaaggcaattttcccggtcgcgacagaggacgtccaccttcccgcctctcaggaagtggctccaacagcataaaatcatcatgcaataacccatcccacacaagttaagaatttagagtctagccaagtgtaatacacgtcccggtgctcaataaccgcgagcacggctattcgaatagatttggtttactcacactgcagtggatgtacactttacccgcactccgcgactgcccaacacatgagccacgtcccaacacatgagacgcgtcacggcaaagcttttcgataacctcgcattggcagtacccactccatgaacttgaaatcctcatgcactctaggcgtacacggtttctagcagtgagaggagttctggcgctcccgggaagggaaaaacacacacattcctacgttgcttcttgtcgttgaacccagtccctcatgattgttctcttatgggtatcctcatgcagtattgctaagccagcctctgaccatccggaacgggcatccgccattcacctggccatccgaaccgggcatccgccagcagactgcttgccgcatcacacacctagaagaagaccactacgcagggatactgcctccgctcggctatctaatccgctaggtctatacccattcgagaagtacggttgtacggggggcgtttcatgcttaacttcatggctcggtccttaattgaccggggacggtactagccttttccagataccacccaaatcctccgtccgccccagtcgaaaacagttgtttagttttatttctcctttcacaaatcatgtcatcaatatcagggcaatgtggtgctcatgtctccacatgccgcatctcaattaccttcccaaaggtaattgctcaagcatatagcatttgataaatatgagtatgcatgattctagaatagcatttctatgcattcgtcatagttgactagggactcatacgtaaacatggttacgaaggaataaggggtaaacaataatcaaggcatggcataatcgcaagtaggatgttcatcattgcatgcaattttatttgtaaacaaaacaatttcgcaattgggatcaacatgttcaaggaatagtgatgacttgcctgctcaggatagtccttattcttgatacaatcgtgatcaaccttcacctcctggaagctacatacgttgcctcacgactaaccgatatacaaattctataatacgcgagaaaaaccgatattcaaacaacaatcgaatatgtacaaacaaaatatagttgttggggtcgaacctagggttgctcatactactcgtgtttgctaatggattctaatcaagctaagaaataaggtttcttaatctttatgttgtcatcatggtcttttcaggagttaaccaacatagcatttatgggatacatatttggctaatatgtggtttagtctagcaaatggctatatatgcatctatctaaatagaacggttatacactagaggttctgttgccggatggattttggatcggtcaaataattactgtgaatcatttctattattatgaacatattttatttgtcacaataaattatgaaaggttaataattatccatgctctatatgttacacttgtgaggctaataatattatagttacagattatcccatcacataattttacaatgaataatcttaatttacaattgaacttaggttatattaggtcaaggtctataattaggatttatccaccatacatgttcatcatatattctctttaattttaatacgtacaatcaagcaatttaatactacaccgtatagctataatgggttgtgcagtatatatgtgtgcacaatatcttaatattgaatcatttactgaatagttgctatttactataggctatatagtacatgtgattttaagtggatttatgagtgagttaccgtctatcaacttaagggttgatttccaatctaaacatatactattgtataggaaatgccgttaactaacttcatgcgggtgattttagtcacactagctctgttattatctctcataaacatgttattatccctcataaacaagttgaagactcatctacgtgtgttcaaatttagtcacaaagtatgaggctaaacattatttatacaatttggacgtcatgagtataattatattcacatatattaataaatggcactagtatttcctatgctttaattaatttgaaacaatgctcctaattagtttacataggttttatagcgagaaagcatgttaaagacaattatttgacatctactctactgtacaatatcaatcctatttatgagcacatttttaagttaactattatacatcatcttggtattaactatttcctaatttaaatatattttcgtaaatagtgaattatataccattggaaatcttatgaatttagatgaatttaggttcaagtttcactcgaatcggagctaaaacgaataagttacgctagtttaaagattcaaatttgaattaattctaataattgtgaaatggtactgttcctaattcatttatttttaatacaaccttatccacaagctatagtgactgacaggtggggtcttcctagtttcttttcttttattttatttttctttctaaaggaatccatatgggcaaatgacaggtgggcccgactcctttgactagggtcaaaccggccattaaacccggtagggcccgcatgtcatagactcgagaccataaaacttctataattagatttttaaccacccggacccacatgtaatagacacaactaataaagattaagaaggggattactattcaccaattacgtggggcccactctaatctctcttctctattcttctttctctctctctcctctgtttcctctcttctctccctctctcacggccgagcggcacggtgtggctaccagcgacgaagggaggagggagggcttaccggaccggtggcaacggcggcggagacacagcggcgaggtgcggcgcggcggcgacgaggcgccggggcacagcagcggcagcgcggcggcggaatgcggcgtcggtggaggggaagaaaaggggaaaaaggggaggagaggggaaatggcgtgggta

SEQ ID NO: 76461 - DNA, 7618 bp, Oryza sativa
cacgggcttgtcacagcctgattttcgtttaggatttataaattatctaataaattattaatagaatttatattaaatgttctttaatttacaagtgaagttaaatgtgggaaataaaacttcctaaatataaagcatggttggatttaatttttattaaattctccatgattaattatactctctgaaattttctcggattttttcagagctcaattcctaaatgatacaaagaacagtacattaattatttaatcattaatgatctaattataatttttaagagcttttcttgtttaaaaatccttaaattataaattgttgttcaaaaggaattattagaaatgatcttaaaagcctaaaagagaagatctaattttaatttgttaaatctcaatataaaattgggctagataaaattttgttaaatacttctcctgattctttagttcctagatttttctgggatttatttaagccaatcaagtatttttaataaatggaattccatttcatgaataatttaaatagaaaaatgtttttaaatccttcttttggctttgggccgaaaggggcccaaaaccttcctctctctctccccggcccagtcggcccaatcagccagcagccgtccgcacgtgcgctccctttcgctgacaggtggggcccacctgtcggacccgtcgtcaacctcgcgccgtcgcccggccgaaccctagccgagccgcgccaccgtctccttccaaatctgtcacgcccggaaattcactagtaatttccgaacttatttgtgcataaaatcctcgtccaggaatcagccgaggtacacaaactgacaatttaatatacagattcatcaaattaactaatacgataaatacttacttaagaggcacttagtcctcaccatgaagaaaactgcagcggaaaataaaatctagcgaagctccggctccactcccacaggcagctcaactggggtataagccaaacgtctactccttctggatcctttttcttcaactgaggttgattgattattgcaagaatgagcatatgacatactcaacaagccacacagcaaatatgcaagtgcacaaggataccaaatgatggcataatataggctcatttgcaaaagcagcatttagcaaagagttaagagtagtaaaacagtagagtaattaatcagaaattttaatcaacactgaacagcacacccatgctgcacaggcccaaccatcctgaacaaccatacccggctgtacagatctaactacaaaccaggagctaaacaaattattaccagttatagcatcaataattattgtgagaggtgtgagactaatcacgaaaaacattgctcaacccacccataaccgcgggcacggctattcgaatagttttactctggccagaggtgtaccactgtacccacaagacacagcctcaacatcatgtctaccatgcgtcgcgatactggaaagtacccgaatagaggctgtgacaataccctccgcacaacacaactcaccacagtgcaccattcctagatcataatcacccccttataaaacaaggcatggactccccagcgacccccgtgggcttatctccgccacttctcagtctggtgctctgcaatgaaccatgctatacaaaaggtaaagccgttgcccacgctggcttgtggttggcacggttaatgtttcacaacagtagctcgcgaaccggtccttaattgccatgagcacgactctcaaaaccatgtgctcacaacccaccattaatcatattttaattaccaattaattatcataacacgattaaccatcgtgagctaccattaaatataaccataaataataatgtagtacatatgattcatcccattagtgagctaatgtttctaagcatggctaagcaattatatctaacatctagttgaaccaatatatataaagctcaactagtcaaattataatatcccaaggtatcaaggaatagagtaatcaatgcaaacaggccataacaaaggaataggttcacaccacccggtgacattcgaaaataaatgcacagttgaaataaatagagaatttaaatataggatcaacatgctcaaaggattgtgtttaagatctgtgtgacttgccttgcaataatcggtcttcaattaatcttcttgattacttccgacgcactcacgaaccttcacaacgacggaaacgacaagctaacacgccaaaacaaggaaaaagactaataaaaaccaaataaacagtacatataaagtaaacaaacatgtagatcatgattttagatgaatttagagacttgaacggcctcattccgatttcatatgaatttattatgaattttacaagattaaatctaattaaagcccatttaaaaagaattaaataaatttaattcaatttatggataattttaatatgtagatatttattttatataatttttgcaacttgaaccacattaaactaagttacaatgaattagttatgaatttttaaagattaaatcggattaaaacacttatatggattttaattgaattatgacgcaataatgaattattttttaaaaggaaaagaggtttattgcgtcagcggctagggtttgcggtgaaccgggtgcacggcgacggctcacggaaacgaacggccgagatcgatccatccaaaacggacggccgagatcgatcggttcacgacgggtctacgggacagcgacgatgacgtcagcaacgacgtcagcaccggcggcggctcggcaacgcatgctcgccggcgaacggcggctcgacgacgcgaacggagggcaccaacgggtagagggcgacgcggcgaactcaccggtgaccaaaacaacggcggaaaagcaacggacggcgccggcgacgaggaagaaacggcgacggtcttcgggtcgacgacgacggcggtgctccggcggtcttcggcggcggcgaagcggtggacggggacggcgacgacctcgcgaacccgatggtggcgacggcgaccgacgacggctgctgcaacggcagcgcggcgcggctgaaccgatggcaacaacggcgacggctagggctacgcggaggcggcgctagacgcgacggcgggctaaggcaaaggtggcagcagatagaggagagctcgggggtccttttaaaggggcaaggaggcggcggcgaaggcccacggcgaccggcgacgcgaaggaaaggttagggttagaggagagagatgaatccgaatccaactcaaatccaccggtttccaaagaaaattagccgatgtttccaaaagagaaaaagaagaggagatctcaaggatcatttgccctcaatcaatttgaccggaaatagagaggggcgacggaatttggaagggcagcggcggcggctcgggcgcggctcggctagggttcggccgggcgacggcgcgaggttgacgacgggtccgacaggtgggccccacctgtcagcggcaccgagagagagaaggaagcgacggcgggtcgggccgactgggccggggagggagagagaaagagagaggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttagcaaattaaaattagatcttctcttttaagcttttaagatcatttctaattattccttttaaacaacaatttataatttaaggattttttaaacaaggaaaagctcttaacaattataattagatcattattgatcaaataattactgaactgttctttgtatcatttaggaattgagctctgaaaaatccgagaaaatttcagagagttgacttaatcatggagaatttaataaaaattaaatccatccatgctttatatttaggaaattttatttcccacatttaacttcacttgtaaattaaagatcatttaatataaattctattattaatttattaaataggttataaatcctgaaacaaaaatcaggatgtgacaaaatccggctgccccattccttctccggccaaatcatttgatgggaaataatctcctcgatctcctcttccttttctattttaaaaacttcggctaatttcgtttggaaaccgacggatttgagctcgattcggatcgacttttctccctccaaccctagctttccatctcgccgccgatcgccgtgggcctccatcgccgctcgctagcccctttataagcatccccgggacctcctcttttcgccgccaccttcgccctagcttgccgccttctctagcgccgcctctgcgttgctctctgcgtcgccgccgccggcgggtgtctagtcggtcgccgtcgtcgcttcggtcatcgccgtctatcgccgtctccttcatcagcatcatgaggtcgtcgccgtttccgtccaccgcttcgccgccgccgaagaccgtcggagcgccgccgactccgtcgccccgaagctctccaccgtcgccgtcggtccagccgcgccgtgccgctgttgcagccgtcgtcttcggtcaccgtcgccaccatcaggatcgcgaggaggagcagcatctcgtccacctctccgttgccgacgtttctcaccgaagcaccgccgtcaccgccgacccgaaggccgccgccgctcagcctcgccgccgtcgtcatccgtcatcgtccgccgccatccaagccactggtgagttcgccgagtcgagctctacccgctggtaccctccgtttgcgccgtctcgccgccgttcgccgtcgagcacgtgctcccgagtcgccgccggtgatgacgtcaccgctgacgtcatcgtcgccatgtcccgtgaaccgcggtagatcaagttgatctcggccgtttgttttggatagggtagatctcggctgtccgttccgtagaccgccgctgtgcacccggtccaccgtgagccaagcccgctgacgcaataatcctcttttccttttcaaaaataattctttattgcgtcataattcaattaaaatccatataaatgttttaatccggtttaatctttaaaaattcataactaattcatcttagctcgggtttagttggttcaagtctctaaagttgtataaaatgatctacatattaaaattatccataaatagaattaaatttattcaattctttttaaatgggctttaattagattaaatcttgtaaaattcatatttaattcatatgaagtcagaatgaggccgttcaagtctcataatacatctaaaattatgatctacatgtttgtttactttatatttattgtttatttggagtttcttagtgttttccttgttttgcatgttagcttgtcgtttccgtcgtttcgaaggtttgtgagagcgccggtagtgttcaagaagattaattgaagaccgattattgcaaggcaagtcacacagatcccaaacacaattcctttgagcatgttgatcctatatttaaattctctatttatttcaactgtgcatttattttcgaatatcaccgggtggtgtgaacttattccgttgttaaggccagtttgcattgattactttattccttgataccttgggtttttataatttgactagttgagctttatatattggttcagctagatgttagacataattgcttagccatgcttagaaacattagcacacaattgggataactaatgcttcactattatttaattatggcttaatgatagcacacgatggtcaatcgtgattggttgattaattaatgtgtcaactaaaacttgataatggtgggttatgagcacatggttttgatggtagtgctcatgacaattaaggaccggttcacgagtttcggttgtgaaacattaaccgtgcccaccacaagctagaatgggcaacggctggacactttgtataacaaggctcactgcggagcaccagactgagaagtggcggagataagcccacgggggtcactggggagtccattcctctggtttttgagggggtgactacgatccaggaacggtgcactgctttgggttgagttatgcgaggggtcttgtcacaatcactcaacatggtgacatgtctggcctggcacggtaacatgctggtgggttgtgtcttgtgggtatagtggtacacctctggccagagtaaaactattcgaatagccgtgcccgcggttatgggcgggtcgaacaatgtctttcgtgattagtcccacactattcattaataataatgtggtaattgatgctaattaatttagctcctggtttggaatggtatattcctggtttggagatagatctgtgcagccgggtatggttgttcaggatggttgggcctgtgcagcatgggtgtgctgttcagtgttgattaatattgatgattaattactctattgttttacaattcttactgtttgctaaatgcttcttttgcaaatgagccctatattatgccattctttggtatccttgtgcacttgcatatttgttgtgtggcttgctaagtatgtcatatgctcaccttgcaataatcaatcaaacctcagttgaagacaagttgcgaaggagaagacgtttggcttataccccagttgagctgtctgtgggagtggagccggagcttcgctagaccgtaattccgctacagttttcttttcttttgtaagtatgtaacgttattatattgatgaatatgtatattaaattgtcagtttgtgtacctcggctgattcctggacgaggatttaatgcacaaattagttcggaaattactagtgaatttccgggcgtgacagggctcaagggcgacggcgacgcgatggagtgcggcgcggcgataggacggcgcgcggcgcggctgtggagtcgacgggacggcgatggcgacggcacgcggcgcgctgatgatgacgacgtgacgcgcggaggggtggggctcgaggcggcggcggcacgcgcggcgcggcagcgggatggcgacggcgacggcgcggcagcggcggtgcgcggctcggagcgacgatgggacgcgtcggtgacggtgcgtggcggcacgggacatgagacgggacgcgtcggcgacggcgcgtggcgacgcgcgataggcggcagcggcgacgcaacggaatgcggcgcggcgcggggcgtgaggcgatgggacggcggcgcggcgacgcgacggcgacagtggcgcggcagcggcgatgtcacgaccggaattaacccaacgggcgttccttacgtgcgtgtattattccttgtcccaggaggcaaggtacaccaagagttgatacatttcagagtttatcaagcggaagcgtaaatagttaatttattacatgggcagcgaaggcccagcacacacaaagacaaacgggaaacaggggaagactagggcgacgaccacaggcgcttgacgggaggcacgagctagacaccaa

SEQ ID NO: 76462 - DNA, 6148 bp, Oryza sativa
tgtgtcttgttgagtacggtggttgaatcagtcctgcttattttcccaagcccagatggaagttccttaaagatgaaggctttgtgtctagctcgtgccagccgtcaagcgcctgtggtcgtcgccctagtcttccactgtttttcgaagtctctgagtgtgctgggccttcgtcgcccatgtaataattttatttacgcttccgcttgttaaactctgaattgtatcaacttttggtgtaccttgcctcctgggacaaggaataatacacgcacgtcaggaacgcctgttgggtgatttccggtcgtgacactcatgaaggcaactaccctacccatgatttggagttagtcgcggtggttcatgctctaaaaatctggcggcactatctcattgggaatcgctgtgaaaaatatactgatcataagagtttgaaatacatcttcatccagtcggatctgaatcttcggcagagaagatggttagagctcatcaaggattatgatgtgggaatccactatcatcccggtaaggccaacgtggtcgccgacgctctaagtcgaaaaagccattgcaacactcttaacgtccgtggcattccatccgaacttaatcaacagatggaagccctgaacctaagcatagttggtcgcggattcttggctgcgttggaagccaagcctaccttgctcgatcaaatccgcgaggctcagaagaatgatccggacatgcgtggactcctcaagaatatgaaacagggtaaagccgctggtttcacagaggatgaacacggcaccctatggaacggaaatcgggtatgcgttccagataacagagaacttaaacagctgatacttcaggaagctcacgaaagtccttattccatccaccctggcagtacgaagatgtacttagacttgaaggagaaatactggtgggttagtatgaagcgggaaattgcagagttcgtggccctttgtgatgtgtgccagcgtgtcaaggcaaagcaccaacgaccagccggacttctccaacctcttcaagtaccagaatggaaatgggatgaaattgggatggatttcatcaccggacttccaaaaacccaaggtggatatgattctatatgggtagttgtggaccgattaaccaaggtagctcggtttattcctgtgaagaccacctatggagggaacaaactagccgagctctagttcgctaggatcgtgagtctccatggcgttcctaagaaaattgtatccgataggggaagccaattcacctctcacttttggaagaagctccaagaagagctgggtacccgattaaatttcagcaccgcgtatcacccgcagacagatggacagatgtcacatcctgattttcgtttcaggatttataagttatttaataaattattattagaatttatattaaatgttcattaatttacaagtgaagttaaatgtgggaaataaaattttctaaatataaagcatggatggatttaatttgtattaaattctccatagttaattatactctctggaattttctcggatttttcggagctcaattgttaattttaaatcatacaaagaaaagttcagcaattatttaaatattaaattaatcattaaatgacctaattataattgttaagagtttttcttgtttaaaatccttaaattataaattgttgtttaaaaggaattattagaaatgattttaaaagtttaaaagagaagatcttttcttttaatttgctaaatctcaatataaaattgggttagataaaattttattaaatactttacttgttcctctattttctagaatttgctgggaattatttgagcaagggaagtatttttaataaatgaaacatcatttcacgaattattttaattgaaaaagttttaaaaaccttcctttaagtcgttgggccgaattcggcccaactcttcttttcctcgcgcggacgaaccggcccaagccggcccagccgacgccgccctcccctcctcctcgggtcaccgacatgtgggacccacatgtcgggcctttcttcctcctccagccgccggccaggccgagcccgagtcagccgaccgagcccttttccgcctccgattccgccccgatccctcatctccgagtccgattgttatgggggttttgatcctctcgttctcctctatctttcccttcaagaatcgaagcaaatggttgagtatcttgcccgaatcaaactcgttttcgagtttatctccaaaaccgagttttgattttcttggatcgattcctctcgtttggagctcaaactcttcaatccaatgctataaatagcttcacctcgtcgctctctttcgtttgccctctctctcgtggtctcccgtgcctcttagctgccgcgccgcgtcgccctagccgccgccgtcgccggtcgtcgtccagccgctccgcgccgccgtttgcgccgtcgccgccgcttgccgccgtcgcctttaggtgcgctagggtgaagggaaccttggccgcccgtcccccttcgccgccgaccaccggagctcgccgccgacgtccaacccgagctgccgccatcgtccttctcgtcgccggccgtcatccgtcgtcgttcgtcgcgttggagagtaccgttgggttcgcctcgtcatcctctacgcgtaggtgccctccttttccccggccaaggcccctagctccggcgaggtggtcgccttagccggccggccatggatgacgtcatgctgacgtcatcatcctcttttcctttctttttcccttcttcttttaatagtttaaatctttggaaaatcatatctaaataaccgtagatccgttttaggtggttcaagttgctaaatttttctaaaataaagatctacatattaaaattgtccataaattgaattaaatttatttaattctttttaaatgggctttaattagatttaattttgtaaaattcataataaattcgtttgaagtcagattgaggccgttcaagtctcataattcatctaaaattatgatctacatgtttgtttactttttatgtactgttcatttggtttttattagtctttttcttccttttgcgtgttagcttgtcgtttccgtcgttgcaaaggttcgtgagtgcgtcggaagtgatcaagaagattaattgaagaccgattattgcaaggcaagtcacacagatcctaaacacaatcctttgagcatgttgatcctatatttaaattctctatttatttcaactgtgcatttattttcaaatgtcactgggtggtgtgaacctattcctttgttatggccaatttgcattgaatgccttattccttgatgccttgggtaataaattgattagcttgaaccttatgtattggtttggttcagctaaatgtcatatatatatatataattgcttagcaatgcttagaaacattagctcattaatgggatgaattatatacactacattattattatggttatatttaatggtagttcacgatggttaatcgtgtgatgttaatgaattgataattaaaacctggttaaggtgggttgtgagcatatggttttgatggttgtgctcatgacaattaaggaccggttcgcgagctactgttgtgaaacattaaccgtgccaaccacaagccagcgtgggcaacggctttatctcttgtatagcatgattcattatagtgtgccagactgtgaagtggcgagaagtccatgggggtcgctggggagtccatgcctctggttgtagagggggtgattatgatccaggaatggtgcattgtggtgagttgtgttatgcaggggataatgtcacagcctctattcgggtactttccagtatcgcgacgcatggttgacatgatgttgaggttgtgtcttgtgggtatagtggtacacctctggccagagtaaaactattcgaatagccgtgcccgcggttatgggcgagttgagcaatgtttttcgtgattagtctcacacctctcacaataatcattgatgattaactggtaataatttgcttagctcctggtttggagttagatatgttcagccgggtatggttgttcaggaaggttgggcctgtgcagcatgggtgtgctgttcagtgttgattaaaatttctgattatttactctgctgttttactcctcttaaatgttttgctaaatgctgctttttgcaaatgagcctatattataccatcttttggaatctttgtgcacttgcatatttgctgtgtggcttgttgagtatgtcatatgctcattcttgcaataatcaatcaacttcagttgaagaaaaagaatccaggaggagaagacgtttggcttacaccccagttgagctgcctgtgggagtggagccggagcttcgctagattttattttccgctgcagttttcttcttggtgaggactaagtgcctcttaagtaagtatttatcgttttagttaatttgatgaatctgtatattaaattgtcagtttgtgtacctcggctgattcctggacgaggattttatgcacaaataagttcggaaattaatagtgaatttccgggcgtgacaacagaccgagcgtctaaatcagatcctagaagatatgcttcgcgcatgtgtcctagatttcgggaagacctgggataagagtctcccctatgccgagttctcctacaataacaactaccaagccagcatacaaatggcaccttatgaagcgttgtatgggcgcaaatgccggacaccgctattgtgggatcaagttggggaaagccaagtgttcgggactgatatactgagagaagctgaagcgaaggtcagaaccatttgggataatctaaaggtggcacagtcccggcagaaaagttatgcagataaccgtcgccgtaacctggaattcgcagtggacgattttgtgtaccttcgggtcacgccattgcgaggtgtacacaggtttcagacgaaaggaaagctcgcacctcggttcgtcggtcctttccgtatcattgctcggcgcggagaagtcgcttaccagttggagctgcccgcctccttgggcaacgtgcatgatgtgttccatgtgtcgcaactcaagaaatgtcttcgagtgctatccgagcaggccgactcagagcaaattgaagttcgcgaagacttgacctacgtggagaggccagtgaaaatcctggacaccatggagcgcaagactaggaaccgggtaatccgtttttgcaaggtccaatggagcaaccacgccgaggaagaagctacctgggagcgtgaagacgagctgaaggcagcccatcccgatcacttcgccagttcttccgaatctcggggtcgagattccgtttaaggggggtaggtttgtcgcgtcccaaaacgactctaaaatacatcctcgaaattatgcctagaataattaaaatccgtgtgaaagcctccaacaattaaaatgtgcaaagttaaaagtcaaaaaaaggcttggaggatttttgtatatttcctaaaagcctaaaatgcataaataaattttagtggaattttcagagcacaaataataattaagaagaaataaacaaagttaaaaaggttttataaaaagaaaaaccctaaaaaaagttccctttccctccccctctccctcttgggccggtccggcccagctccctccccctccctctcctctccccgcggcccatccggcctctccccgcgcgcgcgccgctgacgggcgggcccgcccgccaccctcgctgacgggtggggcccacccgtcatccccttcctcccgccgctcccgccgcctcgcccgtgccctagcgccgccgccgccgcgaatcccgccgcctcccgccgtccacgcgcgcaataaagtggggggaaatattccccgtgattccctccctctttccccccatttttctctccctctctccctcggattcgtttggaaacctctcccctaacctcgccggcgccatcaatggcggccggatcttccgcgcccgttttgtcgcgaccgggaaaattgccttttcccgaacgctagtgtattaatccccgtcccaggaaaagccggggtacaccacacaaa

SEQ ID NO: 76463 - DNA, 8403 bp, Oryza sativa
cttgaggcatcaatgtcctgacttatgaccttattgcctttcttattgtcagccatctgttgcaaagatttggagagggagagagggaaaacaaaggggagagacagattagaaactaaggataggaccttaacagatctaagtcttttgctgttatgatgtatgttaggcttattctgcaagttgattaagcaaacaacctagcatggttacatcaccacccaccgatgcaaaccacgcgctacacacacaagcaaggaaacacacgactaacaacactaccctatagggcggcttaggttctgcgacgggttttccaagatcttcactcctgcttcacagctggcttcactacttcctgcacttcgctagcggatcctgcagtcttccggagcttcgggaaacaactgacgacatcttcttcttcgcaaagctgaccatctagtacttagttgaaatccgaagaaagaaaagagtaagccttttgcaaatagcattaggggaaggagaaaaagaggaactttcgcaaataattttacttataaaatatgtccttaggttttatccatttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctatggctccatcttcacaggcgctcaactggggtataagccaggactccacctaagacttcttctccaaagcttctcttactgaagaggggaaagattgagcaagaatgagtacaaccacagtactcagcaagccacaccggcggatgcatgattaatgcaaggggtgtgcaaggggtaataacatagaggttaagctttgcagtaaacagcatttaaagacatttagttgctcaaagccactttgtaaacgcgatcctagaacgctacaaggttattaatcaaggccgtgaacccacacgaacctgccttaacccaaggcctatgatgattcagaccgaactggcaacccgaccctgggtcccagctcgtcctaagccaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccgcctacggccggaacaccgggacaggcaggcagaactgagcccctagcagcagggcaccaaccctctgccgtatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatacggccgaggtgctaccatcaaaaccatgcaccccgtgcccagcctaaaaccattttaggggattttgaatagagggggcggtgtgaagccaattccacaataatccaacaattccaaagtgtccaagtgatatgaatatctcccaaagtctatagttgtaaaaccacctaatgttacctaattaaaagcgaagcatctacctaaaatcatactagtgataccacgagtagagtgtccactagttggggttttgtttattctagggtgaacaaggtaataataacaataacaacaatgataaggtcataacaaaggtaaataggcaaggctaaataaaacagtgataacgcgggaatttaaataaagcgataatgcaataatttaaatcaacataattttataaactgggattcaatatgatcaagatgatgtgtcttgccttgctcgctttcccaaacgccggcttcaacttccacgaagagcggatcttccgaagctgcagcgtctacacgaccaacggaaaagaaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgttctttaaatggatatttgcgaatttcttcatttaaattttaattaaaaatctcatttattgcgtcagccgagggagcggggcgcgcggaccgggtccacgggaagtggggcccacgcgtcagccgctcggtccacggtggaccgggcgcacgcggctggcggcggtcggcgccgtgggtcccgcgcgttagccgcacccgcgggcgcgggcggctgacggccgggcccacttggcagccgcgagggcacgcccgagggcggcctcgccggcgcggccgacgggagcggcgcgcccgcgccccgatggtcaccgccggcgaccaccggcgcggcggagcggcgcccgagagagaggagggaagggggaaggcgaacggcggtcctcggctcaccccgggacaacgacgacgacgagaacggcggtcggagcggaggaagacggcggcgcggctcgggatgacgatggcgacggcgctccgacggtcggcgggcgaagcggagcggcggacggggtcggcaaccactcggcgaagccgatggaggtggcgccgagtcgggaggaggtccggagcggtgcgcccggcggaacggagttcggcggcacggcggagagagaggagcacggcgcgagcacgaatccgacggcgagagcaagcggcgaacggcggaaatggaggagggaggcacggggagcaaatatatagcgccgagagggggagagcgcggccggggagagaggaaaccgcgcgcggagatctcgggcgccattgaagacgccggcgaacttcgcgggatgaatccggacgaatccgagggagagagagagggaaaagagggggaatcgggagagggaaacgtggggagtaattcccccctcattaaggcgcgcggggaaggcgggatgcggcggaatccgcggcggcggcggcgctagggcacgggcgggcggcgggcgcggcgcgaggagggagatgacaggtgggccccacccgtcagcgagagtggcgggcgggcccgcctgtcagcggcgcgcgcgcgcggggggagccgatgggccgcgggagaggagagagagagggagagggagaagtgggccgagccggcccaagaaggaaggggggaaaagaggacttcttttagggtttttctttttataaacctttttaactttgtttatttcttttcaattattatttgtgctctgaaaattccactaaaatttgagggctccttttagaccaaggagaatttaacaaaaattctccgggccatatttgaatttttcttgtacgtattttaatgtttgccaatttcttttcgaattttaattaattctattattccttttagagaatgatttttatttcgggatgaatttatcaggacgtgacaaatccaccccccttacaagaatctcgtccccgagattcgaggaggctagcaagaagataggttgggcggtcttctcttcttgtctgacttcttccgctctgtcttctataacaaacttgtctaactaaacttctccactctggactgcttggctcgatctcctgttgcagatgaaatcttctcttcacccgacttgtccctggttgcacctttaactgactcagactaggctgcggtggttgaggatggggcttcagttctagaacttcttatcattcatatctttggcgtcaacctcatacaagttaccaccttcgtgacatgcgtcaacactagcttgtcattactaggataccatgcttgtcatttgcttctaactcgccaccaactgcctcatattagctttcctggtctccgggtgatagctacttctgctatttgatgcaagggtcgataactttgcctttgaattatgcttcccaagagaaccaacttatcccacttgatatactttgacgtcttcccgaatgactttgctgctggacttgttattgtctgatcgtggtcctgccagacctgaagcttcgttgttggaggtgattttaatctgacctctgtagactatcttcgatcatatcacttggttcataactgggaatagctcccacgaacaagcaacgcagatttactttctttatgttcagtttactttccgctattctcttcatgttgtcatcatttagcattcaacgtattcctgtgcaccttccgccttgatgtgttctttcccattagatcatctcccaagacatggcgtcgcctggtaaccggggcttgcacttttcactccgtgtagcatctgataccgagttgaagatttcactccttgccttcatagaaacacttttacctaggtcatcttgcttacttaatgacaaggtgacttgttgtgggggggcaattactatcaggggtcttctttgagcgatgcagagcatgtttatgtttatcaatcacctttcggcctacttctttcatgctagagaacatctttgccaatctcttttatcaatcatctttcggcttatctctaacagggagtattctttaatgtggattgcggacgcttctggggatgatgaggtcctttggcttgctgcctttcggtgaaaccttgatgtggttcgtcaaaaagctgcactgactaccttcagggaaatacattgcttgctatctgtatctatgccactaaggtttaattgccgatggtcatctttagtgctccctcgagatggggagcatccatattgtccttctgccctatcacctttgacccttttctgatacctgatagactaattaccaaccatcgactatcatgttctcaaatattgatgtctcctggatcttcttaactgtttgcaggtatatccgaacttatcaatgtagaggcatggcgggtacccttatgggtttcatccaacaatccttatcttgatttgtaaaagcgtatccaaactcttatccccaactactgtctcattagctttttaacccaacacagtttaattggttttcttttccatcaacaggttggttattaactcgaggttagaatatagttcctctgacacgagaccctaggtctccttcgtcagtaaacaattatacacatgatcacatatccgcatcttccaaacgaatcctcttagaacttgtttttattacaaatttctcccatattacatgaatacaaggcactgccttaaacaaaaagggaaggtgcttaacatcggtacattgcatcctcaacatgaatcttccataatcataacaaactcattgtttataatcatgaatatatttatttattacatgactgctgcaaactcccgattacagtgataagtagcgaactgaaaatcacaaacatggatacctagctggcattgttctagtgactgcatccttgatcggttctgtgatgatgtgataggactgcatattgctatcattcacaggagaagtttccttctgattgctggttgaggcgaataacggtcttctgcttggtatcgccctccggaggtcgattgccctttgcttggcctggagtaggtcggggagagacacaacttcttccatcgacgacaattctttgctggggctgaaagtgagcattgacaccttgtggtaatgcactcgctggagttggagctgttgcaacgcgggccataggactgctttgggatgcatggatgacaattcgctgaggagcaagcttctgattgcagggagttgcgtggactgacgtgctggcagctatgtttctcggttttgggcacttgtcggcgaaatgacccattccttgacaattgaagcaacagatatcttcccggactcggcattttcttttctcattttgattcctctgtcctggcactggagttaggctgaaaccgtaatcttggcgaggattggtgttgccttgatgcttctctccgttggaactggcgggttggttagccatcttcttcgtcagcagaaaactgaattgacaatcttttggtacatgatcagtcccttcacaaaagaaacaagtgatcctgctcgttggacacctgtcgggtggatggtcttcctcgcaatgaacgcatatagtggcacacgagctggcgacatgaccgatttctccacaacgagagcatgccttacgttccatttcatcttcatcatctgaggagacttgatctgaatcttcactatcagacactctacctccattagctaaaagatgctctgtcaactgtggtgcacctcggaaggtatttcttctctgacgttttgtcattcctggtggaggccattccgtgctggtaatgatcatcttacggacttcatcttcggttcgcattggtgtttttcttttctgctgaggacactcccttgcatagtgcccttgctcatcacacataaaacaaatgatacttgcttcttttgagtcaacatgtggcacgtcaccatgggtccttcgggatgttggcggcatgctgacttgtggtgtgagtgcttggactgcctccaactgcacttgaggttgtatctgactcaggttcagaattggcgtctgatgctgctgtagtatctctataagcaatcggttctggttaatcaggtgttggaccagtgtcacacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaggtcttttgctgttatgatgtatgttaggcttattctgcaagttgattaagcaaacaacctagcatggttacatcacaccccactgatgcaaaccacgcgctacacacacaagcaaggaaacacacgactaatgactctaccctagagggtggcttaggtcctgtgacgggttctcaagatcttcactcctgcttcacagctggcttcactgcttcctccacttcgctagcggatcctgcagtcttccggagcttcggcaaacaactgacgatgtcttcttcttcactgacctgaccatctagtactagttgaaatccgaagaaggaagaagggagtaaaccttttgcaaatagcattaggggaaggagaaaaaaggaactttcgcaaatagttttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccaaacaaacatgatacaaaaggcacatctttattatatcgataatatttacattattacaaaggcgcttcaggcctgacaatcaaaaataaacagcagcgaactagcgggcctacggctccatcttcacaggcgctcaactggggtataagccaggactccacctaagacatcttctccacagcttctcttactgaagaggggaaagattgagcaagaatgagtacaaccacagtactcagcgagccacaccggagatgcataattaatgcaaggggggtacaaggggataataatataggggttaagttttgcagaaagcagcatttaaaagtcacttagttgcccaaagccattttataaagacgatcctagagctacacaaaattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaaatttaaagaataaaacactgacttgggtacattgctcggcttgcccataaccgaaggcgcggctattcgaatagattatactctgatcagaggtgtacatctttacccacaagacacatcttcctcacgtgtaaccacgtgccacataccaccacggtatacggacggaagacgtgacatagtt

SEQ ID NO: 76464 - DNA, 972 bp, Oryza sativa
tccccctcgtccggccgttctctccccctcccaaccctatataaaccctccccgtgcctccctccaccgtttccgccactcgccgccctctcttcccgtcggaatcgagctcgcgccgtcgctctctctctccgccgtcgccgccgagctccggtccaccgccgtcgtcgccccggaccaccttcccccacggcgtcgcctccttcggcttcgccgcatcctcgccgacctcgtccacctctccgtttcggtcgccgaccgccggagcaccgtcaaccccgtccacccgagccgcgccgccgccttcctccgctccggtcgccgtttccgtcgtcgccgtcgacccggggtgagccgtggaccgccgcttcgtttccccctttccctcccctctctcgggcgccgctccgacgtgcctatggccgccgctggcgaccataggggcgcgggcgcgccgcctcccgccggccgcgccgccgtggccgccttcgggcgcaccgagcggctgccgcgtggggcccggctgtcagccgctgtcacgcccagaaattcccgaataggattccaagcagaatgtgcattaaaacccccgtccaggaccggcgggggtacacaaacggctatgttgacattcagatccacgtcttacaaacatcataaagtcttacagaaatgcaccggaaaccaaaaaaaactggagcttaaccttgacttgaattgcagcgggaacacccctccacaggcatccttgatggcacgaagcaagcctactctcggagaacccgccatcggacacatactcaagctcttggatcggggggaaataaaaccaggcttaggactaccccctggactcagcaagtcataccggaataggggtatgatgcagggagttatcaaagaagagctaaagtggttcatttgcataaagcgagcatttataaacagagattgaaagattaaatgatgaag

SEQ ID NO: 76465 - DNA, 1552 bp, Oryza sativa
tgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatataaatattatcgaaataataaagatgtgtcttttatatcatgtttgtgtggtgtaccccggcttttcctgggacggggattaatacactcgcgttcgggaaaaggcaattttcccggtcgcgacagcagcatcagctcaagatcgcccagggagaggtctgtcgccccaagcgccgccgcgtctgccgcagccagaagatcaccgcccgcaagagtacctccaggcccgagcttgttcgccagtccttggcatggacctgcttcgtggagaccccttgtgccgagcccgcgcccgtggttcctcaggagggggaagcctccggcgttggtagcacggaggatgcgctgctgctcaccttccgtcctggcccatcgcagcggtagacgagcagttagtaggcttgcgcgtgtgttctttcttgtttgtcttcttgttggagtcgtgtggggcatggttatgccggtgtgtggtataactgtgtcggagcctgtctttattttatttgcctaagcaacttgaactttaatgaaccaatttaatagcagtaataaattcaagaattatggtagtcgtgggtggctagctttaattgtcagctctctctgtttgctggttctgtgtggggttttcagatggtgacgaccaggaaaagtgctgctaccggtgaaggcagccaacccgaaggcagcaaccacaacaaccagggcagcccacctccacctccttcttcgcctccaccaccaccaccagacaccaacgccattctcacccaaatcctcgcccagcaggccaacatgatggctgctttcctccaccacatccaaaatccgccacaacataatgctccaccaccacccccacaacactctaaactcgccgagttcctccgcatccgtccaccaaaattctctaactccaataaccctgtggatgcgttggattggttgcatgccgtggggaaaaagttagacaccgtgcagtgcagcgatgaggagaaagtcgtctttgccgcccaccagctgcaggggcccgcatctctatggtgggaccatttccaggctacgcagccagaggggcagcctattacttgggcccgcttcaccgccgctttccggaggacccatgtgcccgccggagtcatggcccttaagaaaagggaattccgagagttgaagcaaggcaaccgctccgtgatggagtatttgcatgagttcaacaacctggcccggtacgccccggaggatgtacgggaagatgaggaaaagcacgagaagttcttggctggaatggatcctcagctgttcgtccgtctagtcttcggtgactattccgatttccaacgtctggtggacaagagc

SEQ ID NO: 76466 - DNA, 1300 bp, Oryza sativa
ggtggtagtggtgcagcaagccgacgagccggggaggaggaaggggcggccgaaagaacgccggcgacgaagaggatggagaggccggcgcggcgacggcgttccggcgaaaccgaggagcagccggggtggaggacgatgctgcgacgtcaacggaggagacggcgacgtcggtcggcgcacgggaaacgcgacagtggcggccggaggtggaacagtggcggcaacgccactgttttgccggcgaggacgcgtctccggtgcttcccccgcgaaacggagggctgaccgagggggaggaggtggctgcgaggccgagggagaagacggcgcggccggacggcgctcgggcgaggagggggaggcggctggaggcggccggcgcggaggaaagagaggggcgacggcgggaatgtcacgaccggaaataacccaacgggctttcctgacgtgcgtgcattaatccttgtcccaggaggcaaggtacaccaaaagttgatacaaatcagagtttaacaagcggaagcgtatataaaattattacatgggcaacgaaggcccagcacactcagagacaacgaaaaacagcggaagactagggcgacgaccacaggcgcttgacggcaggcacgagctagacaccaaagccttcatcttcaaggaactccccatctgggcttgggaaaattaagcaagactgagtacaaccaccgtactcaacaagacacacccacgaatgcagaataaatgcaagggagtacaagggaattataacataaggggttagagttgcagtaaacagcatttaaagacttttagttgcccaaagctattttgtaaacacgatcttagaactacacaatattattaatcaaggccgtgaacccacacgaacctgccttaacccaaggcctacgatgattcggaccgaactggcaacccgaccctgggttccagctcgtcccaagccaacccaggccaaccattccatattttagttgttgagcaaattttaagaattataacactgacttgggtacattgctaggcttgcccatatccgagggctcggctattcgaatagatttactctgatcagaaggtgtacatcttttacccacaagacacatcttcctcacgtgtaaccacgtgccacataccaccacggtatacggacggaagacgtgacataatttccaacccatcctagacttagacaagagtaccgacccaatttcgcctacggccggaaccccctgtacatgcagaccgaactgggcccctcgcagcaaggcaccaa

SEQ ID NO: 76467 - DNA, 585 bp, Oryza sativa
gccctctctccccgccggaatcgagctcgcgccgtcgctctctctctccgccgttgccgccgagctccggtccgccgccgtcgtcgccccggaccaccttccccctcggcgtcgcctccttcggcttcgccgcatcctcgccgacctcgtccacctctccgtttcggtcgccgaccgccggagcaccgtcgaccccgtccacccgagccgcaccgccgccttcctccgctccggtcgccgtttccgtcgtcgccgtcgacccggggtgagccgtggaccgccgcttcgtttccccctttccctcccctctctcgggcgccgctccgccgtgcctatggccgccgccggcgaccataggggcacgggcgcgccgcctcccgccggccgagcggctgccgcgtggggcccggctgtcagccgcccgcgcccttaggtgcggctgacgcgtgggacccacagcgccggtcggtgtgagcccgggtgcgcccggtccaccgtggaccgtggggctgccgcgtgggccccacccccgtggacccggtccgcgcgcccctcccctcggctgacgcaataaatccatttttt

SEQ ID NO: 76468 - DNA, 593 bp, Oryza sativa
agctcggtaccccaaattaagctagttcaaattaatgaagtttggagccaacagttgatcacgcacaccgactgggcaactgacatgcatgcaatctctactatgggctccttcagaatttattccatcaattttccccttttgttgaatttgttggttggctggttatgatttttagggctatttttcgcaccattgactattgattagaaatacctggcaagctaagtaatcaatttgcatttgacgtactgtaaatctgtaatcagggtgtgaaaaaccgccggtaaccgcgcggttaccgcggttaccgcccgtaccgcgggggtacggttacccgtaccgcgcggtacggtttaataaaattcgtccaaatcaaaaatttaaaaaaaaagaaaaaaatccaaaaaaatagtgaaggtagtgcttgatttatagtgttttatggtgaagaaatttctcaaaaaagagttatatttattcaaatttgagagcaaaacggagaaataaattgaaaaattgaaaaaaaaaaaaaaatgggcccggcccgtacttgggcacccaatacacatcgcgcggtaaccgcgccaaac

SEQ ID NO: 76469 - DNA, 583 bp, Oryza sativa
tctggagatttgtgacagtgaccacttgtggatcaaggaaggcaacttccggtgcatgcttctgacaccattgccaacttaacctacacacaggataaacgatcttgtaagcaagttaaaccgattgttattaccagaatgagttgggcgacaatacttacaaggagtagcacttaaggaggcttgtgtccaccgttcggagcctgtagaggtcgaaaagatccttgaagtcgaccacgacataatttgttggaccaaggaatggctttccatcgtgctctccaaggatatcggtagctttactcggcttcctggcgttagatttctccatgtagtataagtgaaggtccttccaagcggtgcccattgtggcaagcacgtcatctccaaccaatggcatgcctagtttgaacttcctgtggagcaacgtatttcttcttgacctctttgcccttagtctcttcctggcccttgcccagatctagcttccttggagctagaagcgaggcctgcacctttccttccctttctctcccctttgcttcgggtttattgagagttattctctaaggggaagaatgtg

SEQ ID NO: 76470 - DNA, 719 bp, Oryza sativa
caaattcatcaaagggatattctgcagattcggattgccccaccgtatcataacggacaacggctcccagttcatcagtgccgattttcaggattactgcatcaggctgggagtcaagatctgcttcgccgacgatgaggaggaattttgaacggagggtaatttggtcaaatttatggttgtaatggtgtggaatcaatggtgcgttgatggcgatggcatttctggaagaaaaagacttgtacgatggcattttatggattttctctaatttaaaattttaagtaatactctctccgtcccaaaatataagcattgttggacttcgacaatgtcttcgagatgctacattgatcaacaatatctataaaagtaagatgttttaaataaaaaaagttacacattatgataatttgcttaataacaaatctagtaacatcaaatttacatgattgatctgtttttgttcgtttgctattaatagtcaaaatttaaaagtttgatttgccactattctaagaatgcttatattgggatggatggagtattttttttcttgtatactaaggatgtatgtgaggtgatatttataagtggacgtgccgattggatgggctaggctgcgttattctagagcacagattgttaaaaattgtaaagtaaaattacttgaatcacgtcgtcttaaatttatgagaaaaaaaatgctgcaacaatag

SEQ ID NO: 76471 - DNA, 10204 bp, Oryza sativa
ggtttatatatatataaaccatgcatatatatgtttcaatacatatatacatgattaatatatatgtatttatatatatatatgttatgcaaatgcatatgtgtgtatatatacatacacaacacacacacacacacacacacatatatatatatatatatatatatatatatataaccaaaatatatatttacattaaagaaaatgtgtacacatgcatatagaaaaatagacatgtactaattacaatccattatgatgtcctagctagctactatttcgacgtagtagtagtcgctatctcagaagctaaggacctatgaattgtatttccgtcgtagtagaattcacccttggcatcaaggatttgttcgttgatgaatcccatgagttgttcttgaaccaccgtgataaattccttgtgtgtgatcaggttatccctcatacgaataaactatatgaatgtgtgaaattaattagtaattaaacaacaaatcgatacgtaatgaaattttgaatttatttgcacgtacatcgagctctcttgtggtgatgatttggtctgcaaggcagtggcaatactcgcacacgtagtagccgcacaagttagttccctacttttgctttgcgcactataaataaatgacaaatggcgagagatctaattaatatacacttgtatgtatttgaattggagattcaatataaatgtagagcatgtgtactcacaggaaaattgaacttccgcctaagtctttctctcatttttccgcggaccaaatgatggaaccgataccaagccctacatggagtttaaagctatgattcgtagtagcaattaattataacaagattcttaattaacataggaatttatgacagtacctgtttataagttcgaaaaccttgtcaaacgtagactcttttttatccattgagtcatatacgttgacggtgcaggcctccaggtcgaagagtaaaagcacccagtggaatctgcaatgtgcgtgggatgcattatatatgaaacacttagcatgtttgtacgggaatgaaatttggtataggaagacagtaaaattaaactaactctgtgttgtacggcaacagtatgaacgtcttgtaatgctgcgccttcaggagatggacgagattgtcctctgtgtcttgcagataccggtcgagcactgtgacgtttactttccgagggtcgatgaatccagtatcgaaaaccccccaccgtcgggccctttgaatctccattctacaacgataaaaggaagtatatattatatatagtctacttatatacaaggacctaattatttaaaggaaacgtaataagaaatctaactgaacgatacttacaaaatgcagcaactcataatagaaacgtcgagggcgtccagctggtatagttcgtagatacccttgaaattgatccagagaatgtcatctccttgcaagaagtccgtgtccctgatcctcgctctgatcatctctctaccggtggcgctcatctccatgtacagttgatggaacttgtacatttgagtgggtaggaactgcagctgctcaggcttgataagcggtttatcgagttcgtacatgtatttcactttcgccttttcgattggtgcacctcatatcaattgatccgtagttagcccggtgtcatcaataaattcttgtattccaaaatcttcaccggtcaccaacggctcgatctcctggcttgcttgctctccaagctgagggactggtttggactttccagaagatgctttctcgagtgttcgctcatagtccgatagctttatggccttcttggcaggtgcagacatacccctgaagaagttcttaacactcgagtctataggaatcttcttttctggacttcgaggcttcaattgtctcctgacttctgatgccacataagcgtcaagctcctcttgcgtgcaatcgtaccctagatccttgttcttggcggtgtgaactttcgccttcttcgttgcccttgtgggggcaggcggtggagcttggggggcccttgacttggaaggtgctgaacgaggagcctgcggaggagtcggtgtaggagcctgaggaggagtcggtgcaggagcctgaggaggagttggtgcaggagcctgaggtggagacggtgctggagcatgaggagacggtgcaggagcctgaggaggagatggcggagccggaggagatggtgcacgagacgccgcttgtcgccctgggaggatgatgtatcgcttgcgccatagtataatggcgtggcttgtgtctcgtagatgcgtctcaccgtctcctccagggtaatccaactcgaggtcctcgtacgcgccttcgaccaactcaacttcgaccttggagtatcctgctggaatcgtcctacagtggtaagtacctaaagggtccgttgtgatggccatgcccgacgccaccttcacgtggtgagaggttatttattagtaatcaacgtatataagcagcaacttgtcgaatggacaaatctaaaatctataaactacgagcttacctttattgataagtttttgaagggaatatgcagctcagatggtgtccgctgagtgatgtcatcaacggggcaggtggttttgtcctgggtttgcatggcgtccatgctctgtgatcctccctgccccgttgaggcgcagttgctacgatttcctgaagggctcacaattgcaggaggaatggttggctggggatcattggaccaatgtgcggccatgcgttcatcaaccttccttgccacctcctcttgcatgctgagctcgtagctcgataccctgaactcaagatctgcaatcttcgcctcggtatctctcttgctcctcatccgactcctgtacgtgtggatgtcctccttgaacccaatcttccaaggaatcacccctttccctcgtgttcatcctggatgctctggagtctgcagggcgagtgacagctcgtccttctctctgtcgggtcggaacgtaccctgagaagaggcttccactgcgtccgttagtcgacgcgtagcctcgcgtatctgatcgctgaagaccagggagccatcaactgggttgagcgttccaaagtgagcatagtaccagaacttcgatcgttccggttaattagcggtggccggttcgatacccctctcaagtaagctagcctccatctcctcccacttcggcatcgcgacgctatagcctcctgaccccaagtggtgatggtacttcttcttggcggcattttctttgtttctttccatcatcgcctgcccttgttcacatgtcttatgtgcaacgaactcgtcccagtgatcccttagctttgggaatgtgtcgaagttcggtgtctgccccttcaggatatatttctggtacagatctcccttgaagctctgaaactgttctgccattttatttagagtccaccttttcactttgtcctctgtacctgtgggaagggtgaatgtctcgagcattgtggtccacaacatctctttctccgaatatgggacaaagctctcatgatctccgtgtgcccttgttctgcgccagtacaccgtactgacaggcacgttatcccacacaacccaaccgctgtgacgtatgtagttcttggtggcttccgcctaggcactaggtcggccgtcttcgtccacttccgttatgatgtgccaaccctcaagcttcttcgcggcacctcgttgcccgcgtgccctcttctgtccagcggagggttgacttccactagcctcctcctcctggttcccctccacatccctctatacgtgcccctcctggttcccctccgcatccctctccacattcccttcctggttcaagtactggtttggatcctcgttcccctcttcttcgttcaagtactggctgcttccctccgcaattgtatcttacaatatatgttcctcatcgcgatcagctatctgttcatacaagaaatagttcctaagtcatgagacatttttgctttaacaatcttatatgctaacaatcatatatgctaagtctaaacacaaatctaataatcttatattaaaactataataatcgtatacgaaaactcaaataatattgtattaaaactgtaatagtcaactatgctaagtctaagtgacgtatattaggaccctagctagtcaataattatatactaagtctaattacaaatctaataatcttatattaaaactcaaaaaatattatattaaaactctaattataatgctaagtctaagtgtcgtatattaaatctaatagtcttaattgcgttaaaaatctaacaatcatatatttacatcacttgcctgcgcgaattccttcgagggctagcaaccactccggcttgagggacgacgacgacaacgtcttttctgcaacatacaaaaagatgtattaggagaaacgcgaagtaacatatattgtatttctcgttcgcgttctcattaagttcacgtttcgttcacgatcgttcacgttcgcgttctcgttaagttcacgtttcattcacctacgttcgttcgttcacgtgcgtccacgttaacgtacgttaagtaaagttcgttcacgcacgttcgttcgtttacgtatgttcaaatacaacattaagttcacgttcgttcacgttcacgttcgttcacgttcacgttcattaacgttcgttcgttcacgttcgttcacgttcacgttcgttaacgttcattcacgtttgttcgttcgttcacgttctcgttcacgtacgtttcgttcgttcacgttctcgttcacgttcgttcattcgttcacgttcacgttcgttcgttcgttcacgttcacgttctcgttcacgttcgttcgttcacggggcggcagcggagcagcggcggggcagcgcggccgcggctttgggtgcggcggcggcggggcggcgcggcggtgccgtgccgcggcggcgtcgtggcgtcccggcgtgtcgtgtcgccgcggtattgtggcgcggcttcgtcggcactgccagggcgacgttgtcgccggtgccggccgcatcgaggtcggggtcggaggcggcagcggaggcggcgatgacgacacgcgcaagacggcgtcgagatacgacggcggcgtcggtgcggggatgccctaggcagtggctgcgaaggagaagccgagagagatcgatcggggcaaaaatttctaagtgttggtagagaagacgagggcgcacatcgggaatatatatacctctagatctttagtcccagttaatgagaacaaccgggagtaaagatatctttaccggttgttctcatcaaccgggactaaatatattttcccgctatttccaaattctttttaaacccggttagggttaagaaccgggactactgataagcgcactgaatattaatttccattacatatgtgtttctaaaatagaaaataatgcattaaaattatttaaagtcgaaaaattaatgacaattacttcgaaaaattattgttgtctgtagtaaattaagtggataaaacgtaataagcaaatatatgatttaaattaataaaaattctaataatcatatatatacttagcgtatgaatgatattaaattgttaacaattgtaattaacatatgtatatacatacgacatgcatgatttaaaattaataaaaattctaataatcttatataattagcatatgaatgatattaaattaattgttaaaaactctaattaacatatgtaaatacatatgacatgcatgatttaaaattaataaaaattcgaataatcatatataattagcatatgaatgatattaaattaatttttaaactctaattaacatatgtaaatgccacaagcatgatttaaaacttttaaaaatcctaattatcgcgtataactagcatatgcagggtttaaaattgttaaaaactctaattagcatatgtaaatgccacatgcatgacttaaaacttttaaaaattctaattatcgcacataactagcatatacatgatttaaaattgttaaaatctctaagtaaaattgttaaaaactctaagtatcatatgtaaatgccacatgcatgatttaaaacttttaaaaattctaattatcgcatataactagcaattacatgatttaaaattgctaaaacctataataaacgtacgtaattaacatatgccatacaacaactgatttatatggataatcaatacatccaaaatagtttacatcgtgtacacaatagttacgacaatacatcagcggtgacggttgaccgcacgtactttctcctcactattgttccctccttgtgatcgctacgtgagtaaggggtgtcttcatttgataggaggatgctagggtcaatcgttaccatgaaagggggttccccatcaaactgatcgtaatcctcgtcagtcttgtcctcaactccgacgatttttcttttgcctgagagaaccacatgacgcttcggctcgtcaggccctctgcccttctttcctttgctagacatttccttcacgtaaaagacttgcgttacattattggcaaggacaaaaggttcgtccgagtatccaaccttgttaaggtcaaccgttgtcatcccactatcatcaatcattacgcctccaccagtcaacctaacccattggcaccggaacagagggaccttgagaggaccatagtcaagttcccatatgtcctcgatggcaccgtaatacgtgccagttgttccatcgtgtcccattgcatcgatacgaacaacgctgttttggttcgtgctcttcatgtcttgggctctcgtatagaatgtgtacccattgatctcatatccctggaatgtcgcgatcgacccagatggtcccctcaccaggaaggccagttgttggttgatcgtctcgttacccatgagatgttgtcatagccacgcggggaaagtatcaatgtgatgccgtgtaatccatgcatcggacttaccgatgtttctggcgtgaactagagccaagtgctccttgatgtaaggagctaccaatgaagattgttgcagaaacgtgaaatgggctttacggaataaattgttgtctatcgtcattattgctttccttccgagagttccctttccccgtagtctcccttcatggcgtgattcaggtaccccgattgggcgaaggtcttcaataaattctacgcgaaattcgatgacctcctctgttccataccccttggcgatgcttgcctctggacgagcatggttacgaacatacttcttcagaacgcccatgtacctctcgaaaggaaacatgttgtgtaggtacacaggcccgagaatactgatctctttgacaaggtgacaaagcagatgcgtcattatattgaaaaatgaaggtggaaatatcaactcaaaactccacatcattcagaagggcttctaatctatccggatcggtgaccttctgcgaaattgcgttcatgaatgcacatagctttgttattgttgcccggacattgtctggaaggataccccttattacaactggtagcagttgtgtcatcaacacgtgacagtcataagactttaggtttgtgaacttcttctccttcgtgcttattattcgattgatattcgtggagtatccagacggtacatttatgctctccaagcattcaaacatactttccttctctgccttgctaagagtgtagctggctggactcaagtaatggcttcctttctcctttggttccgggtgaaggtcgccgcgttgttccatacgcttcagatcattacgtgcttccagtgtatcttttgactttccatatacacctaggaagccaagaaggtttacgcaaaggttcttagtgaggtgcatcacatcgattgcgtggcggacgtccaagaattccctatagggtaactcccaaaatatagagttctttttccacatcgccgcgtgaccatcttcgctctctataggctggcttccaggccccctttccgaacactactttaagatctttaaccacagcaaacactgttttcccgctgcgatgtttaggcttcgtacggtggtccgccttatgttcaatgtgcttgcctctcttccgtaccgggtggtttgctgcaaggaatcgacgatgaccatgtacacaaccttcctacagtgcttaagatacgtactttctgtttcatccatacagtgagtgcaagccttgtcccccttgttggactgtccggatgggttgctaagtgcaggccaatcgttgatggttacgaacagtagcactcgtaggttaaactcctcctgtttgtcctcgtcctacacggggacaccttccttcttccacaacagtttaagatcttcgaccagcggtcttaggtacacatcgatgtcgttactaggttgcttggggccttgaataataatcggcatcattatgtacttcctcttcatgcatagccaagggaggaggttgtagatacacatcgtaatgggccaagtgctatggccgctgctcatctctctaaaaggattcatgccattcgtactcaaaccaaaccgtatgtttcgtgcgtcctttccaaagtctttaaattttctgtcgatgtttcgccactgcgaaccatcggcgaggtgtctcagcatcccgtcctgttgacgctcttcagtgtgccatcgcatcattctagcattccccttgttcctgaacaaatgccttagacgtggtattatagggaaataccacatcaccttagcaggaattctcttctttgttagctgcccatcaacttctcctggattgtctcgtctaatcatgtatcatagtgctttgcaaacagggcatgcttctaggttctcgtacttcttaccgcgatataggatacaatcattcggacatgcgtgaatcttctgaacttccagtcctagagggcagactatcttcttagcctcgtacattgtctcgggcaatttgtttccctccgaaagaatgttcttgacgagtttcaataaattgccaaatgccttgtcactaacaccattttttgccttccattgcaagaactccagagtggtatccaactttttgtgcccctgctcgcaacctgggtacaacgacgttctgtggtcctctaacatcttgtccaatttatgggcccccttttctctttcgcagtcctccttggcgtcctgcaacatctgaccaagatcatccgcaacgtcgttaccatcagcatccctttcctcctcgcccgtttgatttccttcaaatccaacgtactgagcaaagtccagaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccttatgcctgttagcttcggccactctcaaaaaatcatgcacgccatcaataaactctttggaccgccgatcagcgtacatccattgccgatccatctacatgacatgaaaaaaaatcatacacaaataattattcttacaataatgacagtcatacaataattataaaataattacaaactctttcaacagtcatacaataatgacatatcattattcatacaaaaatcataaaatattacaccaaataattcttatttactatttctaaagtttacaactaatattaatgtgttttacttcttttaattttcattttagtttgttttctattatttaagattaactatcactatattttccttctcaactattttataaaaccttctttagcaaataaactaaatttctatatattctttcttccccacacaaattttctctctcatcaacttacaactaaattttggagacaaaaaagtgtgcaaaacatagctccaaatgtaatatgacaaaaaaaacattggaggatgaagttgctaaccttttaggcacctctgatttctatataatcaccaaaataaatttactagaaattttggcatgacctcccctcttttttgaagaaaaattgaagcttgctcgggcagttggaggaggaagaagacatatatatataggggtaggact

SEQ ID NO: 76472 - DNA, 665 bp, Oryza sativa
gtcgcatttgtctgcggcacgcggatgtcacgccggtgccgtcgcacgaagcggccgcatatgatgtcacagtcgccgaaaaacctcgccgccgtcgccgggccgacggaggaggaagacaggatcagcgggatgcagacggcaacgacgatggctgcgttaggagaggctgcacggcaagaagccatgtaaaatggtgtgttggtgattcacaagcaaagatggagatagctcgagatctttgatgcttaattgatgagcaattgagcaggtgtggtgtgcccatgcaatggagccactggtggagaaagcgtttgtagtaccggttcgtaacccccctttagtcccggtttctaaaccgggactaccaatacgggactaaagatcgctatctttagtcccaggtgaaataaccgggactaaagatcgatctttagatcgagctgaccttttttttttgcatggccctgttgctgcatggtttatatatatataaaccatgcatatatatgtttcaatacatatatacatgattaatatatatgtatttatatatatatatgttatgcaaatgcatatgtgtgtatatatacatacacaacacacacacacacacacacacatatatatatatatatatatatatatatatatatatatatata

SEQ ID NO: 76473 - DNA, 1476 bp, Oryza sativa
tgatccggtaacaaatacccaagaatcagaattttaagtattttttattaattcctataacattaatacctgaggtggaactctttccaccctgctgcttctgcttgagctgctctaggtatttcttgcagtttctcttccaatgacctgtcttcttgcaaaagaagcactctgcatccttagcgggccctgtcttttgaaccttggtcttagagttgctagtactcgtgatcccatcatagtttagctttcttttttgaccacttttcttgttgttgggcttgcgcttatgcataaccatcacatggttggagtttttcttaatgctttcctcggcagtcttttgcatttcatgcaattctgccaaggtcttgttcaggttgttcatgttgaaattcattatgaacggctcaaagctgggagggagcgactggagaatcaaatcagtagccaattctcggctaaggggaaagccaagcttatccagactcttggtgtaaccaatcattttgatcacatgtgggctcactagattaccttctgcaagcttgcacgcaaacaaggactttgaggtattaaacctctcagctcttgcttggtcctcaaacatgttacgtagtcccgtgattatcgtatgaacatccaatgccttatattgcctttgaagctcaggggacatagtagcaagcatgagacagattatatcaagataatcattgcatcgttttcatgttccctacgttgagcagcaggagcattgttgggcaagttagctggaaaaggctctgtaagcacaaactcttgtgctcttgcctgagaacaattctcaggttgcgataccaatccatgaagtttgttccagtcaacttctctttctcaagaatagaccgcaagttaaaactggatggtgcaggctgccatgatctacaatagaaatatatgtatacaaaatcagcagcatgtttacatttaacctttcattaaacaatttaacaaaagatactcccactatgtattgtgaaacaaaattccctctagtaacatagtgagtcaagatcctcattttattagtgtctagggagttttggcatcacaattagacaactatcaaagtaggtaagcaacaccttgctaatcacatcatatgtgactcttgtgctgttggggtgacatctccatatccaacccaacctatgtcccaaggttcaaaaccgttttgataaccttgtcaagtaaaccaataatctccgcatacagatgtccgagatctatcctattttatcatgataaaaagtgacactttgctatggcaaacccatcacttatgatcacaaccgtaataggtgcaattattggaagagcataaattacacttaatttttctgagggaatccatcctactatgtcatatcaaatatataacagcaataaagtaagatagatataaaaccccaagcgaaatctgaggggcaacgc

SEQ ID NO: 76474 - DNA, 1226 bp, Oryza sativa
tcaccttgttaaattcagtgtcctatacttcaaaaaaaggtatcttgttgctgcctttagcatatccttatgcacattctagttcttgaaaatgtcacaaatatacataacttatgatttttttttcaaaagggaaaatgtcaatatcaacatttgctttaggcttgtacgatgctattgtctttatgatcatcacgattcctcgtgtttttaggaaaaataaacacaataaaatgatctagatttacctacaaaatatcagcatacgtatagaaaaataaatgtaaaactggatcatggcatcttgcagttacagaacaaattgggcaatttatcaaacttgggaagccacacataagagagcagatttatatgctttttagtgcatgtacaattcatacaacagaagttaaacaccattatatttgccaatatattcttgagaagttaaatacatttcctttctatggaatcccaacttcgcctaagcatctgtagctagaagtgctcatctcgtccctttcctatgtggtcttcctcaaaaagactcaccagagatggttgcagcggtgattaactttctgaacttatgtcatatcttacaaagattcctctccaacaagctcatttttgccacataattcctcatatttgagctccctttggtgcatctgcttgttgccctcctccaaacctatggctagaggtgccaccatcccaagtaggttgcctcctcttgcatgcacagatgaaaaaaaaaggtctattaagaactcgttgaaatgctgaaataatccaaagagcaatacatatatagaaatccatattttaattacattgatagcacacattgtgccactggttaaagaacacagaaagtgagaatatctgaatctgtgatgttgaacctgatcatcacctaattctctgatatttatactaccaattagattccccttgactgaccagtaggatgagacagccttcctgatccaaagcacaccaatatatcgtcatcagtataatccttcagaataaagctcatagaccacaacaagttcaaaaacactacacttgaatgcaactttaggtttatacagacgttagtgatgcagtactttgcagagtcaactgaatgcaatcaaaagaggaagttacaacttgtaaatataaaggggtggctgttgatgcgaaaaaacacacactggcctgggagatctgcttaa

SEQ ID NO: 76475 - DNA, 10072 bp, Oryza sativa
atcgccccaagttctcatctcagattttcgctaagtgctcctcaaagtatgggccaacttctgccatatgttggagcacagcgtaatgagcctacgcgtacgatgcttgatcaggcctgattcttttccttccaattgtgccaacacgtgacaaccttccctcgtgacgagacgcaggaactccgataggatcagcatcggacatgtaattgacacagaactcaatagcctcctcggttatgtaaccttcaatgatgctcccctcgggtttagctctgttacaaacgtacgacttcagaactcccatgtacctttcaaacggccacatttcccttagaaaagccgggtcacatagttttgtttgcttcaccatatcaacagggagatgaaccattatatcaaagaaagacagtgggaaaaacatctccaggtgacagagcgtattcacaatatcggtctgcagcccatctagatcttctggatctataaccttctgtccaattgcattgaagaaggcgcacagacgttggatcgtgtgacgcactttcggtgctagaatgcctctgatagcaactggcaagatttgtgtgattagcacatggcaatcgtgagacttcattccaacaagttttagatcgtccaatttaacatacttacttatcctcgctgaatagcccgatggaactttaatatccttcaagcatgataacattgcgatcttctcatccttcaacagtgtgtggcaggctggaaggaggtacactttacctgtctctgcatctcgtatgggctggagttcactgcgaatattcatgtcctgtagatcaaggcgcgcgttcaacccatcctttgtcttcccgggaatattcaacatcaggccaaccaaactctcacacacattcttttctacatgcatgagatcaatgcaatgatggatatcaagatctttccagtaaggtagccgccaaaatatggattttttcttccacatacccttctcctttgtcttgctacgttttcttttcttaccaaactcattgcttatgtccttgaccatattgtggacctcatctccggacaaatctttaggagcaggctgaagttctctcttaccattaaaaattttattctttcttctaaatgcgtgacgtagcgggagccacctccggtgacccatgtataccatctttcgtgatttcttcagccaccggctttgtgtatattccttgcaatcggagcatgccttctttccttttatagtttgtccggaaagattaccgagtgcagggtagtcattaattgtgcagaacaatagaactcttagcttgaagttctcctgaccatatgcatcccaagtttccacaccttctttccaaagaatctccagatcgtcgataacaggctccaggaatacatcgataccattgccgagttgccttggaccttggattaacaagcacaacataatatatttccgtttaaagcataaccatggcgggaggttatagttcgcaataagaactggccaagtgctgtgagtactactcatgtcaccaaaaggattcataccatccgtacatagacatatcctcatgtttctagggtcggcatcaaagtctttgtgttttcgatcgatattcctccattcaatcgaatccgctgggtgtctaagcataccgtcattccttctctccgtggcgtgccaacgtactaacttcgcttcgttcgggttggcaaagattctcttgaaacgatcaatgataggtagataccacacaacctttgctggaccacccctctttgacttatttctttcgtcagcacttttctttcgcttgtatcgagaagccttgcagacaggacaagcatccaagtccgtatattccttgtggtacaatatgcagttgttgggacaagcgtgaattctacggacctctaaccctagtggacacagaacctgctttgcttcgtatgtcgtctcgggcaatgtgttctcaataggaagcatagccttcaaaattcctaaaagttctgtgaaactcttgtctgtccatccgctacttgccttcagcttcattaggtccaaggtaactgacaacttagtgtgttttgctttgcatccagcatacagagacgtctcggaatcacttaccaacctgctgaacttcattccatctctctcattctgggctgggtcctcaacgtcacgtaacatgtcttgcagcagatcgtgatccacatcaaccatttcaccgcccaatggagaaggtataaacatgtcatgctcatcttcatcttcctgattatgcgcaccacttctgtctgctgctactccacttcctgattcttgctctccatgcttcacccaacatgtatagctctccatgaatcctcgttgtatcagatgaccatgtacgtcctctccgctatcaaacatattctcattcttgcaatctgcacatgaacaacacatgtaatcactgtttcttctgatccgatcctccttcgcggcgttcataaaatttattacgccctttctgtactccgtagaatgacgtttcaaatttttcgcatacatccaacttcaatcaattgctacaaaataaaaaaaacaaattagaggcacatattataagatcagtattgcaaaagtaagacgtgatgaaattgctcaattaatgattaatattactcacttgattgatctatttttatcacttttgggaatttaatttcggttttccttgggaaaaggacaaaaaatcaccccctacagcctcccaccaaaatagtgaacagtgggatacaattacactaggtagtggggggtatttatactgtgcaacaaatatctgtaatggccctaaaacaatcaaccgtgacgggcatacaagtaatctctatcgagtcttaataaaaggcctaaaaaaagagtgtcatctgtgacgggcaccaaacttatctcaatcgggcctcaactatagcccgtcatagataagtgtcatccgtgacgggctttagttttatgcctatataccatgactgtgcgaccatatctcaatcgggcgaaacttcggcccaattaagattacttccttgtgacggcccgcaaattccagtcttgttatgggccgtcacagatggaaggatctgtactagtgtatatgtccgtcctcctccattatggtttttgccttttctcctacactgcttcttctccagatccggttatgaggaagtggttggtccatgatggcaacggtgcatacagtaacgacagatcatatagagatgatgaaacgcagccagtactttttctcccgtttattttattcacatatgatggttgataaattcttattttatttcaaggattgtcgatatctaggatagttcacaacttctaaaccattagagcaatggcggagccaaggcccggccagcctgggccattgcccaggctccgcctcatgaacatacactgttaatacactgttagttctaataaagggaagattaaccacgcaaattatgaaattagtaattgaggttcaaatcattatttgtagtttgcattagtttctctccaaaataataactatgtagtgtcaaattgtttacatcaatgagaaatggtttgtacagagttatacggatttgtgcgcttttatcatctatcatttgacttgcctaggctcataaaattttctgaatccgccgctgcattagagggcattgaatctataccagctcttcaatcgaatcccacaatgtttgctaaacaactataatgttcaataaataatatgacaccggtttttattagataatatgatattcgaccattcatttcattaaaaatgttatataagtgccatttatttttattgtgacttttaacatgatatttgatgcataatgatgaattgttggagaccgataaagcactaccagtttgagaaccatcggtaatagtacctgcattgtagatttagagggatactagtggagagagaaggggacggctgataagcgatcagccacgtggggaggcgcgcacggggccagccgcccccttcctctaatctctctgtatctaatctactacttctatacgtatgtatatactatatatgtatataatatatatagtatatacatgcgtgtatatatataagtatatttttaatatataaaaaatatatacacatatacaaagtttgtatagatatgatgtatataaagtttatatacgatgtatacaaagtttatataggacatagacaaactttgtatacgataaatacaaactttatatacatacgtattaaaaaataaaaaaactagaaaatacacaacatatacaaagtttgtatacgcgtatacaaatatgacatatgtgtatacaaacttggtatacatacgaatataaactttgtattcataaaccttaaaaaaaccgggaaaaaacagaagagaaaccagaaaaaaaaaaggaaaaccaaccgaaccggaaaaaaaaaaggaaaaccaaccgaacggaaacggaaaaaagggggggaaaaaggaaaactcgctctccctccttacccgcgcggcgcgtccgccgccccctttccacgcgcgacacatgtccagtcacgcggggaggggggcacgcgactgatcgtcaactagctttctcgagagataagggcatgatgctagccctatacattatggttatatttttagcaggcctcagcctgagaccaagtactagtactcgtccttggtttcaatggtacgagagtgtctttggaccctcatgtcagataaatcgtgcttacaggttgcaagctacacctctctattatttcctctattttaatatgggtgagtcctatgattatttctataggtgttttataccctgtaacaaattttcctaattgttatgattgatgtgtgtcccacctctctagtatcgcatatgaactatacgctatggatgcatttactagtcctatgcaagcagtgactatactaaatgtcagtaacaattccaaaacaactatagtttttttttcccaactacgtaagcgatatcacctagtgaaggctgtgtagatttagtcaatgaacgcatgcatttaccagatctagtagtatcgactatagatccggtccttgtttatgttatctgattgattcctagcttaattgcttgcagacgcactactaaaacaagcgtgtttattggatctagctagctagtacctgtatagttgtgttgatagtgatattcttggtaagagtgcttctcgtgcattggcatgttgaaaagttataggtgaaatggatatctgagacacagctataagtatactgatcaggatgggcaagtaccccagatcctgcattttgtacttacccttctaaaatttattcctttttccccgcaaacaaaaaaaaattattccttccactttacttttgtactcaccggacataaggatataaagttccataaattttttaaggccataagaagactgaatactgaggtggataagagaggagaggagtgagagaagaagcggatggcacgattacagccggcttaggcacaagaccaaaaaaatatgtgagagagacatattgaccatatattaatagttaagagctaaccagttagctaagaggtagactgtaaagatctatatagtaaacagctggttatattattagccttgcactaaggttctaaggttctaagcacaaactccaaagtgtctatgcttaaatgatgttgtggaggagagaagacaagaaagagagaagcagccacccctcgtataaggggaaccctccacacaaactacaagaacaaaagaaaatgagaggggctgattggtggcaagtgtattgagactagtgtataagttagttttattttttggatagatgacgtggataaaattggaggtgtgaccaccacctctattataaaacttgccctaagagttagagggtgtgaccagaaaagattgacgtggcaccaataagaattctctcgacactgtggtggaactaatcatcattaattaaacatcctaggtaatgtgctaatcagccattacttgtttcaatcacggccataatactccctcgaacatatttcttttattactaagatcaaataagaattaactagaaccaagagataattaatattaaaatggctcattggatatcagtcgacaattaatttagtatgtagagactataaatatgatcatttgtttttaaaataacaaaaaaatgaaaatacttcacatttttaaatggagggagtaattaacaagttccacgtacgtcctagactcatccaaaagtcagaccatcgtatgccaaatataggcttatgtattggcttaaataaatcagaagatctagctagcttaaattacatgggaaaccggacacaattaatttatagctgctgagattaaattacatgagaaaattttcctcccaaagccaacctcatttactagcattcatggctggtgcatgttactcacacatgtaatttagtgatagggctaattaggctaagctatagatagctcctttttgcaattgcatcctgtgtataaattttcgtaccactgcggcttaccttgtcaattactaacacatagtcatcgatctcgtcttcttctctctctagctacctagctatcttcctcaagctttgcaagcttgacacgcagaagcatatggctcccggcgctgcttcccctaaggcggccaccgtcgccgccgccgccgccgtcttcgccgcgctggtcgtcctgtcctcctccctcgtcgcgccggcggcggcgaagatgttctgcagcaactgcgacgacatctgcaacgcctcgtgcgtcaactccgacaccatcgccaagctgtgcgccccgcagtgcgacggctgctcgccggaggcttgccagagctgcctccaggcgctgaagcaggagtgcttgacgggctgcagcgactactgccacaaaaactgcacttaacaacgtatggagtaacgagaccctgcgtgccagcagccttgtgtattgctacaggttgtaatgttaggattctgtttaataaaaatgaaagtgtttttttttaatttttcagaaacttattgagatttgaggaaatgtaataggaggtagcataagtttgcaatatctttgaacttcggcgctagtgctacctttactggaacagtgaggaactcaaataaaggagtaaatatagtgcaaccggttttccattcctataataacaaggaatggacgtgtagacggagttataaaaccaagaattaattacatgcatgtgtatttaatcacatcgttccaataaaaccggacagtgatccactacatgtcaatgatatgcacacccctaatgttgcacttgaagcattggctcaattcgtcgagacggcttcatttctttctttggttcgtactccgtaaaatctattagggcagtcccaaccctccacctaggatggtgtctatggcattaaatacattgctatgtaggatttttagcttatgtggcactatattaattaagagagagaagagaggaagaaactgggtctcatgcaagacacagcttcaacacgagaagctatgcactagacactgtcaagttttgcattgggagataatagtgtcttcataatagatgaaaaataaatatgattggtagagaagagcgatgatgtatttattaatggcccactttaagaaactatgggttgtagagtgtagtttatattatgatgtcttattgacatggtaccatagacactacttatggacactatgggttgggagactgaccttagggtctgtttggtacagctccaactcctaaatttagctctaagagttgggtctggagtggagttgtggagctgcctaaacccagctccacaactctagttcattttgtgagagagctccacccagctccactcccaattttggtggagctgaaactgtttggttgagctccaacttcagaaggggtggagctgaagctggagctgtgccaaacatacccttagtgttggttcttaaatgtaccagcactgatggccctccctcataaatgcccaaagtttttttttaatttcaatttagggaacctgcactgatgtggcttcccatgtagcactaaaggcatttttgggagcaccgtaggaaaagtccccatagtaaaagttatattaataaaccaaaaataatatctacaacagggttaactaatctaaaagaatttgtctatcatctaatgagaggcgaaaaagaagaaggtaaaggtcttttttaaagaaagacctccaagaactgatctaaaggcttcttctatctttagttactgatgtgtgattaatgattgggtacttctatctgtaatggatcacgcataatggtgaactgttatagggtaattaatgaatcattaacgtttaagaaccataagttcctgctccctctgcatccgaaaaataatactatatttaccttttgatatatattcatatatgtgtcacaaggagtatctttttagatgcagggtccatattaggcctcttaacatcacttcatgtttttttcagattttagccatccaaccaataaatagtactcccttctcctccttattttttctctgtatttattaatggaggatatgatagtctgttgacatatttcttgatatgcctttgattttctaaaacaacagcttttttgggatgagggatcgagtagcctaaacaagccgtgaccaaattaatgtcactagatctggtaattggatgcgtgcattgactagatctggtccttgtttatcttatctaattgattcccaattaaattgcatacaaacgaactaaattaacaagtgtgtttattggatccaactacactggtggagaaatcgtttttagtcccggttcgtaaccctcctatagtcccggtttttaaaccgggactatgaatccgggactaaagatccctatctttagtccccgttcaaatacctaggactaccaaccgggactaaagatgggagtgggcaatagtttttttttcatttatttactatttaatctctaatttattttctcccaaattaggtgggatgcatattcctaaatcaaaccctaaaatcaaagtaccatcccaaatacacaaatcaatcaatcatatacactacagattatacaccccaaatcaaagaatcatcccaaatacacaaatcatgtacatctcagatctatataatgagattccaaaaaagaaattatacatctcaatccatacaatgaattacagattcttcatctcaatctatacatggatcacaaattctttgaaaaaaaaagaaaaaaaaaggaagcaaagctgccagccggctgagccggctgccgcctccccggcccccaccgcgcggccctccgcgccggccgccgccgcgctgccctccgccggccgggccgcccaccccctcctgctgcgcacacgggatcgagttgggaaggggagttgggaagggataagaaggaaaagagataagaggaagggaagaagggatgagataggcttagagatggagggagagaggagtttgtgtgaatgagaaaagagtagatgagaaaagaggataagtaatagggattatatagtgcgttttgatctttacttccggttcgtaactccaaccgggactaaagatcctagaggagcctgacaacacttgacagcatgtgaaccgggactaaagatcacgtagtcccgttctacttataaactaggactaaaaaccttctttagtcccggtttttactgcaaccgagactattgtggtttttgatcgaccgggcaaagatggtttctccactagtgctagtaggacctgtcttgcaagtttttagggttttaccaataaattatttggataattacattattagatagctttggataatcttggagctaggcttgtttagagc

SEQ ID NO: 76476 - DNA, 1931 bp, Oryza sativa
ttagcattcatggtcatgtaatttactgattagggatagctagctactccttccatccctcaaagtaatttcagccagggttggaaattatagaacgaaatcggtcatttcggacccctccgatacgatattatttcggcagaatttttttatttttttattttttttcatgaattttggtaatatttgttcaaattcaactaaactttattcaaaattacggaaatttcagcatttcggcgaggtctgatcaaatcggctaaaccaaaatttccaaacctgattttagcctataacttttacgttaagtatatattgataacaaagacaatttagaaatttgccatgaaatgaaaaataaaattttagtagtttcatgctttaatttctaactaatgccgagtcatcctatatattgtggtggttgatggcggtgtcgcaattgtgaaggatgacgaggaatgagatcaagcgaggaaaacatctatcattgctaccgtctaatagtataggaagacaattttaccacttcaaatttcctactacaataagagaggacaaaataatctaaacgcttatatcacttatactatcagtatataccaccaatatattataacataaaagttctcaaattatctcacattgattgtattttatagtgggttctatagagctctttaataacaagtcgttttttttctccatattaacgaaggacttttatcctccagcttcatttgtgttggttaaaacatttagagacgaagggagcagatagtagcgtcgcgttttctgcctataaatatagtcaacacagtgcatcttccccagtgcaccgcatcggtttggtccattaatccgagcatcaatctcagtctcctcctcgctctccatctatctcagcttcttcctctagctttgcttgacccacacaattagtagtacgctgacaactagcatgccttccggggcaaactctcctacggcggccatcgccgtcgccgccgtcttcgccgtgctagtactgtcctcctccgtcgcgccggccgcggcaaagatgttctgcggcagctgcgatgacatctgcactgcttcgtgcatctacgcagacactatccccagggcgtgcgccccgcagtgcgacggctgctcgccggaggcttgccagagctgccttcaggcgctgaggcaggaatgcttgacgagctgcggcgactcctgccgcaagaactgcacttaattatctatcaacccctgtgatgtacgtcgtctcaacgtgcctgttgtacgtcaagctctagcttctggacttgacacatatatatgtggatgcttctgtttacttgcagatacagaggctagctgttcggatttctatcctttatcttaaaaagatatgcatgcttgtgtatttttcatgctacatgtaagaatgttatgttgagttgtaatccaaatttatttacatttgataaagacctgcttcgccgtagtggagcggaggcccgtgcacctggggacgcccgggggtgcgggggcagagcccccacggtacggatcgtcatcccttttagggttccaccatatatatacctcttgtaagccgccgtgcagcgatgtaacctcaccctagatatagtgaagatattttgctggctagcgcccgtggtttttttctctcctgctttgggagggttttccacgttaaaatctcgtgtcttctgtgattgatctattgttctttatcgtttgtttgcctatcgtttcctaacatgttacactagtatagaaatcatcatagggataacttaaagctcctgatttacttatgatctttctcattctttgaacgtgtctaaaattgaaagctggcatttttatcccttataagtgccggtttattaaaaaaaccggcacaagcataatag

SEQ ID NO: 76477 - DNA, 6257 bp, Oryza sativa
gaatgcccagatcagtaatcagaggaacactttatccaatttagagcagtgaactgttgtaacactggctgcatgaggaccttataaggtattccttctttctcttgctttgacatttattcttcattcaacagtgcaacctagctgtgatcgctaaagataccgcccctgttgatttcttaacccgcagcctgtcccttgccattcccctcctctacgtgagctaacctggtgcactcattcttctctaactaggatacctctcgatggcagcagtgctatctccactgatcgtggtccaggatgtagaggtgggtatgtattcgttgatactctactgattagaatttgacgaaccactgtcattcaatctgctgacacatattgcagttaatgtctgttcttcctgcctgtataaacactgtttgatgcatgtagaaatgtgtaccttgcaatgtcatgcatggatcaaaatcagacagctcaagataaggtattacaagcacacttaattgaacaaattcgacatgctgcactttgattgacaattttgagggcaacaccaatcttgatttgagtgaaaacttgctttatgtttctatttgttccatttctgtcttttcacatgcaagtgcaaccttatttttttatgagacgttgctgtacaagattaccagcattttcttcccaatgaacaatacagaatgttgtttcttattaatggttctatccagcaatccagtcttctataggttgtcctgtttttgagcagtattcaggagggcagatccctcccttgaatttggaagtgactagtatattcaatgcgtgcgcatatgcaatgctctttgcaggcacacaacattattttagcttcattgaattctgacatttgctgttttggcaaatagttatgaacctctcaacaccagtctgtgttttgtaggtaccctactttgaatatgctcacttgcttgtaatttgcagtataattgattaaagttcctcctgaagtaacttccatcaatctattcgcgcagttaatatgtgtacgcatgatcaagtttcagtattgctatttgtatcacagttattctttatgggttggttttatttactttgcttcacttacaagactgctcagagattataagcaaagctgtgtctttgtaatatgtgggggtagaccattccttctttaggaaattcctgatgctgattccctgtactggaatctgatagtagaaattttttaagaaatttttttatgctgattccctgtactgtaatctgatagtagaaattttagcactgagccactgactggcgttttaataatcgcagagctcacactgaagtctgccctcatgctctggtcttaatttgtcatattactgatgaaagtcttaggaaatggtatgagcaacaaatgaaccacatagttcttttctattgttgtatggcttgataggtataagtaaagtacctttgttgttgcttgattccttgcaatacatcaactgtaaactatgtgttgaaccaaagttgcaaagttttgctgctattcttgctacttaatcttcgtttctgtgtctgttcagaaggaagcccatgacttgaactgaaaaggtaacgttacaaaagaattagtacaaggccgaaagcaacaggaagggtctccaactgaagagaatagaaaaaaaaaatccagaggagaccatggcagataacagagaggttcaaagcctttgcattgctctatctcaaagaccccgaaccatcctcagttccatttaaaacgtgcttaatagaaaggtaatgtttcagtaaaaaataaaaactaacgttaaagcttgggttacagtacgattacgtcttgatgcaaacttgcaaagtgagagtctgcttccttgataaaaacaaattcctgaagacttggtggtttgttgtttttctacaatattgctttgagttcttgctaaactatagctgtgtaatgtaatgatgtagctaagtttcagattctgtggttcattagtatgcagagatataagcgtgatatttaccaattttctagctctcataatgggttccatgttcaagtttactagtgtttcagtaaagcctaagtggaatcttgataatctctgaatagagaattttgatttttttaaaaaaggatttaaaattctgctaagtacttaagtaccatgccgaactggtacatgctatttgtattttacttatgatctttgtcaatttctaagattctaatcatggatacgacttgtctaggccacgtgtgattcataatggtgactggtgggcgtcttctatggctgcagcactcttggaattcaacttggtaattggtgtgaatcatcaaatatattgttacatggttccgaagttctaggacggtgttgcataattgcagcatattgttattatattaatcattctaagatgatgttttcgcttcaatataccatgtaaggtattcaattttgtgacatagccgtgaaagtttctacctatccatcatttctcaatgaaacgtatgtaatgtatattttgaactcatcatatgggattctgaaatctgaaataagaacgtaactgtgttggctcgaggattcactgaattaacagagttaggctccacaagctttaaacttcaacttgtccatgctttaaactgctttgcacccactgaacttttcaagtgtagcacattttacatataacttattgagcaaagaatgaatgtaattcttggtaataacaaatatcagtttccatttcattgtctgcctagtgctgcctgtatatatctgtgatgaaatatttttacagcgaggagaaatgtggaaatatgtctttccccttcctgcagcattgcaaccatggagtgaagagagcgctggctggttgagtggtggtgaggaagcatccggcattatttcatcctaagagcaatgtagtaaacatgggtcatccaagaacatgggctagcctccacatctgttgccactgtacactttacaattagagcttctttatggtttcttccactgcgcgttcataatacctcattctctgtgtagctttcactgcacggtcgaaatccctcctttcaaatgcttcctggaaggaatgggaccaggtttccagctttctcttaatctgataaaggtgatatagtgcgagcctagaaatcagtcaagcgtatttatgcttcgaaataacaaccatgacataattgtgcttaacagaacctgagattgtatcttctccagggtttgagaatcattggcatcattaactgcttcacgtatctccatcatctgcaaattatgtagaaatatagctttgtttcttcaaattgatcttgaattgaaatatacatgtcatcgcaattactattacttctgtgtgaagttattgacacaagcgtcatggaaatatataaactagtgattaagtggctgcatcagaaccacagaaaaaaagattcaaacaggttacctccataagaagttcaggatcagtgatagtcttttcttcatcaatgggtatcccctctagttggagctgcagaatggttttatatggttgagaagcaatttaaaagatgatgtagatggatgcttacatagatgttccatgtaaaaaaggtcatatgtttacaggtcaagtatattttttatattattttgagtggagatggagatggtttagcctcatataatcataacctaatatgggttaaaatgagatgaaataggctgtattttttaagtattactggaagaacttaccaagtataatgcccttgacaaaggtttgctcagtgtgcggtatgcatcaattacaagtgctgattgctcagcagcaaaggctctctctttctacacaaaacagaagccaagtcacaaattgttttgaagacaaaggtacgaatactatagattggtaagaatgccagggcctagggagagacctcagatttagaatgaactaggtcaggatgtaacttcttctgccagtctttgtatttcccttctaaattgttatcctttatggtgtattccctttctctgccaaagtaatgaagtaaattattgatgtatgattaaggcatagaaaatattgacagaaacttatgcaattgtagaaaattttgaaaatattattttaagagtaaaattcataacgtgattaccatgatggtaccactgtatttatcatgaagcagatcattggaacaaattgtgaatttgccatatcattacaggagaggtcaaacacttagggtggacaaaatatacagtgtggatacaagactatccaactgaaacgctcacgagttttctgaaggggagatttggaaatttaataaattataagcattaagcaaataggtagaaaatcacgaaaccatcaccaaacaaactacttgcgttattacctaaacagccaacatggaaatgaatagaagggaacttatcacttatcagcataataaactatgcagacatattcccccaggtaggattggtggatagagcaagttggaatatgaacttcgaactatatccagctaatcccaattccacctcccaataattcttttttttaatattacagatcagtgcatcaacaatcaaacattatactaacataattgcattgccctagaaatttccctaaaatgacaacatgttttggccaacctaagagtcgcatcaaaatgcacatatcttgtaacaatcattgcaaattaccagtcctattatcgcaatcacatcaaaattgccagtaggataattttcgtcctaaccataaaagctaaagctggtgtccagtttccctttctgcataacccatcaagctacgaacacttatttgcgctgcagatgatacaaagaaggcccaagaacatagaaaccgtccttgtacaagtagcatttcagcattgcaatacataatgcctacgagctgagcagttatgacgatcactgcacaatccaattatacccaaaatacactagaattcgaaagagacgacacgattcattcacaaacaaaagacaataatgagccaattagcatctgattaagtggggatgctactcacaggccaaagatccggaaataatcgacggcggggtcgacgggctgcacgctgccgcaggacccgcatgagaggaacgcgccgctcgcgccgcagctccagcactcgcctccccctgcccggtccgagaggctccgggaggaggaggaggagccccgagcgaaggctgcgagatcgcgggtggtggtggtagaggcggaggaggaggaggaggaggagggcacggtggggacagggggaagcgggttcctcctcctggcgccgcggccagcggctccggccgccgccgcgaggtggaggcggagctgcccgggtcggcgccacatgtggggctttctgcggcgggggcgcctctgtgcggatgcgggtaagtccggcgagcggcggcggcggcggcggcgcggagagaagggggggatatgcggttgagttgagagccaagtattttgtgtgggtttcggtggttgacaggtggggcccctggtagctttctcccgtgaaaaactagtgcggaggtgtgttggttttaatggctttggtttagatcccatcatggcttatgtggacgttaagagcaagtccaataatataaccaattgttggttctaaatcatttatatctaatctaatactctagtcatcctatctttctataaagttatcccccactaacttcttaagcttgacatgcaaagatgccacatcatcatctactaacaagataccatatcattatccactaattaacaagatgacacatcatcatccactaacaatcatcatatttaaacatcatgcaaacatactatatctttatagtttttataatttaagagttttttaaatacaaacatattaaattatcatccaatataattcacataatgtttcaatgtatatctttattatgttttatgatatcctatatacttatatagttcatccttagtttgtgcttaaataattaatctatggtccaaattatttttctccttttttttctctaattaagtcatatcacatcaattatttttagcctttagataattaatctacggtccaaactatctccctactactagcttactttttacatttgaatcaccattctacatactat

SEQ ID NO: 76478 - DNA, 3951 bp, Oryza sativa
tattgtttctataaaaatatttattgaaaagtgatatatgtatacttttatgaaagtatttttcaagacaaatctattcatataatttttacattttcaaactcaataacttgagagttatttatgatttatattcccaaggtttgacttaaacattatccataaaggaatagaaacaataggtcaaagttgtgttttgaagaccgtgttgctgtccaaaacgacttcctttatgattactactccattaatactctgtcctacctctaatatacacataacgtcttagagtctgtgttacagccggctacaaatctgtagctcgcttttttctcactcttctcttttcttctcgatatgtggttatagttggtttatagcttgctattgtacctgctctatgcaagtactactagtactatctgctcggaacttggtagattctctctttttcaagtttctttttgtaagtttacatgtaattttgacaagtttattacgatactcgaaatctatgtaagagcagagattaataaatgatgcgctaccatagatcatggttgagatgataacaacatttttcgtatgaccataacaggataatgtttacaacaaaaaataatactgatattattaagcttgatatggccatacagcgaagcttgaaattgaaattaattaagcacaaggtggtacaatgatattagtgtgctaacccaagataatgtctattgataaaaaggaaaatagccaaaacaatgtagcttgcagatcaaaagcggacaaattggataagtctagtgtttgatcatgccatacgctagttgaattctagtggacactactaaattaccgacaagttgaaacgacgctgctactgatacggataatcaatatttatcatggatataaaataaaacgagagaacatgaactgagcataactttttttatagtcaaatctacacatttagattcaaattcttaaacagtacgggtgttcgtatttttttgctaattattattcatgtggaaggtcacaagaataaaatgtctagtgataaaataaccagtttctttagacataggagtgatttatgccagacattttgactagaccttaacataaacataattagaaatggaactttactacaatgccaaagcaccacgggctttgacgctgaggcccaacaccttaacaccgtggaatatactacgaaaacaataataggcacaaatgcgggggggctcctagttagcgcagacgcgccagataattttgtagcgcgcacttccgtaacttcctcctgtttcgtcgttttgtatatttttctgttccgcatcgcttcaggggaggttaagcgtgtgggtccactacagccacgcgtcattagcactaataacaacgctaaccatatggattaatctagttatagtttttattatcaaaataatacataaatagttaagttgaaagtttcgaaaatatgatgaaaattttcaaaatctgagttgaaagttttaaaaaaaaatcttgaaagtttcaatttcgagttgacagttttgaaatttgagttggaagctttcaaactcgagttggaagttatcaaatttaggttgaaagttttcaaatttgggttgaaagttttcaaatttgacttgaaagttttcaaattttgagttgaaagtcttcaaattcgggtcgaaagtcttcaaaactcgagatgaaagttttcgaaattgatttaaaagtttaaattttgagttaaaagtttttaaattttaaattgaaagtttaaattttgagttgttttaaattatggttgtgacttttaatttttcatctataaaaagttttaaatttcacgtatatattttaaatctttagttaaaaaatacaacctcatgaaaaaaaaggaaagattaattaaaaaacataattatcggaaactaattccgtcaactaatataatcttgattattttctccgaatctagcgcacttgagcacgcttcccggtgttccctcgcgcaaaaaacagaaatagaagtaggccgaagagaaatcacgtacgaggacatgggcctaaaacgcacgctagatggctagttagcgcgtctgcgctaattaggaaattcgcaaatgcaggttatagcatgcgtactgcagtgataaatggtgtctgtattatcttggagatcaatgtttgaatctttatcgctgcaatattgtttcctttttctttcgaagtgctgaagaaaaaagaaaacaagacggaacagattcctaagtggcaaaaaaacaacgataacgcagattctgaagtggcgaaaaaaaacaagatagtggaagtgggtttggacctagcaccttcacaccttatttagaaacaatgatagtgggcctcaacaccatgacccatgacgctgagatagaaatctatttttggtttataattttttagtttgtgtattactcgatgccaaaatatatgatgctaaggattcgtttggagagtttaaagattttaagaagctgctggttgatacccaacttctgataatatgcaaaaaattgagttcaacttctgacttctagcttatatgaatgaaaaacttaattattttgggagttttcgattcagggaaaaaatagagttttccaaagctttttcaaacaggctctaagcttctaatttcaacatcaagggtaggggtggatactgacatgactcggctcggtctactcgttaggataacgagccgaatcctaactcggctcgactggcaactctagctagcttgtttagctcgcgagccaatacatccgtgactcaatagaaatctctcacttcgagattctggctgccaacaattttttttgcaattgcttaagaaatcaaacaaccgacaaatcacaaagacttggcacaaatttttttttacacattgcatccataaaaacagatctgaaagtctcgtcatattggaaccaaacaaaacaccaagcaaacaccctagtgaatcctagaccaaccaaaattaacatgggagattgacttgccgaagtgccgaactgccgacggcgacgaggacggcaagattgaacttttgctccttgatttataacttgtagcgctgtcgatggagttgcatgctcttgcatcctgcagcaggggaccttcaccctgcttgttcgtcttcctcacgacgacgagactgagacaaggccacgcttgccacggagttggccgaccggctggagcggcgacgagaggaagcgcggcaccgtgagctcacaaaccacgctgttgctgccccctagaggctggtggtgacggccaggtcgtcgacgatgccggcgtgagggcttgggcgacactatggcgatgtgatactggacagaaacagcgtgcgctgtagattggggaatggggaaatcaatcgatctatttgatataactagggtttagtggaaatcagtggatctgatgggccttaggcctacaaataacaatgcgatccacctcagcactcctgggctgctttgtttttccatggctcatttagctcgcgagccagcttgagctcgctcgttatagcaaacgagctaaccctggcttagcccgttaataaatacaaacgagccgagtcgagttagtcacgagctatgagctttttggtatatttttgttatagtttttagggttaattggatccatgccactgtaaatgtggcaaattagaaaaataccactactatttgttttattggctaggtgccactacaaatttttaaaattgaaaccatgccactccgtcactatttctgtcgttctctctcacgtcgtcatcctctaatctcacgtaggcacggcgagggcaagaagacgaggcggccgccggcgaggacgtcgcgagcgcggggagcggctgcggccacgcccggc

SEQ ID NO: 76479 - DNA, 1222 bp, Oryza sativa
ttgtgcagtttggtgcaatcatttcgcataggccaaaccaactctaaatctctgtagtcgattaatttagtagcttcaatcaatgtagatcggcatgttgcgttgcatatggactcttagctatgttactatgtagtagctgttgtttattttgtccgttcttccgacgattgggggatgacggcgtaatcgatgctttcatacaaagtggcgattgtcggttcacgtgttgttagtgactgctggcaaacttacaaagtttcctgttgtttgtatacacagaagatgacattccggaagaagaagaagagggcaccggaaccgtggctaatgtaagctggctctgtaaatgcatattgtaaatttgcgtattccacgttgtacttgtcggataataacctactagttatcatggttagatgtttgctatgcttttttaagcactataagtttatatagaaattaaaacattgacttctattttaagccggtagaatttaacctctttcacttgaaatatatggtcgttattattcttgcaagatttattaattgatacttctttgaatggataataagataacatgtgtaaccatatgaagtcttcttaagttacacacttacatttttgtccagtgccagtgctacttattttaccttgataccctattgaatcttccatatgatcaagttcctaaacacatgttgctttatatgtggaatctgtccattgtcaatcctcagaattctgccaaagatggagatgacattcttagaaggtctgatagctatgacgttatggatcttgaagaactattgaaacagaggacattcacgaggcaagtacctgtttttgtataacattaataggctcatgtttagcaagtaatttgagcagtattagatttgttgctagcatttcagtaactggtaggcataggtaccgccgatatatcttttaattgcataataccccaaatacagcatacacctaaggaactgaacttgatctgcaatgatggggtacatccatgaagttcataacacagcatcacactattaccatgaaatgatttgtactaataataatttctatgtgaccaagaaaatataaaccatgaggctatagaaaacatgggtttccctaactggtttttctttttttaggagaaaaagaagtgtacttcagttctaaagctgggaactaagaaatggacagttg

SEQ ID NO: 76480 - DNA, 12895 bp, Oryza sativa
agttcaatcctcatttatcctttaatacttccatgcttctgtatgagttgaagtgcaatgccatgttttctttgctagatcctattgttgtgaatacctgttttgcctattgcattgtaacttgcaaatttgttttgctaatgtccaagtgtacagtagaaatgcgaaaacatatttctatcttacaaataattttctgtcttgcaggagtgaatttgaatatttgtctgagttgttgttatctagaacggttgggtccaaattattgattccaggagttggtaatatgaagaaaatgcattttcctgagaaggcaagtcgatctggagacttacctgttgatttctcctttagaacattcaacacttctgttaatacgcaagtcatgttgctcactaaatattcctgttcatatgatgaaattgatttcttttacaatcacccatactgtactgtacagaacataatttaaagtgttgaagcaacaatataatttcttatttttaagatactagaaaaaatgcccgtgcgttgcaatgggtaaatgctattttaattttattgttgttatatggtttagctagggtaaaattcactgtgggaattcgcttggatatttttttttgaaaatcataagctgcaagagtccgtatatcatctcaagttagcatgcgagtttttttaatgatatttcttatacgactccttctgtatttccaaaagcaaatgagcttaaaatccaactcaaacacggatctgtatttctaaaagtgaacgaacttaaaaaccgactcaaacccggatgacataccaaaataccggcaaaaacatcttcaatttttataatagtagagatatggcatattgttgagttaaaacccttgaccagcagaatagtttgttatttttttttcgaagttgaggaaagcatatcataggtcccccttattccctaaatttttgcaggtcacttgggtctctggatttgagtgggtacataaaattgtataagtgggtcaacaaagtcatcctacttttttttttggtatacttgtataagtggtctgtagttgcttattaggcatggtttaaacctgtacttatgcacatacacatgtttaggggcctatatgtgcaattttcgactttagaaacccaacttttagtagtccctggtacacatacttcttttttctattcctacatgagtttcacttgcgattctatctacatttgccacaaaatagcaaagctcgtaccatgaactattttatctcctgacacatttgttgtttataccattgatatgccatatgttccgtgactacaagggtaacataatctcatgctattcattcctgcaggatcaagttgcttcacctgcagaacttgcaaaggcatacatgggttcaagatcttctaagggatcaccattacgtcttagattgcatgacccctctgtactttccaaatcgatagaagctaatacaacacaaataacgaggcctcccaccctctctctgctcgcgagtgcaagaaatcatgctccaaccacctctgatcgtcttgggagcaactacacgacaccaaatagatcagcaatatacaaaatgtcatcatctccttattttaaggttctgttatttcctacttcatttaatgtctaattactttatgcccgcagtatttctgttatgtatttgcacaaagagcacaatagtacatcagatcttgcatatttgttaaatagaaaaattgaataggtagccacagactacttgagaaactcaaagagacaactaaaaatgtattacaccttaatcaatctgtttagtgcagcatggcaatcatcaagttaccttgattcaagtattatgttaccacgctgttgcagttgctctctctgaatttcattagtagaaaataaaccttccatacattattttcttatttggcctcttaaaatcacaatttaacatggaaaggtccaaggtgaccaagttgtcgtatgtatatctagtatatgagttaaatttaattagtgtgtgtgaacaatgccaaatgtgtcttttagcgaacaaatatcagtttatttgttttaagcaatattagaaattttataattgttctttttctatcgaaaacatgtgcaattagctagtgctctacatactgccttattttattctcattcttgagcacaataccctatctctgttactatgtggttacatctctaactcaagttcctcaatctgttcagagtgctgtttcttccagggatttgtttggtactgtatctccatatcaggctccaagcagccttcatacatttggaaggcaggtattaatcacgaaacataatcttattttgctgtaaatttgttttgggtttattaccggcttctggatttatgttgaactgctactgcatgacttttatcttggcttctttgtttgattagtgaatgatttatgacatgaaatgtttggaccttcaatattgatcactgattgactcaccacataattttgttgctttaaagtacacgatacaatgttaattgcagatttttttgatcggatgctgcctattttatgcgtaaaacacaagctattattttgaaatctaaagataaactagacgactctggaatatgttttcttgaaccctctttaatcatggtaaattggtaatagtagttggcaattagtggtgtacctagaagttttctagacttgggcaaaaacaacttcagctagcatctggcgtcatcaagcgctagtggtatgacatgccctccattttgctgtgtgatggtgaggcctggtgtccctacaagtgtcttcaggccctgcatccaccactgtttgcactgtttaccttaaacttcttcaggccctgcatttacactgtttgcactaccttaaggttttaccctactattgtagttaccgaatgcataaatatagcaaacactaatttccaggatgtgatttacagtttatatattgctagcagttagtgacacagtatttggacaatatatattttatgttaaatgaccaatagtgcataacattgtttaaatgcctaataattattttgaattggatacctgtgcaaattttcatggttacataatttacttgtgggctacagtccacttaatgttctttgctgctgtcctacctgcttagatttgatgctaccttgtatgtaacatttactgttaataatgaatcaacaggttctgaagaggaagagtgctgctctcaataacgagagtgcctctgttggtcccatacgcaaaatgcatcagaggtacaacagagtgtcaccactgttgcaaactcggtcaggccaccgtggatatagtggtagtcatgctagcaaacttgatgaaggtttggaacactcagtacaaagtcaaaaacgtaggtgtctggataaagttggtgatattactcgaagtggtgtacatgacagagcaaatgatagcagttttggtcaggcaccagcacagtcaattcaaatggctgcaaagatattgaagcagcttgatacgataattccttcacagaaggaaggcacattagcaacaaggcaaaagcatgtggacatcttagatgttgaggatcctatttctcagaaaactgaagtatcagcacagggcagtcttttgaaaccatcttcgtcacgagttaaggagtctttacctaataactccaactgcgctgctaaatttacctccgccgcaaaagacagcaatactgttgatgctacatctgacaaatcagctaaattgatgcccaaggtaatgtttggatggcacctttttcctcctagggtacataatattttatcaacatactgacattttctttattgtaggattggttggagatggataactgtaggggaagtacaaagttgtcactcaaccaaggaaatgataaaactgagagaaagcaatcaccaatcccagagaataatgatatgagttctggaataataaacaaggagaaacctccaacattgcctttgagaagtcatgctccttcaaatctagtattatccagtgaaattgaccgaaacaaaatcctagcatcatcaaatggcttttcattcccggttccggctgctctgactggccattctcaggcccctccaacacctactttggcatctccacctgtactatctgttgagaagcagcagctgtctgcatcatctagtgcaccagttacttcagtggaaagtattccaaggttagtttctgatcggttgtttgaactgatgtagttacagtcaaaagcatagttttaaatttgaagtacctttgcaatgaaaatgggcaatggttaccaagtaggttaacacataagtacttatgttatcattttatagtgttttttgacttgattgtcgttttatagttgagatatggtagtctgacacatgccaattatgcttcagtttccaatttatgaggatactcacttatttccagcacattaatctgacatgtctttttctccagggttttcaaaccagtttcagaagaagcctcagtttctaaccaacgtgatacaaagtcgaatacagataaaccaccaatttctcaaagctctgggcaaattgtttctttcactagtaatccagtatttaacgtcatctcctcaaaaccaacaaccttaagcaatggcctggcagatacaacaaaatctgcttctgctgctgtatttccttccaatggatcaaccaagtcagtttgttctacaaatgctggctcttcaacaccttcgttcccaaagttctcatttcagcctggattccgaacatcaacctcttcagtgcaatctagcggtattcaagagcctgctataacagctccattcagcactgtgagtagtttagctgggggcagttcatcgccatcctcaatgatatttgctggtgctacttctcaatctagttccatcaccaccagtggcagtgttcccttccaattctcttctcaatctagcagtgaaagttcattagctggccaagacaaatccaaggcagcaagcagcagtgccccttttagtttctctccacagtttggcagtacaagtccgtttgcaggccagggcaaatccaattcagtctcctctcagtctactttgctgtctggaagccaatttagcaattcactatctgcacagacttcaacaagcaattcaaacctattatcttcagaaaaagtaaatcctgggagctcgccaagctttgcatttggttcatcagcaccaggctcaagccctgtgttttcgttagcagttggttctggcactacttctgcaacacctgcttcagcatcttcaccaattttttgcaaccgtttaactagcacaaatgctccaccttttggctcccctgccacttcaccttttagctcaacctcgagccctgtattctcatttacctcagctacgcctacgataccaaatgcatcacctacaacaccactttttggtacaccgagcccgactgttggtttaagtacaggaactgatcagatgaatggaggtcagatggctggggacaagaacccgtttgctttttcagcagcttcaccctttggtcttccaagcagttcaccatccactccaactctgtttagtacgccagcaactcagtttgcttcagctacatccgcttcaccgggcatgttccaatttggccagcatagtcaatcatccccaggtggcttctcaataggcactactggtggcaacagtgaaaagtctgcaagaagaattctaaaagttaagcgaaagaaataagtcacttcgtcctctgtcaaggacaaggatcatgagaacttattacagcctgcattgcaaattgctctggtttttcagggctgaggcgatcggcaaacagaaattcacatttcttcattttataccaggagtgtttgcctgagctggcaaagatgccagtgttttcttttggctgatccgaattttggcacatgagctatggaggtacccaatggactgttttttgaactgaatttttgtatgatttatcctctcatgaaccattgcgaatttgttaaaatttgaatgtcatctgttcttacaaacctggcattgattctgtgtacctcttctactctattctcccatatcgatatatggtcgaacgggtacaatttcatttactctatgccactacatggtcgcatcatatagacgaaggattcctattcgtgttcagatggaaattggattgtagggacaagttatgaagatgaagcattctcgtgtaccatctcatgtatttaggttttaactttttgtttatttcctgtcattcagaattgattttggctcacggcacgagcacgatggcagaaacaccaggaaaaaattgttgaggtgggagtaattgtttccttttgaaagtacgcacatctcaagatatatacgtgtcaaaggtaggtacataggccagatagtggacagacgtacttctgatcgagtacatatacatccagttccatcctctaacaaatctcgtccttagactccgttagattctctaacaagatgaatattaagtgtagcaaaagtgaattttaattattaaaaacttgaaaaatagatttaattgattttttatagtaatttctatgtagaaagttttcgcacgatacaccgtttagcagtttgaaaaacgtgctaacggaaattgaggaaaaatctataccttgttggagtttagtactcaacaattaatcttctgagtaatatcacatatactgagatgagattttgaaccatggtcaaaatacatctaccacaggcataattcttgcttctacccaaatacaaagcatgaaacgtaagttcattaaatcagatgttttctgatccttagatctattcatccaacggctcatactaagagttggatctgccctgcaattagcgatctcccacgtcttagcagcggttagggatcgatcaaagcgaaaaagaaaacgaaaaaagtttcttcgctcgccagcccgccgccgaccgcctcctgccgaagccgctcgccgcctcctcgcgtagtcgcgcgccctacctcgccgcctccttgcacgcaccgggctccgccgccgactccgggcgcgcgcccgccggagccgctcgcgggttcactggcagaaaagcacgcacgcaatttgtaaccccgccgccgtcgcatgccatcctccgcacgtcgctgcgccccccgtccccctccaccgctgacttcgccccatggtgcggccgctacaagccgctgcagccccgtcgctcctcctctgttccctcgcacatcgttgcgcccggcgcccctgtcccctccgccaccgacttcgccccgcagcatggccgctccaatccgccatacctgccccgcgtcatttgtcgtccacgcttccaccagttcggccatatccgacctccagcctcgccagattggcgccgccgccgaccctaagctcgtcgtcgagcattcaccgtcgccccatctgccccgtgccgatccatccctagcgccgtcgccgattcaccgccaccaggtcacgtccatcgtcttcttgatttgctccttccgcttcttatttgtcctttcttttgtatttgatcagaaacggcaatgaattttattttaacacagagagagagagggggtgggacgggggaggggaattgattgaaaaactgaaaactggagtttgttctttagctaggcaccaaagatttctgagagtataattcaccttggccatgtacagggcatcacatttcacatttgtaatgttgatgggaaagctacagataggggcagagagtaactggagaaaatagaaatagaaatgagtagcgatgttactagtgtacatactttatgcaagtcaatgaggatcaagagaaggagaaggtggcggtatcctagctaactggtcgtctcgtggaggtaaaaaaaaattctttgattccagcgaacctatggctatgtttcgttgataacttctaaagatcttcctgttgttcatcctgctatatatggtgttcttttaagtctttcctccaatcgcctccttatgttctactccctccatttcacaatttaagtcattctagcatttcccacattcatattaatgctaataaatctaaatagatgtatatgtctatattctttaccatcaatatgaatgtgggaaatgctagaatgacttatggtgaaacggagggagtattataccagtggtgccgtacctatggctatgatgtgcagtccatatatagaatcaatcactgaaaaaaatgagtttagataagtcacagccattaggactatattaaattagtgatgaataatgtatttgcacattttgcagaatcatggcagtaattacatggtcaggttgtgacaaaaaaaatcagagatacctatgctcacgttttgatcaatgaaccagttgtagacattctcagattttggcaaaaatgcacaaatacactacaaactcaatacacattctttgaatttctgagtacagacagcgaacacattcagaatttcagattgcttcatcagtcatcacagagcacacaaattcagaaaagccctgttgtgagaaatgatgattatcgacacttcttgtgtcttaaggtagctctccagcctctagccacttgatggtatccaaaacaataagatttgcgggctaatcaagtagcaacaaatcagtaccctgaacaatcaatttaagaatgtaaatgcacacaaaaaacagaaaatttcaattcgatcactaggataaattcaaaaatccagacccaattcataaaatgatatagttggtacgaaaataatatatcttcaaacgatatagctagctcttgtcatgattctgatggtcatttaaaatatctatttgtcaagattttacaagtgaacaggatcaatggcttaggttgctttcctttgaatgtagatgcgcgtgctggcatgatatttagaaaataggttttcccttgaatgcacattttattagttaatttaaatgaacaaaatctttatgtattttttcattactttcgagagaagaggacactaacaaaggccaatatagaggtaactttctgatctttatatacaatggtgatcctggcggtggctatcctacccatgacgaggctacccaggtttttgcttgactccctgattgattcagattcttgttgccaaaccattctccttcggggtatcagggctactccagcgaggagcagcagccaccttactactaccttgctgtcgcacaatttctgttcatctgtttactggaagttatgctaattgactaaaactgtgatggtactacacactgacttgacaattgacatatgtattgcctacaatgatggtttattggtgatcatcttcctttttatcatgatcttgtttattatttttgtttatggagtaacaaatggattttgtcgttgtcaaggtagataagagggacatcatggcattgcagggtaagaaagcataggcaccaagcaaaatcagagtttagttacgtttgtcaatgaatgttaattcgtatttatatgccttgatgacctgcttctacagagatgggattaacccatgatgcatatgttctattgaataagaactgcatggtctattatgtttatttatgattaaatatgcttatttttcttcagagcaacatctaaccaactatgtataatctaagaaattgagacatatccctattgtttcaaatttcaaagagtgctatgttaatttccttttcttagattagtacattctaacctttatttgtctgcacataccaacaattcttcttgcattaatgtatagttcttaaattgacataagctttatattatgagtattacacattaaagaaagcatcttatatcagaccatactcaggcttttatgttaatttcttaaatgcaaattaatatggtgtttggttattcaaaagaaaatggaacaatgaaaacaaacgtggattttttcacaagaatttcttttttctatcgaagtgtcattgtcgtgctgttatgagaggaaatacttctctctgaatttattgatcatggcaaatggacatgtgaaattttcgtatgaatgaaacaacagaattatatttttattttacataccacctgtgatgctccacttgtgataatctagattttctatttattttatttttattctcacattgtcattgaaatgatattgtttttgatttacatatatgcacatgattcctcacttcacttccatgcccccaggtcgctacacccatcgccgccgttgccagtccggatgccccagtgaggctggtgccctcgaatgacaccacaagcaagtataatacttcatccattttcttaaacatgctctctatttgtaattcccactcatggaaaggctgctcaaggtcaagaaaatgtaacccgtgaagagactaatgcttctatagtcacacaaacctgtccaggaactaggataggtaccatgtttgtttccataaattgtggatataaactctgttaggtatcatgtttgttctgtagtaggtgctcgatggaatcccccagtgaggaaatttgttttttgttctgtaccagagaaaaggcagcgaggagatctgtgagtgaaaaaaaataacagttcaatgtccaggccactgttaacgatcaaatttggtaagccatgaactagattcggcatcgggatcgaagcggatttgatagggaattgtcttctggaaacagagtacgcatcggctacgagggcattggctgaagactgcatcggctaaatcagacagaagacagccgatgtagctgatctcgttaaggtggttatataatcgtctccgagattgatcaacgtgctgtgcaaggattaccatgattgagataagcacacggatagacaattgtatctattaattaggatattttaaaaagtttatttagacatatgcttcggcaagagtctatcgtgaagacttgttcgtatcttagagtttgttagagataagagtcgtgttcggcaaggaccagtcatgtatctcgggtataaatataacccgatcccatgtaaacatctaacgacagtttaataacactttcggcgcatcgccacctttttctattttcattgtttcgacgagttcttgcttttgggttgagctgcatcaatttcgatcttcaacaagaggtaaaacttgtcatgacgacttgtgttctcgggattagtgcttacatctttatgacactctaatcttggttatgtaaatcattgagttatcatatatgcttcataatatttattaatatcataatctaaccctaaaccggccaacatctatcattggaaggcagctgatagagttagatatcgttgttaatctagattatatagcatatctaccatctttcagaggttttcatcaacctgtttagatcttgtatttatttttatgcttaatgctgcatcggttgagtttgatctattaagtaatattcataattgcaatatctagcttgtcttatgatcatcaatagatatagtatcggggtttcagccgatcttacctgatttagttacctttaatgcttacatgttcacttgatatgctaaatctgtcctttatattaagatcttattgcattaaagtatattagacttgtcgtttgatatattttgtctgttttaatatcttaataaagagtgatatcagagtattagtcgatacatgttagatctatttgatcggctatgctatgaacgtatatataatcttcatcttaaagtacctttaagcataagtgatttatattgtctcgacttactgttcgatctatcccaatcacttggcttaaatatatctcgagaagaggattatatatcgttgatatctatagccaatcgagtagatttaactttatattgctttattcttcattgtcgatctaatgccagtaacatcggttcaatgattaacgatatgccatcggcccttagccgatcggttatcgtttatggatttaacctcgtctttcttgtttttccttcttgttgattgcaagatcaaatcaactggcacgcctttgaacccaagagcaagatttaggacatgcactggagttaagcagatctcccaggccagtgtgtgttttttcgcatcaacagccacccctttatatttacaagttgtaacttcctcttttgattgcattcagttgactctgcaaagtactgcatcactaacgtctgtataaacctaaagttgcattcaagtgtagtgtttttgaacttgttgtggtctatgagctttattctgaaggattatactgatgacgatatattggtgtgctttggatcaggaaggctgtctcatcctactggtcagtcaaggggaatctaattggtagtataaatatcagagaattaggtgatgatcaggttcaacatcacagattcagatattctcactttctgtgttctttaaccagtggcacaatgtgtgctatcaatgtaattaaaatatggatttctatatatgtattgctctttggattatttcagcatttcaacgagttcttaatagacctttttttttcatctgtgcatgcaagaggaggcaacctacttgggatggtggcacctctagccataggtttggaggagggcaacaagcagatgcaccaaagggagctcaaatatgaggaattatgtggcaaaaatgagcttgttggagaggaatctttgtagatatgacataagttcaga

SEQ ID NO: 76481 - DNA, 5299 bp, Oryza sativa
ttgggattccatagaaaggaaatgtatttaacttctcaagaatatattggcaaatataatggtgtttaacttctgttgtatgaattgtacatgcactaaaaagcatataaatctgctctcttatgtgtggcttcccaagtttgataaattgcccaatttgttctgtaactgcaagatgccatgatccagttttacatttatttttctatacgtatgctgatattttgtaggtaaatctagatcattttattgtgtttatttttcctaaaaacacgaggaatcgtgatgatcataaagacaatagcatcgtacaagcctaaagcaaatgttgatattgacattttcccttttgaaaaaaaaatcataagttatgtatatttgtgacattttcaagaactagaatgtgcataaggatttgctagaggcagcaacaagatacctttttttgaagtataggacactgaatttaacaaggtgaaagcccataaggatcaaatctgattttgttttccttgtgttgtttatgaaagaaatcttatataatctggtatgatcaaatgagagtataggacactgaatttgacaaggtgaaagcccataaggatcaaatctgatttcttttcccttgtgttgtttttgaaagaaatcctacatgcttttagttcacatatctagctagggatctcacatgtatccaatagtcatgaaacattaatttgttggttgcagattgctaaggtgacagcattgttttacaattacatttttttaatagaagggataagttattttgtaactatcacttaataattgatatgtttctatttgcaataatatatattacgataacgtgtctttgcacgtgcacgttcactagtttaataaaaaagataagagaacgcacgtactgtatatgtttagtgatgcacatgaagtgatttgaacgataacagacaaatgtgggaaatgtgtgaaatgccctcaaatccaaattccaatcctagaacgtgctcaatcaatgaggggttcatatatagattatagcataatcatagaagatacctgcactctatttcttcaccaataactaattcccgtggaaaattgtcttctgccttaaaggactaggatttggctggctcatattttggattgcagttttcggtccccgtatagaatattctttcggctaattaataaaatttttgaatttttttaaaaatttcaaggtggaattttttccatccgaatttgtcttgcccatctgcttacccatcttgaattttggattgcattttcggtccccgtatagaatattcttttggctaattaataaattttttgaattttttttaaaaatttcaaggtggaattttttccatccgaatttgtcttgcccatctgcttacccatcttgcctatatggacgtgactaggtagagtgcgggttcagatctcctggagttgtggacgaccccaccaggtggatttggccaaatatagaccctccttttcttctacggctgagatcatatctcttaataattattataaaaaaaatctaagttttgcttctactccctccgtcccaaaatagctcaatctaggataggatgtgacccatcctaggtaagttatttttgggacagagggagtacgtccttaggcgtgtagcctggcgcagcggccatggcttgtcagtggcacgcggtgccgacgatggccagtgcgtggcctcggggatataccatacggttctcctgatgaaatgtgttgaatgttgtcgctctgaattgctctaacaagtcatgttgtgtgtggagaaagagatgcatgtttgattagtttattgcactacgtattgatttgttctttgtggaaagaatgtgccttgtattctgtttagcgagagcgtgatcataattatggaggaacacctgaaaactttccctccaaatcgacactaataaatgcaggggaggggggggggggggggaggatgccagctgtagaagcaaacggagggttcagatttagccaaacctatctggtggagttggcctcaactccaggggatctgaactcgcatggtagtgctttagtcctaacagtagaccactccattccatatataattctccctttagtatatggtgcatgtctttttttaacatctttaataacttatatcttttaaattacatattatcttcaagatatatttatattattgtactctacataaaatatatgataaaacaagatccatgttgaatatatttaaacattttattaatttaaaagtaatttatttaaattgtaactctctatagattagaagcaactaagttatgactgagttgaaataagaaattatatgtagagtaaattcacgagaaaaatgtagagaagatttttaattaaatgcatttatgaaagtaaattcaataaagtcttaaagtaatttacataaatcataaaagcaacttaacattgtcgatgtttgatgtcgcgattccggtatttgcatagtatggggatcgttggtactaggatatatgctagattgtaagaaaagagatagggacgaggatttttatacaggttcggacccctgaattgtcaggtaataaccctactcctgttggctgaagccggtcgttgctcttattcaccataatcacaccagtacaatatttggggtagcctatctaactgttgtcgatctggcggtctaaagtgctgactcgtagtcggtagccttcctcctcgaatccacatccgacgagatcaaagacaacgctatgtctctcctgacagtatccgtagacaccgtaggggactagccatgcttatctctgaagtcgatatccagcgtcttgtcttggcgcatgttggcttgtatgttcattttgtgtcttgatctattgttcagtgtcccctctcttcctagggggccttgtatttatacccataggtgtcctcttgtccaaatagaactagagaaaccaatatggatacaatccgagtagtccttatcgtttccatgtagaactctattcatccttccttatgcggaactcctcctatatccgaaggttgtttccgtataagacatggtatgtggtgggtcctgccgagatttagttaactactattaggtatatggtatccataaccttgacaaacataaaatggaagtaagttattacaccattagaagtaaattcgttggaaggagaaaaatatggtctatctaaaaattaaatttaaagtccagaaattatagaattgactagaataaataataaaaataatcattttagagcattatgaatgtttaagaagtaacttagtcaaatctaaaagtaatatatatatatatatatatatatatatatatatatatatatatatatatatatatatatatatatatatatatatatgataaaagtaacttacatatatcataaaagtagttttacaaacataaatatttttgcatcgtaatatattcatgcatatttttcttggcagaatatattcatcgtaatatgcttaacatttttcacagaatattagagaactagcagtgctatgataagggcagccactcgagtaaagttgtgggttggagagaggtgggagcaaggtccactgcgacgactagcagaggagagatgacgtgatttcgttgccgtgactagccaagagtagaggagagaaatatggaatggggtcaaaaccataaggctttggtctgggctcgaagtttcgttgcttcagctccagcaataaaaaaaatgcattggtctattgtaacagccctccctccagaacagcgtagcccaccccaaccgacgagcgggcccacttacacacaccaccccacttacactttcgtcctcgtttcgtgtaaaagggttaacccgggagtgatgtggttggagggaagatgccttataagtcggttccactcgtgctaatctagtaaggtggtactaaacatacgcacacagctcacatgggccacacaggcatacaccccccctcaaaggacccgacgtccccgtcggtccaacttacccagccacacaggcaaatgtccaggaacacaccccctcttagcgcacatccgtacgtccagtgtcgatgccatatgccatgccttgtgcctcacacagtgcgcacatgcgccatgcgccatatgcccgcacactgacccgtacgcgcaaccgcgagggtcggctctgataccatttgtaacagccctccctccagatccgcgtagcccagcccaaccgatgagcgggcccacttacacacaccaccccacttacactttcgtccttgcttcgtgtaaaagggttaacccgggagtgatgtggttggagggaagaggcctcataagtcggttccactcgtgctaaactagcaaggtggtactaaacatgcggacacagctcacatgggctacacaggcctaatccttattgggccgggatgtcacatctattgcttagaccacaatctaaacgataggtttacggtctacagtcatctaaatgttgtttaattgtgtggtctagatggtctagttgaccgactagacggtcaaacggtctaattcacagtttaggtcctaaactagacgataacccgtcgtctagcgtctagacgcggtctagaccgtctagactatggtctaagtgaacattgccttgcctccgacgatccaactcataacgaactgggaaccattcggaaagctgctttcaaaggtaaaaatgaaaatcatggcagatatgctactgattattgttggagtttggcttcgtgcacaagagattgccaaaattctcaggatttctagctattgtttttctttcttcaaacattatcatgacaatttggattatacttgagatataaatttcagaaaacacccaagcgtagaaattcaggttagactaagaactgctagtggaacctagctttaatggtgaactcgtcatctctaacatccggcgttgctgctgcagtggtgggtgtcactagaacggataccctcatctcaatcgggtggtaagcccatctcaatcgggcatggcgtcactgatgtgaagagctatctcaatcgggcaaacggccgtcatggatgattctatctcaatcgggccctaagtaaagcccgtcaccgatagctttgacccagacgaccagtcaaactatagcccgtcacagatgacctatctcaatcgggccacaactagcgcccgtcacagatgacccttat

SEQ ID NO: 76482 - DNA, 16120 bp, Oryza sativa
gatccgaaggcggcgagctcccgctgtggcgtcgccgccgcgcacacggtttgcggaggggaggagcagcaaaaccctcgtcgccgcctcctgttcccgtttggtgtactgcccacacccaccaacaccacaccacgcccaagcctaaccttctctttgtctctgcaaggagtaataaaatattaaatatttttgccctactcgtgtgtttcctgtattgcaaaaactatggtgcctgcctagggtttgtcccatgcctaacaaatctacccaggcagggaagaaaagataattggtagtacctccgatttcattttaattgatgttttagataataacacggtctataaaatatatttttaatcttatttttttattataatatatatatataataataaataaaatatatatctacttttattatattgttttaaaagacaaatctatatgtgttgttctagttcctttaaactaaatatttttaaagttattgttggtcaaaattataaaaaaattgacctcaaccttatctaaaacgtcaattaatatggaaccggagggagtagataacagttttgctagcatatggctctagaatagctaaaatgatttttataattgtgcgaaagttttaaatagattgggataatgaagtatatttagaaaccacagctacgttacgcgtcaccaccagtcatctattgctattagaaaaaaaaagttttcacaatcgtgtaaagtttttttaagtttgagagcttatttataaaccatagctataagacgtgcaatcatctgtcgccaattagtatcaattaaacatatttctaaatagttactactaatttgctatacactttttataagagaatttgtttcgcagtgaacatgtgcaatttatctagtaactagtgaaaacctttcttttcccatcttaaattatgttttgagttcaaaatattttgtgtacattgttgatgcatgcatagcaatgccacacatgtttttccttcaggaaaaaaaatcaatgccacaccttgcattagccaaaaggattttcaaaattgcgcaaaagtttcaaattcggagtaaaatagaccgagatttcagagcatattgtcccacatttccaattggtgcttcaattaaattccttgcttccttctctgaatgtatgcactttgttgccctacacaacttcaggtagaggcacagtgtcgttacgatcccttgcttacgtgctaagttttcttctacagctcccattcttcaccagtaaacaaaccaccatgtgcagcaaaacggcaaagtggttcaggcactcgctacgctttaccgcgttggttttctttttgctgggctacatatagcgatggccacttctggcccatacagattgcaggctaggcctttttcctgatgggctaatcctggccattcccaggagatgggccattagtaatttataacaaggccttacacactgtggcccaaattactaatggaccgttcagaacgagttgctgatccggcccagtgtactaagctgctccccaaagctgttttttctcttcttcttttcccctcttgacacatgtttttcttcaagttcagcactattttcaaggttcgaaatcttaatatctcagtagaattcatcagttgagacgtccaaactggtcctgcaaacagtttccaggagaactgcacatctcgacaagtttgtacgtggcacgacccaagtgacagagactgatttagaacaaaaggaacataacgcagcagcacataaggctttggttttggttgttctgggaggagacccgttccctgagtggcttttggttcattccaatcattcccaatggcttaatctaactaaacaccaacattttcgtacaaagaatatatgccaaatgtaatgtggttccttctggtgagaaatcaaaagagcacacactgcacataaacctacttgaaacacatttcagttagtgcaaaagagaggacaagtagggccaggttggtgcatacttaagagccaagcagcactatgaccatacaaagtgacagattccaaaagccatcttctgttggtagtatccactacttctactattatcatccactgaaaacaaggacatggatgcataaactgcttctgaattttattttaattttttggctctcgaccaagggggtccatatgcattggagcattattaacaaagcatgcaacaaagttgtgaattatttttgtgctggaatatggacatggaaggatgttgactccgcctttgtctctgccacgcaagaggaatcatttcgtggataatggatttggagagaaccagcagtgtaatctatatcagtggataatattctcagtagtggagataacaaaagaacaattagtgtgaggaacaaagcaactaaagggaagggcgatgtgaaaagaaacctgatgagaggtattttaattttcttatttagacggtaatgtctcttttttgtttcttcctcatgaaagttcagtggccaagtacatttgagtcgctgaaattgcttcagtaaagcgccactgccgccatgattaccattcaactaggtgagtgtctgagtgatggtggcatttgtttttgctccagcgacgagcatttgttttctactgctaacgtgacaatatgttctgctgaaggatcaatcggtgaagcggtttcctgcccaattaccacgtcgatttgcataggagtacggtgcgttgttgcatggaacagtgataagcaatctgcttctgttcttttcagctgcttcactaaattattacttcatctatatcaaaatataagcgattttagtttgatgaaacttatatttgtactataaatctaggatacgatccatctatctaaaatcctttatattttatattttagaacccaatacctgttgtctcatatcgtttcactaaaaataacaagtgcaatgcgagcttggaaaatttgagaaaaataaaataaaacgcgaggatgagagagaggaatcatggacgaatggatgtgttgagaatataggcatataatgatttaatatattctataaataaatcatgacattacatatgtatactagcattaacgcatcattagatctacacatgtaaactaagcagtaaaacatgaacagatcaaatatgcacaatatgtcgaacacgtaccgaggtggcggaaagaccggttgctcggcaagaactactcgcggttgcgagcgtcgacgaaggcgcgcagcacgcaagcggagaggaaggcgagccgtcgcggacgaacagggagcagtcgcgcgaagcgcttcctaaaaaccttattgtcgccttctcccggtgcaggacgtcgaaggcagaggttccggagacctgctctcccgatcgcaggtgcacgccggcgagcgggatggagtagtctacgagcgacggcgcagcacagaggaggaggcaaaccttagattgatttcgtgtgttttgcgtgaaggcggcggctcggtttatatagagataggtcgcttgatcagggcgcccgcacgatctccactccgcgtaaccgaaccggataagtcgcgcgtaacttatccggactccacgccgttttcacgcactggattttttggatttttcggaatgtttcgaaaacaaaacaaattcgaattttcctgcagcaaaacaaaactgcaaaccactccgcgtaaccgaaccgaataagtcacgcgtaacttatccggactccacgccgttttcacgcaccggatttttcggaatgtttccaaaacaaaacaaatccgaattttcctgcagcaaaacaaaactgcaaaaggaggctgcatctgcgcaagggtgaggagccaatttaaactgcaaaaggaggctgcatctgcgcaagggtgaggagccaattttgcggaccattcgacgcgtacgtcgtgcacgcgcgcctatcaggcgaggcgggcgagcgcacgtgtgttcctccttttctctccaccacaaatgcttcaagtggctaggagggcatcctcccttttaaggaggtcccctctcctagaataagcaaggtggtactaaactccacatgcatgccatcccatgaggtaggcttttataattttttaaagaattaattttcgaatgggtcttagtctatctattaatttcaacaggttagtggtggattagcgagagagagagagcagtaatggagacgagaataatcgccgagacggagcatcgaatttgttccctccgtttcttttccgtctcttcttctgactgaccaaaccaaaccaaaccaaaccaacagtgccggtgcaatgcattcagcagccagcagcacggcgaggtttgcagtattttccaatgcaactcgcacactccacgcaagcatcaagccctcggctcggccatgggaccaacccatggacggatggatggatggacgcatcaagccatgagccaacccggtcgatccgtcttttcataggaaaccagaggcgccggctggaagggggcatatcgagcaatggaatacctcaccaatttgtacccttcccacggttccccctcctcccgtcacgtctgattcacccttcaattctccactcgtgccgataaaaacgattttcgtttcgattattcgcggaataagccaaacaacatactactatttacaaacaaaaaacaagttacaaataaaacttttatatacatgttttaacgatctaaaaacaaaagctgaaaaataaattcaataaaaaatatcttaaaatcaactctaaatttaaagttataaatttattttttggctgataagtataagcaagcgaaaagatgagtcccttacgcttttacgaaaataatttgcgaacctttaaaacttttatatttaactatttagtgacgattgtaatacgatatttatataggtagaaacagatgcagtcaaaaacagtatttttacccgggatgatcgaagaaagactgttattaagataagtctaaaacggtgtcagtttttttgccaccattttttcatgtaagtatactagtaccagtagagtgcatgtttgccagccaaaccaaactacgcccgttggctgtcgtactctttcgtaatgtcgttgcttacggagtactcccctgtccagtactgtacttcggcctgtttaattcagctctaactcttaaatattactccagaagttaagtctgaagtgaagttgttgagctgcctaaacccagctccactactctagtatattttatgagagagctctatctaactccactcccaattttaatggagctgaaactgtttggctgagctctaactctaataggagtggagctgaagctgtgtcaaacatgcccttcgtataatgctactgttaattactgtagtgtagtagtcgtgagttttgttgacagctagcgtcaggtttatctactcgtcgtcctcttgggggcacttggcatctgattctgaattcctgatccatcatgtcacgtgtcaatgtgtcaagcgtccgtctgctacactacacggcccagcctccctctccgtcgtttgccgctcatcctcctgtcccgacacacgacgagtcaggtcagaattctgaaatagtagaaccatctcgcaaccaacagcttcagggggtgtttgggagagtttagcccctctctcccgaaagtaccccctcagattttcatccaacgctgttaccaccgtcggatccaccatccaacggctgtaaaacctcgatgatcgtgcaaacgaaaaaaaaagagtagggaggccaggaacaagaacaaggcaaggcaaaacgtgcacacaagatgtagccaaggagagcttcaattctccattttatgtactttttcacagggattttttttctttttctccactgacatgtgaggccaacttattccacgactgcgagtgctccggcgatggccggcgccacctcgccgtggccgacgccggcgacgatggacatggtcatggtcatcgactcctcgcggtggaacctcgtttgcttggcgatgaacgcctccaccgtccgccggaactcctccgcgtcgtccgcgccccagcacacctccgcgtcgcgcgccgtcaccgacgaccgccgcctgcgcccgttgtccgactccgaccgccgcagctccggcgacaccgcccgccggaacgcgccgcgcgagcccatcttctccgacctgctccgcctcggcgcgcgtgccttgttgacgcgcaccgcctgcttgtcctcgaacgccgccgccgccgccggcgctgccggcgccaccgacggggcgcaggggaccacgggcgccggaggcgctgccaccaccggggcctcggtggcgtgaggcggcggcggtgatggctgcgggacgatgaacagagggaagctggcggcgggtggcgctgtcgtcgacgctggcgtggacccggcgccagcgctgtcgctggagacggcggcggcggcggcggtggtggtggtgccgtggttggaagagatggagaggtcgtgcctggagagcgcgaggagcaggagcacgatggcgttgccgaggacgaacacgaaccgggcgttgagcaggagcgacccggcgagccgcaccacggcggcggcggcggccggcacgcgggaagaagaccacgacaagaacaccacgagcgcgaggagctcgcccacccgcagcatccggtagaggaggcgcagccgcaacgctgctccggcggccgccatggtcgcagcacactgtatcgtgcacagctctagctagctagcacacggcgtggccggcggcgacggcgacggcgactcttgccttcttggagacttgggttagtgtgggttttggaagagagtgaagctgagtgtgaggagaggagagctgtctgaactgaactgatgaaatcttctctttggttggggtgaggtggatgtgagcttatatagcctcaatttcggtggctttctctgtggccttttgtgtttaatacatgcatttgtcttctagtctactgtagtggtgggtcttaataaaatttttttgatgagtatattggtttttaaaattccaggagaatatttttgaaagatcaatttataggagaatatatttgtgctactgatggtagcatataaagttcttgaaatggagcgattataggacaaaatatgataggtgatgtggatagaacattagaaccaccaacttttgtatactgtggacctgtgggagttgtagttattgaagtcaatacaaattttagaatacataatctttttttccttctacaaggtgtggttcatacctaaatcaaagtggctttagagcgaaagatgtttcctacaaaaattcacatgttgatatgttgttagcatcatgttctattgatttttttatagatatatagcgtattaaaatggaccgaaaaaagtttactccgatcaagctttaagctggcaactcaacagtagtaaaccacaagttgtcttattatttttcagcctattcactgagttattaaaatacttcacgactcaaaaagaatacgttttttcaacataattctttttcactatagtattgggatcacttgttttaaactacagtatttgtttaacttttttttttcaaatatttggttttagataatccacactaatagttcctttaataatctaaaacaaacaaacaaccttatattacccaaccgcttccatttacacttgtttggcaacatattatatgtacaccagctctcacgtgtacacacgtacacaccaactaccaaatgtcacaaaaaaatctagaaaaattcatatatgtattttcaacagtattatacctagggataaaatattaaccctaaattcattatattttagccgtaataaaaaaattaaaaaatataacagttttaaggttataattctattagaattttgtctctttttttactttctatgtagaatgaatttgaacgtacgacattgcatgcttgtatgaatttttctagaattttttgtgataatttttagttggtgtacatggtgtgtacgcgtgaggaccttgtatataggataggctccccacttgtttgcttgcatagttgcatatactcgtcacgatgtgtgttttcatatgcccttgatactagtatacttgaaccttaactgagtcttccaatggataacaaacagcaacagcatcagctcgtagcaggagcagggaggcaggggccccaagagggatatgtgtacgtatcacgaggtggttgcccctgcacgagccaggttactattggtttgggtcggcttggagattcgtgtgcggggggccatcgatgtggagtcctcgatcagttcaaaacttcgaaccagctaatactggcagcatatacgttcggtttggagtttggatgcctctgtttgtaccagtgtgtctctctcttttcttcagattacagcactgcagagcagagtagatcatggttcagtctgaactcccaagcctgaatttccaatgtcaccaccggcctctgagcaaagcaaaggggaaaaatgatggcatcaaagcacaacggaatcaaagtgaaaatctctgcggatcgaagcaaagcgagaggataaaatctgagaccaacaacaaaccgagctgaaactcctacccggacttgctgtaaaactggaacgtgtacggatattgcagtgggggcagtggcagtgctgccgcatgcacgagggccggctgaaacactgacccgatggagtatcgcagtgcagtgcagtgcaatggagatgcatgcatgccgctgtgtacatcctgtgccattacacatttacgctacgctggccgtgtgtcgcagttggtgctgaatgctcctcgggcgtgcgtgcatgcatggtcgtgtattagtgttgttgtgtactccatagttactgcgaggcgtccttttgtccctggtcgcgcaggtgcaggatgcattgcagagggcgtttgcaatggaagaaattaagcgagatttagggtggtggccctcgcgccacggccggctgcttggcacaaatgtccctcacgtgtatggccgtgctaaccctgccacaacaacacgagcccctcttggaacatggaaatggcatagcttagctagcacatctgcaggagctaggatcagacgagagaaaggcagtttttcgtcgtgcggccatggactccgcatgcatggggcgttcgttcggtgtaacgccacggatttccagcgcggcccggacgaccaggcacgcacaccggcacacgcacgcgacgcaaacgcgactcgccgcttgtgactcgactctgtttacggaagggaaacgcaaaaacgagcccaaaatcagcggccgcgcgcaacagcggaagagaaggaagaaggggatcacggcgcggcgccgctcgcgtgcgtgcaaatgcatggacgcgcgggcgcggccgtccccttgttttccgcggcgttttttgctggggcgtttgcacgcacgcgcgcttttgccggtgcgcgcgcggcggggagggggaggaggaggagatgccgagacgggacgggacaggacaagcgcgggacgctgggttgtgcacgtgtggtggtggattggtggttccttttctttgccccgggcaagcggccatcggcagcggcagcggcccagccgacgcgacgcgacacgtcgaaacaacacagggagggagggagagtagtactagcagccgttgccgtggaccggccggcctcgcatcagcgccctggtctggtccactgttctcccttggtaacgtgtaagcaaaccccgcgagtaataataaagggctccttcagtttctttttccctttccacaccaactagcacactaattagcaaatatcacataatttttttaaaaaaaatgacacagtattacatctgcctgtaaaatcttatctttaaatttattatatttttatcataaaaaaaagtacacgaccaaccaaaatttagtatcatcacgtagttttggcacatatttactgttacaaaaatttaattgcgttgatgggtttagtctggtactgtttttatgaagatgaaactttaagaaataccgaatttggtaaaataacatttgacataaatatgtttaatttgttaggataccaacctgtaataatatattaaaaatagtagggttgaaagtgattaccaaaatgctttctctacttctcctttggacaccactcaactaaggtgaaaatggaaaatgtttatataatctatattccacatccacatcgagcagatataacgtcacatgcagctcattagagagcatttaggaggactagtattagaaaaactcgcatgatttcgcaggaaaaaggggcttccattcctttcggtacaacaacaacaacaaaaagcacacacggatcgaacaatttgattttgcccaaaggctaaaagcaaagctggcgcctatggctagttcacatagggagactgttaattatgcgtcaggtcgtgttcgtgtgcacgcatgtgaggtgccggtttctgagggcggatcagaaatttttatttttgttgcaaagtaaacttttcgcgcctcacacacacactaactacggctaagctatagccaggtgaggtgattaattagcggcatatattaacaaaaagaggagatttggtggggagacatggtggcatgatgcgccgttcgtcgcagtcaggcaagtttggtatcactaactaaacggccgtagcgattggctcgtgtcgccacaatattgctcttcttctctctctcttttttctttcttgttgctgttgctgttgttgtgttgttgttatgctggtcatgaatgacacctctttcgtcaaagcacagtttccgtggccttgactctaggctgcaaaagctcccggatagtttgctgctctagcatagtgcacgtaggagtactactttagaatagtgagggcaatgattaactattacgattgtgttggattacactaatcatgtcgggcaaccaggtgatatggctagtactatgcaaggtttaattaaacaatcaacacaaccttaattagcttgctgattgatgtttaaggttttgtataggaataggattgtggtgaaatattatagtctctgcctctctttcgaagtatgaatcgttttatcgttttttatatccttttggatttttggctattattgtttttactaaccaaggacgtatatagtattatacttacattcagaaacatatatggactatggtggagttttcatatgacaagtgaagtgttgggaaaaataagtggagtagttcttctaaccatggcaagttttcataggggtagcatgtaaaaaaacaaagttttcataggacaagtctactattattaacaaagttttcatgaattcatgtccagattgtcaggaaaacgaaaacatggcatggttaaaagcgagggatgagaagttgaggacaacattttactccctccgttttatattataagaattttcagcattgaccacattcatatagatgttaatgaatctaggaacatgctagaaagttttataatctgaaacggaggtactagttatgaattcatgtttaggttgtaagcaaaaccaaaatctgaataaaaaaaacttttagttctgaattcatgttcaggttctaagcaaaaccagattgtgaggaaaacgaaaacatggcatggttaaaagcgagggacgagaagttgagggcaacctgaattcatgttcaggttctaagcaaaatcaaaatctcaaaatcaaaaaacacgcgccaggtaggggtcgaacctacggccttctgcttaggaaacagacgctctatccactgagctacaggcgccttatacaaccaaatgaacatataaataatcaagtaggacatgtgtccacaaagaaacacacaaatagcaactgactcattgacagacatactgatccatctagattattctgctttttccatataagcacattgaattattcgccctgcaagctacgtggtgtccagcagtttgctgctcacatgaaatcagctcaacaaattcaacccagaaccgtgttaagaaatggatatgtaccttccaaaacagcgaatagaatcagataccgcaactaaaagcatcacttcttctcttatttgcgccgctttactgaaccacttgccccaaagcacctttccaattccaaatgctcccatggaggcgatcttatcctcctaattctccttgtcattgcctcgacgcaaaacatatgcttaattggttccagattcgcgattcccagctgcatccatgttctttcgcatcgccacgcaattatcgaccagctaaatgttccaggattcgatgataatacccggttctcaacttctgaccacttgaaattcagatgagggagagagagagagagagaaagaaatgcagctttatacttggtttattcgagctgtcttgcctttggaggcgtttattctgggctcaacacgtcagtaataggcccctttcactagcattggagcttaggaattgaaaggtgccttctctagaaggttaggaggagagctactatagctttgctttagtcttgatcattgatttgtgattttcttactggtaccagtagtgcattttggagaagttgatcaatcatccctaaacccatcattgcggagattagagtaataatactcgtggttctttttagacatattaatgacttgtggttctaagtaggaccctatttggtttggtacctcgaagtcacaaccggataaagctaagcaagagcaaatggctattgagcattgagtaggctaagttagttaaagcgttccaaagcctaagctccatcaccaaagcagcatcattactacaactccctcactgtcatggtgatttttgtgtttctttctactggtgtagtggtgctctatcttgattgtttatgatcagtttgagtcatggaagggactcacctgctttgtccaaggacagatccactgaaattagaattcttgttctgccgattccatgaaagctacgaatatctatgatccgttcaattcggttcgatttataaccaccattcagcacaagtatgcactccatctaaaagcatctgtatgactgaaaacaagcatataactttgtcatcatgcaattgcaaattattccaaaatcagatcaggcaagtgcaaattgtcagaaaagatagtaaataatgagcatatgtacaaagaaggtcaaaagtctacatactgatagacatgattcaccgttacataatcaaaatgtcaaaaggaagaatatcctaggagcagttgtcagaaagaatatggtactaacaactctactatagtacaaggattgacattaacattgtatataaaagaagaatcatcaccaagacaccaagcaataatatcttggtcaagaatcaagttattagcaagcagcatgtcacacatattgatgcaacttgggtgccaccaaagcgtcaatgctgctatgaatatctctactgccgtccggctcccttctaaagaactgatgaataagatcaacatcacgcggtctgccacattcctgtctgctccaaatcagtgtgcataaaatgcttccaacttgtattggttaagagcaagaaatgaacttcttcagttcttcactgtacatctgatgcaggaatcaagttgacatatttacgatttaggatatgaaacctgcagtgggtatctcattgaattgaaatccattcttgtaagacatgtctgctactggctgtgtatatccacttgtggatatagaggctggatttctatccattatcttaaaagaaaaaaaaaaggcatgtctgctactacaagctgcaatgctgaagcctggatcagagcatgcagcatggttgcctcatagttgtgcccatcttatcgagagttgtctctcaaacgagcttagcattggtatatgaactattcaatcagtgctttagtgcagtagcagaaatgattggatgaccagaccatcctaagctgcactgactggcaacaaatgctcatcatagcactcattcgtagccaatgcttcttattcagttaactgctaatcatcatatccacttcagatcctaaatccaactgatcaggtacatagcgagccattccagttccgaaatatatcaactcaagcatcctgtagattgcactgtcctggggatgtgtgcgatcactggccacaaacacccctactctcctgccctcccctccaaccgtgattgatgaccagcctgcccctttcacaacccctttctgcttcatcatatgccgttcttgtgcagcctcgtgccattgtcccttgctggcataaagattcgccattgccacatgtgctcctgcgccccatggttctgcctccattgccctctctgcagctttctttccagtttcctcttctcctcgggctgcacacgccctaagcaaagatgtccaaacaacaccatctctttcgttggcagctatctttccaatcagttcctcagcttcgtttattctaccagctctgcccaacaaatccaccacacagccatagtgctccttggcaggatacaggccataaatttggttcatttcattgaggtatctcaatccaagctcgacttccccagcatgacagcaagcattgagcacacctatgaatgtgacatggtctggctttagtccaacatgacacatttcctggaacaattcaagtgccttcttgctgtgcccatgctcagcatatccaacgatcattgcagtccacgaaacaacatcatctttcacacgatgggagaatactatatcagcatctaacatgctaccactctttccatacatgtcaatgagcgcactcctgatcattgcatgatgttcaagtccgcagcaacagcaagtgtgtggagttgccgtccagcatccagtgacgcagcagttgcacaaacacttatgagactggcaagagtgaattcgttcggaccaggacagccgctatgatgcctcatttctctgaacagagcgaatgcatcctcagctaggccttcctgtgcatagcctgatatgatggcactccaagagacaacatccttgactacactctcccggaaaacagcatcagcagccgacagacagcccgcggcgcgtgtgtagagtgtgacaagagaattggccaccgagcgggcacaggcgaagcctttccttgcagcttgagcatgcaactgctccccaagacagacccaagcaatatctgcacacgcagcaataactgcagcatatgtgtattcattcggcatgcagccactgatgattcctcacgaagcattcggacaaacgcctcgatggcctcctttgcacggccggtctgcacataggcagagatcaccgtcgtccaagcggcgacgtcgcgcgtgcccatgcggctgacagcagccagcgcacggtcgacgtcgctgcagcgcgcgtacagagtggcgagcgtgttggcgacgtagggcgtcgagtcaaggccgagcttggcgcagaaggcgtgcacctcgcgcccgcgagacagcaatccggcgtcggcgcacgctgtgagcgcggccgcgtaggcgtacgaatcgcagtgcacgccagaggcgcgcatctcggagaagcggcggagcgcttcgtggcgccggccggccctcgtcagcgaggcaaccagcgtggtccaagagaccacgttcttgtgcggcatttcgtcgaacaccttaagcgcgaggccgaggcatccagccttggcgtagacgtcggccagggccgtggcgacgaagacggaggagacggccgaggagcggaccgcgaacgcgtgcagcgacgccgcgtgcgggaggaacctcgcgtcggccgccgcggcgcaggacttgaagacgaggctgaggacgaaagggtccgcgggcgcgagcggcggagaagaggcgcggagg

SEQ ID NO: 76483 - DNA, 647 bp, Oryza sativa
aaaggaaacatgctttttacaatgagggctagtctacagccggaagtgacctctgacaagcagagcacacgcctcctgccctgctcgcccgcttttccggtggacgcccatttcaaccttcatttaatggccagcgacttccttgccatacttgcgctgaagcctggaatggatctgaccgggactgacataccaactccaggagttagcacgccagctccggctagggacgagagccaggaagctctcatcattccgacgggacggggcgaggcgtgtgacaggccgcctgttgccacctaacccgcgatctgaccggtcacacaccgcgaccggtcacggaccggataagcgtgcgctgcgccgcattaaatgcggcgtggcgcgctcgtccaacctgctataaatgcggttaggtgagcccgctgtgctcacctaacccacacacgtggcgccaaaaccacagggggtcggggcgccccagccctcggggccgaaacgggagcggcccgacccttcggggagacagagggaggggtggccacgtcaccctcgggcccgacccccccgagggggtcaggccacgtgggtgaccgcggctacccaagcctctagtcacgatacccccagccccatgtcaccgacag

SEQ ID NO: 76484 - DNA, 1280 bp, Oryza sativa
cctgcagccccacgattatgggccgtgttttcagcctattgaattgtactccctccgtcctaaatatttttagacacgccggtaacttttttttaaacatgtttgatcgtttattttatttaaatttttttattaattattatttttgatcgctgaaactgaaaagcatgttcgtttgctcaatgtggttacacaaactagtgctactatgtcataatacgttctatatgctccgctagtattagcaatttcactatacaaaccgaaccaccaaacttcaattcctggggatccaggtaggagtacatccaaatgaacatatgtgcatacaataattatacaaaaagcgatgtaaagctgcaaaccaacgagacaaggtagcggtggataggatatgtaaaaagtaataggtgatttcccgtgctttgctgcggaaattactaagcaattctcaatatttttttttgacaatcaagttagaagtcaaaagaaaaaaaaagaaacatcaggtttatcagtcaaatgatacccgtgctttagtattgataagtatatgttaaatattgtaaaagtgacagatagatttgttaaaatattgtacaaatgatatgagaggtgatgattggatatgcttgcattttgatttgtagtattaaataaattgtatatcatgttgtatacttgcatgagattaaatatgtaactattgctagtggttgatgatgtggcatggttacatgttaagctttagacttagtgtgctttaactttatagaaaacatagattggcaagacggttgatgcaatgtcttcaaagcgtgcaagtgcataagataaagaaataagcgaatagggtagctcataaccttgctcaactaggcatgagttcaagatcaagcactgagtggagattgtgtgcacatgtgtgtatcctggacctgttaaaccaggaatgtatcccctatcttaatcattaataaagttctatctttatgttaaaaaaattaattaacaaaaccacaaatagaatcccaaatactattaaaaggagggacgataaacacatcgttaagcaatatggtcatggcaattggtgggattgctacaaagtaaaaaaaataataatcatgtttgattttaaaatctcgatgacattaaagaggggaggcagcgtgtgagccgtaaatgactatagtgacaaagcagttaattgtttggcgggacttatagagagtgaaaaaaatgaacccaaacgataattaagttcgatttttaaaatc

SEQ ID NO: 76485 - DNA, 1011 bp, Oryza sativa
acgtgataaggagtgggtccaggtggctgggtgggttggatccaggattgtaggattgcaggattgtggatgaactcatactttttatattagtagagatgtaccaaacattacataagtttgtttggtgcgcggtatctccacatgtgtacttatctgattgcaggctctatctgcacccacgtccacgtccatacatgcaataatcatgtggtttatgacaatcaaacggctcaccgacgtgttgttggttaacgccaaatcgtgcgcgcgcacactaatcaaattttgcgattatggaacggtaaacgttgcaaggcaggcataataattgtactagctgacaacagcaagtagttaccgaagccgtccggaaagacacggcacagaaaaatgaagttacggaagagatcgttttctttcgggtgagttttgcttcgggctcagtttagttctcgatgttttaaatcatccaaacaagtcctccaaattaatcatttgggttaatatagtctttggacctaaaaacaaatgctacgtgagtatgccaagtcatcctcgcatgcagcgttatgaatgaaattagcattctacccttatatatcatatcatatagaaaagaaagaaaagatacaaacagaaatcgtaagtgacaaaggaatttatacgatcagtgcttggctacagcaatcgcaagtgacaattctataacgatcatacatgtgtgaaacaactatcttctttttttctttcttttctattggtacataagggtagaatggtcatttcattcataccgttgcatgtgaggatgatttggcatgctcacgtgacactttttgtgggtccaagtactatattaacccaaatgattaatttggagaactagtttagacaatttaaaacctcaagtactaaactaagtccgaaacgaaacttcagagaccgtattagctattcacccttttcttttccccacaagctcttaatggcctctacgtacccttccat

SEQ ID NO: 76486 - DNA, 9411 bp, Oryza sativa
atcatacatgtgtgaaacaactatcttctttttttctttcttttctattggtacataagggtagaatggtcatttcattcataccgttgcatgtgaggatgatttggcatgctcacgtgacactttttgtgggtccaagtactatattaacccaaatgattaatttggagaactagtttagacaatttaaaacctcaagtactaaactaagtccgaaacgaaacttcagagaccgtattagctattcacccttttcttttccccacaagctcttaatggcctctacgtacccttccatctgggaattgaactattgatgtataaaattcctttgaaaccataatgtgatattttgcatattccagatagggcgcaaattaattaggaacaaagctaaatttcggcggagtacgtaaacatatctgtgtgagctttattacatagtttaattgatgagataactatcagtaaaatattggtcctggtaaacgtattgactagaattggtccatcgatcgatcttgagataatatagagtaatttttctctaggtctgcatacgcatgttgttcattatcgtgcgtacgtgcatcttattacgtctgataatttgtgataatatataattcagggtaagaatatcctgctgtgtgctgaccattgacttctttaggttggattaatcataattattgtttcgcttatgttgatattataaaccttacaggcttataatatcatcattattgtttagcccaaaaaatggaaaagaggttaggaaattggtctggttgttctgtctctcatgcagggagagctgtacatatcaatgcctgtctctcatcgattccctcgtatgctatggggttctatcagctgtatgaggggattcatcagaaatttaattcaattcgaggtagatactgctgggctggtaacaaacaagggagaaaataccatatgatgaaatgggcagatttgatcttcccaaaagagtttgtagggttgggtcttactgaaactagaatgtttaacattgctttgttggctaaatggttggttaaggttgaatctcctgatggtagtctctgttttgagctattaagaaagaaatacttgtgttctgggggagtctttcagtgctctactgaaggtgcttctcagttttggtctgggattcttaatacaagaaaatgaatgatgcttggttctgaattgaatagaagattggtgatggttcccatatttggttctggctagatgtttggtatgggtcttgccctctgaaaacaagttttcatgagatttttgagatatgcaaccaacaatcaatcacaattctgagctgaaacagataggtataggtggtttatcttttaggagaacttttggccctctggaacttgaccaatggcagcaggttaggacaatcctagaagagctagagttgactgactctcctgatattttgaaatggggtttgacagctagtaagagatttactaccaactctttatacagagctatggcttttagatgggtgaaagatgagatgctacaactaatctggaaatctccctgtcccataaaaattaaacatttcctttggttggcaagtagagataggatccaatcttgtgaacaattgaaaaagaaaggttgggatggttcagaactttgtatgctatgcaatactattgaatctaccaatcacattcttttaactgtccaatggcaatttttgcttgctgcatttgtagagatgttgtgaactgggatactgtcccctgcagctttgaagagtttttcttgctaataaaacataatgcttgtagtaatagaagagctttggtttctttgcttgctgctatctgttgggttctttggaccacaagaaacaatatgatattcagatctcaattggtgtattcccccctaatgcttcctttttgtattgcttcttatttgctgcagtggaaggttttagggcatactgaagaagctagcacgatgatggttgtggcagagaagatgaagaccgctgctgccaactctgaaagtgataggctgggtattgggtgatagattagttaagaggttccctaagttgtggcactatcctctatctactgaagttgtgatgtttgaaatctgcttgtactggcagcccttttggttcttttagttgtgttgctgcttttagagctggtagtaagttttggagtctgtctgttttcctttaggagggctttgaccctccctacgctgtaaacctggtgtctagattttcccagcacaaaccttttggctttcaataggcttatgagcaataaaaaataattcttaatgataatatgtttcttagcaatttaaaagaaaatgttagaaaataaactacaacgaaagaaaacataagatcaactccaaactgatgtttaaaattcaaaatttgaatgtggcgtaattataagccgaagggtaatcagtgggtggctagctaggagcatgtcaccattgaaagcccgttaatggagagatattgaaagataacctattatcgtaccctgctgacaaccaaattaagctagttcaaattaatgaagtttggagccaacagttgatcacgcacaccgactgggcaactgacatgcatgcaatctctactatgggctccttcagaatttattccatcaattttccccttttgttgaatttgttggttggctggttatgattttttagggctatttttcgcaccattgactattgattagaaatacctggcaagctaagtaatcaatttgcatttgacgtactgtaaatctgtaatcagggtgtgaaaaaccgccggtaaccgcgcggttaccgcggttaccgcccgtaccgcgggggtacggttacccgtaccgcgcggtacggtttaataaaattcgtccaaattcaaaaatttaaaaaaaaagaaaaaaatcaaaaaaaatagtgaaggtagtgcttgatttatagtgttttatggtgaagaaatttctcaaaaaagagtaatatttattcaaatttgagagcaaaacggagaataaatttgaaaattggaaaaagaaaaaaaaatgggccggcccgttactgtgcaacccattacacatcgcgcggtaaccgcgccaaaccgcgtggttaccgcgtcaaaccgcgcggtaaccgcgccaaaccgcgcggtttgcccgaatttttgaattcaaatttcgatttgtaaatttgtcgcggttttgcgcggttaccgcggttaccgccgtaccgccgggtggcggtaaccgggcccccagcggtttttgaaaccctgactgtaatcgtatatctgttattgtaatggagatcaacatgaatgtatcggagttgacttgactcattgcatttagacttgcaatgcaaggagaatatatatcacatgcatcatggatatgattaattaaaatccttgtgctgcactgctggctaagctagttgctgggccattttacttaatttggtacgtacaaactgcatggagaaaattatttaatgacgttgtctcaggtgatttatatatgtgtgtgtttaactaaatcagaagctatatttgaccttacaagcacaagaggaataacggcacatagtttgaatgaactaatatattatgtcataccaccctccatctttgaagtcaatacagagatatgataaacgacgaatacggtgcatgttacctgcacgcaaaatccagtgatcgatacacacagatatatacaagtacatatattagcaagcttcagcatcagttgcctagctataaatagcgtcattgcctgaaattttccctatcacatctcacatcttaattcctcttctgaccaagatccaaagaaagttacaaagcccatatgatggtggcctcccctgtgaaggtggccgtcgtcgccgccgtgtgcgtcgtgctggtcgtgctgtcttcttccccggcgccggcggcggcgcagatgatctgcagcaagtgtgaccagtactgcaactcgtcgtgcgccggtgggatgggtggctgcagcggcgcctgcactgacccagcgtcctcctcatgcacgagctgcaagcaggcctactactacaagtgcatgaactactgcggctcctactgccgctccaactgcgtcaacagctgaaccaaatattatatgcgaattctccccctgaattagaagcttgttgctatggctccatgtagataaataagcgaatgctagctgcatgcgcgcttgtgcttgcatatggtggatgtatgcccctactatgtacaacttcatatatatatgtgaaagttgcatgtgtcttctgtcgaaaaatgttccgtcgtttcttgtacgtaactcggtcaatcagttatgaaagatcgaatgtaataaaatttaacagaatagattatgatctatgcgatatcactttacaaacatatgcacgtaatttctatctgcaagctgttttaaccgtaagtacaaatatatactccgttaagtagtatgcacatatcgatccgcaaccagtgggccgtgcctgcccagtctgtttgcatctccttcttgggccaacacctcatcttgtaggtcggcacgggtttggccttgccagcccatatactttttccatgtaattttctcaattttcccgatttccttcatatattcctcatatttatcctatctttccaacatattttctatatttcctaaatttttcccttttttccctcaaatttcagttttttgtggaccacggcaactggtgggtcggccgacagcccgttttttagggtttgcaattttgcccccacttttccaaaacaaacaagtcgtttgcccttacttttaacggctgttcgatagaccccacatttttgtgttacagaaaggcaaatgaaaaaatcaaaaaagtgtgcagtgaatagatagggattgagtcctctcctgcccaccgagtgtgcagtgaacaacaaaaccctagacctacacggcggcggcggcgagcgtgggacgacactccggcaagtctccggcagggcggcggccacggggcttcctacggcagccctcctaggcgtggagagtcagggcaacgtgacttcctgtggcaaccgctcccagacgctacacggcagggcaggctcgtcttcctgtggagagcggtggccaggcgcgacgagcgacggccagtcacggcggctagggcgtggggcttgctgcgcccttgcgcggcaaatggggtgatttcttatagatagaaaggagggaaagatacataagttagattgcaaatctcctaagtatttgaagatcttatgctagaaattctccaaaatgtagaggaatttctctatatatcctatgaaattcctttgacatctgtaaaaccaattctttcctttcctccaaaaaaaaatattacactagctatatcagccctaaatggagacatggactgtttatccatttttgaatatttatatgcaagcttacgtaaaacgacttatatttattaggaacaattttgttttgctcctactttaatgttcaattatggttttgctcgtgttttttttcgagttttgggttttttgcccatttttttcaaatgaaggaggtgtttactctttttttatggaagttagtggacccggcccggaaactggaattgttaagataacaaaataataagaataaagaggaataatcattttggaatttattgatttacctttctacccctgatatacgtaaaagaagaaaatgagagcagaaatctgtctcctcaatcggccctgacgctgtttcccctattcccgaaccatacggtccaggcgacgacagcgacctgcctaggtggcagtggccgggagacggcagcagcggtggcggcggcagccacccagccagcaaggtggccggagtagttggccgtggtagcgaaccctgtacatggcgggcggggagcaggtggcaacagcggcgactccgcaggcagcctcggcgatgaccaatgtgaccagcggcggggaggagaaggtcgcggcgatgactccgtaggcagagcgcggggagcaggcagcctaggtgaacgtgatcctgcagccgtcggctcgactcagcagtgaaggagcagcctgtcaaagtgctgtgactacttctgctagctgtgtaaaaagatgtaaaaattatgttttcttttactggaaaaattatgtttaatttctactatcaaatttgtgatagttctattgatattctgtcaaaattgttatatttgtcaaaggttgtcaaaaatcatttgattttaaacatctttaaaaaaaatcaagttcactagtacacaaatactcattggtgctggttagaaaccgtctataggtgccggtttcccaaccgacatatataatagcaaccggcacctattagaaatatacagccggcatcttaagctttgctcgagcaaaaaaaaaaaaaaaaaaaaaaaaaaaaaaaaaaaaaaaaaagagagagccggctcattcgagtcgaactcaccaacctcacatcccattcatcaccgcctcctggatcacatcatcaagaactcaacagcaaacctggatcacatcatcaagtactcaacagcaaaccaacagcgaaccaccggccaaacttaacaacaatcacattaattgaaatcctacatgcatcaagaactcaacaagttcacatacatttgggacatggatcaaggaggagaaaagagaggaagacctaaacaagaactcaaaaacagtgcgccaccgctgccgcatgaactaaacaagaataaaaaaaaaactaaacagtgcgttgccgcttccgcatgaacttgggccgccgctgctgcctccgccggaccgccgctcggttgccaccgcctgagagaagagagagagaggccacccgactgcctccgcctggccgccacccatggcctgccttctcccttcccgccggaccagggaggccgcccaccacccgccgtgcgccaccgtgggggctagaggtgccgccccaagcccgccccagatgcagatagctagaagggagagaagagaagaacatgggagagagaagagaagagcccgccgccaccctgcctccactgggcagccgctgcgagagagacgggtacagagacgcgagagagagagagggagagatatgcgagagataggaaaggcgagggagtagataaggacgcgcggtgggtgcagtgcgcatgcgtgcgcggatggtctcggctcgtcggcttggctcaaagttataggtgccggtttttaaaaacaacatataggtgtctgttctttaagtctttaattaaccgacacctataatatattatatgtgccggttcttttaaaaaactggcacctatagtatatgtgccggttctaacatggttaaaggtgccggttctatattttttcattgctcggaggtgggaaatgctctatagatgctggttttaaatgaaccggcacctatgagctagtccctatgagggttttttagtagtggttgcgagctgcatttacaatattagggggaaaaacacaactaatgcacaaataaagggacaattttgtaacagtaagtaaagacatatataccttttcacttcacaccgtcaacatatccctccaaaataaagataaaatttggctccgtttaaaagaactggggaaaaaatctttaaaaaaaacaggggcacatatccaagtaggggtaaaaataaaattaccgccactaccggagaaatgatctttgttgggtcactcaaaaatcacattagtcctggtttgaaaacacaccggtatttttttatctttagtcccggttagtaacaccaactgaaactaaatattaattttactctcgattcaaaaacatgtcaaagccctattttttagtcccggttggtgttatcaaccgggactaaaaatagatctttaatcccgattgtttataccatccgggagcaaattaagttaaaaaaaaaatagtgcaccaccgagccatgcgcgcctcatcatatttagtcccggttgtttataccaaccaggagcaaagttaaaaaaaaaccgagcaccacctagccgcatgcgcctcgtcctccccgcctcatccttatcccctccactccaactcttcttccagtctcatcctctcatctcccctccattttctctaactccttcatctcctccagccctccccctctcctccccttcctcccccttcccctctcctccccctcccccctccctcctctgacgtcgacgacggtgacagcgggcgccccgcagcgcacgaagcggcagcggcgcacggccggcggcctaccctccgccatatccggtgggagggaggccgggcagcggcggcctagcggaggcggccgggtggcggcggtcgaggggcggaggccgggaggcggcacacggccgggtggccggcggtggcgtgttttctgatttttttttgaatgatttgtaatttttgttgtagtttattttagatttgaggatgatttgttgtgcatgatttctgaatgacttgtggattgtggatgatttcgtggatgggctgagaattgtgcatgatttggggatgacttgttgtgcatgatttgggggtgatttgtgtgatttggggatgatttgtggggatttgagggtgataataaatgcaagaataaaaacaaaaaaaggaaaccggactaaaatggcgctagaatctttagtcccggggactaaagatccatttttactctgggttatttcatccgggactaaagatgggtatctttagtcccgaattggacgtctcggttcattacccgggagtaaagggggttgcgaaccggcagagatgcccatctctccagtagtgcgctagctatgtgtaatcataaaactatatctagttcccaagcttcactggcatggactatccaaaagtcagagcagatcagcagacatgttggcttaaatgaatcaaaagatctagcttaaactacatgcatggggtcatgaggaatgaatcgaaacacaattctgtgagattctttactcctaaaccaaagcctaccatccatgatgcatgttacttccacatgcaaattggtgatagaataagtagctagtagcaatatagtggcatcgaactctcgtttgctgcctataaatggagtcgtctgctcactggtggagaaaccatctttcgtcggtcggccgaattccacaatagtcccggttgcaataaaaaccggggctaaagatcactaaaaatgatctttagtcccggttaaaaagggtaacgggcatatttgatctttagtcccggt

SEQ ID NO: 76487 - DNA, 1366 bp, Oryza sativa
tctctatagaaaacacatactacaataaataagagaaaatttcatgagcatgagaaaacttcatgttgaagaaactatgagtgtgtgataggcaaggtggccattctaacataacaaatggttccatttcaaaacctaggacaatatattggacaataaaactaaatactagactctctttcttgaaagcaacccatagtatttgacaaacactttgatttaacaatggaaagtgaacattttgtgtacacttttagaaagcatgtgcttaattactcaataggtgttataatacattaatactatggatgttaatataattaaaacaatatttaggaccatggtagtatgatacacttaaaaatatgatgatatccaaatattgcatttataaacaagatcttaactggcagccttatttctttcttggtgtaggagatgaatcctatttttatatattcttttcactgacttgtaatacactactatgtaaatactatactcttaaattaagagaagaacaaacatgtactcacttttagttatacacatagggagaactacagtacttcacattcttttcttgatctcttaaaaaaggaagctctataaagaaagtaaagctaaggataaggataaaaagaaagtactatgatgaatagcttggaagaacctagtatatgctaatattagttgaattgaaaacaactattaaaacaagaataaaatgttgcattaatagtcaaaggctgagacaaagcacataagcatactctagaatatacgaaacttttaggaaatctgaaaaattttcaatacaacttctatgttaaaaaaattatatattgtgttttcttttaattgtgtagtactagtagtcggagtaaggagaagcaaaacatgaggagggagcgacacaaaattaaccagaggaaagaaagcaaaaatggcaaagaaggaagaaaaaagaaaagggaagaagaagaagagacgctggcagcagctgcgtcgagacgctttatcccttgcctcgcgagaacagaaaaaagaaaaaaaaagaagaggaagaggggaaggcaatccgaaaggaaattaggctagggttttcgccatggctaccacccaccacctcgagctccccctctccattcccaatctctccgactcctcctaattaatcccgtattcccaccccccaagccaaggacagcatctcgcatccgcgtccttcaattgatttgattgggttccccccctccatttcagggtttcgtttcgcatcgcagcaatcttcccgacccagcaagcttcttcttcccttgggtccgttagggtttgagattgagaggggcggcgctggcgatcg

SEQ ID NO: 76488 - DNA, 10558 bp, Oryza sativa
  unsure (1)..(10558): unsure at all n locations
atgttaccgagagattcttgaaagttacatacaagttacattatagttacagtgtaattacatgcaagttacagtgtaattacactacgattgtactgtaattacatctgacaaatattagggggagaaatttgatgacaaatatctagcaaaatcgaataggaatattgtttgcacgcttggttggagcgacagactgaaggaaaagttcactttatgagtcccagtttcattcccgttgacattttttcgtggccaacacaagatccccagtattaaaatccattcgctcggcggtttggatgacgattttatcaaatgtaaagtgtttactagatctacataaggatgaattctagatgctcgctctggaacattttttttttttttgaaaaataaccaccggagggagagattctccgcctgaattatattgaaaagaggaagggggttacaatcaacatgatgtcaacaactttcgtagttaatcagcagccttcgatctccaacactccgcgaggatgcaagcaggaagctcggctatatgtgctgagcgcctcaaacaagaagatatatatagggctgtagctctccgttggcaagatgtattttctatttttcttcctccttttaaccctgcaatctgtactgagcttccttgtaaaaccttcacaaccttgacttgtaaaaaaattactcagtagctaaatttaattaagtaactaactttagcttttataacataaaaaagaataagatgatacctaaatttgttttgcaatctgtaatctatataattaatatagacattgaacacctctccgaacaggtacaatagtagactactaagcaagctataaacacatatcgagaacataaatgagaagagaaaagagcaaagtgttatagatttatagccagctgtagcacaaactataagactcaatgtgtgtatgataggtgggaccagatattactagtttataggtaactattgtatgaattagctattaaattaactatagatgatttagagttagtagttgactatactctatagttggctatagattattcggagctagtagttggaagaagtccatctacggagtgaaaagacacaacataacagtggtagccatatcccttggcgatgacatccggcacttagtcgctgagccactccggtcgggcgcctgccaaacaacgctcctgtattgggcgggcctcgagtgctgagatggcatggttcagcgccattttccttagcactgatctgcttagtccatggctcggctctcaacgctagctgtaatggcgctgagctctgactactcagcgccatttttgctggcgctgagatccggccctggttccagcaatccatccattcacagattccagcaatccgtccatccattcacaagcaggttcacaagcagcaagcagccaacacaagcagttcacaagccggttcattaacaagttcacaagcatccatctattcacaagttcacatccacacacagccaacatacacatccatccatccattcacaagtttacaagccgcaagtagcaagcacagaacacatccatccatccatctatatatccacaacacacataggcaacacacatccagcacacatccatccaacacacatccatccatccatcacacatccattcacaaagttcacagaatataggttcacaagttcacaaaatataggttcataggttcacaagatcacaactaaagaggctatcgactgtgacacctacttcttcctaccccttggagcacgaggttgatcgggagtgtacctccagttgaaacatgagctatcttgtgttgtggtcgagatggcccctgcaacgactgtggagcgtcctacagctaggagggaccgagctccacttgctcctcctcttcctcctcctctctttcttcctcctcctctccctcttgtacaccctcttgagccactcctcgacttgtcccctgctcagcccgtcgaggtggttcgaaggcatcgtcggccctgcatcccagacatgccgccaacttctgcatcgctgtcatagagtctagcaccaacagaaggaagcagttagttccaattatgtgtgcggtgcacgaattttacaaatctacctgtaatgcattccgaagaatgctgctctcttgttgcgagctagggggcatgccaagtgccacgcccgcatcgttgactgtcctgatcagctcccgtgtctgtaggagaagttataagcacgaagtacagaaattggaaaacgagtaaatagaacccatactcaccactttgtctcgaaccggacccatcccgaccgtgctacctctatgggtacttgtatcgtacttgttctgctcctccacctcaatcaggtcatccagtatgtcggttagcgtccaagccagacgtagggcactgcggtagttcctcgcgagccaggctaagtacgcgtcgaactcttacctgttgtgcatcgcgttatccggcatgcggttggcttcgaactggttccatcgatcgatgtgtgtctgatgataagcagtccaatcggtggtcttcttgtttttccttctgtccaccctacacgcaagacatagtaatatgcaattttttaatgacaaatgtgtaaataggaccgactagatgaattatccaagaattgaacctgatttctacgtatggttatcggaggcaactggacttacttatgaagttcgatacttgtagagaatctttgcgggatcgttggcgctgagggtgggcatctcagcgctgaagcggttggcgctgaggttgggcaacacagtgccgaagcgattggcgctgaggttcttgccacgtcggcaggggggtcggctcggccgccacgctggcacgaggtcagcgtcaggtccagtggcgctgctatttacaacctcagcgctgagccgacggaaatagttgaagtttttggcagtggctagtttcgaaataagttttttaaaaagatcaatttgtcaaaaaaaaaatggtgaagtccattcgcggagtgaaaagacgcaagataacagtggtggcaattaagaaggttgttcctgagcatgcaaacaaagatggatggatcacatgcgtgcattcacgcacgtatcgacagatcccgagggtcccaatacgcaaccaccggctggtacatatgcatatgcatgcacgctctatactattagctaaacacagtagatcatctcccatctccggccggccggccgatctggaagtttcctatcgctaaccagctaagctaacctaattaacccggccttaatttctttcttctccacctccatctatcgctagctatttataccacccctcctcgacagctttgctcactccagtactccaccacaagctctagcttacagctcactaccagtgtacattgttgctagttagctagagctagatctcgatcgagacaatggcgggtgctcgcaggacgatggcgctggttgcgttggtggcggtggtggcggcggcggtggtggcggagagggcgtcggcggcggtgagctgcggcgacgtgacgtcgtcgatcgcgccgtgcctgtcgtacgtgatggggagggagagctcgccgtcgtcgtcgtgctgcagcggggtgaggaccctcaacggcaaggcctcgtcgtcggccgaccgccgcaccgcctgcagctgcctcaagaacatggcctcctccttcaggaacctcaacatgggcaacgccgcctccatccccagcaaatgcggcgtctccgtcgccttccccatcagcacctccgtcgactgctccaagtattctacattttctctctctctatcttcatttgctccatccatgtgttggcctaattaagctaatttcctctttccttttttatgcaggatcaactaattactagcttgatcatctccagctgagatcgatatgtatgggaagatctagagagtgactgttcactgctagctttgtttattttcttgctgcatgcgtacgtgcactatataatgtaataatgcgtttcaatgtttacatgtagtgtactatgtacactacttatatatttttcatatataataatctaataatgataataatgtcgtactgatacatgcgtacacacacttgaacttgctgtgccccgtttttttacttcaataagtaatagtatatggatggaatgatatgagctgttattaatttgaaaaaatgccaaatggaattctggaatataatgatggatcagtgacgaggctccatgcgaccacgtagtgatgaacgtacttccgtacatacgttttttatgggccggcagcacaccatgcctgaaaactgaaagaaaaaaaaacgtaatgcagacatgcatatatggcccatcaattcatttcttggatcctagcccattaaacaatccaaagggagaaggaaaaagtgcactgaaggtccctcaacttgtcatcgagttacaaaatcatcctccaaccacaaaaccagatatataacatctctcaattaacaaaaccgggtcactttagatcctctagcggttttaaccccggttttatcctacgtggcagctgagtcagcatgggacccacgtgaaccccgcatgtcagggtgaccacgtcatcacacaccatctctctctctctttctcagtttctcccctcttctcgtcttgaagacctgggcaagctcctggaggacatccgcttcttggtcgccgccagcggcggcggcgctcgctccggcgcgacatcggccgcatcgtccgatccctccagacgcggcggggcggtggcggtgcgacggttccacggccactgcagaccccgctgaggtgaaccgctgatgcccacgccgtcagtgaagcggtagggcggccttctcctcgtccgacgataggggtgtccggcgccgcgggtgggggcgacgaggcagggttcttggagcagcggaggaggcggtgggtgccccagctgaggttggggaacgagaagcggtgaagccacgtgcgcgacagcgacggcgtcctcgctctccctgtcccctacccgccaggccccgacgcggcacgatggcagcggctgctcggtcgccgccttgcatgactgcgcaggtccggggatgtcgcatggacggccatccgcacggcgtcgatgacctccgcggcgccgctcgggccgggggacttcaagcttgtgcgacgcatcggcggccgcgacatcgggtgtaacaccctacctccaaaatccgcattagtccgctctacacgttgagcggacccacgtttgcatggtatcccgcttacactttcgtcctcgcttcgtgtaaaagggttaacccggggataccatggttggagcaccaaggcttataagcaggccctcacccacctaaacttccaaggtggtactaaaccaccactatacaaccacttctgggccacatgggccaaatacacactactaggcttcaaacgggctggggtgttacatcgggacggtgtacctgtgccgcctccggagctcaccggcatccgcggcagtgagggagagctgtgcctgtacgcgatgaaggtggtggaccggtgggcggtggcgaggaagcagaagctagagcgtgcggcggcaaagaagcggatcttgcggcagctcgaccaccccttcttcctccaccctcttcgccgacttcgacgccacgactcacttctcctgtgtcgtcatggagttttgcgccggcggcgacctccactctctcatccaccgcatgccatcccgccgcttcccgctccctccgcccacttctacgcagccgaggtgctcctcgccatcaagtacctccacatgataggcgacatcgacgacgagcaggatgacacggctggcggtggcgcgtcctgcttcccagaccacctcctccagttcaagcggcggcggcggcgcctctgcggttcgtggccgagccggtgaaggcgaggtcgtgctcgtttgtcgggacgcacgactcacgaatatgtcgcccccaaggtggcgagcggcgacgcacatggcaccgccgtggagtcgtgcaaggcggcgttcgcaacgccgccacgaagccggcctgcccagagtccagagtccagagagaagagagagagaggaggaggaggaaaggagaggctggcctacttacgtagcagcttgacatgtggggcccacatgggtcccaccctgactcaaccgccacgtcggacaaaaccgggatcaaaaccaccgagggacctagtttgcactggttttgtaagttgtgggatgcgctgtatctggttttgcggttgagggactattttgtaactcgatgacaagttgagggaccttcggtgtactttttccaagggagaatgctctatatccttttacctccttttgccaggcccatgccacacaaaatttgattagttaatcagaaaaaaaggggtaaaatggaaaaaaagaagaagaaaagaacaaaacaaagaactattgtacacagttcaatgggatgtttattgtaagtagtagtcctcacataagtttgtgtatacccactccccttctctcgccttaattattatgaaaaaaaaactactctcacctttatgtgatacattagttctgtatagcaggctcttcatttgtcccctctactccccactccatagttattaagaccggaccggagaattaaccagtcgagctctcggttcactagtctggtggttcgaccattggttaggccggtccaaccgcggtttaatgtacaatatagcgcaaatgctgggtaccttcaagagtgtaaagataaagtgtgtggtagtggatgctattctcagcgatgccacccaaggtccattttttatgtagtttgctcagtgggctaaggcttttgatggagtttgctcattgggcctcgcatcagcccatcaacaaaagcgtagtagcttgttaccctgtctgaccacttcggttcaaagccgggtttatataaanatcgcccggttcaatgggttttccccggtttaaggggactggaccggccgaggtcttaccactccggttcaaagctcggtttatataaaaactgcacgattcaatgggtctccccggttcaattgcgcagtcgatcttttaaggggaccagaccgaccgaggccatggttagggtttttcccggtcggaccgccagtccggtcctaataactatgccccactctttcctcttaatgtgaaagaatatttttgtcaccaagatttatattctttttatgttcataaacaagggatacttcttttttcatcgtaagaggatgaggtggcctctcaaaaaaaaagagcgggtgtggggaaggggagttacaagataatttttatactctagaaaggttgagagtaatcttttttttcgtcaggaggttagagagtgccaaagaggagggtaggaacgagagggacaggaggggtccgaggggagtttggagagtgtaggacaaaaccaatgcttgtgagagtatattttttttacatcacgagggaaagggagggaagagggataggtgggcaactatgaggctcaatgtgttatttaccgctaaaataaaacttatcgctttttttatttctccccttatttttcttatctacttgtgttctattcattgacctgggtcctagttggctagctagcattttgtaataaatctatcatatatttattgagtttcaacccaataaaaagattaaaggacttgtttgggatggaaaaaaaaccctagcccatatattcgtaaggacatcccaagaatttatttcaatttactggtgcacctcaaatcataatttcaactctcatcgtttgatatatagctaatagccgtaaaaaaaaagaacagagcaactaaaataatttacaggataaaacttgtatatccatgttggcaatttaaaacacaatggcaaaaaacaaaccaagatagaggaaacctgaaaatcaactctcgaattatggttgaaaattcaaatttttgatgtggttgataagccaatttgcaaacgcgcggtgataatattgtaaacgctacaaactgatagttaaggtccttgtgttcgggtggctgcctaggttctgtcgttgacatctccactgcaaatagccattgatgtcacgaaaaattggtcgaccactggaaaacattattagtcatccagacttcatgataacgctctttctcttgtgatagaacctttttatcttggttcaagccatagtataggcacatatgcttgtttcttttagatttaatctcttgagagaatatatatatatatactctacctacatatacagatacgttcaacagtaaaacgtgtgcccaccgaagttatgtgagttaggcctctaatcttatttatcatatgctagtgagcgtgtgacgtccaattcttttttttcaaactctctgtattaggcctagtttagttcccaactttttcttcaaacttccaacttttccatcacatcaaaactttctacacacataaacttctaacttttccatcacatcattccaatttcaatcaaacttctaattttgacgtgaactaagcacacccttatttcaaagggaatagtgctctatcatacaagcctgatgaaaacaccaaggttgtgtttagttcacactaaaattaaaagtttggttaaaattggaacgatgtggcggaaaagttagaagtttgtgtatgcaggaaaattttgatgtgatgaaaaaattaaaaatttgaagaaatattttgaaactaacacgggccaagatgaaccgatggtagccctctttaatttgtctaacgtctacatagaaagttggccatgggttgctgtaggtggcatcatgatatgcattaatacctaggaggaggagtaacggttggcaggtagatcgatacgagaatgacatgaacataatggatcgtcggcttcaatttggaagccacctgctggcgaccgacagccgtcccggccgggagggataacctacgtcaacgataaataaatactcctactaactggagtagctagcagcttggtcttgtgaaaaagaaagataaaattctactactccatagtgtacgtggtcttatctagagcttaattggattgcaaaatagcatacagctgattgattaaaaactacgttaaacttagtaactgaaaattcttagatttaattaattgatcgatctgctgagagctttgcattgtggagcacatgccaagccagctagtacatttttgtgataagaaacatgaagtttcggtttaacctcttaaatacatgcatgcatggttgatacaatacacgtcctgaacatgaataaatactactaaatatatgttatccgaattttatcatataatatatttggattagtttcttaatatgacttttattcttttatcccaattgtatatcaatctcttgtgcactaacactggtggagaagtgttttttagtcccgttttataacccccttagtcccggtttttaaaccgggactaccaattcgagactaaagatcgctatctttagttccgggtgaaaaaaccgggactaaagatcgatctttagtcccggttggtgttatcaaccaggactaaagagagggtagcggcggtccagctggtcctttttttcttttttattttctcccgaatcgagtggtatgcatatcgtcaaatcaaaccccaaatccacatcacaactccacagcacgattcacaaattcatcacaaattcattcacaatatccattcacaatatcacaaatatattcacaatattgattcacaggttcattgacaacatcgagtcacatactcattcacaacatcccagattcattcacaacatcgattcatagattcattcacagatcaaaacatccaaaccacaaataaaaaaaacaaaaaaaatcgactcaccgggcggcctccaatcccgtcgccggccggccacccatctcgccgcttcccctccggccggatctgggggaggggagggcgaggccgcaggcgactggcctccatcccgccggcccgcgccgggccgccgctggccggcttccatcccgctggcccacgcccggccgccgtcggctgcctctgcaagggggaggggaggaggagagggggtgagagaagagcaaggggaggatggaaggagaagaaaaagagataagcatggagagatgttgcgcatgcacatgattcagagagagaagcgtgggctggtgcatgcgctttcttcccggttggtgttaccaaccgggactaaagatccgggggcctgacaaggtatgataggtttagaaccgatatcaaatatatccgctgtagccaccaaccgggactaaatctttagtcccggtttttagtggaaccgagactattgtaaatttcggtcgaccgattaaagatg

SEQ ID NO: 76489 - DNA, 11909 bp, Oryza sativa
gctgatatgatggcacttggatccaaacatcatgaatgcgctcaactacttgcatgttccaagtgtacaacatgcatgctagctgctacaaacgactagctctgttaggccgctgctaatcattttctcatcactaatactaacactgtgtgactagctagctaaaccagccctaacaaccaaccaccctgattcaattgaattgaattgaataacattagacgcaccgacgactaagtgcagtcccaaccctccacctaaaatggtgtctatatatggcattaactaaattgtcatgtatgacttttaacttatgtggcactatattaatatattaattaagaaggagagtgaagagaggaagaaactgggtctcatgcaagacacagcttcaacacgagaatctatgcactagacactatcaagttttgcattggaagagaatagtgtctttataatagttgaagaataaatatgattggtagagaagagagatgatgtatttattaatggcccactttaagaaatcatgggttgtggagtgtagtttttattgtgatgtcttattgacatgacaccatagacactgcttatggacattatgggttggaactgccctaagaacggtgcctaaacactagcactccaagcttaattacactatgtgtacgccaattagaaaatgtcatgaaacattctataaacaaattagatatttactcctaatagtattatacatatctggaaagtctcatactcaaatttaatatattttagctgtaacataaagtgaaaaaacccgacagttttaagggtaaaaatgtcaggattttatctttcttgttatggctaaaatataatgaaactaaagataagatttcacatataggtgtaaaactattggaagtatgtgtctaattttttctagaacttttgtggcatttgctaattgatatgtatagtgtgtacataagtaaagcttctgtgtataggatatgttctctaattataattataggtggactatatattccacgtagtaactacatttgacttggtcgatgcatcggcacagatgaaatcatagctacttaaagccccctacattcccgggaattctcatcgatcgatctcacctgcagcagcaaacgagcaccacacaccagcagcagcagcaagtcgatcgatcgtcagcacacacgaccaagatcgagatggcccgtgcacagctggtgttggtcgccctcgtggcagcggctctgctcctggcgggcccacacaccaccatggccgccatcagctgcggccaggtcaactccgccgtgtcgccctgcctcagctacgcccgcggcggctccggcccgtcggcggcctgctgcagcggcgtcaggagcctcaactccgccgccagcaccaccgccgaccgccgcaccgcctgcaactgcctcaagaacgtggccggcagcatcagcggcctcaacgccggcaatgccgccagcatcccctccaagtgcggcgtcagcatcccctacaccatcagcccctccatcgactgctccaggtaatcaaattttatatcgttttgcatgatcgatcatctaattaactaagtacatataaattaatttgtgcgtgtacgtttaattgcagcgtgaactaatctgatcgatcgatcgctaccggccggagggtgtgacatcgcaggccgtacatgcacctgtcgtcgtctcacgctttgtatcttgtgttatctgtgtttatgctgaataaaatgagagctagctagctaggtcgatcgatcgatcgccatgcatgacgagactagctagcattgctgctagatcgatgcatgcatatggttgatcgcccggtcactacgctatctgtttccttaatttattcgtcgatcgactacgtacgtacctgagagctagagatcagtttttgtaccatgcatatgcatatgaacttctgcatgtacatgcagtactacttgtactacgtgcgtgtacgttgtggattatacattatatagacagcttcttttggtatacatatacatgttctacaccgattcctccatcttcctggcattacacatatatacaaacttgggtaaaaaaacagtactgtgttaatttgtcttgaaatatgtatactctaataatcaattaataaattactccctccatcccaaaatatataagcatttttaaaatagcgtcaagtcaaatatttttaactttgattattaatagcaaaaaatcaataatgtaaaattgatattactagatttatcattaaacaaactgtcgtaatatgcaactcttttcatttaaaatatgttgagtttaagaggagaagaaaagagaagattgagaagatacgcaacatgaggtgtgtcattagcgcatgattaattgagtattaactattttagtagtgtaaaacacaccgtttagtagtgtaaaaaaacacaccgctaacgagacaaactttctctctttcacatgttgtcgaaagcagccctactttaacaaatattgttagtcaaagtagcatcgttaagacaatgtcgaagtacaacaatacttatatttttggatggaattattaatatagtcaaagccgcactttgaaagactattgaaaggggtaaaactatgacaacacttaattaagttgttcaacgaatacaatgttggagtattgtattaattagatagccaacagatatcttgcaatcatctgaccaagctttatatctctaccccgcaaaaaaaaaagaaagaagatatgtccagttataacttacctcacacattttataggctcgcagagtgtgagaatgattatcctatctgctgcataataaaaagatgcttatttttctagacctttagagtgaatatgataactttttcaatttactcttattcttttgatataatataatgtttgaaaagatggatggacgatatatatacaggcaggccggtgtactactatatatagttcctaaagtttcttgttcttcatttgaatcggatgcactgcaggccggccttgtttcatttctcctggcgaagatgcccttggcccaaatacacgtcaaaataatctcaaatatggaaaagaagctatgccatgcataaatatttatccatttggatcatactccctccatcccacaaaatatcaattccaatcccaagaagaaagtagtggagagtaaaaatgaccaaaatacctcttattgttgcaaaaggcagtagtagtgataggtaggtaaaaggtatttaagggataaaacttctcattttatgcgttgagagtaggtaggatgatagaagttgatttctttgggacaaaatttaaactctagaagataagttttatttggatagagggagtatatacaagggaaagggcttcatggcccatacatccttacttatccactactacagaagcactaatcggtgccagttgagaaacccccttaggtgccggttttcccaaccagcaccacggaggcggcattgattactcgggtcaaaaccgacacctttgaggcatacacgagccaaaaaaaaaacggcttgatgtatcgagccgtcaagctgatcccaaataataaccaaatcccaaaattgtgtcaaatccatgaacacgtgaactaaattgcgtcaaatccatgaacacatgaactatagtaaaaaaatccctagaaaaacaatacatctagatcaaataatacacatctagatcacatcaacatgaacaaatcacaaagagggaggagaagagatggatccgtggccgccaacatcgtcgcacctccagccggctctctcctaccgccgcatgccgcctcccgccgctgggccgcccctccgggctgccactgggtcatcgtctccactcttgccatgtaacatcctgaaaatccctaataataaaaatcactaaaatttcaaactttttaaaacttttgcatcatgctggatgttatggttgctattgcttgccaaactataaattgtcacgattgaagattaagctaaagccgtacaactaagaagtaattagaataagataattattattaatcctataaatatttgtgtacatgatagcaagccaaataaaacacaagtcaattattaataattacaaattgtatgttaaatacttgaaccatatcgacaagtgtcatgacatctaagtaaccacgaagtagtcaccactacaatgattttatatatataggagtgttccactagaataattaaattaatatttataactttcatcgagtctctcatgggatgaattcactcatgtaaaataatttgtcatgcaaataaattgaactttatatataaaatatgtttatgtgagtgtttaattaaacatttaggtcaatactgtaccaagtatcaatttacttttatggaataatagattaaacgtgtccttgtaaaatacattgttatacaaataaactcgactaatgtgctattgtattattaaggtcacattagaatatttaattagtttttaataaatatcaaagcttataggttatattggataatttttggataatttaatggaaagcaaattcatttgggaactaatgaataaccaaataaatattcaaatcaaacatttgaattctcaaaaccaaaatatattgattacatttcaattcaaattcaatcccattcacttttgcagattagcccctccctttccttcctttccctttttcttccttttctctcttttctcagccgctactattcactgtccgccaaccgttcgatcccgtctaccgcgtgcaccacatcgcttccggccgtgccagtcacgcccgtgctgcaccgcaaccgcgcctccttcccctcagccgcgtccgaccccaaccctagccgcaccgcacttgccgctccgcaaccgcatcgcgttgtatcgcgccatgcgtcgcatcgcgccggacccacgcccgcgcccgcgtcgtcccttccgtgccgcgtcgtgccagggcccgcgccacgccaagccgcacctctaaccgctctcctggattctctccaggaaacacggagctgcgccatcgcccatgtgcgcgcgtcgccgtcgccacgcttgccttcatcacccagacacgcgcgtcccatcgcccctatccatgcccaatggataaaacggagccctctcctccagctagcacccagacctgcagtctataggttataggtgtgatgattaagccacagaaccttaatggagaaggagatgaatctcagccgcgtcatccacctcattgctcttatccgatcaccattagtactctagctcgcctaggcatgtgctggtgatcttatccccatagtttgcttgcatcctaagcgaagccctcaacaaaatccccatccctctcagccttcttctcgtatgcatttcatcgaacaccttgcaatcaccctctcaccaccgctagagatcaccattgtgaggctccccggccggagctggaggttggagggagtggaggaagagccgtgctgccgccgtcgccatgggggaagccaggtagccgctggacatcaagaaacgccgtcgagcaccttacatcgccgctgtctgcccctgtcctgcaccgcgtcgagctccacttcgccgcgtttcgccatctcgccgtctcgcggtacaccctcgcgcccgtagcgtcctccatacatctaattgctagcgccggctccaaaatcggcgattagcgcccatggccgtgccgccccggccgccgtttcgtcgccggcgagctctccgtgggtaggctatcccggcagctcccctctccatatagttcgtgaaatcgaatccccataccccgtagatgctcccgcacccttcaattcggccggaggatgtccctagcaccgaagccccttgtagccgagctcgggcatggcgtcgcctgatggcgccgcgcgcccccgtctcctcgcgcgccggctgccatcggcgggagatcgccggagctcctccgcgcctcaccccggccctcgccgagccgcccgccgccgtcccggctcgggccggccacgccggctgcgccgagtcacgcctctgcctcgctcggtaacgggcgagaggaagaagaagatgaggagagagagaaaccatgtgggacccacatgtcattagcgcacagtaatcctatccctaacggtgattatcccactcaatggcaggtggggtccctatagttaaaatctaagaaaacacaattatatattttattcctatgacaggcgggacccaatggtaattaaacaagcaggtttgaccctaagtcaaccagggccggtcccacatgtcaaccacagtgggttttggataatgtttccgattaaaaataaatcatttatgaacagtgcatttttacaatttctcggattaactcaaatttgaatctttaaattagtataacttattcattttagctccgattcgagtgaaacttgaacctaaattcatctaaattcataagctttccaatggtatataactcactatttaataaaatatattaatatcaaatgattagattatggtcaacttaaaaatgtgctaataaataaaattgatattgtacagtagagtagagtagatgtcaaataaatatatttaacatgttttttcactgtagcaaccacataaactaagtataagtgatgtctcaaatgaatggatgtataggaaaatactagtgcttatttaatattcgatggccatataattaaattcatgacttaaaaattagttacataaagtttagctttatattttgtaactaaaatattaatactcatagatgaatctttaacttgtttatgagaaataataacagagctagtgtgattaaatcacctatacgaaattaattacttaacgtcatgttccttggaatagtatcttttaagttggtaatcaatcttaagttgataaacagtaccaactcgccaaatccacctgcatcacatatactgtatagcttacagtaaatagctcatgcttagtaaatgatctaatattaatatgttattgcactcacaactactgtacagtccatttaaatcatacacaagaacaataacctacctttttcatatattaaactgaggagtctatgataagcgtgtatagtagataaaacattaattataaatcttgacctcacacaattatagtttgaccgtgacttaggattatttatggtaaaattatgcattgagataaactttaactataatattatagaccacactaatctaacctacatagcatgtaattcgttggaaccctaatacagtaatatttgtagagccatgcttagataatccatcctgttagaactcttgttatgattaaattatccactgagccttggtaaatctcctgtagggtgtcaccatttaaattacgatcaaagctggtttagccatgaactccacatagcaatagttgatagataattccgtagtcctgagtattgagttctgtatgtgagcagccatagtttagacttcatagcaccttacaatccattagcaagcacgagtgatatgaatagccctaggtatattccgaacaattatattttgtttgtgcatatttgattgttgcttgaatattggttttctcgcatattatagaaattgtatatcggttagtcgtgaggcaacgtatgcagcttccaggaggtgaaggttgatcaagatcatatcaagaataagaactatcctgagcaggcaagtcatcaccccattccttgagcatgttgatcccaattgtgaaattgttttgtttacaaataaaattgcatgcagtgatgaatatcctacttgttattatgccatgcctttgattattgcttatctcattattcccttgtacccataattacaatgagtccctagtcacttatgacaaatgcttagtaatgctaatttagattcatgcattctcatatttatcaaatgctttatacttgggaaactaccttggggaggtagttgagatacggcatgtggagacatgagtgccacgttgccatgacattgatgagatgatttgtgaaagaaaatgaaaactaaacaaatgttttcgactagggcggctggaggacttgggtggtgtccggaaaaggctagtgccgtccctagtcagttaaggaccgagccatgaagctaagcatgaaacgacccccgtaaaaccgtacttctcgtatgggtatagacctagcagagtaaatagccgagcggaggcagtatccctgcatagtggttttcttgatgtgtgtgaggtagggcctacggtggggcagccattggtaggactgcgaggggcgggtgcctacagtggtgtcgtcatcggtaggactgccatatgtaaacctaaacttaactataacttaatgcatgtgtgagtcttcctttcccgggagcgccagaactcctctcactgttagaaaccttggacgcctagagtgcatgaggactaaagttcatggagcgggtactgccaaagtgaggttgttgaaaggctttgccatggcaagtctcattcgttgggacttaggctcatgtgttgggcaagtcgcggagtacgggtaaagtgtacatccactgcagtgtgagtaaactaaatctattcgaatagccgtgctcgcggttattgagcaccgagacgtgtattacacttggctagactctaaattcttaaactggttaggtgggatgttgcatgatgattttgtactggtggatcaacttctcgagaggcgagaaggggtaaaccccagaaaaccatgacgaccagtggcgggaagctatccttgggaacacaatggatggtggacagaaccgtcgctgtttaatgaacaatagaattaaaacttgatcagtttatactaggtcttaggtttgtgaaatgatatttgaaaactcagctttacgcaaagtaaccatagccactccttgtattatcctgtacattattgcattttctgtggtggcttgctgagtacttttgtactcattgttgctctatgtatatcttttagcagagtattgaagagaagcccttgttagtacgcttgcgtacctaacaagatgatcggagtgcggttctgttctaggtctcgttccccagtcgactgcttgtggcatgtcaactgagcccttgtattattttgtcttccactgttgtttctctgatagttgttggcctgcctggccctaatgtaagtatttaactctcttagcctgaattcattcgtgatatgttgtgattcggctatgtatgtgtgtaccaactactgatccagggattggtactgataaacacagaagatttccgatttacaaaatcgggggtcgacatgccagatctggcggaggggagggccccgccatgttgccgcctcccttcccgctggatctggcggagaggagggtgccgccgcttccgggccgcttcctcccctcccgtcggctctggcataggggagcacgccgccgtgctgccgctggaccaccgcctcccctcccatcggatctggcagaggggagggccccgccatggtggatggaggaggaggagaggagtgctgccactgttgtggatggaagaggaggagagaggagaaggaagaaatggagagaaagaaggaagaagaagagaggaggaagtggattgcgggtgcgggagatagagttcgagagagagggaggggaggaagagataaggatgggagtagatagggtggctcagctcggctcggttagttcggcagataggtgtcggttttaaaaaaaccggcacttataatatattataggtctcggtttttaattaaccgacacctataatatattacagatgccggttttttcttaaaaaccgacacccatagtataagtgtcgatttttctttagaaccaacacctatagttgtttaaaggtgtcggtttttttatgttttcatcccgttgaggtttgaaaaacattatatataggtgccagttttagcacgtccggtacctatagtgccgatatatatgtccctttttgtagtagtgatccctcggaataatagtaaccaaacaatattcttattctgcaggtgtgaacaaattaaacttagttttgtcttgatcatctgccaactattctttttaaggttaactgtcgactactcgcatttctcatatacccatcctcctcgtggaaaacagttctcctcctagactatgtttagttcctaaaaaaagttgaaagtttagggaaagttagtagtttggaaaaaaaattgaaagttcatgtgtgtaggagagatttggatgtgatgtgatggaaagctggaagttgggggtgaactaaacacggccctagtgttctctcgttccccaaaattaatataaatatatttactctttctacacatttacatcaacacaattcgcaatatgcgaagatcgtttcatattgccttccacgtgtaccgtaaaaggggagcaaatacagtcgacagtggatggaggggaatagctctggttttcccaacagccaaccaccagctgctaagctagctcccaatcgtattgaatgaacgtatggacacatgcaccgtttaaacaccacaaacccatccttgctttgttaattgctcgatctcttgcagctgcgtgcaccgcatctgtgcatgcatccacactagcaactctacctatttaagcccctgcattcccgcgtattctcctcatccatctcatcagcaacgaaccaattcacaccgatcgatcgagcaacagtagtaggaaccatggcccgtgcacagttggtgttggtcgccgttgtggcagctctgctcctcgccgccccgcacgccgccgtggccatcacctgcggccaggtcaactccgccgttgggccctgcctcacctacgcccgcggcggcgccggcccgtcggcggcctgctgcagcggcgtgaggagcctcaaggccgcagccagcagcaccgctgacaggcgcaccgcgtgcaactgcctcaagaacgcggcccgcggcatcaaggggctcaacgccggcaacgccgccagcatcccctctaagtgcggcgtcagcgtcccctacaccatcagcgcttccatcgactgctccaggtattcatctcatcatctctaattatatatattctgttaaatataattaattaagcatggctaattgcatgatatatactccatcatctaatatatatatgtgcatgtgtgcagggtgagctgagctatcgatcggatggatcatttatatgcatacagaagcgcgacggtgggtcgatgtgtggagccgatcgaattctgtatccaatattagtagtatctgtacgtattctggaataaaaagatgagctagctaaggtcgatcaatcaccatgcatgcatgtgtgtgcatccatggttgatcggcccggccggtcaggctagctagctttcttcttcttgtgtgttcatctcgtacgttttgctccttctcgaggtgtacgtgtaccagagagagctagctagagattctacatgcatgtactgcaactccttgtactacgtgcttgttttggaatattacacatacatatagctctttttggtacatatatagctctttgtagagctccacactagtatagatactctcatctgtgacgtcctctaacatgcctagaattagcgggctgtcacaagaaagtcatttcaatcgggccgaaaaaacgcccgattgagatatggtcataaaactcacgcctgtcatggatgacacctatttgtgacgggcc

SEQ ID NO: 76490 - DNA, 2626 bp, Oryza sativa
gtatgccatatggaatgtccatcaaccacgtgcatcaactctagcctaagtatcccgcatgatctctgaccaccacggacgtcatcttatccccaagccgactcccggtccatcaccgcaaatactctcccgagacatcgagtcacctacacatgaaataaacaaagaaaccatattctgagaccaagctatctccaacttgactcattagtagcaaacaacagtattacatacgtataggatccatctagaaatcataatcatgaaataatcacggatatccaaacaaacaacctgaaaccgaaaccgacacagcgtcggccggtcagaccgtgggctggccggtctgaccgctcgatcaccgccggtctgactggcatacacaactcggtctgaccggtcacataaaatgatagaatcctacgatcacctgtgaatccaatcatctccaaaaccacttcgtgaataaattccaaataacaaaaccaatagtctccaatgcccaattgttcatcacagaataataatcaaaaacacctttgattttacaattattttatgtaaggaaatctccttgggagccttgctcaaatgtatgcaatgaagatccagattgttgaacctgtatcaatctactaatccaggaattgatacagttaaaacatgtcggttaccgaatcattagttttgggacccgacaggatttcgggccagatttagcccaaagagagggagaggattatttgtaggttgttttattttaataatctctgaaattggtttttgttgctttaatactatttagggtgctcgagggaccaatttagagcatgaaaaatttaagaaaaataatccaagccacattcgattttttttcttccctgtattttagtgtttgagatttcttttaagcttttaattatttatattattccctttagaaagtgattatatgattttatcaggacgttgcaaatccaatcccttacaagaatctcaccaccgagattcgaaagtgctagcaagaaggtaggtgtgggtgtcatcttcacttcttatgtagctttccctttcatctgaccaatctgataaaatcttccaagagaactgtttgattggtgagatttttcttcatggcatttctctagcaccaagttgacttcacaattttggaaaagttctgacgtcttcttgatctatccaagctaagcttatatctgagttgccggtacttagagacgccgctttcattatgaggttgttaactttggtacatacatctttaactgaaaacaatattttcttatgtcttgatgtcgatgtgatcttattgtagcttcgcattggctttcttatatttcaatgtttcctggccttgtgatgtggtatatttttagattagttgatgttgaagatgaaggttctatgtatcttggaaacaaatactcctcaagggaataactattcttgctgatttagtctggcatatttaccacctgtcttaaagattaccgccaactggcttgtggttgttgtgatctgtttatcttgtcggcctgatgcttcaccattggatctgtagcaaggagttcctctatattgtcgcatgtagattactttggagtagacacttaacatagcttgaaatggatacaactcgggttcaatatcttaacatacaaattaatgtctgctcttctctgtgggtctcaattatcggaatgcaccttatcctttcatataccccaaccttgatgtgactctttcattggatatatctgccagtgtgatatatggtatgatctactccctagttatcctttatcaatcacctttctgcctatccctttcttagatggtgtgaagcaaatcttctgtttcatcgcctttcaaagaaaacttgaaatggttcatcaaaagctatatcgaatgccttgtgaaaatgatagcactctgagtgggtttacaccactagggttttgatgcaacttacgaacttcactttcacttatcctgtcttactataaagttataacccactaactcctaaagcttaatatgcaaagaagccacatcatcatccactaataatcattaaatttaaatatcatgtaaacatgctataatatctataattttataatttattaaattttagagcttttaaaatgcaagcatgttaaatcatgatcccacataattcacataatatttcaatatatatcttcattattttttttatgatatttctctcttttcttattaagtcatatcacatcaattatttttagtgcttaaatgattaatctatggttcaaattatctctctacctttcttctcattaattcatatcacctcaattatttttagcctttagatgattaatctatggtccaaactatctcaatatttttctacttttataaagtcatatcaccttacctttacatttgaattatcattctatatactatttaaatttaaattatcatgaatcatgttaacataagtaatcttatgtgtctagctatcttacacattatttttattcatttttattcattgttagagagtcatgatggacggtcactaatacaaaaatgattttccatggcgtcaccctat

SEQ ID NO: 76491 - DNA, 1568 bp, Oryza sativa
tgtccagtgccagtgctacttattttaccttgataccctattgaatcttccatatgatcaagttcctaaacacatgttgctttatatgtggaatctgtccattgtcaatcctcagaattctgccaaagatggagatgacattcttagaaggtctgatagctatgacgttatggatcttgaagaactattgaaacagaggacattcacgaggcaagtacctgtttttgtataacattaataggctcatgtttagcaagtaatttgagcagtattagatttgttgctagcatttcagtaactggtaggcataggtaccgccgatatatcttttaattgcataataccccaaatacagcatacacctaaggaactgaacttgatctgcaatgatggggtacatccatgaagttcataacacagcatcacactattaccatgaaatgatttgtactaataataatttctatgtgaccaagaaaatataaaccatgaggctatagaaaacatgggtttccctaactggtttttctttttttaggagaaaaagaagtgtacttcagttctaaagctgggaactaagaaatggacagttgtatggcatttactttggtattagttagttgtagaaaataccattgacatttctggaaggttctgttaccttagataatttttcttacccgtgtcttctttttctcatacgtttgtttatgctaccacattctctcctgtaccttctcccttctttttttctcacttaccgagaccaattttctgtggtgaagttatacttcattgttaatgtcatgaaccgaggccatgatggcataaccaccactgggagggtagccgggcggcgccggctattggagaagggatgtatatttagactagggataagaagatattaaggaaagaaattatactaatctgattcattgcttaatgataatagacacaatcccatccttatatagattatataacttgatccttaagtaaggactcaatctaatctttgactgataatcttatctctatatgggctgcttatggccctcagccttttggctcaatgctcatcacaattaacttactttattgtagttccatttaggctggtatacattggagaacactaagaaaattgatacatcctgcatagaaaaagaagttcgcattttctttgtagcagttaatgcatcagcctgcagttgtatatgatttgcgtacatgatttgtatggagtagcaatgcagttgggggaacacatcttcttgatagttcaatcctcatttatcctttaatacttccatgcttctgtatgagttgaagtgcaatgccatgttttctttgctagatcctattgttgtgaatacctgttttgcctattgcattgtaacttgcaaatttgttttgctaatgtccaagtgtacagtagaaatgcgaaaacatatttctatcttacaaataattttctgtcttgcaggagtgaatttgaatatttgtctgagttgttgttatctagaacggttgggtccaaattattgattccaggagttggtaat

SEQ ID NO: 76492 - DNA, 512 bp, Oryza sativa
tatgttgtgcttcctgtggtcactagcttaatacggtgttggccttggtggtgtgtccaacagtgtaatccagagagaactccattgacaattgtgtaactgtcattatcaaatagtggaatttttggagagggccgagtagcgtcccgtggttttttactcctcatctcgaggatgtttttccacgtaaatcattgtattatttgtgcaagttgctttgatcctttataattacttctgcagcatccttcacttctagagatgggctaagtgaaaggtttggaactgtcaatgtcatacatgaccgtcttccaaatcatgcatggtcgtgtgtatgtgttacacactagtacagatccttctatctgtgacgggctctaatatgcttagaaatagtgggccgtcacaaggaagtcatctcaatcgggctgaaaagtgcccgattgagatatggtcgcatagacatgttagatgggtataaaacttaagcccgtcatggatgacacctatca

SEQ ID NO: 76493 - DNA, 1021 bp, Oryza sativa
attcctgcagccctttggattttcgagcacgatgtgtacgtttgtatgaagtgtgttttttaccacttgtgttttttatttttccaaacaccaaaacatttttgacgggtttgcccatgtgttcatcaaggaggagattgtaaaatcaaaggtgtttttgattattattctgtgatgaacaattgggcattggagatcattggttttgttatttggaatttattcacgaagtggttttggagatgattggattcacaggtgatcgtaggattctatcattttatgtgaccggtcaaaccgggctgtgtatgcctgtcagaccggcggtgatcgagcggtcggatcggccagcccacggtctgaccggccgacgctgtgtcggtttcggtttcgggttgtttatttggatatccgtgattatttcatgattatgacttctagatggatactatacgtatgtaatactgttgtttgctactaatgagtcaaattggatatagcttggtctcggaatatggtttctttatttatttcatgtgtaggtgactcgatgtctcgggagagtatttgcggtgatggaccgggagtcggcttgcggataagacgacgtccgtagtggtcagagatcatgcgggatacttaggctagagttgatgcacgtggttgatggacattccatatggcatacgatggaggtattgtgtgcgtatgggatgcagagtcgaatttggaaggagtccaaatttggtacgattggttatgtaaagttttcttgtactagagggtttcctaaggtgtttaggactcttagtatgagtttggttcgtggctttaggctgcctacctcgggtataaatagagggggaccgtgaggcttcccggtatcgctttaaagagcaattgaattgagttttgagttagggtttcgagtttagtcgaaatttttgtaaggagtactgttggtgcactttgtaaacacagagagaatccataaagtcgtcatctactttaagagttcttc

SEQ ID NO: 76494 - DNA, 4875 bp, Oryza sativa
cgccctcccagcccgaccccccaatcgacgacgacgagtggggccgggacgacccctcgtcctccggcaccgggtggggcgagccgggtgtgtccgaaccccaatccacctccgccgccgacgacgagtagggtggggaactggggatccggcgccaccgccaccaccacctcctgccaccggcggggatggaccgtggtgggggtgggggtgatgcctccgtggcggcgctgctgctgccgtcggcgccgatggcgtacgcggtggtgactgacccggggacggtcgacacccctgacatgcccagctaccagccatacgtgtacggccgcctcgaccccctgcgctgatcccgctccagatgaaggaggtcgacctgtccgtcgactgcgcgctcggcgaggccgccgtcatccgtccgcgcgcggtggtggctgcacttcatcacccgcagccgcgactgtgacgtccgcgtcgtcgtgcccatgggcgaccaggtaaatctcgatcggatcaaatttggagagcgaatgttgtttaatttggtactacttggttgacgtgcatgaatcaaatgcttcttgaatgatggagtgcaaaccaaatatttctggtgggaactggcgtattgcagtgttatacatgctgaggttacttgcagatcagagataatgaaactttttatgcactgaaatgtgctttgtactgtgagtcactctgaagatatttctcctgtttgcaactatgagacatgctcaattttgtatttattttacgctcttaaattagttcttttgctatatttctggatagatcgagtaggtttcatttttaagaattttgtttctggatttttggctagcgattagttcggatactccaatgttaatgttgtgtagaggaagatagaactacatgagcagaacatctaccagtcacttatccatttatctcttcagaattttttggtctcagatcaaatgacaggagaaaataatggacgccttctctatttttcaatagatatagactcagaaagggaaaaacccatagcttatttcagtttcattttggtttatgcctcatgaacttgttgttctctgaattttctaaagataattaaactggcaaactgcttgtgtatatgtgtgtgtctctccaataatgcctgccatttcatggtttatcatgtcatgttcctgaagtcaaaattcttatggcataagcaagtgaaagtaatcccttgctttgtccagtggaaatcaaatacaacaaggaatgtgctggtttagcagagtggtaacctgacttgtgtatcaaaattttggcttcgatctgtattatgtgattgcccagtagtagatctagagttcgacacaattagtggctagggatttggttattggcccttgaccagaagtttaatgattgccagtggaatgtcagtagatctagattgggttcttgtgtcaaaccctggctcgcttcatttatcaggtagcaaaccatccatccgttactattgttgccaattactattttttctcagagctctgattcccagacattaagctagacaagttgattcccatattagtctacattgtgtgatttggtccataagagtaatttaatttctataatagagatttaattttcttggattagtcctagcttataatatttattttacatctaaatgatttgtttcttgtttcagccttctaagacaattatgtcaggaccaactaattttcctccctctggccattttgtgaagacctaatgttgtggcaccacaggtactttcacactagagtccctgctactcataaaactttgtttgtgtctggtagtgaattgtttggcatggaattaatcgatcagtgtcttatcatacactatgcttttcttggtcacatttagttagaatgcagatgttggttaatatcttccctagaaaaacaaatttaattagaatgtagatgcttttcttatgctatttttgccttgcaattcatcgtaaggattgtgtgaataattagtgttacagtgttttgttttctctgtttcagtaactaagaaaacatatttttagctcagtttgtatgcatgaaaacattagagctttctagcctctagaagtgcaaatacatacttcacaagtctaagtccttgtatatcttttggcaagacacatgctgctacatgtgttggatagatacatgccatccaaataataaattagttttagtctcttgtttttttcttatttacaaaccttttataatttaccttgttcacggcacttcgtatttttcttagcaggccatagtttgaatctaaagtgctgcagttaaatatctacagaatgttgcacatcatgaaaatcagggtatgcttctcattcaggccatagcttgaatctaaagtgtatgcagttaattcagaatgttacccaaggttgaagcaccacagaacacggactgttggaagacaattttcttgtacatgtgtttgatgaattgtaactgaacacatttaattttcctatggaccatttgtatatttctaaatccgatttgaatgaatttgttggtactgaacttagatggactatttttgtaaactttagaaacttgaattttgatgtatgaattgagatcgatgttcatatatttatccaaattgctagcaaaggcctgaggctagctaaaaaaacaatttttttttgtggattatactcatctgtgacgggcattaactcagagcccgtttgagatgagagtcatccatgacaggctatactttaggcccgttagagatgagagtcatctgtgacgggctatactttaggcccgttagagatgagagtcatctgtgacgagctatagtttaggcccgattgagataagagtcatttgtgacgggctatagtttaggcctgttagagatgagagttatctgtgacgggcttttgtgttggcccgattgagatgtgtgtcatccgtgacggccggatgtccgattgagatattttaccacatcagtgacctttacttagtgacgggtgacgggggctatattcgaaagagatgaggcttttagcccgttagagatgactgatcctgttctagtgccatctatctctacggcattggcgcctgtattgcaatttccataagccattttctcgatacataattgctactatctcatcccataatataagaagttttagagttcgatacgtcattaagaaagtaaagtaaaattaaatggaggatgagtgtaattagttgaaaattggatgtaggtgggaaaattgaatggtgaaaagttatgattggttggggacataatgttggtgaagaagatgttatattttgggataaattctaaatcctagaagttgttatattttgggacggacgcagcgggtctgggaggccagcggcaggcaagcgtcgcagcggtcggcgagcggcggcagtaggtggcaagcggaggtggccagaggaggagcgtagcgggcggtggacgagctccgccgggctactctgcccgccgcgtcatcgtcgtcctcaccatcggccgcgccatcatcccctacggcgcgcaccatcatcctctatgccgccatcatcctcggaggtgctccgctccttcaaggagctatgcctgcgttttgagctcctcgccgatgagcccaccatggtagaaggcgtgttgcccgggtctcctctgcaccccaccgccgctaccccgcccccttgcctccagctccggctatcgtcgttcctcctacctgcttcgtgcgtggccgctccgcccgatgccaccccgcttgccctgctcctggctgagagaggatagagagaagagaattagagtgaggatgatatctgggccccataatttttattccctctttgctaattaggaagccacatcagctaaaccacccatatatactgccacagaacctattttgcacggttttgaacatttaaggggtagacatatctagtattggggattgaggatgtcatataaactcgatgtaaagttaagggatggtaggtgaacttattccttttgaaaacggctaggattggcccatccaatattggtaataggattgaaggcgatttaaaatatggcccatggcccactacaaattataattatattggcctactgatgaatgctaccactgagagctgccgagctttgcttgtgtgatagcacaatcctatagctgtagatgtttaattcaagttaatggtgtcttatttagcatttatatatgctttttaaagaaacaaagttgataaagtactcttgtttctttaatatggacaccttcttatgtttatctgcatgttatattttcccgcaattaaaacatattaattctttcttgagtaaaattaaacttaaggtggatactaataagtgcaacgaaacactttttgcgatgtgacaacttgcttagtccgtactaactttaaaccgaccactcaagtgaaaatgatcttacaagacgctctctataacacgcttgtacgttccaacccatgctagcaggatagtactaattaattgttattttgcaggaaaaaaaacccataacttgcactgtataactttatataagtatttaaggtccctgcatttttcaatggctatttttattggagaatttgggcttgaggactaatgttgtcatacattttaactaaggttgaggacaaagtagagttgtgacaggaaccgaacaatatctattaaaattattacttccttaaggttaggtgtggaaaattagttgccaagtaaaattccatgggggtccatgcatgctagctagca

SEQ ID NO: 76495 - DNA, 2438 bp, Oryza sativa
tggattttttttctttttctacaaaaatactacaaatttctagcacggcatatacttccttcatcccaaaataaacatgtgagtcctctacgagctatatgtttgaatctgcatatgtttgcatggcctaaacaggttattatattgtacataaatgaatgttttataagttgctatatttatttccaccatatacgtttgtatatcataagtgtaatttatctatatttattcttgcttggtagcttgaattaattgaaggtcatggtataatttatataactgaaacaatcaaatgcggcagagatatgcgtacagttggaattaattgaagctaatatatgtgttgcactgttgcatggttgagaagatttggcgggtcattatcgatcgatcagagcaaatattaatggtgagaattaatgtttacctttaaaatgtcctgctactgcgaaaactatatacatttttcctccgcacgctgaaaaagatagaaggtgtgcatatagccttttgttacagtttccaaattccaactttaataattaaaacttttaaatatattgtcactaaccacgaaatcaattgaaagtaatacaaatccaatacatgtcacctatatgaccctaaatatatattactagaaaaaatgcctatgctttacaacgggtaaagtcctttttttatatacaataactgttaggagctaagtaataaattaaaatattataatcgctaaacattataattaaaaagttaatgaaaattattcttgtttttggtcgaaagcccatttcttttttccttttcagtctcggcctactacgctacatgttttcgccccagcccacaagtgaagctgcagtcccagcttgtacactctactaagtcttcaacctcgcgaaagtattctcgtgcccatgaaataccagagctgatcctcctcgtcaaattcggccgaatcttttttgatctctcaaaattaatagagggcttttgatccactcgatctgctctatccgtttttccaatattagaatgaaccaaactcaccgatcggccttatcagagcaaattagaggcggcgcgtgcggatcggactggaggagattgaataaaaaggaaaaaaactcgtgacccactaaaaaatcgaatgaaaaaaaggcaagtggagaagggaaaaaaccaggcccacaaaaaaacgaaaaaaaaccaaaagaactaatcgtatggtgggaaaaaaaccaggcacacaaaaaccggacggaaaaaaggcaggttgagaagggaaacacaccgggcccacaaaaacgcaaaaaaaccaatccaacggtggaaaaaaaggggaaaaaaccaagacagagagaaacggcgcacggataaaaaaaaggagtcggacaaaaaaaaatcgtgcgttgtgttggtgtgctgaacggagtcggaaaataaaatcccgtgttattgggctgacgtacgaaactcacgggcaaaaacaccttgaatttttataataggtaaagatttttgaaaaaaaacattagtatcagcttataattatttttggaaaactacaaatgttacttctccaaatacgtgttcaacgatcgcgcgaggagcgatcgagcggggcaacattattacaacaatgacttttcaacagaaaaatttaaagctatgactgttagccatatttaatgaagtcattgaatatcaactgaagacctgctggccagattgttgattggctgtaacaggatagccatcgatcgacgccggtaaaatcgtgaatcctagacacaaactattttatcatgattgcggttgggcaaatttagcttggcatgcagatcgacatcgtgttgactgatcatgagtcgtcgcatgagcacacagatcgacaccagatgagtccatttctgatggctgtagaggtaccgcaccctgagggaaccggtagagaataaccgcacacacacgatcgcttccatacacgttgcagtatacttatatccgttttaattaaatatatggtacggttaacttttgaaaataatgttagatcgatcattcgtttccttcaaaaccttaatttatatgtgcatcgttttttttaaaaaaaacttttacactaaaggttactttattcaagatttattttttcatatttacactaatttttaaaataaaaacaatcaaatataatgtctaaaagtgaataaaaccttatattacaaaactgagagagtatgccagttacttaattttcctagctaaatatatataattgtaactgatcaacatttatcagttcaaccgaaacaaagctcgatatatatattattagcgaaaaatcaaatctaatgttcaaaagaataattaattgccttaattagaagatgaatgctctatagagctagaagcaagtatagtagtagtga

SEQ ID NO: 76496 - DNA, 4431 bp, Oryza sativa
agcaggtagaataacaagttactccctccgttccactatacaaggcgtaattgctttgatgtaaaaaccaaggaagctcatataactaccgcagaattagggggctttaaaacaagcagagcaaccaaccaatagttttcactgcatgcatgcatgtgcatggatgagaattacaggattcaaagaggcgcctctgcagcttccttcaatgcatgcatgcgcatgaacgagaataatggagtcaaggaggtgcggctgcatgtgccgccctatattgtactggaacttgtgaaaaaaaacagttacgccttgtataatggaacggagggagtacataattaagtaagctgaacgaagctatacgagagacactctcactgaacgacgagtagtagtgattactactcgccggttaattaagtactagtcgaacactaagggcaccaacaatgattatctataggctctctacaagagatccatgtcagcatattttcctatttgaaaggtattaaatgaagagagagagcaaagctatctactaacttagagatagtctatagagaaaaacgaggcaatacatgagagagctactaacttagcaaaactatctactaacttagagatagtctattaagatggtttactattaatcgagtctattgctgagatgtacatattttatagataacaccttactttactattacggatgcttaagagtattatatgtatatgagagaggaatcaagtattaatggtgctgtttgattagctatagaaaattttaagatggcatttaattagctatactattatcaaacttattttaatggaacacatattagagcaagtttaatagtatagccaactactagctccaattcatctatagccaatctaatagctcatttgcacaatagttacatactatactattaatactgatcccacttgttatacatacaccgtgtcttggagtccgtgctatagctggctacaaatctgtagcccgctgcttttctctttttatttatctccttaaaatatgtttgcagctggtttatagcttgctattgtactgctcttagtatatacatcattgagattgagaagagtctagtatagctagctcgatggagtccaactcccaacgacttagcagcgactgccatcaatggatgtatatatgattccatctatcatccgcatctcagctcgttgcccagcatcttcctatttataccctccacccatcgaccgacgatccatcgatcaccggcgacgagagacactctcactgaacgaagctacctagcttaattacctagctactcgatcgatcatcagtctagatatggcggctttgaacggtaaggtggtggtggcggtgatggtggtggcgatggtggtggcggcgccgggggcgtcggcggcgatcacgtgcgggcaggtggggtcggcgatcgcgccgtgcatctcgtacgtgacggggaggggcggcctcacccagggatgctgcaacggcgtcaaggggctgaacaacgccgcccgcaccaccgccgaccgccaggccgcctgccggtgcctcaagaccctcgccggcaccatcaagtctctcaacctcggcgccgccgccggcatccccggcaagtgcggcgtcaacgtcggcttccccatcagcctctccactgactgcagcaagtaaattaatcatccatgcatatgcatgctactttttttcaagttaattcaacttaatttactgactaatccactgtatatatgcatgattatttcattggtgcagggtcagctagatcgattaatcctgcttggaccgaccgatcgatatatcgatcgatgctggctcgcagttgatcaactagccaaaataatagctacagtaaaaataacagctggggcatatcaatgcagcgctggtcatctctctctctatctctgtatactttatgttgcacgctccgtgcgtgcatgctatcttaattttcttgactctgtacaccgctctgtgtacgtgtaatcctacgttgatgaattgcatcttgtccagacttggacctagctaactacgtactccagcttggcagcttcttgccgaggcaatctgtagtaatttccttgttacattcccctgtcccctctactccctctatcccataaaaacaaacctaatatactaaatatgacacatatattctagtactacaaatctagacagatgtatatttagatttgttatactagaatatgtcacatccagtcttatgttcgtttttttggacggagagtatgtcatatgcaaaaattgataaatgcacatcatgctccctagctctgcactttattattatttttaatttacatgacagctgtacacacatacacaccactatacacacaacattacactcatacctccgtgaatacgtcctctaacacatgtttcaagagacaaaaaccaacagcacatccctaatatcactaaagtcatgttgaaatcctatccgcatctgtgtaatactcgtggccactctattacttgattgttcacaaggaagaatgatactctgaaattgattctaccgaaatatgaaaaatattatatattagaattgataaagggagaagaatgaacataaaaacagataataaatcattttctatcgtcggaatcacacatctccaacggatggtgtgtgatgttatagcctgatccaacggtttaaaatggtgataataagatctatgtctactagctagtagcactttcataagaaaacagctgggttatgactggatggatagacggttcggtcgttgtacacccaaactcaccagggttaaagtactactatatatatatgtttgaaactagtgttcactaattctaagagtacatagtggagtatatgtgcttattcagtggttatatatactcctccgtttagatattagcggtgaaaacggatgtgatagtttctgatccgatactctccgaatttggttggagcaagatatggtatatgtttgtttaaatccctcggatgcgaattgtatggtgcaggtgtggatcggatgtggtattgcaaaaaatcggtggatataattattcggtatttcgaacatattatccgatgaaccgtttagcaaattaaataatccgaatttttcagcccaccagctcactagccgactatctgcccatgaaaacggtaaattagctcaacccacaaattcaggacatcaattaacccttgaccttaactcaccatctcaacttctgtctatttcgcttgtgcatctcacggatgctgctgccatgcacaccaaaatggagatcatgcatgtatatatgttatattgttactgtgttgatgtatgtacattatactgagtccgcaccatgtgaaaatgtagtgaggttgacacgtaggttgtagtattttatttctttattttgctgctatctatttatattgattgttatcttgatgtcatcactactctggactctgtatatgttgacaccacgtcatcgataacgatcccagttcaggtacagagataaaacggaattaattggtttggatgggactaaaaatttttaggcatcatgtcggatgtttagacactaattataagtattacacgtagactattgacaaaatccattccataaccctgggactaattcgcgagacgaatctattgagcctaattaatccatgattagtctatgtgatgctacagtaaatatgtactaattatagattaattaggcttaaaattttttttacacgaattagctatcaattatgtaattagtttcgtaagtagtctatgtttaatactccaaattagtgtccaaacatccgatatgacatggactaaaatttagtcccggatccaaacaccccccaacatcagaaagctaacaaagtactctcgtttctaaaatactaggtgatcctcgcgctttgctgcgggaattactaagtaatttttaatatttttttcgattatcgagctaggattaaaaagaaaaaaaaatgaaacgcgagggttcatgaggacttatcataaaacaaacagatgatacccacgatttaacgtggaacatgtatatgttaaatattataaatgatagatatatttgttaaaatattgtggaaatgatgtgaagaataatgattagagatatacttgcatgctggtttgtagaattaaataaattatagatgattttatatgtttgtatgaggttaaatatataattattgttagtgggtgatgatgcatgtgacatggttacatgttgagattcagaagttagggggcattaactttatagtaagatagtattaacatatatctttttaaattatcagtctgttatattttcccggg

SEQ ID NO: 76497 - DNA, 5017 bp, Oryza sativa
tgttgaagatgaattcgctcgatagagagatcatattaattccaactggatcgcccatgatgtaattaaatcacctgatactgatagagaacacatgctgtagtacatcattgagattgagaagactctagtagagtacctatggcgatctgagtccaactcccaacgacctagcagcgactgccatcaatggatgtatatatgattccatctatcatccgcatctcagctcgttgcccagcatcttcctatttataccctccacccatcgaccgacgatccatcaccggcgacgaggagacactcactgatataatcaagctagctagcttaatcacctagctatccgtcagtttagctagatatggctgcagttaactgcaaggtggtggtcgccgtgattgtggtggcgatggtggttgcggcgccgggggcgtcggcggcgataacgtgcgggcaggtgggatcggcgatcgcgccgtgcatctcgtacgtgacggggaggagcggcctcacgcagggatgctgcaacggagtgaaggggctgaacaacgccgcccgcaccaccgccgaccgccaggcggcctgccgctgcctcaagagcctcgccggcagcatcaagtcgctcaacctcggcaccgtcgccggcgtccccggcaagtgcggcgtcaacgtcggcttccccatcagcctctccaccgactgcaacaagtatatcatctctctatgactcctctctctctctctatatatatatatacacgcatatatctctttattttttacgtgctatctaaatactccctccgtttcaggttataagacgttttaactttggttaaagttaaacttctctaagtttaactaattctgtagaaaaaagtaataatatttaaataccatcatagtttcattaaatccataattgaataaattttcataatatatttgtcatgggttaaaaaagatactacttttttactacaaaatcagtaaaacttacagtattttaactttaaccaaagtcaaaacgtcttataatctaaaatggagcaatagttaataaaaacttttacaagttaagatagattaccatatgtgagatatatctcacttcatagacataaaagattaaattcaacttatacaagttaaattaaaaaacaaactaaactaacactagttaacgtattttcgctattatatctgttattattgttacaacttgtacaagtttaatttaaacatgtatatttatggacatgcatatttaatattaatctatcttatcattttgttttactttttaatggctattaaggtggggggatgaaagcaacaatgagatatttctcgagatatgaaacattttcccataaaataactacctatatatatgcattttttttctttggtgcagggtcagctagatcaattaatcctgcttggatcgatcgatcgagcttaacacgctagctcgatcggagttgatcagctagtaattaagcacgtatttgctacagcatatatgaacaaagtaattaaaataacacctgcggcagacatgcagcgctccattctctctctgtatcagctgtatactttatgttgcacgctccctgtgtgcatgttctatcttaattttcttcagtatgtacacgatctgtgtgtactacgtgtaatcctatacgttttatgaattgcatgttgtccaaatgtctttgtcctagctactagctactccagcttcttgctgaggaaatctgcagtagtagtaatccctcgttgtgatacgcaacaaaattgtttaatgtgatcctgctatatatatagaaaatcatctctattattttacaggcataaaacaagtccactctaaaaacaattagtgcggccgttgtcttaatagacccgtatgtgaaaatcgtttttcacaagcagttccttaagacaacttcatgtatcattattgtagtatgtcaaaaagatgcaccacactatgcacagtcatacaaaatggcactactacacaactgatcttttatcgggatatccatttcggatagatttagaacgggtattagagatatttttaagcaccggttaccaaaaacatctttaattccgattggtgttataaccggtactaaagatgcctacagggctagtttaaaaagaaaacatccatatccatgtctgatgggtggagttggtggatggttacacgcgtgagggctgaggtgagagatcttgagttcgaatcacatatcccacacattttttttatttcgtatgcatctttagtaccggttatttcaactggtactaaagatcgagatatttagtctcgatttgttagaaccggttctacatctaaaacggttcccaactggtgctaaaaatgggttctccactagtgtggcaatacatttacattcacacattaaggattcacatcgtcacccatattcacgttgacactgtcttttaatgtataatttaaatgttcacattgtgaatattcgacaatgatagggagcccgatccctatctacaagtctaaacctaagattaatttgatcgacatgagctaatgaatagataagcgcactatctattgcttgaaatggtagatccattaatttccttttcatatatagattattgtaaaaagttgtcgttggctgattggaaatagacttgggcatgaaacctataccctctgcaactccacgtaatcgaaaatcatcctggaatagacccaaggatgaaatttagaccaaggaacgaaattgggcatctataagtgtggggagacaaaaataaacggtttcatagagttaaatgatcaaagttggaacaatattgcaatagttgatgattaaattaattaatgtggacttctttaaaccatatatagactgtgttcggcagcgctgttcctaacactaccagtacgcacgaaaaatgaaacggtccattagcgcgtgattaattaagtattagctattttttttaaaaaaaatgaattaatttgattttttttcaaacaactttcgtatagaaactttttaaaaaaacacaccgtttagcagtttcaaaagcgtgcgcacgaaaaacaagggaggagggttgagaaaaagggtgccgaagtattgtgcgctagatactggtaggggcattgttgtccatcctcggaagtggctcaaatataacgtgccacgacattagcgccatttcttacacgaaaacgaaacagggaaaactaattgaacaaatagagagatatgtagctagctagctttcagagtccactttttgagagagctcaatccaatgtgtggtttggctgcagcgacgaaccagaataatctcactctgctggtgcacccaatcaccaaatccaaaggaaattcaatgtacaacaaaattaaaaagaacatcttataatttgtctcctcctcctgcatatgcttgactcctagcttaactagaggtacctgcagccagccatgcggcggctgggtgacgtcgtggaggcgcctgcgctggtgctgacgccggcctccatgcagcaggccggcgggagggggagctccggcgccttggacgccagcatggtcgtcatcctcgccgcgctgctctgcgtcgtcatctgcgccctcggcctcacctccctcatccgctgcgcgctccactgcgcccgcggcctctcccccaccacggcgacgccgacgccgtcggtgtcgacagctgccacggccgggctgaagaagacggagctgaggaggattccggtggaggtgtacggcgccaagcaggccggcgtccccgacggcgagtgcgccatctgcctgggcgacttcgccgacggcgacaaggtgcgcgtgctcccgaggtgccaccacggcttccacgtccgctgcatcgacacgtggctcgccgcgcacacgtcctgccctacttgccgggactccattctctccgtccatggagtcgtcgccggcggccaaacatagctagtaatataatttcttgaacagaagaggtctaaaatgtaaatagaatataggtggtaaagtactccaaaattgggattgcgtaaatgcaagggattggacacaatgtttgaagtgtctctgtcacttggattatccatctgtttagctgtttctatgagttttctcctttaatttgtgtgctagcacatgatatttcccccaagattcgctgttcgtttgttctgggcataattttgtcaccactcaacaacaaaacgaaaggagagaaagcactgaattggtattttcttttggaagaattgcattggtattttggatgcatgttcagccaaacttttcccccaagtgacaagtccttttctcaaattggtgttgtccagcatctaatcacctcccatgccagagaccttcttcctttccccttttcttcacgttgccaactagtactagtagctaagaataagatggctccatgccaacgttctgcgctcgagttatggcacaagcattggagtaaaaactcagaaaatgttcaattgttctgttcaaataatgcttcaaaaaaataacgtaggattttggggagagggtgcctggggtggcacatagtaatacgtcttcggtgatgctaaatcttatgtttggattcctctaaaattctctacggatatattaagtcattccatataggtttctaattgattatcttttcttcttgttagagtttgtgtgaatatgtatataaagtcggtttcagtttagaactttaagtttaataggagtagggtagagttagagtcaaactctttcagctctcttaaatagagaggcaaacttattataattaaccacatgacaacttagcataggcgagagggaatggctgtcgacgatgtccgaccgaagtttgttgtacctctgatacgctgtaattatgctacatctagtacgagtgttcataatcagtgtccagagatataggattcggttgaatt

SEQ ID NO: 76498 - DNA, 3309 bp, Oryza sativa
tatagtacttccagtagcaatagctagtgttcaaataatcttttctgccatgaattatgtgaagaataaattgagaaacaggctgggggatcaatacttgaatcattgcttggtcacatttattgagcgtgagatgtttttgaaagtcaaggactgtgatattataaaccgctttcaagtcatgaaggaacgtagaattaaagctactcttccaaaccatgaatgaaccgaaatagaaaattagaggtaccatgtaataatttgtagttttatttcttcgattatcggtattgacatactgtgaaccattgatttttttttactatgaacttttttttgttaaacgggaatacccaacttcgaaatgctggctccgccactgcttagaagaagttaaagcagaacatctctaatttatttatttgttggagtaggtaacttgtatgggttggttgattccaaaatgagtacaacactgaaaggaggttttaaaggatgtacaagactgaagactgcacaccaaactatggcagtacagtactattcatgaatttgtgtcatgatgttgctctcaaagatattctggtgtcgttttccagcttcattttgcaagctcaatacacaagttggaagttggaaccactggtggacttaattcgaacatgagcagtacagggacagattcctaccttcacttctatcactgtcttaggctgcttgcatcagatacacaagtaaatttgaaacatatacatttgagtatgtttcctctgctttggagcaagtaaatcatgcatttgaagtagtagggaaatcaataccattatcaattgtagcatgcacatgagagcagctggacaaatcaaagcatgatcgaattaaaaatgaaagggaaacgggcaacattactacagtagtttattactccatgcctcatgcagagagcagtgctgcgaattgatctgccaggctcttcacagtcgtcggagaaactgcagattctccacccaggtaccacttctgaatcatctcggccacattcttgttctccactgtcagcttcgcctcgcccttgccttctgtcacaaatgatatctgcacacatatatgcatgattcaattaggtttgcaagaacaaagatttgatcacttgatatcttaaccaaacccagctgaatataaggagtactctacaagattatacctctgcaattccaggggtggtaggaaagtggaaggtgatgacggagttgggcttgaaatacttggactgaaagaattcggtgaccttctccagagcctcttcttcatcctcctcgtacttgtctactgacacgagacggtcacgcactgaactctccagctgcacgccgtattgtgatcctttgatctccttgatcaccactatcctcaacaatttctccaccggagctaccacacgtaaacatcatcaatcagcatgattcaaatgaaataatgaaaaaaaaaagttattgctgtaatgcatgagctgtcgagctgaagctgaaccttactctgttttattttataggatataacaatgttctataaactctacagagaaaatactactatttgtgatcagccacttgatatgggagaatggtattgacatactgcagaacatgcatttctaaatcagcttttacagattctgaagtgcaaaatctgaatgatgggggtcattttagttaccagaaactagggcctgaaagaagccatcatcctgcacaagctcctcggccttcttgcccttccaactctccaaatgcgctagcacattgcccttttcaagatacaccccgatggcgttgtatttgatctggagggaaaggattctaatggctgggaaggctggcattgggttatttcaaaggcgttaaaaggctggtgtggtactgataatctgatattagttaacagcttaattcgttagtagattaattaattaccattagcaagcagtgacaatggcttactgacggttatctcctgaggaaatgggatgccctccacctccacggtggctatctctgtgcccactgcacttacaacaatcatgcaaaatgcaactaattgggcattgaaatcttgtaattaccagtacatgtatggtcatgttttgtatataagcatatttcaacaaccttcacatactactttcagaatttctctaaatgtacaagctagtgcaaagtccgaagtgggtatgaagctaccaccagagtttcagatggaattagatacattcattcatgagaaagtctttttgagttcttgatatcccttttttttagaaccatgagaatgtcttttcttgatatccctcaagacggacgaaagacagaaggcctgtttggttggtgacctgagcaccacgcctgaagaatttgcactccaacaaactcatgggttccacctgacgagttgcttgtttggtttgctgctgctgcctgatcgagtagatgattactgctaactcaagtattagacgggaagaacaaaaatctcgacaaaacggcttggcgtctcgggaaaaatctcacaaaatccatatgctacatacctaactttccaaaaatatccccaaagtcgcaataacgatcagcaaaatcagcagcatcagctgaattgaagcttcgctctaagctggatccggcaaaggggatcacgcgaagcttcgtacaaactcgaccaacgcggggacttcgctcaacgacgaccacggcagtggcttcgcttgccggcggtggcgattgaggtaggtgtgggcttcacgcagtggcgtcagatcaggggcagcctcgtgcgatggcggcacgcggtgatgacttcgtacagttgagatttcgatggtaaagcacgcatttgtttacgcctggagcctcgggcgacagaaatcggccgcgctaattgcacgcctctatggctggagtatgcgtcaggccaggccagtggagaacagtcttgggtagcaaccaatcaagatcgacacaaatcttttaagcctaattactccatgatttaataatatggtgttacagtaaatattttctaatgatgaattagttaggtttaataaattcgtctcgcaatttacaggcgaaatctgtaatttgttttgttattagactacgtttaatacttcaaatgtatgtccgtatattcgatgtaacacggtaaaacttttcacccctggatctaaacacagcctaaaactttagtccctatcacattagatgtttagatgctattttagagtattaaacatagactaattacaaaact

SEQ ID NO: 76499 - DNA, 2051 bp, Oryza sativa
tcaacaccgggcagaccggcggcatccactcggtcagacctgcagatcaatctcggtcagaccgacttccgtcgatttcgagggtaacttttatttccgctaaagttttcggtttttgggtataccaaccatttatccccctctagttggcttaattcttgtgattcgatcctacaataatcggcttttttttttgcttgagcgaaggtaaaggtgctggttctatttttcacatatataggtgccagctgcttgtaatggtgtagaccaatagataccggtgcacctgcgatggtttctgatagctagcgctgccttgacccgttgatctgaagcctgccccagtgttggtaattacgtatttttatatgttttatttgtaataacaataaaaagagcaaaattctgatcttacatgattcgggctgctctcagacttggcttgatttgtttgcttgggcctggcctgacattgaacaggcctagctaccactcccccgtccgcacggttttgctaaatgatagtgaaagcgacttgtaggtttgtcacgacctgatttttgttttaggatttataaattattattagaatttatattaaatattcattaatttacaagtgaagttaaatgtgagaaataaaattttctaaatataaatcatggatggatttaatttttattaaattctccacggttaattatactctctggaattttctcggatttttctgagctctattcctaattttaatcatacaaacaacattttagtaattatctacatattaaattaatcattaaatggtctgattataatcttgttaagtaccttgggtgtccaagtattttcaggatttttcttgaaattatttgagcattagaagtatttttaacaattcaaagatcatttcagtgattaatttaattggaaaagtaattaaaattcctcttttccttttcgggccgaaacaggaaaagtcctctctctttcttggcccaatctcctctcagcctgtagcccctccccctctttctgtcgaagtctgctttgtgtccctctttcaatcgggccaagaagtagaagcccagccggaagtctagttttcctccctgtcgctacagtggcatcttcaacctccagccggctggagacagagcccgatgccgccattgccgtcgattttctcctccacatccggccttatctctcgtgcattcctaaaattagttgaggggatttgtttcccttaaccttctctatcttttcccccaaaaatcccggtttatccctttgaattcgacgcgaatttggattcgttttcgagttgactgttgtgagacattaaccgtaccaaccacaagccagcgtgggcaatggctttaccttttgtatagcatgattcattgcggggtgccagactgagaagcggcgagaagtcggtgaggatcgctggggagtccatgcctctggttatatttatagagtgggtgattatgatctaggaatggtgcactgtggtgagttgtgttgtgcagagggtattgtcacagcctctattcgggtacttttcagtatcgcgacgcatggtagacatgatgttgaggctgtgtcttgtgggtacagtggtacacctctggccagagtaaaactattcgaatagccgtacccacggtcatgggcgggttgagcaatgtttttcgtgattagtcttatacctctcacaataattattgatgctataattggtaataatttgcttagctcctggtttggagttagatctgtgcagtcgggtttggttgttcagaatggttaggcctgagcagcatgggtgtgctgttcagtgttgattaaaattgatgattactctactgttttactattcttaaatatttgctaaatgctgcttttgcaaatgagcctatattatgccatcctttggtatccttgtacacttgcatatttgctgtgtggcttgttgagtatgtcatatgctcatttttgcaataatcaatcaacctcagttgaagaaaaatgatccagaagga

SEQ ID NO: 76500 - DNA, 1584 bp, Oryza sativa
accccacttattttatatgtcccactatagttgtgtgactagcttaccagagaatgatgtgggtttaatgttcatgcgaatgattgctctatgacattgcagaggatatagagtaatattgatacgccccgaccaagaccattcatacatagtgtgattgttgcgcatcaatgcaaggctaaagctatgcttaactccaaatcttattgtgttcatcacgaaaggctgctacttggcttgtacgattgtaggttacagcatattgttgtacttaaagagagagacttgactcggattaccaacactacaccaaggcatcgtaatcgtgcaccaccgttgctatcatatgaacgtaaaccatcaattggactagtgctaccatctcaaggaccgactacaccaagtcgtgtggttactcccatcactaagagatcatgccaagcatggatggagtactcaacatcattcaataaaaacacgacaaaaggttaattcgtttcttgctgaatttaactttagtattgatgtgaattttatactatctaaatggtgtatatttgatttgctaatgttcataccaaaggagatggacactactacaaatatcaacgactacatcaataccaataaagattacacagaagatgaagtgacatttgctcaagtggagatggtttacgacaacgagcagaccggttatgtgcagatgctataacttctaagggatgtgcgactcagccatcaaattcctccatgcataatatatatggttggaaagataatcaagtctagtttcacctccaacaaacggctagtcgtctcgacttcccatgagagagtaatatatatttttgtggaggctgcatagaagctgaaaggctctagcgaacctgctcgggaatgactcatggaaacccttgagctagccatatttatccccatctaggaggattgttcctattataaatatcccctatgttttatcatttgaaagacttttgacaataagaatatgaacccctttgtttagctgtgtgctagcaaattcagagatagatctctacgcctttgctcttgtgatttccatgttagattacagaagcggcgttcgacgccccccaattggtgcttctggtcccttcgacgtttttccttgattgattccaggttgtgttggttggtaacttagagtgtggttggacgaaccctcgattcaggttgtcgtaatagagatggtggttggcttcgagtacgatcgtcaggttgcactgttatctttgttgctcgcaactagttatcttgttttcgttgaggctagttatcaattcttgatcctatgccgtaaagatcgggacatcacccctaccggggtcgtatcaaatatttaataatgtaaacgtggtgcttatatcattaagtatcattatttgggtatatatgctgcgggacagtagaggtgggccgctgatggtgacagctcagtacggttattcctccacgttattcctaagacactttcccagggtgggtactcctccgtatttgatcccggttggatggctatgacgggttgtcgtaaggaac

SEQ ID NO: 76501 - DNA, 5898 bp, Oryza sativa
cctgcagccctgctcccttcatcctccttttagctttgcttaattgtgccgctatagatctagtcgctatttgtgctttactcttgtttgtgtgatagatctacttgttgtgcttcattggtggatcagacagtctgatcaacatcagactatctgatattttcggatagtctgactgtggatcagactttcgaccttatatcagttttagcttccgcataaagttttaaattagcctctaggccgaattgaccctttcaggtagatgcatatgcgcacgagtgaatttaacatgttgtgcggcaagcaaataatatggctccgatgtggctgggtgaaataatatcatgatatctataaggacccaaggcttggcactagatggtacctaagtgaggacaaaaggatatatatacacaatatgttttttaaaaaataaatctaagtagaatcatagtcacgtaagatgagttatatacacgagtgtaaaatagtaatgtgcatatatttgatatctattagtactacatgtttgatgtttctgtcacaggacagagtaacccaaggaggtaaatttcctctcttttgctgaagtgtgtgttcttcttattatctatatatatatatagtttcctatataattatctgtttctgttcttcactctgattcttcttatgttatatcagttatcacaatgtatattggcatctcaatcatcaaaaattttatttctgaatcaagttcaacaagccctggctatttctcagtatagtactgattgagatcaatcattggttccatctgaattttgcttcatcatataaagatatctgaattttgtttgtaaaattttactgtacacctgttcctacagctgcatttggtttgttgtcaccaaccttgtagatgcagatgccttgccatcaaaacctaccgaaatgagggagctattaaatgtcaaggagcaggccaagttttctggtgaattcaccagaaatctctatgtgaggcagtgccagatgattccaagtcttcagcttcataaatgttgcaactaaacatcacagccaaaacagaccaggatcagggtacaatcatttgtgctgcatcttcaggaattctaacattagtaatctcaatgccctatctgatcccacagtttgcatttataatctttctcttctagtaataagatcataattttaaaaatgtccagacataaatacttctgtaatctgtactgtactgtactgtacttctgtaatctgtactgcatttcagttgatcagtgactgaaaaattttcaaactctcacctaacacatcatatagatatctactatttgatttagcagttgtgcttactttgttataatgaccagtactacaagtaagtcaatcatcgtagtcatagtacatatcaaacctagaaaggtcatctgaataggacttcctgattgggatttctccattgttcactggagtagaaaggaagaagaaggcctcaggctgggcgaggcgccgacacgtgtcgtctcgtggcaatctgcggtatctcagatctgtatataggcctgtaacaaattgaagcaacagtgaggtcaggtgagctaggcaaaggaagagctgtgagatggattcagctacctctaccggttggtctcaaacagcaggaattggttgtgtactctttcttgtacactgtcagaaaatcttggcaacaatctgcacttgcctgtcgggcatattcatgcaagaaggggaaacaaattattctcacatcataagctaatcatgctataacatgactagcagcagagatctagaacaaatgaacaattgctgtagcatgaaactgaacctgaaactgaatcaggattgttctactagcataaacaaatctgaaaccgaatcataattgctgcaagcataaagtttcagggtttagagaacaggatcacataagcaccagttcagtaacagtttcccagaaagaggcaacaatcagaaactcttttttctaagctataagatcagaacatttcttagctaacgactaattttcatcaaagcttcagttgcacactagagccacatgtgtgtgcaaccaccatcccaagtaaaagctgatcagatatggtgaagcatatcacaccatctggttttcagatctcaggccagtatactttgatgataatctgaatgaaatcaactacctatgacatatatcatgaaacataacagtaaaaatattatacagccacaaaaaaaaatgcaagttacattttagcattacaatggctgcacgtccgcaacaatagtacactccttaaccaatacaaccaggtctaaactagtcattcaacaacccaaccggaacaatagttcacttatgaactaggcacttattttgtttttttttatagaaaccaacatataaatagttttttaactgccaactacagcctcagatcaatggaattgaagcctccaacatgccgacatagcaatgttacttcgggtcagaacggagtttgtgcggagtaatttctgggacaactctgtagatgtgcacttttatgttatccttctggacaagctcgaagacacacacatcaaacttctccagattgttgccaacagcaaatttgccccagccaccactgaaagaaccaacagaacgatcactgtagtagacatagttaacttcccaagccttcccttgtggatcccagagtgtgatccttttgttggtatggggaagacactcacggacaaattcacatgggatattctgcaatataagaaaatgagttttggtttagatataagaaaacaagtagggaggttgagtaaacatatacagatagtgagcctttttgtaaaaaaaatgtattgccccgagggtaaggcataattggggaaatcggaagtttatctaagaaagatagttgaaaaatactaaacttggctcatttatgatggtattaaccgaatgcttgaaaattactactacagactgttgcttatttatagatcgctctctgctgtatgcagaaactttgtaataaggctatgtcaagatgggatgttcaaattagaacatccaaaactctcaaactatagcagcagcgccattgtgcaaattataatcatgcatgaaagaatcctctcatgcacatattttttttaagataaaatgtctcatgcacataaaaaagggaaagtgctggatgaggattaacacacggaagtaacattaccatgaaaaatccaacatagacatatgactccatcattatttgcacggcaaaaggattcttagatttaaactctcttgccctttgaagagcatggtccttctctgcttcagttaccggacgcctctgtgatattactgttagttgtctttgaccctttgaaacacctgaaaagtgcaacacagtcaaattgtctacagaagtaatttattagcactacatttaggggacaataacttacatctaccacgccgagacacctcaccagacagaaagcgcatcaggaatggtggatttggtgacttgctagaagaattatcttcatctgagctgcatgatgaacctataatgtgcaaaagtaattttttgggaaatcatatgaatccttaggattctgaacaagtatgatggaaataaataaataagcaacctctaaccaagagattagaaatatgtctttttgcaattactttgcatggtttggcaccgcgtagcttatggctatgcatggaacaaatcaggaatacaactaaacaagttctataaacgaaatggatgtggcaagtcatttgtgccgttatgcagacctccctggtcccccaacagttcaaaataattgactattaatagtcatcatctaagctgactatgccaaatatgtgtataacactttcagaaatatagaaatgttttacctctggtactgttatggcttgtcgatgttaccttggacttgccagcagaagctcctgcacgttttctcctagaactttcgcaaacattagcctcagatgacttcttaaatacaaccaccctatcttccataaggtaatctacatctctagttctctttcctgtgattccattattttccttcagggcgggagccattttctctgttgtgatagctgcggtgaccatgcccccttcatcactttctgttttaatgatcacatttttggaagggtgagcagagaaagttgatatcttgtcaatgcctgaaggttcaaagactgtcactgagaattgtgaccgtttatcataagtgaatactaaaaattgaccacactgaattgagttatctctgacaaattctttccatccatgcacaaagaagaatccctcagagtctgaagtcagctctgcactccatttatttccacttcgatcaaccagagaaaccatcccagtaggttgattctgaaggcattggttgaatgatgatgggattttctgcattgtaccaaagtataaaatatgttaatttatttttctacactacttgttaacattgtgaactactcatacgatgcaatgtcagttcaaaaacaaatatatcagacaaatacaatatgccacgtcatgtaatttttctataaggcatcaaattgtaaagaccagcaaagcagtcctgacatcatagcctcaaaaatgcaaaattacagaacatacgtgatgtatgactggaaaaactaaatgcttagaccaactaagatcaaaccttatcctgattaattgaattccttcttttcccacaccaaaaaataaaaatgaaaagtaagactcaaaccctctgaaagataatccaacccattagcagaggcccatgttgtgtaagttttaagccgctgagttgaaaaatgaaagacatcataggcaattttattgtaacacagtgctttctactattctttggccacataaatgtgaaaatgaactaagcaagtttggcagctagccagctactttgggaaaaccacgaaaatagtaaatgtagtcgtcatgaacttctaacaataactgattgtgtgaccaatacacctgagtgttagacaaacctggatttggtagtgggagtgattactctatgtttttctaaagaacgctatgagaacacataccaccaccaaacaaggttaatcaagatgttgtttgctgactatgaaaaaccaactgtgcagtgcaaatgaagagctacatatcaaaatcaatactttaatacgctcgtgtgaacaatgaaagtgtataaggttactaacgaatcaaagcaagctagtcacactagggaatatacataaccaccacaaaaactcggacatttatttgaaagtgtttatagttaccctgcaatcatacagccacctttcgactaaaacacatacttccaaataattaatctagcgaacacaatccacatccgtgggattcgcaaaaaggggggacaagcatatagctaccctgcaaccaaacaaccgccttggggaaaacacatactcctaaatcattaatctagcgaacacaatccatatccgtgggattcacacaaaggggggggggggggaagtatttagctacccacagccaccttggggataaaacacattcctaaataattaatctacacggacacaatccacatctgtgcgattcaaaaaaggggaaaaaagtgcagatatctaccttgcaacctaacaaccaccttggagtaaaacacatactcctaaatcattagtctagcgaacacaatccgcatccgtgggatttacaaaaagggaaaaaatacatatagctacggctacccacaaccaccttggggctaaaacacacactcctaaatcattaatctagcgaacgcaat

SEQ ID NO: 76502 - DNA, 697 bp, Oryza sativa
aaaaagttaaaacctaaatacatgagatggtacacgagaatgcttcatcttcataacttgtccctacaatccaatttccatctgaacacgaataggaatccttcgtctatatgatgcgaccatgtagtggcatagagtaaatgaaattgtacccgttcgaccatatatcgatatgggagaatagagtagaagaggtacacagaatcaatgccaggtttgtaagaacagatgacattcaaattttaacaaattcgcaatggttcatgagaggataaatcatacaaaaattcagttcaaaaaacagtccattgggtacctccatagctcatgtgccaaaattcggatcagccaaaagaaaacactggcatctttgccagctcaggcaaacactcctggtataaaatgaagaaatgtgaatttctgtttgccgatcgcctcagccctgaaaaaccagagcaatttgcaatgcaggctgtaataagttctcatgatccttgtccttgacagaggacgaagtgacttatttctttcgcttaacttttagaattcttcttgcagacttttcactgttgccaccagtagtgcctattgagaagccacctggggatgattgactatgctggccaaattggaacatgcccggtgaagcggatgtagctgaagcaaactgagttgctggcgtactaaacagagttgg

SEQ ID NO: 76503 - DNA, 2593 bp, Oryza sativa
  unsure (1)..(2593): unsure at all n locations
acattcctaaataattaatctacacagacacaatccacatatgtgggattcaaaaaaaaaagggaaacaggtgcatatagctaccctaaaatcaaataaccagatttgggctaaaacacattctcttaaatcattaatctagcgaacacaatccgcatccgtgggattcacaaaaaaggaaaaaaaatgtatatagctacccacaaccaccttggggctaaaacacatactcctaaatcattaatctagcgaacacaatctgcatccgtgggattcacaaaaagggaaaaagtgcatccggtctacgggtatcacctgaggacgcgagaccttggggttaaaacacatactacttaattattaatctacgaaaacacaatccacatctatcggagttgcaaaaaaggaaaaaaaatgcatgtagctaccctgcaatcaaaagtcaccatggggctaaaacacatactactaaatcattaatcttcacgaacacaatccacatacagctacctacagccaccttgaggctgaaacacacactgcaggttatgtttggttcatggccatttctagccttgccaattttgggcaatggcaatgccatttttttttggcaaaaattggctagtgtttgtttggtttgctaccaaagttgcatcttgacatattcaactcagccaaataatttggcaaggcaaatttttggccataaaccaaacaaataataaaaattttgtcagtcccaattttttttttcggtttggctgagattggctacaaaccaaacatgcatatcccaatcaactagcacaatcagcatctaatgaacagattaaaagtagcacaagtgaacacaacattattactaccctctaatcaatcaaccattcataacaaactgaacaacaacaacaacaacaacaacacaaacggagaaagagagacaaaaaagggattaaagagacatcaccatccgctccagagattgcagggtgagaagcacacggaagaagctcctcccgaagcagttaatgtcgcactccttctccttccccttccccttacccttccccatccggccaccttgcttttccctaaccaccatgacctcctactccgattcttgggccccccccccccccccgaccgaacaaccaaagccgaaatagaatccaagaaaaaggaaggaagaaaagagagcgcaagctcgccccgcccggccgggtgaacaaaaagaaaaaaaaaatcaaaccggcgaggaagcgggtggcgggtcgggagagggaanacgagcagcaacggcggcggcggcggaggagnaggaaaagcaatggaagcgaaatgcctaccgctgtgctgcgatgcgaggggaagaggaaaataggaaacaagcgagcaaggagagagagagagagggttttggaagagagaggggggaggggagtgtcagcactggaaaagtggaaatttccagaagggcctgagatatcacctgcgcggcggggtgggacccacctgcagtcacacacacttccatctcttttttttccctcatttttttactttctattgctcgcgtccaatcaataactctctctccttcagtccaattctcgcactctgcttctctgttggccctgttcgtttccttctaaactgacaggataaacttttggattaaaatggcatgttttttaaactactaaacggtatattttgtgcggaaactttctatataaaaattgttctaaaatatcagattaaaccattttttaagtttgtaataattaaaactcaattaatcacacgttattgccacctcattttacgtgaaaaacttaatttttatcttcaggagattcaaacacaacttaatttttatctttaggagattcaaacactaccttgatagtacccacagccactttggagataaaaacacatactcctcattcgttgatctacacgaacacaatccacatctatgggattagaaaaaaaaggaaaaaattgcatatagcttccctgcaatcaaacaatcaccttggcgccaaaacacaatctcctaaatcattaatctaacaaacacaatccgcatccgtgggatacacaaaatgggaaaaagtgtagatagatacccataggcaccttagggctaaaacacatactcctaaatcattaatctttgcgaacacaatccgcatatgtgagttttacaaaaagggaaaaaaatatatagctacccaccgccaccttagggctaaaacacatactcctaaatcattaatcttcgcgaacacaatccgcatatgtgagtttcacaaaaaggggaaaaaaaacatatagctacccaccgccaccttagggctaaaacacatagggtatgtttggttcgtggccatttctagccttgccaattttgggcaatggcagtgctttttttttagcaaaaattgtctagtctttgtttggtttgctaccaaagttgcatcttgacatattgaactgagccaaataatttggcaaggcaacttttttttgccacaaaccaaacaaataacaaatattttggcagtcccaattttgtttgctt

SEQ ID NO: 76504 - DNA, 706 bp, Oryza sativa
actctcaataaacccgaagcaaaggggagaggaaggggaggaaaggtgcaggcctcgcttctagctccaaggaagctagatctgggcaagggccaggaagagactaagggcaaagaggtcaagaagaaatacgttgctccacaggagttcaaactaggcatgccattggttggagatgacgtgcttgccacaatgggcaccgcttggaaggaccttcacttatactacatggagaaatctaacgccaggaagccgagtaaagctaccgatatccttggagagcacgatggaaagccattccttggtccaacaaattatgtcgtggtcgacttcaaggatcttttcgacctctacaggctccgaacggtggacacaagcctccttaagtgctactccttgtaagtattgtcgcccaactcattctggtaataacaatcggtttaacttgcttacaagatcgtttatcctgtgtgtaggttaagttggcaatggtgtcagaagcatgcaccggaagttgccttccttgatccacaagtggtcactgtcacaaatctccagaatgaccgtcaaggaatggtcaactacatctacgacaccttgtggtcctgccgagacaaggagtacattatgtgcgcctataataatagtaagtgtgttaactaaatatacacaacaaaatgacacacattccttgggtacttaatta

SEQ ID NO: 76505 - DNA, 1143 bp, Oryza sativa
ccttatattatgggacggagggagtaggcccacagtaaatggtgccattgggggaacattctctaccgtccaggacatgagatgatcaacggcttagattgaactggtacagtagaatgagcaaagtacagctttgtctcacagcaacatgccagcatcaacaccctgttgctacagtaagaacgtactgtttgaattggtcagtgatttggatccttcgctgcgatgctagcagcaattgcaagcataaggaccccatatcgctagtttggtatttatcactacctttgtctttgtatcgttgtcagcaacttgtataggataaacagtattactctctccgtctcataaaaaatcaacctagcataagatgtgatgttttctagtacaattaatttgaacaaaagcatgtttcctcttttttaaaaaaatatacaaggctatttgacttttaaatatgagcatatatttgattactcatcttatcatgtctaaaagttaatagtgttatatattaaaagaatcatgctatacgtacgacccatccatccaaccggcgtacgaccaaaacaacgtagcaacacattgcgagacggcgtgaggattcgtactgcacgctgctgacggcgcgtacatcaacgttgtagtcatctgatagagtcggatgtgtgggtcgtgtgtgtagcattttccatattgaaaaaaggagggagtatctatcttccctctagtttatactacccctccatcttttatatgacatagagggtattatacaaatgtctatatgaatttaatttgtctaaaagataaagaattttaataaggtaaaacaccttcaatcataatttagatccaaactcttaattaactcttatgctgatcacctttcaaatttagtgcataactgttgtgaaaaaagagtttcattttttagaaccaaaaaaggaaggactgtacatgtatataagattcctcaaacagccagcatccaccaggactaattttccccgttcctgtcgatggctcaggacttctcttgacacgccttcccgtattttttgtccatatgtgtcggtgacatgggaccgggagtatcatgactagagccttgggcaggagcaatcacccacgtggcctgac

SEQ ID NO: 76506 - DNA, 672 bp, Oryza sativa
tgcaaactacaaataatgatttgaacctcaattactaatttcataatttgcgtggttaatcttccctttattagaactaacagtgtattaacagtgtatgttcatgaggcggagcctgggcaatggcccaggctggccgggccttggctccgccattgctctaatggtttagaagttgtgaactatcctagatatcgacaatccttgaaataaaataagaatttatcaaccatcatatgtgaataaaataaacgggagaaaaagtactggctgcgtttcatcatctctatatgatctgtcgttactgtatgcaccgttgccatcatggaccaaccacttcctcataaccggatctggagaagaagcagtgtatgagaaaaggcaaaaaccataatggaggaggacggacatatacactagtacagatccttccatctgtgacggcccataacaagactggaatttgcgggccgtcacaaggaagtaatcttaattgggccgaagtttcccccgattgagatatggtcgcacagtcatggtatataggcataaaactaaagcccgtcacggatgacacttatctatgacgggctatacttgaggcccgattgagataagtttggtgcccgtcacagatgacactcttcctttaggccttttataaagactcga

SEQ ID NO: 76507 - DNA, 741 bp, Oryza sativa
tcgggcgactcgggcggcggaaccctagccgccgccgccgcccttccccgccccttcctctgccttgccgtcgcctgagcgagcggccggcaaagccggcggctcgcgaggacggcggcggcggggctcgcggtggccatctcccgagctcctggcgcgggtggacgcaaaggcggtggccgaccggagcggcgccggcgtcgaggcgcatggcggcggatccggcgtcaccaccaccggatctggcgcgctcgcagctggatccggtcgcggaggcgcgggcacggcgtcggcgaggcgtgggcgctggcggccgcgacaggcggtggcaaacgcgacggtggcgcaggcacgggcggccgggcggcggcgtcaggcgtgacggcggagcaggcgcgggcggccgcggtaggctcggaggcgcagctactgtggccggcggctcgatgcctggcggcgacggcagcgatgcccccagatccacgcctctcggctggatctggaggatgggagcagtcggcgacggcggcgacggtgtggcgacggcggcggcggcaattggccgacggcagttggcgacggcggtggcagctgtggtggctgctgtgtcatctggcaaaggcggcgtgtgtgtcggcgatgtcgtcgtgtgggtggggctattttttttcttttcctgggtacgactctccaggggtataacctggaccttttttttcctgctctatcattagaatttcc

SEQ ID NO: 76508 - DNA, 676 bp, Oryza sativa
tgttgcgaggaaagtaaactggaataactatggagaatccattagaatatacaaaaactaaccatgattttgagcgaatttataattagtacaaccaaaagtccaaaacaaatgcttctgaaaaaaggaacataggactaacttttgaaatgtagctaggcagagcacctccacacaattgagctgcctcctcataaggtaaaatataagctaatacctgcatcaagtgtaaaaaattgaagtcacaagataaacattataaacttcaacaagaacagcttcgtgtgtcttacttttgctcctttagtaattaactcatttgcttctttttccaactcgtttttcttatcctgcaactgatctggtggaatgactcctttatactcaacgaaaggtctgcagtgaacaaagaacacttaattgtgcacacaataatctaactacaaccaaattagtttgagaacacatgataagttggacgcaaaggccaagagtaatcaattgttgttatggagcaacagaataaagcatccaaaacaagcaaccatacccatcagggaaatgatgtcctttcccagggtcgaaatgtgataagccaatattgctcatgcagatgtctatcaaatgccctgcagaatgaagcctgcaaagcaacatcacaggttcagcacgacga

SEQ ID NO: 76509 - DNA, 650 bp, Oryza sativa
ctgtatgttggtagacggtacagcccgagcaccgagctcgggttgccggacctagctggctagctcccccactccctataccattgccatcttcagattaaaatggcatagagtatttgtaacaacatgacccctcttgcagattgcatgaacgaagaagagggtaaagagtaaataccagacatctgtagactgcacatgtatgcatttttatgcacagatcagggcgtatgcttgtagagtgcgcatggtgtttaattctaactccggctcggcaaaagggcactgcgttgccggctggctttgccgccagtatgcgggactgcatgtggccatgccaccacagggagatggcgggaagagggacaccgaggaattctgccgccggtagggctcatctctccctctcactcgcacgacggcatcaacagatagggattgatctgaaaagagaattactaaattgcccttacatttttttagcatattcctataatacccttgtaaatacttgcagtatatactgttagtatattgtaccgtaaaagttctcaaatatttagctttaataattagtttatggttgcatttccgggcattttatgattaattaattccgtggctgcaggatcgacggatcatgtcatgtg

SEQ ID NO: 76510 - DNA, 2061 bp, Oryza sativa
tgagacgaatttttaggctaattaatccatgattatagtctatgtgatgctagcattaaatatgtgctaattatagattaattaggcttaaaaaatttatctcgtgaattagctctcatttatgcaattagttttctaattagtctatatttaatactcgaaattagcgtctaaacatccgatgtgacaaggactatatttgacactaactagaagtattaaatataaattaataataaaacaaattacataaatgagagttaatttgcgatacaaattttataagcctaattaatccataattagcatatttttacggtagcttcacataggctaatcatgaattaattaggctcaatagatttatctcgcgaattagtctaagattatagaataggttttgtcattagtctacgtttaatacttctaattaatatcaaacattctatgtgatttagtccctggattcaaacaggacataagtccaggcatgcttctctcaggtagcaaccaaattaaacatgctcggagtaatactactactagcaaggatccatcagaaggaagcaagaaagagagattaacttacttcttagcaatggaaccagaaggaggttggaactgaaactgcttttgctccttgcgatgaatagagagcgctaattgttgacgagagaaatagagaggagctgaagatcgaaagagcgtgagtagggaaatgtttttattcgccaaggacaacatatgagggttgatgcaggcaggggttaggtaggagatgaagacaggacagaagaaaagaggcgtggcacatctcagactttcagatacacctaccactccgaaagttccaagctccccacgaacttaaggaaaaaaaaacaagaagagcagctaaattgctaatagaaggggtaggtaccatgttctagatcgtggccaaaacatatacaggttcacaccgaacgatgcatttagcttcagatgtttagcttgatgtcattttaaatcatatctttttttaagttgttaaatatgtacattaatttagttttttttatcaaactttagtactccctccgttccaaaatataggtatttttagactttgacacggtcaacgagatattatttttgaccaataatatctataaaagtaaaatattttaaataaaaagagttatacattattgatagtttgtttaatgataaatctaataacattaattttatatgaatgatcttttttatcttttctattaatagtcaaagttgaaaatgtctgacttgtcactatgctaaaaatgcttatattttgggatgcagggagtaaatacgtaataaatcatgtcaaaacttggcaatattgccaaattgacaaaatttgataaggtttattttggctacaatctaaggcatagcggcacgacacctccctccactgcgcagtgcctcatccctcgccctcgagccacacgcatacaagcttagctcccgaggaggcctcaccgaccaagcaagcagcggggtgcacatccaccggcgcacgggtgctcgctagctcacgccgcgttcgtcgaccgcgcctgcaccgtctcctccctcccaccgtacatccccacggcgggtcagttcctcgtctccggtccctgactagcgctcgcggaggtccagggcggccgcgttcgcctccctcagctgcctcttctccgcccctctctcgccgtgcggatccgcggcggtggccccaaaccaagtgcttaactagcgctctcctcgccaccacctccccgcggacggtggagttgaccgtggctgtgtgcacgctagcctcgcatggcttgcgttaggaggctaggcattgaggtcgacattgtcggtgccaggagctccgccgcgagctggtcatggctcatcaagcagtgagagaagcaatttggtctcatcaaaccgcattctagcgaaaatggagaaaatagctaagtggctgtgatcacacactctatattggcattttagcgaaaccttttttttttaacgtggcgaaatgtccattttctc

SEQ ID NO: 76511 - DNA, 1034 bp, Oryza sativa
taatttatatggaattaaggagataagattagatatgccaatgacaaaggagattataatttataagatcagtcattttatataccttcttgcccattaattcagctcttactgtgagaactgagtctccagaactgttttcatttatgcccatataaatttccattgctccatatacaccgaaacttaaaacttttactggaatgtcgttcaccagcattgtatagcaaatattacagttaccatctggcaatatgaagccaagaaagaatgcattctgcaatcctatttgtgtttgcccatctggatcagcttctcgagctcctcaccatggtacttgctttggtacttgctgaatattccacctttcatgggctactgatctagcgaagcgtccacattgaaatttagttcatcacttctaggcagaggacagagttcaacttcattctccttttctgcatttcagtagccaatttagccagtgcagtttactgacaacagacattcagtggagtagacatccaaaatttcacatattgcaatggaaatggatagaaacccaatattttcattttgtctgatgcatgttgggaaacaatgcacttctccaaagtcctaaccacaatgattgtgacatactcaaaaacgaggactctcagtggaacaggcacatttcagaacaagaagaagattatctcccatctgctgcgtatcaatacattaatagtttaatacgactcaaagttcttacgaaattcacagttcagcagtcttcactttgagaattagcagcagtattggcctaaacaccacagaaggtaattttagaaatatgaaattatgaataaacaatattcagatagataaaaaagttacttgagaaacgtgaactcacccgttggaactacagtctagcggtaaaaccgaagtgtagcaaagtggacttctggaaatgaagctgaatattacactgtacagcttgtggcgggtttattggctacctaaaattaacttggctgtttgcagcatgc

SEQ ID NO: 76512 - DNA, 3315 bp, Oryza sativa
cgagatccaacctcccacattttgcatacatatcaatgagtgcattgccaaccaagccatcagatacaatgcccttgctctgaaggtttatgtggatgtctgtccccagctccagcttgccatcctttgcacaagccccaaggattaatacaagtgtaagctccgtaggttcaatggcattctccttcatttcttgaaaaatctccaatgctttggtatatttgccgagctttgtgtagccacttatcaaagagttcaatgaaacaacatccctctgtggcatttccctgaaaagccttgatgcctcatccatatacccgatactaacatttcgtgcgatctcagcattccaccatgacaagttcctctctggcatggcttgagagacgcgctctgcacccatccagtctgcagcggcacgatgagccccgaccaacgcattccacgagacggcgttcttgtcaggcatttcatcgaacgccttccgtgcatccccgaggcgaccgaacttgccatacatggagacgagcgcattccgcacgtatcgatccttcccgcagccaagcttcaagacacggcaatgcagctccatccccttggagacgaagaccgacgcgacaccggcgcgagagctgcggttgaatgcgcgagcgcaggatttgagtaacgcagggaaggtgggtagcggggtggggagggagcacgaggaggcatggttgaagaggatgagcgcggacgacggggccggagaggaggagaaggcgacgatgaccgggcagacgagcgacggcgagaggacggccggggaggcctcgagcagaagggagagcgccgacggcgaaggcgggatgcgagagaggagagcggagaggaattcagggtggtggagcaggccgagcttggcgagcagcgcgtggagctggtgaccgccggcggcgcaggaggcggtggtaggaggcagtcgtggtcgtggatgtggaacgcattggtgggctcgcctagtgggccgtggtttggttagtgggctaagaaaaagcccacgaggccagcgaatggtcgcagggggaaaggaggaaaccgtggcttgaagccgcaggcagagacagcgtcgtctcctcttcctcttcgtcttcctgccgccgccgaggagccgagcaaaatccaataatccatcatcggagacgagcaggagcacgcgcatcaatcatcgtagagtgactcatcggaggaggcgtgaattccacctatccttttcttttccccccttgtattctcttattattgaaatcccaaccccataatccgaccgtacccacccgccccccatcgccggcggcgcccagatcgccaccgatcgcctccaccaggggcgcggcgcctcttccgccctctctcagcggcggttgctccacgtctccggattccggaagaggagggagggagggagggagggagggagggaggaggcaactcggggcgttggaccgggctcccacggcgacgcccatggtcgacaaccagggctgctcgccggcgctcgagcccgtgcccacgccgcccaaccccgacccctcatccatctcgccggaggcctgggatcccctcgaggccgccgccggagccgtcgtcgcccggatccagcccaacccgccctccgaggaccgccgcgccgccgtcatagcctacgtccagcacctcctcaggtgcaccgttggctgccaggttcatctctcactttcctcacgcctgcctttctagtattccgcaataactactactctacctttcctttgtgcgtcaatggcatgtccacaacacctagtatgtgcttactacatgtgaatcttattcagtcgtgtaattattccccttcgatcatctctatgtacacagctgctctggagtgtttaggaggattcttttattactgtttcacaagttatttccattctctgtttggatatggaaatgtagtaaggacaacatgctacatacattgttgcctctgatttggctaattaccatactcggagtttcatatacctacactatgatggcccaagtatgattttgctaacactagcgatagcgccaaactgatgtacaagttcatataaatacaaatacttcccgcggccagggtcgcaggtgttaaatgtttattccctatgaatgttttgatatcccttgtcataactgggcttgattttcagcagcataaatctgataatctaattatgcaaaacaataatatatcgacacatgttaatgtcctgcatttaacgacagttaacttgcaggtactgggttggagagttgggtatatggtatatgcactttagtgtccttttttatgacctgggtctccatagcttgctcatcttgtatgctccttttggataagtgcctcttctctactatatctgtgctcacaagaaaatggaatagggaaaagtctactgtaacacctccagaccgtggcgggaaactggcatagttttttttttagtttagtaaggagtacttccttcctgttatatggttagttattttggatctttgttcatgtcaaacacaagagatctggtgaccatagtgtattttaggggatttgtagaatattcactgaacaactatagagcatgtacgaggcatccaaaaaaaggaaaacgtacctgtatgcaatcttgcattagcacctaagcatatgttccgatatcaatactactttgccaagtatatgttactgtctggtgtgtgtccaccatgtctagtatcagcaagcaagtcatccacatcgttgctcatacttgttgttcacggacctgtttaagctacactatgtgcggatggagctaatatcaaactgttaattatggcaataatagacatcaaacgcgtacatggtctattctttgatgtgccaaaccatgccttttcaacctttgtttatacctaattactagaattactgtcgtgcacagatgcacttggtagatcacgaattttcaagacaaaggtgaataataaaaatagaaaagaagtcaaacaaaaaaaatcagaaaacaagcagtttattgctttatttcaatccaattcttaactggaacccttagccactgtgaggtgtacatctgacaaatcaatactgaaaactgcatagaaaattgaggtttatttatttaatatcgttcatgtaatatgtgatatgtttactaccttggcatcatgttctttaggagccaaacacatgttccaatggtgcataacatgctcactgctagttgttctatgaggagtgctccttagtgctca

SEQ ID NO: 76513 - DNA, 813 bp, Oryza sativa
cgttcatgtaatatgtgatatgtttactaccttggcatcatgttctttaggagccaaacacatgttccaatggtgcataacatgctcactgctagttgttctatgaggagtgctccttagtgctcaaccctaggaattggcatggcattagataggcaatatgggattctctgattttgttgtgacttatgtacaatacttgaaaaagaattattgcttgcgcttttagtcctctgcgagcactggtctctctctctgtgtgtgtgtgttgaatcatccgacatcgtgctattaaaaactacaactttaacctttttctttctgtaaagcacaggtctttccatttggatctgttccgttgaaaacttatcttcctgatggagatattgatttgactgcctttggccattcaagtgatgaaattttagcaaaacaagtacaggctgttttagaatcagaagaggcaaggaaagacgctgaatttgaagtcaaggatgtccaatatattcatgcagaggtttttctcttgatgctctttgttttttagtttatatattagttagtgtctaattcatatgcgtttatgtttctggtagtggtgtctacttatgtgtgcttatctattgtgtttattatataagatcacatgaaaccatccatgtgattcattaatacatgaattcttttcttttttcttttactccccttcttatagctgcaatcaaacatttcgcagtattcttatcctactataaaacgggaaacaacaatagagaaatccatcgtattcacatgacatcaatgaagcctgtg

SEQ ID NO: 76514 - DNA, 505 bp, Oryza sativa
tcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcacacgtggtctggtacccccgagggacgtcgggcccgagggtgatgcgttcgccctcctcttagtccccccg

SEQ ID NO: 76515 - DNA, 1644 bp, Oryza sativa
tgtggaggaggaggcgaggaggcggagggggagaagaagaggagagaagaggagaggagggaaagcgatggcgggtgggtgcaagcaagcaaggtcgttggtgagagatttaaaagcgggatttaaatttggagggagtacattacatacaaagctttaaataataataattaaattataaacaaactacactgtactttgtgtatatacggcgtggcgccgaactgtacatcacagcaaagctgctgtacatctccgtcaggtccataccgtggattcgtggagccattgggttcggaatcatctatcataatatcattatcgttacgtgatcttaactttatattatcccgcacgacagtgtttataaaagtagtgtcattatggtagataatgtgaacccgatggactaatggtagtatcttcacctcccgcacgtaaaacgaagggatctattatggtattactaattaagtattagttaaaataaactttaaaaatagattaatatgttttgttaaaacaactttcctatgtaattcttttttaaaagactattgtttagtatgtttggaaaacgtgcgcgtgaaaaacgaaggagtataggttgggagttgtgagtgacaaactcagcctaaaatcttcataaacccgagacaatggctactgttcacacctctcgtattaatatgtaagatgtgtgcagtggtgaaatggtgatgtgttcgctaccatgtgtgatcacgtctgagtcggatgacgcataattcgtgatatattaaaattttgttattatgttaatagatggcggtgtaagtgattggtaattaatgcgagtgattaaaataaaccaagggtacatgacatgagtgttgaaatgtttgctagcttgattgttgcaatggcgtttaatcggtgttgtaggatccaggggggtgaatggttggtatacccaaaaaccgaaaacttttagtggaaataaaagttaccctcgaaatcgacggaagtcggtctgaccgagattgatctgccggtctgaccgaagcgtagccgccggtctgactggtgttgatcttccggttggaccgccctggaatccctgctgcgcctgttgtcgtccccggtctgaccgaaggtcacccgccggtttgaccgccgccttgccgccggtctgaccgccgatgtgtcgccggttagaccgccgaaacccggtgaaacataaattgaagaattctaaaagtagatgacgactttattgattctctctgtatttacgaagtgcacaaacagcactccttacagaaatttcgactaaactcaaaaccctaactcaaaactcaactcaattgctttcaaaagcgataccgggaagcctcatgctccccctctatttatacccgaggcaggcaggaaccaaactcatactaggagtcctaaacaccttagaaaaccctctagtacaagaaagaaactttacataaccaatcgtaccaaatttggactccttccaaattcgactccgcatcccatacacacacaatacctccatcgtatgccatatggaatctccatcaaccacgtgcatcaactctagcctaagtatcccgcataatctctgaccaccacggacgtcgtcttatcccc

SEQ ID NO: 76516 - DNA, 2852 bp, Oryza sativa
ccactctggcgccccataaaggaccatttttgggataagtttttctaggggtctacttgccaaataagccttttaaaaggaccaaaatgtgaaaaatcctaccgttggttgggttgggacgggttcgggagcacgtggaatatgcccttgccctcctgtagttctgtactaccggatgaaacggagcaaggaatccgccacgctggcgcctcctctccattttcatggtggctctcactctccaagcgaaaatggatcggaattacgaacgctgatggcatgatcgtagctaggcccggtttattccctaagataaacttttcaccctgtcatgtcatattaaatgttcgaatacataagagtattgtaaaaaaactaattacacaaattacgtataaattatgagacggatattttaagcttaattgcgtcataatttgacaatgtggtgctacattaaacatttgctaatgatgaattaattaagcttaataaatccgtctcacattttacaggcgctctgtaatttgttttttattagactacgtttaatacttcaaatgtgtgtgtctgtatatccgatgtgatatgccaaaacttttcatctcgcaaactaaacaaggccctactaccttcatgtcaaaatataaaaacttattatcggattgaatattttgtagtataaaatatctagatagaaagtctatccaaatacgttgtattaagaaacgtctcattcggtactagattcttatatgttgagacagagggagtacgtaaaaaaaacagtagcgaaagagaaactcttactattcccactatcctagttcatacgtaaaaagacactttttagaaaacaaaggtattactagtattgaagaaataaaatgtctcaatttacaaccgaggatagttaagagagtagaaataaatttattttgtgataaattttaaattgtaggaaacttattttgcaggatggagggagtccttatcagatgcaaccaaaactaaaatttaaaatgaagttgatttgggggtccttttctttgtagtttattttttagcattggcttttaaactgatagtaacacaacttctaccgataatttacttcacttgctagtcgtaactcaaatgatcagaacatctgtctattttcttgtgtcttattggtgatgtagtttgtgtaagtaacaagttgtctctgtttcatgagaagccattattatcatgctgtgtaacttcagccccgttcttttctccaataaaaattgtataaatttggatattcatggcacgcttttcaaaattactaaacgctgccgtttcgtgcaaaatttttatatatggaagttgctctaaaatatcaaataaatatatttttcaagtttataataattaaaactcaattaaccatacgttaataccatctcattttgtataaaacatttcatctttattacgagtttcaaacaccatcttcatttcctaatggataatcatccatttataagtcatgggtttggtcttatacctacagaccttccatgattttgatattagaattatgtttgatgtacaattcacatactctctgttcaagaaaaaaaatccaacccttatatcctgaggtaattttagttgtgagaaaaaaaatactacataacccctcgttaatagaaaatgaatatgttggatgcgtaggtgagcggtacagaaggaataaaagttcttgatcaatgaatcaatagtaggtaaaaatgtagaagtttaaattttaattttaggattgagtctatctgagacacaaggagtactataacagctggtttaatttggtactacaataaagagagtccacgggattttagaggattgtttctattacaaatctgaacggcttgatggtttttactaagtccacattgtgcatttttcagatagtactccgctgacttaaaaaaaggacaaaatgcagtgcaagccagccaaacaccgaaacacgtatagtactgtagaagtatttatatttctgaccaaatacgtccatgtcgtgttctgaatttaggacgtgggagcctctatattgcctgtctgcctgacatagattttcagccaaagccaaaaataagaagattaaaaaaaaaaactctttgttcagttgtgccaacttacacacctagaaaacggagagaaattaattaattaattaatgctatgtcctactcctacagttgactgttgtcaatgtcactccgttgtcctgaaccaatttttttaagaacaatttgtcctcaactttggcccgtgagtgacacagaagcagagggacagttattatagttgcatttgctccaaagcaagtactacaccaagcaaagtcagagtgtttacagttcataatatctgtttttgtttcctcctcgtttaagccagggctgataaaccgtgaaataattataaaaacttctaaaacagtatgtgttattagtggtttaaaaatcaatttttaaaaacacaaggataaaaatactctaaagtcaacttgttttaaacttcattttcaaggtgacaaccaacagactaacaagctattaaggtaatattgttatcgttttgcatacaactaactataagtcataacgcttactaacgataaaaaaaaatgatgataaaacttttataatgtgttctgaacgacttaaaaattcaatgctaaaaaataaattaggataaaaaaaatcaaaatcaactatagaaatattttttaatattaaattctttgttgcagttgataagttaaatagcaaacggtacaattcacagctagaaatgcgaaagctgccgct

SEQ ID NO: 76517 - DNA, 840 bp, Oryza sativa
ctgaccatgtgagctgtagtagttctgctgttaattgatataggccataattgtccttgcacaagtattaaggaggtgataaaattccccgcaaaaaaaaaaaggaggtgataaaattgagaatgcttactaggaatttagttctgttatgtaccatctcatgattgtttttggaggatgagggaatacttagtagtttgtatgggttttaacgaaagctgcatactgaggaaagataataagcaggggcatggttgggaagctcattccatcgacatgcaggcattataaaatcagaaaatatctcaaatatatacctttaaattttcaattgaggactgattatcatatcagattatcagctatgatcataagcattgcaagctagaaattgtagtatggtaagacggtaatgtattactgttctggcctactagttctgtgaacaatttccattcagtaggattctgtagagtttaactgggtatttccttccactaagcacataccttagataaagaattggattcttgaattaaaaatatcagcctgttccattgctctattgtggtatacttgtttttgctaatgtcccatttatttcgactttatgattccataactgttgttgtcatgttatttattatagattctaatattacgctaaaaatggttatcctttcagggataaggcctactttgtggatctcttcgtaagagcatctaacatgccagcaataaggatgtatgaaaaggtaagcttcatacaaatttcatgatcatctagcactctaactcactgatttatatgattacacatttatatatgaatactgaata

SEQ ID NO: 76518 - DNA, 707 bp, Oryza sativa
ctgcaagtagttcatcactctcatagccagatcttaagggatggcttaggtaggatgaggatgtgaataaaactatcactgaagattctctaaagttagctcaaggtgagtgtgagacatattcaacgagagcatgaaccatatctgtgatgactactagctagtagccaatatattatatatttttgactcaaatccataatggttgccagtgcactgtaaactacattacagatttaaatccattttaacaagatgggttggatcagaacatatcatcttttatggtctaaaacgttataaaaatgaaattaattcatgtagtgctaatatgtttttgacatcaagtttcaaaagatagtataagaaaagttgccaatgtagaaatgtatcagctttcacgtactgggacaatatattgccgaagcgccgcctctctgacagggtgaatcctggctgtccacaatcctgcagagtaggatgcaagagatttaattgcatcaaaaggctcaatagtgatccaataggacttctattttgtaacaggcagtatgccagctggtacaatagcacgtgaaaggcacatttaaatatatatcacattctcaagagcctaggcatatcagtattctaatggttgcctaggtaggctaggcagcgacctttttagaacagtgatgattcaagtaaaacatactactataata

SEQ ID NO: 76519 - DNA, 768 bp, Oryza sativa
tgggttatgcactggccaggtgatatacaggggtttccaatgtgctaacgtggatgttgttttgaattgtttattgttgtcatcacttgaaactgccgataaattcaccattcgttttttcccttgcctgtactgctctggtgggttgaacatatatgagatttagttttttttttgacatatatgccttgggcctaactattaactaagaaattgcatttacatggtctgagctaaaccatgaatatatcctcgaatagttggattggacgagttgctagcttggaactaagtacagggccctatacaaatggaatacatgattgtgtaatccttgttcttttaccccttcctccccaccttggtttgtggccgttgggattttatggttggcttggctcttggctgtactgcattttcagaagttgcatggtgaactgtgtatacctgaacttttctggtattcttcgacatgtgtttggtgttgaaaatattgttctaggcaactaataataatttgtatgctgcaactgatggttcaatttttattacatctgttgactagtcatgcattattaaaaacagattcgttcatcttcgtggaactcagactttgtctggttatgatttatgcagggaggcagtggtgctgaatggacctcaggaagctagtaagatttgctcatcaacaggggcacatgttggcggtggctttttttcaactaatcctgatgtacagtcagtttggtcgttcaatcaaaaagagac

SEQ ID NO: 76520 - DNA, 6240 bp, Oryza sativa
aattcctgcagccctccatcttccagaagaaaatcttgcttgtaaaaggctcatttagttacttgctttctacccgtcatggaagaaaacgtggagaccactgtgacatatatagtgataaaaaaaacaaggacaattaattaaaaggactaaagggatgaaaatcatatactaagataaggttcccctgactatgaatgacacatggccatatgttactttagcccaaacacttgagatatattaattattaaattcttttcactgtctactacttgttccgtcctaaaatccagatttattgtgttaagatgtgtcaaatttcattctaggtaataaatttttgggacgaaattcgtatactagcagtaataacttttcgtgtaaaaccaaatgggtgtggtaaagaattatatgaaaaaagattgggttatagcttaatgaaaagtatgtaattcaaagttttacaagtgatacaacaacgtggtttgcataatgcgtcaaagagagaaaaaaaagaagaggtcaacaggagagagaggggggctggtttggcttggctgttacaaagacaaagaatgacatgcgggcccagagaggcggaccgcgtcccttttgacgacatctcatctcaccctctcctcggccgcgtaaatcccataaataaattcttcttcttctttttgtttccttgccaaatcccatctccattttcctctctttctcgttgcgatttgagaattcaccttcttcttcctcctctcgcctcctacctcttgctgcagcgcacggcgccgcgccgtcatctcgtgcttgtatccttgttcttcatcttctctcaccttcccttgagaagatttgttattactagtttaatatttctaggaaagaggagaagaggagaggagaggagagggtggtaacgcagcgttaggtgggggcgtgctagggagtcaagaacagaaggaagggaggcccaactgctccatcctccctttccccaaatccactccttcctttcgatttgcctccttccttccttggttcattcattgatttttgcaccgcatttgaggaagaatgtgcccgctgagggtgatcctaatcttcctctccgccaccatcgccggattcttcctcatccggggcctcaacgccgatcccgacctccacgacgatgccgacgcctccgaatccccaagggaaaggccccccgtgcccctccattccaaggtaatcaaaccaaaaaaaggggaaaaaaaaccattctttcttggtcgctccatactattcttgggttaggttacctcacacacacgtttcatgacatcccttgctagaggactaacgcttcaattctactgcttaattcctgctacgagccccatgtaccccgtctcatatggcaaatcacaacattgtcttgtctttgacttctagtttgctgttgctggatatggaagctagcgattctaggaatgctttcttcttacggctgaaaaaaaagaaatcttctagctaactttcctatgaaaggggacgaaaatcatgtgctttggaaatgtttctggcatatgcctaattttcagataaatcacaaccatatgtttctttttagtgcacacaacatgttctctcttgtttttgttttttcacagcagtacttcactacacataatcgactcatgcacagcaacaacaaaaaaaatccaatggctttcatgctaatttttagattcacggcttcattttcggtcatttttttcagccttataacaattagaacaaatgtttcagtacagtattgttggttcctgctgattgtctagagcttggaggttgaaaaggaactaacacccgccattccaaacttatatgcaaccactgttataatacgataagcaaagatattgcctgttcttattccaaagaaaaaaaactgcatgcaaattatcaggaatcatactaaaaaatgagctattttgaagtatttctatagttgcagtatgcttgataacaaatcttacttaaacagcgacatgtagttggctagttggcagtgcttcttacattgtgttaaaccatggtatcatggttttacattgtgaacctgtccttatggattatgtaagcataatagtttatacactggagatgctggattgttgaaagaagtactagggaaaagattgggttgttgtcctgttgacgatgcctgaaatttatatttccaggcccacaaacttataaccctctcttttttttcttaaaaaaaaatttatagcggaagaagattttttcttcagggtggagcgcatcagaacgccgtacgtaccacctacgaataataggtagccccaccccagacagagtttgtgagccgtgtaattggcgaccatttcgcgcggttcgggtcagatagcaagcgaatcgtcctatatcgcggaagctggattattacgggccatatttggtcttgagccccagtttttgttccagtgttgaatcttttgatgtatgtagtaaaaatgggtgctggcatcatatcttcatgcttcctaaccaagctacagcataatattggattttatttcgttgcttgccacataactttctctctattgaagtataattttgcatgaaactgtaggttgggtcggctttgaaaacaggattctggacgatggtggacatggcaagtgggaaatacctttggcgcactcttgtttcaccaccaacaaaatgtgaatctgagaaggcccagtgatggagttctgatatttatatcattgttgatttgggaatagacgtaacccctattgtggttagattctgttcttgaagtgtaatatgatggcaactgtaacatgaggattacatcttgaagtaaatgtacaaaatagttcacgtttgagccttttcgtgtaacctaaaacaatgagtggagaattgtattaatacatgagatttggactgaagtttctgaatacaatagttggacactattctttattttcctgttgaaatgatgcttgttttgttttgttgaaatgatacttcaatattatctttcttcctttctatgtgttgtttgaagtatctggtccaggactgtgtttctgaaatgtcctgttaggtgcctggtatttgtgatggcgcttataaagcaagggcaacaatttcatggttgatgtcacatcttatggtaagttcttcaggtaagatatatggctgtgatgtgcaaaagaaaattagctgtactcatcctggtaagattactggtattgctggaggctggagcatatacatacatgcttcaaaacacgtatatatatgctgccgcctgccggaagattaggtagggggttgcaaatcaaatcacagtgtctgcaatgcaagcagaaggcacagttgtaccctcctaattacagtccagcagaaatgtggacgacaaaatgcatcgtagcagataaaagcattgcttcatagaaaccaaaacgatactcactagtttcagaaaacccgttttatgttatagtagccaaatgggtagcatatggacttgtgcttgaccatccagggggcttgttgatcatctttggtaccacggggaggcaccatctgcagggcagtgaggacagcaaactccatgtgaatttcgtcatcttgcatcatagaagagaacatcttggcgacgcaaaatctgccagagccgaggctgatgaggtcgagccgaatcggcgaccaggatgcaggtatgtcgaggtccaactaagtgtgtagctgaccctgtgcaatattggtgagatcacaagcgcacaagctatgggggtggtggcatgatagtccgaaccagagcttgagctccggcacatattgagctttgcctaagaatggcattgaccagaggctgcttataggccgccattgacggctcaccgtgtcaaaggcgtgagtgccacagagcttggaagaaacgtagatagtgttgtgtaggaggtaattgtagtttgggtggtcgttgtgaagggcggcggcggtagagaacgccatatggggatcctttcacaaaaaaccccatagctgagcacctcgaagcaatggttgctggtagtggggtggtgtctgaggttgaggacgtagaggcagtccggttcttggttgatggagacggccatggcatcataccccttggaacaattgaggttggggaagtggacgacggagtaggaggcggcgtcgaagagcacggtgtgtccatggttgtcggcggtgaggatcttggtctcgtcgtcgccgagaagggtgaccaagtcgagagatctttcgtttcggtgatgcattggggtgggctggaggttgagcaagggacatgggaaattgcggaacctgtccatgaaatgcagcgcccctggatgcggcctcttgccatcgtgatcgatgtaggacttggccatggctgctgcttcggctgctctcgctgatgggtagaagagacgattggcgggtatgcggcgcagagaatacaagtcgtcgtggttgttgtgcaccaacagattcagatatcgccgtcgacccatcgatctccaaataccctactgccctgatcaatcgaattaaagagaacaagttattagcaggaggcggcggtgaagtcagatggattagatgaaggcgaaacagagaactcgtgcctttgggctatatatggcccgacaggccacagcctagggccttcttcttggttcttgcacggtagctgacaaccaacaagaaagttgattattttctgattggattgctcccctatcatctactctatatatatgctgataactgtacaaactctgatgctgattaaatgtgcccttctcagctgatttgccccccctttccccttttttttcctgaaaaaaaagagaggagttttgatgcttttattgagagaaacatagtaaggtttttttttggtaccactaggtaattgcagaggacaccaccttacaaggagataatagatagaacattttaactatcaatcctaaaccaaaagataacagcccaaatataaagtggaaattagataaggtggcaagctataagataaactactccagaagacaaccgaaccacttgggccttttagagggttaaatcagatataatatttacacggtctgaaaataagcaagttacttatatattctcaatgttttaattttatttttctaccctatcacatgagacattcttacattggctctcaccctttaggttggttttacttcatcttcacatgttccaggaaggagaactgtgcaggcattgcaagaggcaacaaatttatatcatatctatcaagcactccaactaattatcccttctccatgaataaatttgttttcctccaagtaatcagcttatgaagcggagacaacacatgactttgtactgatgcaaggaattcagaacttgtatttgctcaacaacatatacggataaggcttctggttgcagagaggtagtgaaatccaggagatgacagtaagatacatattgttgtaccactaactagctagcaaaatgacacgccagcccagtaatgtcattcagttaggaccaaaaaacactggaatattacatgccactagctagtttagaattccaatcctacttaactggtaagtataccaccactaatttacttgatcattagtctcttatagtccactagaaatgtggacgcaaaattgcatatcagataaaagcattgcttcagccttcagagtatcaaaatgaataagattaggccatatgggctgattcatagaaatcataacgataatttagtttcagatagaacactcggccaaatttagttcagctgacaaggaaaaatcttcagtctccactgttttcgctgcctttccatttctgacaagatagctctcttgaagatacaaccagcaagagtgatactgcttcatacaattagcaaagtagactcttacagaccatgcactaatttagagttccaaattttcaatcctactcactagtcccttacagtccactggaaatatggatgataaattgcatatcaaacgaagcatattgtttcatatgaaaatgaaatcagtttaggcgaacccattctgcttcatatatagcaaaatgatattagtttcagaaccaattcgatttgcgttagaatgggtacacacatatcaggtactaatc

SEQ ID NO: 76521 - DNA, 2509 bp, Oryza sativa
ttatcccctctcttttttatcatgtgtctaggggagggaccagaaacctccggaaatttccatttatttagctcatctgtggtttgtttatacatgtacccttttcatccaatgaccattgtttatccaaatccttcatccgatggctaatatatttataatgatttggcacgttctcgtgtaagaaagcctgctgctttcattatataagataagataagattacccttacgtgttaaatattacctcgaatctaattatattttggccataacaaaaatattctttttccaatttaagagtataaatctatcagaatttttttctccccatatataagtaatgaatctgaattggactttagacatagatataacactactaagggtagatgtacattttttagagtttttttctcatatttttaagttggtgtatatggtgtgcacacaagaaaatttgtatgtataggatacgttttccaataaaaaatgctcgatttattgaccaaagttataatatgaatagtcatcggtgatatagatgtattatttatttattttttttcaattttgtatggaataagctgagcgcgatttctctaggtgtgtgatcgacagcgaaaccttgaaactgtcgatgattcctctttgttccacgtgcacacaccaccggaccgcagcagattgcaagttgcaactgcagcatccttaatcaactcaataaaaaaaaagcgtgcgcatgttatcctagcgtactaaagtactaaccttaaacaaggctgcgtttgaatgtaccatgacctttgaattatctctcatttttcgttagcatgttaaatggcacatttcgtgaaatgatctatataaaaattgagatcatctatttttaacattatattaattaatatttaattaattatatgactcattggaacggccccgttaacatccgtgcatgacgtgcatggagtcatgtctgctgctgtgctgcaccctaaaatgcacaggtagaagcacaagaagttacgtacaactgcgggggattggttggcattacatcccagaccgggcaaatcggcaaattgatacagcgttgtgaacgtgggagggcgaacatcaggcagggtaagctcagaactcgggaagtttcagaacgtgaaccacgcgagagggagtgagtgagggacggtcggaccaccagaaaggcagcgctgatgggaagaatctgggactttgtgcaaagttgtgtgaagctaccgcgagaccgcgggacggagctgggacaatcagtacacgatctgcctttccagcggccgggcacttcagatctagtcgctgtgctagtactgcttgtcaccagccggcaaaccaaaactttttgctcactcacagaaatgtggttgattagacccctttgctgttaaagaagatgagagtgcatgttgctttctttggcgtcgacaaaggaacgaagtctcttcttgacatgaagacacccagggcatcttttgaaacacgggattaaaaaaaaagaaagtataaaaagcacaaaatgtaaaacacacatggctccaaataggtccttttcttactggttcaaacacacctctgttaggcctccctaagttctctccccctttttttttttccttttttggaaaaaaaaatctgtagtcgatcatcttaacacctgtgaaaattggttcgcatgcggttgtgatgctcgcaagtgaatattgtgatttttcacatacacctggagctagacagttgcttcacccaccagcaaaaaatacttttggctgtctaaaaaggtttctttgtagcagtagtagaaaaagactatcaataatagatttgagtactgctgctacagtaccttgtatagtatgtgctaatgcatggaaatgcagtagtacaagacttaaacgctgcggttttttgataaaaaaaggtgatataaaaggcttttaaaaagattcaagtattttttaaaaatctataatagttaacattaattaatgatgcgataattgagtgtgttctccggcaaccaaaatgacaactcacctcacaatcttcaggggcttttggctcttttaaggatagcatggcaattgaatgccaatttatcgagaaagagagatgacacaactcaataagatttttttatgtgtccctataattttgttaacacctcaccattcttaaaaatgcttgattatggggagtaattaaattgcatgtgcggtacacagaaatatcatacatgtgcaattagtacataaactaataaaaatatttattctagtgcataaacttgtctagtacatatgaatcaagtcttcaacgatatattataactaattaggatgtctcacacacatataaggccatgagacatgttgtattcgttgcatactccctttatattttacgttttttattcgtataataaacattacttatttcatgtttgatcaagcatatgtatacgtaggtaacat

SEQ ID NO: 76522 - DNA, 2320 bp, Oryza sativa
agtccattgtgtcatcgtcatcgtaatcggagaaacccaatgtgcagtcacctgcaatagaacggaaaatcttgacgacgcaaaacctgccacagcccaggttgatgaggtcaatgttatagggcaaccaggattcaggtatgtcgaggccacccaagtgtgctgctgctgcaccgtgggtggctttgctgcatcggagaggagatcacaagcgcataagctgtaggggtggtcgacggatagtccgaaccacagcttgagctccggcacatactcagctttgccatcgaatggcattgtccagcagcccaggcgacgccactgacgccccactgtgtcaaaggcataagtagcatctggctccatggaagaaacatagatagtggagctgtcaaccaccgtgtaggaagtaatgtcggcatgcatgtagttggcaaagggcggcggctgtagagaactccaacagggagtcctcccacggaaatccttacaagaagaagtgtagttgagcacttcaaagcagtaatccttggtttcagggtcaacactctgggacatcacgtagaggctgtcttcatcccacatgtcgccactaatgttcttgttggagttgttgtttttgatggagagggaaatggctgcacaacccttgtcagaaatgaggttgggaaaggcaaaacggtggaggagtcggcgtcaaagacgatggtatgtccactgtggtcggcaatgaggatcctgttctcattgccgaggagagaggcgaactcgagattcctatgtcgacgctggccatcccagggggttggttcgaagttgaacatgggagagggaagcttccccaacatctccaaggtgtggaggcctggatgtttcctgccatggtgctccttaacgtacgcgttgaatgattcttgggactttgccgtggcctcttcagctgctcttgttgatgggtagaagagatgatttgcaggtatgcggcgcagagaatacagtccactgcgggcgttctccaccacaaggtttagaaatcgcctccccatatctttttccgaaccaaaactgatcttcttatctgacgggatgattctattgttgggtgggagtgcctatataacagttgccacaatttcagcctaaaaacagttagtttttcaccattacagatcaacggccaggacaaaacaaaagctcattactgatgaaacaatttgacactaaacttatagcataagtactagctgcatagctaaaaaccaaagctagaaggcaaggtctgtgcaaaaatagataaaaatataaatttacatgcacatagaactaaacctacatttttaaatacggtgtaactgtaatgtaagtgacatgtaattgtagttcaaatgtgatgtgagtaccttttaaccttaactttatcatacactacattgaccgaagaaaaataccagctaagagcagttggtaactcggcattcaaaacgggcttgcatgcttgcaatagaacgaatctgagaatcgatatgatgttgataaatcttactataatcagccaagaattgtggagacacaattttagtaattccgtaaaggaataaaagaaacaaaatacgacgaacgaccagacggaccaatagaacgaaacagcaatggatggagcaaaataaacccatacctgcagcagcagcagcaaaggatgtggatttcctttcaattccttgcaatctgtgacagtcggccgggatgcagatcagatggaagctgctgatctacaggggcagcgtgcaatctacaggaaggaaggaggagggttggacaagtcaggaaggatggcggcggctgccgaggctcagcctcagcgcgatggcacggattagggccgtctgggtcctgctagtcgcgatttctttatttttatattatttttttaaaaaataaaaattaaattacccttattaatcgccataccatacaaggggaagtgcgagacgtggcaaatgacggaaggggcgcgcgtcgtgtggcaattttgtaggcgccccttctcactcttccgtagaacgatttattactggggcactttcaaatatccgtggtcaccccacttgttattttttttaagataaaccattgcaacagtagattgtcctaataaatggtgatttatcatgcctttttggaggcagcaccctgcccgtaaaatttcaataacacgcctcttcggtcgtcctccatgtcacatttctcgtcctaacataggatgatttatatgtcctatcctatggtaggacataaggagtacatttctacaaaacttcag

SEQ ID NO: 76523 - DNA, 3750 bp, Oryza sativa
aaatgcaatagagatccctcatcttgtcacattacaaaatcatccttgaacggcaaaaccggacataacgcatccccaaacttataaaccagtgcaaaggaagtcctctggcggtattgtccctggttttgattgatgtggtgcctacatgcctcctttaactaggtcttcgtctcatgtgacattgatatgacgcttattaggtactaataatttagaaatgttaattacttagataccactagtaacttagaagagtctcttacaatcaatcctactaattattccaatcaaattaagtagagtctctgatagacaactaggtagctagaaacatggacatatgtataggagattaaagctagcattgcttcaaataccaaagtgaaattagggcacatatgctagctgcttgatagcaaaataaccatcagcttcagataacccattcgatgtaatcatcgaaaaattggtagtacatgaacttgtgcttgatcatctggacatcatcatgtttaccacgagggcgaaccatgtgaaggccagtgaagatagcgaaactcccatgaattgggtcagagtcttcaattgtgccatcgtcactctcagagtaggaacaaaatgtgccatcacccgaaatagaatggaacatcttggcgatgcaaaacctgccacagccaaggttgatgagattaatgttccatggcaaccaggactgaggtatgacaaggtccacccaagtatgctgcaccgtgggtggttttgctgcgacggatgagtcgtcggagggaagatcaaaagcacataagctgtagggatggtcagcagacaggccaaaccagaggttgagctctggcacatactcagctctgccatggaatggcattgtccaggagcccagccggcgccactcacggctaaccgtgtcgaaggcgtaagtagaatggattggcttattgcaagaaatgtagatggtggtgccgtgaaccaccgtgtaggaggtaatttcggcgttcatgcagccggcgaagggcggtggtggcagagaaacccaatgaggggtcatctcacggaaatcggcagaggaagaagagtagttgagcacctcaaagcaaccatccttgattctgtggacgtcgggactccgggtcatcacgtagaggccgtcctccggcggtggttccaacccgttgttgttgttgctgccatcgttgttgataatggagagggatatggcgttatacctcttgggagaaatgaggttggggaaggcgaggacggaggaggagtcggcgtcgaagacgacggtgtttcccctgttgtctgcagtgagcatcctgctctcgtggccgaggagacaggcgaagtcgagagacctaagatggtagcgatccacgggggccggctcgaaggcgaacgtcgaacggggaagcttctccaacatctccatggtgtggaggcctggatgcttcctgccaccgtgctcctccatgaatgattcttgtgactttgccgttgcttcttcagctgctcttgttgatgggtagaagagacgattcgcgggtatgcggcgcagagaatagagtccaccggcgccctgcaccaccaggttcacaaatcgtcgtcgtcccatggtacgtatctgctccaaattccaaacgccgagacgacctgattctaatgtagattagacaccatgcaacagctcgcaacgaagaagaagatcaatatggtgtggagagagaaattaaagaagatcgaagaaccctctatatatacgtcgaaaagcagtaagtaatccttggagtttatagcaatggccggaggtattcgatgcatgcagtggagttggagacggcgggcggcggcggaggtgccggcatggatggagtagatgaaggtaaatctgcggcagctcgcgtctttgggcccgttggcccgattaacatgagtaatatttttcctccttaatgggtccaacgggccggttcaagtaggccagtaattcctttttctttttacaagtccgcatgacaccttgcaaatttcatttcaatttcatccttgcgacagagatttttttttttactagtaaatggttcgactgtaacctctagttttgtcgaaatgatgcttgttggttggacagtggcgttttattgttaaaatgagactgtactacagaaatatagggtcgttcttactttcttcattttctattcaaagtactgatgcaacttgtaaaagctagcgtctgcaagacgaatcacagttgcacaccggaaaaaccatccttaaactttgtgttacgcataagaatgaagtggtaagcggtggatggtttcaaccctgaaatctcatatttaattcttaataagctcacactttcttttaaaaaaatatttgaagggacttttccccctccaaatctcgtttcatgcatatacctaaatgccattgcacataggtataaaaatacttttcggcccaaataggatgcacatgacactactcctgtattgcacatgcacctctaatttattagagctccaacaactactgagtagtcagtactctcctaccgtccaccggaaattaactaaggtggatgataaatatatttccatagaaagaaaatcatattgattcatagaaaaataatattactttcaacacaccaattctcatctataaaaactcgaaattagtttcttagagaacaaattcaatgttataggcgttgaaaatgtaatacatggacttgtgcttgatcatccgaacctctcttggatcatctttaccacgggggcgcaccatctgcaggccagtgaaaacagcaaaatccgcagcaaaatcagagtgaatcatgtcatcatcagagtcgttgagtaaccaccagaagtgaagatcttaacggcgcaaaatctgccagagacgaggttgatgagcttcagctgaaacgtcaaccaggacctgaaacggcacacaagctgtacagatcaaagcctagttccttccatctcctctccgagaggataataaggtcaaggtgacaggaaagcagagcaggtcaaggtttttctccatctcttgcaaattcagactactattccctctgttctgctttactggttataaaggattacctcatcatcatcatcacatattgtcggccaaggcttttttttagcatatcctatcaagacaaacactactgtatataaactggcaacagctgaaagatatataaatgtatagtagtagaactgaattttgcatgaccacatgacttatcttaaaacgttttttttctctctctctctaatttacagcgatcttatcaggaatctatcattgatatctcagtattatttctcaaagcaaaaaaaaattctcaaatcttacaaaggacaaaagcatctaggtgggaaattcgcaagttgcaatctgaagagtatagcctttgtcatatgtacaacttgtcacagctacaattgggttgttgagattaaccaaatccagtcgacatttggacagtctgattagcagtattattaacatcttggaaagttgttgggtgatcaattaggaccgtgaaaaatgagctcttggatgttggatctatcctcagtgacagggacaatttattttcctcacaactcacaactggtgtttaaatagcttttgttcagacttttcaacatgtgtattatattttcttttgtttaccaataacttcgctctctgtgg

SEQ ID NO: 76524 - DNA, 2567 bp, Oryza sativa
  unsure (1)..(2567): unsure at all n locations
tttgtttgataaaaacttatgttcaatatctgataaggtatacctctgtagcactattgatatgagaattttcatcaacaagatgataataaaaagttaaaaactctagaaattcttgagtgcctggtgaataccaagaattgcatacttcatgctgcagaaaccttgctaatggtgtcacaacattgcacccaaacatagctttatgacagtatcaggacgaatatctgaagaaagcttgaaaggctcaaagccaatttttatattgcagctcaatttctcataaaattactctcgacagactccatctaaattgtgcataaattgcctaaacatcaactctccaaatacaattgcatacattgtctcaacatgaactctccagatacaaaaacatagatgctaaaaagaacacaggcaagacaaataaattcatttgagctaaaacctaatgaatttgaggagcggaaactaaatgcttgagacatcaaaatctactcttgcgactgctgctattcatctccatgctaggccaagacaatgtccttcagagctggccggatgccctcctccagtagctgtcggtactccaatgaatcgccacttgtttgtttcatctcgatgatatgataggaagtggtaacctcaaatatctctatgtcaaactgaagaacaccattccttccctccttcctcccttgcatcttcactacaccattgtctttcttccttaccctgagatttagcgcctttgctacatcttctagctttgagattatggttgaggcagatttatctgaagtgaaccttgcctcatttctccattcctttacaatgaacatgccagagagatcaaatcccttggagaaagagataatttcaaaagcatttaagtttgtcactgacatgggcttcacatcttcatgagcatttttcttgcgtctcacaccaagcaccggagcaacatttttggtggtgttttcattcaaagttctttccttcaaaatacggttctcctcaggacctttccggaaccaggtagactcctttatcttctggattgaaatccttgtgcttgggttggggtccatgatcttgtacaacaacttctggagtttgcgtgaaaannnnnggggcacctgaattcaccgtgttgtatcttccgatacatttccatcaagtttgggccctggaaaggaaggtaaccagcaacaagaacaaacaggataacaccacaagaccaaatatctgactttgcaccatcatagcctatcttgctaatcacctctggagctacatatgcaggtgttccacaggtggtatggagtaagccatcttgcctcttcgactctgaaagcgcactcaatccaaagtctgagactttcaggttctcattctcatccaacagtaggttctcaggcttcaagtcccggtgatacacacctcgactgtggcagtaatccactgcactaatgagttgctggaaatacttatgtgcaacaacctctgtaagctttccacgctttgcaaccttttcaaatagctcaccacctttcacatactccatcacaaagtagatcttgttccgtgttgccatgacctcatgaagctgaacaatgttcttatgagccaccaaccgcatggttgtgatctcacgtctgatctgctccgaaagcccgaccttcaatatctgctgtttgtccatcatctttatggccacactctggtttgactccagattccttgcatagtgcaccttgccaaatgttcctttccccaacaatctccccaactcatacctctccattagaatcttccctctactctccatgcccacaaagatataaatctcagcactatgttttgaccaccaatcagatggactgcaattctttagccatcctccccaaggtcatgatcgtggatggagaacaacattcttatatcatcgtcgtttcggagtctaaatggtgtagaattagtgcaggaaagttgatcactcacatcaagacttgagtagatcagtagcactggtgaaccagcaatctgttttatctcacacggaaaatttcttctatgcaagcacatctttcagcattccttgaggctttcactgcttgttttttttattgattcccctgtataaacaaaaccaggcatcagatttagtaattgaatgtcctaggatatgcactcaagtgctaacaaggtacgtataataatctgaaagtctgtaagaactttaaccaaacaaaagttaatgcgaagaattttgaaggcttattgtaatactaaatgcatttttgtacctactacttatataatataagtgttccctagaatcaatcagaacttacatgagttcaacgtgttatgtaatagataattaatataataaggaacttcaactaagtacttatcagaaatctaggacagtaaatcagaagctaacaaaataaaactagtcaattacgaattaaaatttgcaaccgatgtgaattattctacatctttcgttcaagttcagaaaggtgattaataaaactagtcaattacgaattcagaga

SEQ ID NO: 76525 - DNA, 11033 bp, Oryza sativa
tattcctgtaatccattatctaaaaagaaaaaaacctatcaagtactcctcaagtagtctgaagatgcttactttttaatactactcatttagtttcacaatgtaagtcattctaacatttctcatattcatattgatgttaatgatttagattcattaacattaatatgaatgtggtaaatgctagaatgacttacattgtgaaacggggaaagtactatttaattagttaattaggtgtcaatcttaggagaagtgtgtgttcaggttgaagccggtggtggtgttactagcaccctggcctacaagggaggttggacatgacaaggactccaggaaggagaacctgaaacccaaaatgaagatagaaaaaggaaaagagaaatgatcgtttgtctgaattcaagatacaatattcagtctagtcaaggaaaggaatactaccatttataacaatttattaggcatggtctaaaatttgtgaatactcaaaggtgttttttttttcaaaataagagtatataagatacccctgacattacttaagctaagataaaacgtgaaaagaatatgtcagattttttacgaaaaaataagcaaagtcaaatacggatcatgtgaacatattctgaaaattcagttgtggttggtcttgtgctgttccaacgtaaccaacctttcctcctcttccctctgcacatctgaattgtcaagcaaccacaactcttgtccatcctctccaatcttaagcaggataacacaaagaattcttccttcacattcccattcacaatccttccttattcaacaatttgtctgatacttgcatgcccacaggcagctcaaaaagctagctacttgtttctgacttgtatcatttctacatagatagctcaaagcctctcaaaatcctgcatttcttgctcaaatggatttttcaaggcatagattcttcaaattcagatcagcagctgtctccttcctctccatgtaactaatttcaagctctcaagatcagcaagttcagcaatcactagactagctaggctcactccttccacatatagtcacagctgctctcatcaatcaatctatctttccagcttccaggtgacaatcgagacctgaatttctgaactttttttccctctcgtcacttcgtcagtagaaatccaaggtttatattcctctgtactactacacaacagagtgagcgtagtacgtgtctcatcagcatcaaaaagtgacatactgaaagcacgccacaattgaggccgattgatagaatcgaattccactcaaaattgcacggtggaagagaatcccctgcgtgcttgatttgatcaggatttatattggaggcatccaattccatcactcaaccggagctgtctgtctgtagctatcgccctatttctgctagctcgtggcgtgccagtttaatttcttccaaaattctccggcctcacctcgcgtcgcgtcgcgtcgcttgcgttaggaggtgcctaagtagtggcttgtcggcgtcagatgagtgcagggacgtgctgctcggaggcgtccatggcgtggatcgactgctccctcctcgcctggctcctcttccgcgtcgtcttcttctcctgccacgccaagcagttcagcatcttctagcactcgatcagctaggctgaatccacatatactccagcatatatatacagcaactgattaagtaagctgttgctcgccgacgacggtggccgagcatgtccggtgcacggcggtgcggtggccggacgtcggagagaagctcggtggtgggcgacaacaggaatggatacgtcgagaccgacccaactgggcgctatggccgggtaatttattcacttcttcttcttcttcttccaaagagaaatttgacttgtttcctttcaaagttcaatcttatcatgattgccaaatgatcagcaagcaattccgagctattcagggtcaattcagttcattgctttttcgttcaaaagaaaaaaaaatcagttagttgcttttgattctacttggacatggattgtgcctatcatgcatgagtttagttgttcagctctatcatgttctttagatgtgggctggtacttggtaattacatttcaatacacgttgtaagcatcagttaaaacatgttggcttcattctctttcagaaaagcatgtaggctttatgttctttagcataattttctagagtagattccatgttgatgtacacatcggagctaacacctctaaactatgcaagacacaattattgtgtctttagtactttcatcgtatccatttggcttttgctgctatctatgggctgcataggacaattgaatattgcgcattgaaacatatcaggtttgaggtttcgttgttaatcctaagccattgctgtactgaaagataacatcatttttttctatatttggtcaaataacggaagtgcatcataaatttgagatgatgagtgagaattcgattatgatctcttccaatccaatcagggaaggtaaggtgttccttatcaaacaagctagagttgttgtttggttggcattcagtttcctaatatgttggatttgatctgaatagataagcatgttccatgtgtcaatctgccaataatcagatgttgaaaaagtttcaagagtggagtatatgccctgtctggtcatgctcatgcccaacgatttgatacgatccgctcacctttttcttagtgggatgaagacgtattggcaactttattagttcatctttttcagtagtttctctagggttagaggtgtacttaccggcaacttatttgtagttatgtgagctttttgcaaaagtgtcttacttttataaatttgacaactacccactactttgagttaactttttatatgtatagtaattttaacttttgatcagaagtactggttgtttagtgctaaattagggagagtagttaattgaggtgccaaattggttctcgtaactcaaaagtgttgattttatttgactagagattttctagacattactgtagcaaaaacccgtttggaatctgcatttttcacttcagaacattatgaaaataaaacttatataagatttttaaatcccatgtaaaattaaattttaaaagatgactataaaagtgcactacaataaataaataaataaataaaatttatctcattctcttgaagaaaagcaattcattaattgcactttctagtgtagtacaatacacaataatattgttttctgaccatgtgctcatgatctgtaagtatatattttctctacatatgcaagcatgtttgtttcaaaaactttttaaactgcacgaagtataaaatatttagaatttagtgaaagcaagcatttcgaatcaaaattaaacttgtcaattcagaataaagtagtctggctagcttgacaatatatagataaattaattaattcgctttgtgctggcatgcatatttctggtatttcagatatatcagaaatttcgttttgtactttctgctatttcagaaacttgaagaatttccccccccccaatatgaaattaatttggctgaaaaaaaattcttgtttttaagtaagcaaattttaactaaactttaaccaaaatttgttgaaatttcaaccttttcggcctgagatttccgaaatttcggttctatcgaaatttgttcaaattttgtactgtatacaatatgtgtgcagttgtcggaggtgctggggaagggtgcgatgaagacggtgtaccgagggttcgacgagctgcggggggtggaggtggcgtggaaccaggccaccatctccgacgtcctccgcaccccggacgccctccaccgcatgtacgcggaggtgagcctcctcgccgacctccgccacgacgccatcatcgccttccacgcctcctgggtccacccctcccgccgcaccttcaacttcatcaccgagctcttctcctccggcaccctccgctcctaccgcctccgctacccgcgcgtcagccgacgcgccgtcgccgcctgggcgcgcgccatcctccgcggcctcgcctacctccacgcccgcggcgtcatccaccgcgacctcaagtgcgacaacatcttcgtcaacggccacctcggccaggtcaagatcggcgacctcggcctcgccgccgtcctccgcggctgcgcctccgcccgcagcgtcatcggcacgccggagttcatggcccccgagatgtacgacgagtgctacggcgtcggcgtcgacgtctactccttcggcatgtgcatgctcgagatgctcaccaacgagtatccctacagcgagtgcgacaacccggcgcagatctacaagaaggtcaccgccggcaagctccccgacgccttctaccgcctcaccgacgccgacgcgcgccgcttcatcggccggtgcctcgtcgacgccgcccaccgcccctccccgaggagctcctgctcgaccccttcctctccccgtctcagaaccacgacgatcacaatatcattgctcatgcccctgcgccgccaccgccattgccattggcgtgcagtaattccagtgaggagcaagaggaggcggcgccggcgccggcagcaaagacgacggacatggcgatcaccgggaagctgaacaaggagcacgacaccatcttcctcaaggtgcagatcggcggcggccgcaacgtgcggaacatctacttcccgttcgacgtggcgaacgacacggcgatggaggtggcgacggagatggtgaaggagctggacatcgccgaccgggagcccacggagatcgccgccatgatcgagcaggagatcgtgaggttggtgccagggtacaagcagcacgagtactcgtacgcggatgacaacgacgatgatgacgtcagcggacaccctaatcccttctactacctctcctcttcgccgacctcctctcagggatctctctgcggagtggggtccacatcgtcagaggggtttcctggcccacatggaaaagttgactggtcaagaggtactataacaaagtgttttcatcttgattactttcctatatatcaacaacgtgctattctaatctgaatatggttctagctatatagaagataaaaggttgggttttctatacaaatctcttgagtaggtagaagaaacttgcataattaaacatttttacatacagttttgaaatgggcacatgacgtagtagcatgcatgcagtgatgcagatgataatagtgcggcaccaacttccaaatgcatgtatgtatacctgaagttagcttttgttcatttgctcaactgcttttgttcctatgcaagaaattaaatttcctagtcaccatatatatgaacagagaaattggaagtcagacgtgcaaactactagaggtagctagctagcaaggtggttgatatatgcttgtccatttgtcgttgctattcgtgccaatcctgtgacacgaatacatgcgtcagcgttatatcgtttctgttcctatatagtactagtagctagcagcttacagacagccatgcattaggttcgtgatgcataattgtggctttcactgtcacaattgatctctgcagagacatcttagacggataaaaattgtgctcagttagtcgtgttacaatcatcatcctggccggccagcagcataaatgtcaaatggaatagttgtcatgtaacatacacatcaatcattatatctactacaagtactaccaccagctggttagtgcagttaataatgtgcgcatgaaataatggacatgaataatgaataaagattaggcactatatatacacatggtacatatatagctccccatttcattgtcatcgaccgcatctttattcatatccatttatttcatgcgcacattattaactgcactaatcagctggtggtagtacttgtagtagatgatgttttgaattgactaatccgtttgatttgatgcatggtgtagattactgttactaccctccaagcagcgtcagcgtgagcgacgacgatgacagcagcacgagctcactctctgctgcagtcagtgcaagcagcctgcatcagcagcagcagcattgctcggcctcttccagcagattggggccagcatctgcatctgcatctgaagacggaggaggaggacacgccggacggccacggcagcgagagggggaggaggagcggcggcggcggaggatgagtcggaacaggtccatggtggacatgcggagccagctgctgcaccggacgttggtggaggagctcaacaagcgcctcttcttcaacaccgtcggcgccgtccacgacatcggcttccgcgaccctactgctgctgcttcttcttcctctagctcttcccaccaccgccggagaagcagcaacaagatcgaccacaagcaccactacatgttctgaataaacttttcagagcaacttaatttgctactccattatgtacagagaatcagatgcagagtattagcctctgataatggattagggccgttcactttgatgccactttgaaccttactaaattttggtaaaactaccaaaaaaaagtggctacatttagtttgttgtcaaattttagtaactatatataagaaatcctgctaaaattttaacaagttgccaaaatttgataaggttttttttttgacatcaaagtgaacatgcccttaatgtgcgcagtgcagagtatgcattgcgtgcgcggccacaaaattgtgtatatttggaacgagtgcatatatatatatgcgtgttatcaatgagagtttcgccatgagacatgtaagtgaatatgggagtgatatgtacatatagttgttgttaccagtggagtacaaaatactactccagcatgcatgcgctgctgaccagagtttttactgatgaacagctctcctaatcaacgcgctgtttttttttcaagtttcaattttgctaataaaaatggctctctctttttgttgaaagtgttttcagctttggtgagtttgctggtcgttctccgacatcttttccaatccaaatttttttccccgaaattgattgtggaaatcaaccaaaattttctaccccgagatcatcttgggctctggacacactgatgtgatgaccctaccttcctgggccacgtccatcgatctctgggctgcagtaatgggccttcgcccatcaccgcgcgtgtgcaattactgcaaggaataagttcactttaggtccctctatttgtcggtcagtccgattttcgtcccttgaccacaaaaccggatacgacccatttctcaacttatcaaaacctaacaaacaagatccctcggcagtatggagtgtggttttagccaacgtggcgcctacgtggctcctctaactaggtcttcattccacgtggcattgacgtggcaactcgatctgaaaaaaaattaaaccccataggacccacatgtaaattaaaccccataggacccacatgtcagtttcacgcataaagtaataaaaatggtggggccccacatatcactcccacccctacctcttcttcttcccctctcccccatctcccctctccggccacggtcacgccgccgcctgggacgacgacctcaagaagacttcgcccgggcgtccgcccacgtcgctgccccagtccgtcccgtcgggcttcacgccgccgtccgctcgcccgccccccgcttcgccccgccccgacggcttcgcgccgctgcgtgccggaagacgacgacgacgaggctggcgccctctgcttggctccgccgcccgccgagtcgcagccgtatgcggacgggagctcgacgcggcccgccgcggaggaggaggagaccacggcgctcaagactctgcaagttccatctagctttgcaaggcccatcaaccgcagcatcatcagttcttcttcttcgtcgtcgtcgtctcagaattctctgcggccaaagcctggtattggcagggctcgccgcaagtgtcgccggagagaggcggcgccggagcacggtggaatcttactataaatgcctgtatggtgatgttggatgctcattcagattacctgctccaataatagtcaagactcaagagtcgattaatttctaagttccaataatatttggtgtttatatatattggactcgcaagcaagaactactacaccaggttaggtgaatggtccagcttgcccaaaagttgcagatgaaatattcagacctgtggatcggacaaagtgttcccgtttgaatcattgatcatagctggagaaaaaacctaggagctggggataactaatatgatatatatggaagacgtgatcatctcaactaacaatctatggcgttgctggttgtagttgctactacacgtttgatgggaaacatgcaggggcggcaacaacctgcacggctgcgtggacgagggcgccgcggcaggagcaggcggcggagatccccatcgtgctgttcctgtcgatggtctttcccggcacgacggtgcagctccaggtgttcgagttcaggtaccggatcatggtgcacatgctgctccagtgctccaggaggaggtcaccaggttcggcgtcgtgtactcctgcatgggagtgggggtcggtgtggcgccccgccaggtggggtgcgtcggcgacgaccggtttcgcgtcgtcggcgctgtccagacgaagccgcacgcggtcccgaggatccgccgccccgccatccgcccgccgccgccccccactccgcgcccgctctaccacccacgcgaagcttcttcgtcggcggcaatggctgataggggaagatagggagaggagaaagaaattgctacagcctaccgactgacatgtggggtcccatatgggccccatcacatttattttgttgtgtagttgacatgtgggtccacgcgggccccaccatttctaaattattatttttttgtgtagttgacatgtgggcccgtggtttttattattttttcgagatataattgccacgtaagtgccacgtcattgccacgtggaacggagacctagccaaaccagccacgtaggcgccacgtcagccaaaaccgctatccaaaccgccttaggaccttatgtgcactggttttgtaagtttggggatgcgttatatccggttttgcggttcagactgggcgacaagagggacctaaagtgaacttattccttactgcaacgcgtaaacagcctgcaacttgctgtatctgtatgcgtgtcgccagcttcggaggagggcacggcaacgatccagagtcaacggtcaaatgttccctatcccatttacatctctctcttgatccaatgcattgtaccaccaacttcttctccaagcactgaccctaaattgcctaattgtttcctcttttttttttatgaaatagaaatcatgtatttgtctcatcttctcaaggtgttcaatgtgtctcagatatcgcgcgttgtcaaggaccaaattatgctgcatatcttgctaacctctttatattttgtatctagctgatcatctcgtaattaaaaggtagtaaatttgatctgtaattctaacatcaatgtaattctaaatttgatttgtcccatggaagcataaccgatattacataaattagactcatcagctgcacccccctccacccgctttctttttcctttcttattataatctcctagcccctgggctattgtacagtttttccccctactttacaaatacaccccgcggggtttaaaaaaaaacatcaatatgcatcacagcagtcagaactcagaaatattcagaaaatgcaggggaaaccaaagaaaaacgttccattagttgttgcgaactagctagcaaatcgatctcatgtatatatatatgtacatagtttctgtatatccaacaaatcaacagataaaaagaaacaagaaaaagaagtagcctgtgtcatacactcatacatacacaactaagatcgagagcctacagaggaggaagaggaagatggcaagtacgagcagctagctaagctagtttgtgcgcttgctggggctggatggttgtggccttcctctgggcttcatacttctcaaccaagacagctgctgctgctgcaccacttgttcttcagtcctcgtcgtcgtatctgctgatgctgtctccgattcgtgcttcagctgcggctgcatcggcgtcgtcggcgacgggagaagcagaggcctgctgcagctgccgtggtgcgcgaagaagacgagcaggaggagcagcacaagcagcagcaacgacgacgacgagctgcagggcttcttgttgcttgacaatagcaatgtggccattgttgtgatctccttgtgttggaagctaatatggatggatttgcagaggaattgaagcacaggtagctatccgggatataaatacaagagataggtagccgcagagcgaagaaaagggggcgtttcaattaaagtcaatggagaggagacgatcgatggaattattaactcaagctaagacgtgtttcctcttccaaaagattagctctcaagacgtgtggaatggaaatatggaatcaattaagccagttttgcaagctggaaggaagaagcagaagaagatgtagataaagaagacttggtgtgaggggaggcgtgcggatcaagttgaagctagctagcaacgatcgatggagggacgacgcgttttgagtagcaagctccacctggcgagaccgtgtagccgtctacacattgatgccactagtatactgtacattctgcttcactcataggctgacaggccacgtaccgactttctatcagcacacctcatctatcagtaattccatttaatttgtagcgaaaatgtttagctatcgtgcaaaacgctaggccccatgcgatcgaggccatgtcttaccgataatgggagtatttggagttggtaagcgatagaccacaa

SEQ ID NO: 76526 - DNA, 4786 bp, Oryza sativa
catcctagcgacgaacctgcttagtgctaccatgcatccggttagcttttgtacttccttgagtcttgtgggcgacttcttgttctcgattgccttgatcttctcgggatttgcttctattcctctgccagagacgaggaaaccgagtagcttgcccgacggtactccgaacgtgcacttctctggattgagcatgaggcgatatcgtcggaggttgtcgaacgtttcccgcagatcgtcaatcaatgagtcgcttgtcttggtcttgacaacaatgtcgtcgacgtatgcctcgacattgttgccgagttggtcgctaagtgcgccctggaccgtgcgctagaaagtattccctgcggttatcagtctgaatggcatcttaacatagcaaaacaccccgaacggcgtgatgaatgctgtcttctctccgtcctctttcgccatgctgattcggtggtagccagagtaagcgtcgaggaagctcaacagctcacagccggctgttgagtccaccagttgatctattcgaggaagagggaagtgatctttgggacacgccttgttgaggtcggtgaaatcgacgcacattctccatttctcgttggccttccgcaccatgactggattggctagccactctggatgaagtacctctctgatgaagccagctttgagaagtttgtcgagctcttctcgtatggcttgtttttggtctggtgcaaatcttcgcagtttttgctttactggcttggcatcgggtcgcaccatgagtttgtgctcaatcacctccctggggaccctcggcatgtcggacggttgccaagcgaacacgtcagcattgtcgcggaggaaggtgatgagcacgaattcctatttctcgcttagtgttgccccgatcttgacggtcttgtcagggttggcactagagagtggaacggtcttgatcgcgccgtccggtgtcggggtcttgtttgtcttgctcactttcttgggtggctcatttgtggcgggtgggctgggcatttgctcgaccatgtcgaggctccacttgtcgcattgtaccgccagctttgtgttcccttgaatagtgattgttcccttcggtcccggcatcttgagcacttgatacgcgtagtgggatgtggccatgaacttcgcaagtgcagttctcccgatgatggcattatacgctgtatcgaattcagcgacatcaaaggtgatctgctccattcggaagttgtttgcttggccgaaagtcacaggcaacgtaattttgcccaatggtttggacgaggattggggagtaattccatggaaggattgatcggtgggtgtcaactcgcttcgcgaaattcccatcgcgtccaaagcactggcgaagagaaggttgattgagctaccaccgtcgatgagaacccacgcaaccttgatgttccgaatagtgggttcgaccacgatcggatagcgtcctgggatgacggcagtcttgggatggtcttcttctgaaaattctatcttctgttcagaccacttcatcttgtgtgcagccccctgccatgtcgaacagacttcacgttccactttcttgtattctcgctttgaggagtacgctgtggaacctccgaaaatgtgtgaaacgtggaggttagagtctggatatgctgtgtccgattcctgaggagccacctccgcatccttctcgaccacgcgtactcgcttgcctttttcaaatgccatgtgcttctcgagcgactttttgaaaacaaggcaatcttccaaagaatgtctgtctatcttgtgtatggggcaccatgctttcttcgtgtcgctaccttgtgggtctgggcgcttgggagggttcgcgtattctgctgcgagaacttccgcttgagctttcattttcccacttttgcgatttttcttcttgcttgactcaggtgcgtccgtggctggtttcttctctcccccggtcttcggcttatcgttcttgcgtctcagtgcatcatctgcgtgggcgcatcgctcaacaatctcgaacaatctccgagtagttgtgatgcgtcttgtcaccaactcctgggtagtatagcgatctctgacaccagacttgaaggcgcaaattacagaagcatcggtgatttcggggattgtatttctgcactcgttgaagcgccgaacatattccctcaaggattcacccgagttctgtgtcaacgcatgtaggtcgtcttcgatcgcgtggcgcttgtaagttccttggaagttggcaatgaactgctggcacaggtctgcacacgaagagatcgagtagggcgggagatgcatcagccatgaacgtgcagagccttttaacgcagttggtaaataattcgccaatgcattgtcgtctgctctggcggcgtagagtactgtggagtagacttgaaggaactcttctgggtcggtgctcccatcgtacttctctattgctccgggtcggaatctctcaggccattggacatcacgcagggaacgactgaaagctctacacccagcgctgggggcggtgggttgtcggcgatcgtgtgtccttcatggatgtctgtctgatgatgaggatgaagaagaagacgacgatgacgatggatcgcttggttccggtgtaggattacgaggacgtcggctaggttctcgagaatcctttcgccgccctcggttgttgtcccggcgtcgatctccgtcgtcctcgtcattatggcggtgtccttgaccagtgtcaccctgcgtccgcctctcgcaatcatcgtgatcgtggcgatcgtggcgattaacacggtctcggtcttcgctcgagcggccctcccgtctttcattatcgcgatgtcgtgaagagacgcgatgccgggagcgatccccgttgtctcgtgtgcgtcgtgcctctcagcggccattgaggtggtcacggagatcgccggtgccgcgaggtggaggggtagctcgatggggtgactcccactattcgggattttcgccattggcaccgccagttggtggctattccgggtgtgctgcatcagcggcttcttcgaacgcgttgctgaggttggttactgattcccgtagctgttctgtccactgtgcgagatcatcgtttagaacgggatcgtaaggggtctccctcagtattgcgttgatggtcctgatgtgctaggccggtgtagccacttgattttgtgcttccgcattagcgtgtgctgacgtgctggtcccgtcgatagctaatacctcgcgcggcgtactcgctttgatgagccatagtcctcgagtagatgcaggactgatggttcgggtgaactgatgtcgattatgccaacgaatcgatctgaaaccagcgtcgttccttgttccttgtcttcatctctaagggatatgcctaactgctggaccttaggggatgacgtcatcgtggcgctgagaaagaccttgcagcttgagaggtcgtgattctttgtcttgtgaataggacaatagacatcacaggttggagaaatacgctgaattccacgctctttgcaggcgcgaatttcggcgcggacgttgagaaaaacccaacaggcgtgcaaagtgtgtttcctggttttgtggataggacaccaggaccttgtcgcttcggaagttattctcgtcggctcgtggctcttgtctgaacgacaaggtttggccgcattagaatccttctcgagctcggatgtcgtcaatgttctgttctccgcttcggcgggaggatccttcgacagggagtcgtcctgggttgtatccactgcgttctcatttccggtcattgatggaccagctgagatcggcatcgtggtataaaccgggaagacgatttcgccgacttgagtccacaccagcattgttgaagtaggaaatccctggtggaggttggtgttgacgccgttgtcaacgaaactggatgacatagtagtagaaccttgagcaccaagtccccctacctggcgcgccactgtcgacgagtgatacccgtagaccggatatagagggtattggggtacgttggtacaaggatctatgtaatacgacatcaagcaaacagagaacgaggattatactggttcaggccccttgataggtaatagccctaatccagttgatatgagattatatgatggaaaacacaggttacaaagggtacgatggaactcgatgaaaccgacgggatcgtaatcgagttggttcgactagatctcccggcgatttggctcctgcaggctccgacttcgtaggctgtgggggttgtgttggctccgagattcgatgccttaggtcctccagggggtcccttttatatcgcaggtcaggtggtttccaagtagaactcggagacatcgaaacctacacgatacattgacgacccagtcttgtccgagtaggattcttttcatctgtaaactccgtgaaggatttccttagttatgcggagaatgtccatatacgcgcagacatgccatatcgatatgtgacgtatatcgaaaggtaaagggtatacctaacccgtaaccctgacaacatacatgaaatattaaatatatgctaaaataataactaattgcacagattgcgactatttgcgagatgaatctttttatcctaattactacattatttgacaatgtggtgctacagtaaacatttgctaataacggatttattaggcttaataaattcgtctcacaccctatataatactcaatgtgacacgccaaaactttacacccctggatct

SEQ ID NO: 76527 - DNA, 2839 bp, Oryza sativa
ttgtcatcagaatcactgtcagatgcagatgcagattcggagtcagattcagacgatgctgatgatgaggtttcccttctgtgcctcctcttctgctgcttccttttgggtcgccgcttcttgtcctccgagtctgaggagctgtagcttgagctacttccagaagaatattcagagccggtaactgatgattcactgtcagagtcaaatacagaagcctcactactatctgaatcactccgtgaacggtattttctcttgcttttccgtttgcttttctcagacttctccttcttcaactttgctttcatcagcttcctttcctcttccttttccttctcaagatcaggattctggaactgataggaaacaggagcagccgtcttcttcagcttggggttcttgagctgctgtgtcctcgagggccgcgaaatgtagacccgttcgttcttgcactcgtatgtccagtgcccaggctgaaaacacttctggcactgggtatatgcgccaccagaagaagaagaagtttgcgcagcttttggtttcactcccagtatcacagccttctctgtactcatcagatacatctgtctcttggcctccttcctctcctgccagcgcgaaggtccctcttctttctgcccataagcattgacattgcgggcagcggctgcagcagctcgctcggcttgagttctgctcaatcccttggcagcagataaggcctgtgcttttattctctcagctgcagcctgagacttatcgtcatttccagacatcttgggctcacccaacaagaatcaaatcatacaaaatcagcaatattatgatcctgtaaggaaaccaaaatacatcaatagagtaatttgggtaatgaaaaataacgcaaacaataaataagctttctgctataccaaaatcaacacattgatgcaggaaaaaaaatctggcacataatatttttcgttgctataagaagaacatctacttatgaatttgtcatacgctcggtgtgtgcgtcggtggtcaatcattgctacgcccaaaaataaaaaaatggacaaacccttagagctaagagattctacagtaaaccgtggtaagaaagaaattgcgagctacaacccaaaagcaagcaaataaatccaacgaatacacctccccaggccgggcggatcttaacgtgggggcatggggattcactcgaacccccccccccccccaaaactttattccgtaacaaactgctgctattagtgctagggttagggcaaattaagagaaaagcttccagatctaggagaagagaagctagggtttaggcgaagacagatggtgcgggggtaggaaggtgcgtgtgggttggtgctcaccggcggcgaggatgcttgcggcggaaggaggcagcaggtccgcctcggctgctcgccgagttcgatggagatcggcgcaggcgaggcggcgggcgaactcacgaggaaaagagagagagagagagagagagaggagcgggtcagaatcgggagaggtgaacgggtcgggatgtgggggcgagcgatgatacgtgggccgttaatgggccgatcactatgtcggtcagtgatgggctgatctttatgtgggccggtgatgggcccatgaagtaaataatgatttgtactgatcctaacagggtaaatttacggtgatattagacaaccatgcaaagttttattgtgagatataaaacgaagaaaattagaaaaaagaaaaaacagaaacaatgtttttattttaagattctttaattttattatgcataaacggagttgaggttgtttatttacatcctacctacatgctctgtgtgattctttcagaacttctatataaaaaaatttccacaagttcctgatttttgaacatgcgtgcaaattagagtataataaaattattatttcttgatatcatatgatatagaagtaccccgcaaaaaaaaatgatatagaagtatatttatttgagatccattgccataaatggtcccaatacggaacccatttctgtttctcagaagcatgagcccctgacacaacctagcagaaaacacatacaaccatctcagttttgtcaagattttggaggtctattacctgcagcgagactgaattctacccgggaaactactttttttttattttatgaaacacgcgaaactactataaccataaaactgacagcttttcaaaggccatgttacagtttctccacactgaaaaaaacagtaaagttacaccaacttcaaattgcaacctgaactatgaatattgctgccaaatggagtaatatatacagcaaaggaaagtaggagcatgaatggaaaaggaaaaaaaatgtggcaaaggttccaaaaaaaaaaacatcctgactacacaacacacaacccattatgatcatgactgaatgtatctgatatctgtgaattctaactgtcgaatgcacaataacaccttgcacagccaaagtaattcccaaggtaatgaaatccagactgaaactcttatttgatggtatatatcatctctaaagccgctaaacctgtaaagccaaatagcttggcaactcctcaaagtgcttccctagcacccattggtcagcgagtcctgcggctgttggctggtttagatggagaagacggtttgttcttagcgaaatcgacaagatccttgaaaagagaatcttcaggtttggtctgccgtgatgcggtcggaactgatgaacctctctcattctcggtattcctctgattaagcgaaaggccttctgtttggctcaccagtccattgtacccggcaccgtt

SEQ ID NO: 76528 - DNA, 3513 bp, Oryza sativa
ccccactaagatagtcaacactgcttgcctccgtgaaaactggcctctttgatgatggtggcggaggaagaagtgggcttgggtaaggcctttcactttttggagcaaaaggtagattgccctgtgctgctgtgccatcccttgcagacctacagaacatatatttgtacatcagatgacaaaactaaacagaccgtgaatcttggtatcataacatgatccgcatcaccaaaacattttcttaagagcagtcagctgatgttgccacaaccatccaaagcttagaatagcaatagcatgtatgagaaataattagtaaagggtactaatagggaaaactaatatagcttgcctgcgggaaagaacagagaactcgtcttctggctcatcgtcttcatggtgcacattaagaagtggggaaaatgaaaccccagtaggcctaggaggggctgttcctcggtttacattagcagcagcaggagctgggcctgaaccgggaggcactccctttgcgatgtcatcatgacgctgaagaacacgctgcagttcatcatttaaaccgagagcttgaaatagaaggctctcatcactgcagaggatacaagacaatatgtcacatgacaatgtgaaaaggacatggaaccaaaatttcagagtaaaagaatagaacatacccagtattgctaacaaggtccatgactcgaccttgataagatcggcactgcccaacaaggtcaacaatgacctcctccctcacaccctacaacatgaagcgcaattagacagaaatttagagaaaaagagcataggtgggtggaatggtggattcaatagttaaatacagagacgcatagagacatcacactagtgcaagtttggtcataataaattaaaatattagggcacattatttttagccagataccagagcaagttctagaaaatacaaaagcttagaaatccctctttaattattcttatgccctcagtctcctatgctgctaaacatgattccctctgaacaaatggaccaagtaaaatagttcgcacattcctgtaagctgatgaggtaacatggatgaacaaagatataaatggatattggataatatactagacttcaaagcctagcaagaaactactttgtcatccattacacatagatctgatcaatgatgggacatgtaatagttacatcctcttctgtgcacaattcacagatacagctcagctcactacatgtgaaatatgctgtagtatgatcatatgaaataaaacacatgatttatgcataatttttttcatgggaaaaacaaaggtctagaagacatgacaatcatattaaagctcttaaaagtaaaagaaactacagaagagatacaaggattatacaacactgcactaaattttgatgcttaaaaaagtcacctcagggtgcctgtggtccaaagcatttaacatctcatccaacacatccacaattcctcgagcactctgaatctcacttagactgtaatgcacaaggagcaagaattaaaggtggattataactaaagaatttcttctgcaaagatggtgaaataaattgataaacacaattgaagtattcaggtattgtttagcatgattatgaaactaaactgtcacaaggcaataagtagaatctattttggcacactgacaccgccatattttgttgttagaaataccactataagtatgaaattcttggaaagttgcatggccctagttctatgaatgtcttgcctgtaaggctgtaacagggagacaaacaaaattactattaatgtaatgcatcataattactttctagtatgctttagagttcaggaatgaggacaaccaaggatagcggcaactgcaaccatcagtagcggaggttccaactttagatcagagatggcgtacttcaagaaagcaattaatcactgaccacttttttcccccaaaatacttgacactccatagttgctaacaggtatttttccaatatcacacctggtgggcccaaccggaggttcagcttttttttttttttttttgcccctcaaaactactaatgtgttctcagtgactaggaaaaaacaagaaagatctggagcctgatagcctatatgcaccgtgaaccttctttccgtactctccagttgtgctgagcggcaagtcctcagggttggagccttggaggcacacaaatcgtccagaagcaacttggacactgctttctgctgtctgatgcacaatttcagcagaatagagatactttaatccaggagcattttcgaaatttaactaggaaacattttatagccttgggaagtttgcttggctaatgggtgtcatctatagaggaacagagggagcagaacatattgtgagtacgattccactcctaaaacatgcctagccatttaatgtggttgtaggctgatcagtatttctgataggaacatgtgtttgaaacttttcccccccaagtgtgaatttacaaaccaggccatgcttgttccaaccaaagtaggttattctaaagagaatgggaaaaatagaacaaagcaaggcataaagaaacagcaaaagtaaatggcattaagaaactatggatgaatatgacagtactgcttgaagtgaacaagtaaataaggaacaaattttgcattagaacaaaagaacacctcaaggcaggtgcagaaggggcgctagattgaagagaagcttgtatcgctgcatcttcatagctttgacctggaggtggatatagatgtggttgcctcaatggttgagtttgaggaggtgtaaacagtggaaccgtgttctcctcacgaggtggaaaatcaacaccagcattctgcacacaagggcaggatatcttgttcatggtttggacagaaacagaagcaattgaatattaactcaaaagtaaaaacgttgaagatctaagtttacattgaaacaaagtgcagaacagattgaagttgagtggaacagtagtcaagtatgagctgtgatagcacaggataaataacagatgagaaaactggaatgaacacaagtagacagtaccctgagttcttggtaagcagcgtgatactggggatatctgccagatgcacctccaaaagccacttgccatgtgtcaatcaaactcaatattttctcccgaacatttaaatctggctgaaatcataaattggcaatcaaatacagaagcataagaatgtaggaactataggaataagtcttggctggttggtcttggtcttgtggtgccttttcctgcttttcagctttctaggacagcatctctactttcagtttggatgctctaggacagttaggacagcagtttgttgagatgctctaggacaatatgttgagatgctctaggacagtttgttgggatgctctaggacagtatgttgagatgctctaggacagtttgttgggatgctctaggacagcaccctcttagactagcatggctgcatggct

SEQ ID NO: 76529 - DNA, 1026 bp, Oryza sativa
  unsure (1)..(1026): unsure at all n locations
cacgtcaccactgccgcaaagccaaagagctcgatccagcgccgggtcagcaatcacgcgcgacacgaggccaatattagaattattttactacacagcttttatcgtatccgagagcagtaaaaacgccgcctaatttacccggatccggattttgnaagcgtgtgcgttgcgtggcgctggtgggggcgcggagcaaatcagggctccgggacatgtcatagagctgacgtggcgccctcccattggccgagggctgtacaggtacgtgtacgtagtcggggcgcgcggtgacgtggcgttggccgtcgttaattcccctgccttttttgaagtcacaggattggatttatccctcgggaccaccccactttcgcccccctaattccacttaattacacatcactcctcatcaggggcatattagtaatttattacctctagttttagcacatctcagcctcgtggagggatgatttgacgatgataagtacagggggttcatcgcaaatgttacctgtaaatatctcgtgactccggtgcgccgcgtccacgagggagtccgcggggtggggcccggtgggcagtttcagggtcgatgtggacttggtccacgtgatccggtaaacccccccctcgcgtactccgccctattaaaacccgtgtgagaagcgtgtcgtctcagggaaaaattccgaaagccacccacactctccgtctcctcctcatggcgatctcgaaggcttggatctcgctgctgctcgcgctcgccgtggtgctgtcggcgccggcggcgagggcggaggaggcggcggctgcggaggaggggggcgatgcggcggcggaggccgtgctgacgcttgacgcggacggcttcgatgaggccgtcgccaagcacccgttcatggtcgtcgagttctacgccccgtggtgagtgtgctctgctctgctctgctacggcccccctgttgatgagctgtgcgtgttgggttagatctcgcgaggtgggtttttgggggggggggg

SEQ ID NO: 76530 - DNA, 8512 bp, Oryza sativa
agggccacgagcctcaggttgccgcggcggcggcgacgtggatggggtactcgccgtcgccgtccgggcggaagggtaaggaggggtcggcctcgaggagaagctgggtgggtgtccggcggccgtggctcgacggcgagcggagacagcggcggaggagtgaactactgtcggtctctgggttgttctccggtgaggctgctgcgaagtggagcgctgtgctgctggacgcgtcggcttcgccggcgagccccttgttccattccagtatcttttctgtcatttcttgaatttatattatgagtaaatttcactgaactaataattatatgatgagaaaacattatattcatatatacttcctccgtccaaaataagtacaaccataagttctcatgtccaactttgatcgttcatcttatttaaaatttatttatgattagtatttttgttattattagatcataaaacataaatagtaatttatgcgtgacttatttttttagttcttttaaaaaaatttaaataagacagacgattaaagttggatacgaaaactcataactacgtttattttaagaagcaattttacggtttttgagaaggtaccaagagataccattttttctattataaatttggtattttttggtacttagctattataaggtactatgaggtacagattttagactaaattttttttacctaatgctacctcttcaagagcagtagaattgtgacggaggagtatctttgattgatcggttatatctttgatttgttgaacttaattacctgcgctgcgtaggacagcagcgtgtagggcagtttggccggccggtcagaatacgagacctcgtcgccgccttgctggtgcagggcctccgcgatgcggtcatgccgcaaggacaccgcaaggtacaacggcgacatcccgccgcccggcgccggaacacgggcgagccgcgggtgcaccgacatcaggtggcggacgagctgctcgtcgcccagcctgacggcgtcgtggagtgctgtctcctgacgagcgttcctcttctccagcacctcggctacccttgagccgcccgtgccgccggcgagctcctcctcctcctgcctggccatgtcgaggaggcaccctaccatcgccgcgttgcccgccctggcggcgcggtgcagcggcgtgtcgccgccgccgccgctcgcgctggggcggtccaggaggcgcgcggcgtgacggtagatcgcgcgcgcgcagcgcaggaacccttcgccgtcgccggaggccgccaccacgtgcagcgcggagtccccctgcggcgtcgtcgccgccgcgtccaggaggtggggcaccggcgccgcctcaggcgcttgttgcccgggggccgcggcggcgccatgatgatgcacgacgacgacgtcgatggcgacttggtttggcgcggcggcggcggcggcgcccagaagtagagcctcgagccccgcgaagtcgccgcggcgtgcggctctgagcagcctgggatccatcgatcgacgtcacgcgctgaagtatgtaccactccggaaattgaagacaggtttacttaggagtagctgactatactctggatcagatcgtcgatgagaaaagatttgcaggtcaatcccaatggtcgagagcatccatcttacccagatacgaaaaaactgtgtttaaccgtaattaattataggttttcacctcagtttacttcttttttctattctatggcacgtaccacacacttagaccccacgaatacgtgtcctagcacatactttaagagaccgaaaccagctgtatatcatgtatcgatcacactaaattgccattaaaaacccacccatagtgtgtaatattatggatattaagatttgaaattatgcacccatgatttcactactatattacttgtgtttctttataagtgtatttatttttatgggtaagaagatgacgatggtggcgggcaacttcataatgggtaagatgaagaagaggactacaggacattgcattcagccggtactgtctaaacccgttggtacatgcaattatcttgagttacatatgtatattgtcagatatattttcttatggggaatgtcaaaccgagacactacgcattaattagccgagcctctccgcccccgtctacgacgcactcaatgttaggaatttttttccgagtaaaatgttcagaggtatccatgcatggagtgtttaaactactccgtttagagatttttttaaaaaaaaactttttgaattttttattttaaaataaacccttcccaaacttatttttagaatctaaactttttatcacgccagccggactgacatggcaaaacaacactgacacgccactctggctagcgtggcagcgttatttggtcacgccggtctagctggcgtagcaggataaagatgtcacatttgcaatgtgtggtgtgtcaatattgttttgtcacgtcagacgggttggtatgcaaaaggttcatattctgaaaataagttttggttgggatttttttaaaaagataaaaaaaacacaagtacaaaaaataaaagaaaattccaatttaggacatgcctacaatttagaccccactttaataccctttatgaaccaagtgagagggtcctttgcagtattgcttactgacatgtggccctcacatatcctcaggcccacatgtcaacgagcagtaatgtgtagtactagaagatttgaattgttatgaacccttgcagacgctattcctgtccgttttgtagtttgtcactagctgaatgcctgaattgatctattttgttgacttcttttaaaaaaaatcacaactatttagatgatatgtaaataacaagggaatgttcctcaagactttataatcagttgggccaaagggcagcgaaaaggaagtgagcagtaaccttccaccatttatcaggaatttcagaattgcaaattcgaggggtattgatttaaatcttgatgactctgatttttcagctgaggttttgaacggatgggacagtaggttgatatctttaatggcacgaagatccataagccaaacgtttggaaattcaaatcttactacttaaaaaaaattgataacttttcattagtcttacataattttcgtctatttcgaggaaagggtagaggagattgaggggaacccatttttccatccaatttggaaaaagagagcaaagggtaggtgtagggatgaaaacggatcggaaacggacggaaactagttttatcatatttgttttcatattttttttcagaatcggaatcggaatcgaaaactcgaatacggaaatgaaatcgaatattatcgaatacagatacggagcgaatacgagacagaacgaatacggtggcgaatatttactggtatataaaaagcccctcaaattgagtttctgatcaaggaagagatatcattcaacatctccaacatttatatcatcaattttgtagacggtctcacaaccgtatgcgaaaatcgattttcatggttgttcctctaagagatccatatgcaaatatgattatcattttcaattctcaagaacttttacttgatgtataacttacttgccattgtataaattggagatgttatttattttactttacatcttcgaaacttgcaatatttgttttatgctttaaatgctttcaaatacaaatgttataaactacaaagtggtagatcccgttgagctctacaactttgatatagaacacatctccatcagatgttgtttgaattgtagatctgagattttgtaaaaattaatatgatatattataatgaatatttagacccttaaatgatctcaaataataaaatagtcaataagaaagttgtagatctcatcgagatctacaatgttgatataaagtttgtcttcatctgattccgtatgaaaaagttatgtatatatacgtgttttttctaaaattttatcaatgtctgaggatatccgaaaaaaattccggatagtttctgaccgttttccgattccgacggatagtacccttactgtattcgttttcgtttccgagaaaataatccaaattcgtttccgaatccgaaaatttctggatagttccgaccgaaattattcgaatccaaaaaatggtccagacggacggaatctatccgaacagtttcatccctcggtaggtgggattggaaggagaggcagcgcgggcttcgcatgggcacgggggttcggtctggaggtgtaggaagaagactgtggcacatgggccctgggcgacagagagaggagagaccgaggaacgctatctagactttttttttcaccaaacgctatctagacttgctctgctgctgctgggccgaaggggaaaggaagaaagcaaacaggccgataaaaggaggagacagattagacttcaccggagaggaggtaaagcctgctagagagagagagagacggaaagcagactttactcgaattggtccaagacgagacgattttaactactttttcatttaaattaatcactgaaatgaactttgaattttcaaaaacactttcaatgttctaataatttcaagaaaaatcatgaaaatagttggatactcaacgtatttaaaaaaatatttatctagatcatttaatgattaataattgcttaaataattattgaaaatgttctttgtattgttaaaattaataattgaaaaatttcaaagagtataattaatcatggagaatttattaatgattaaacacaaccatgttttaattaggaaattatatttctcatattaaacttcacttgtaaattaatgaaacttaatataaattttgaaataatttattaaataatttacaaaatcccttaaactcaaatcaggatgtgacaaacacaaatctttaaaaagagcaccacaataagcggaatatgagttgcatccaagacataacacatgtgaaatcatgaaaaaacatatatcatcttcagtgtcaccaatcagttgcgctctgcttactctaccttcgaaatggaagacggctcacgtttctctgctccagacgaccgaatctgccagcgagattttcctttttttcttcccgttacaacgtacggacactttttctagttaaaattaaagggttgtacagaaagaattactcatcgaaggacctcgcttcctgcatgagacacttgtcctcacgaatcccatagcaacgacttctctcgtgtctctttatcaaatctcccatcttcctactgttatgggctcatggcgacggcaagggcatgaacacccgcgttcaggtctgaattcgtagcatctccggccataaggcgagggtgcggaggcgtgcctagaagctgcttcgagctccttccatattttgattagctattggtagatacttcctttttcctaaaatttaagggattctatatttttttctaagttaaactaaggatccaattctttaattttgttgagaagagtatgaacatctaacataatcaaggaagtaaatcatgaaaatatatatttcaaatggatgtaatgatgctcatttgatactgtaaatattattattattattttccttttattagaaacacggtataaaagtagatgctaacaatacacgtacgctcgtatctatgaacacgcacacgcgcatcctacttctataagcacctccaaaaaactggactgacatatattttgaggttgacaaaatcaccatgggcacctcgttggtgatgagtacgtcgcctaccactaaaaaaataattagtcgtaaatatgagcatccgtgttaactctagaacttaaattcggacgaactggttccgctataagaaacttggctagttgcttagttgtctgaccaaacttgagacaacaacttaggacataaatagaattagaatttttatactttactactccctccgttccattataagtgcagccataagttttcgtgcccaacatttgactatccgtcttatttgataattttatgaaaaaaatttaaaagttaagtcatgcataaagtcctatttatattttatcatctaataacaataaaaatactaattataaaaatatttcaaataagatgaatggtcaaagttggaattaaaacttacaactgtgcttattatgggacggagggagtagaaccaagtgtgtattcactataacaaccacatcccgtgaatcccgtggcaaggtcaacatcgctacatggccgcatagtttgttttcttgccgcacggtttggatgcacggctgcataagaaaggtcagagctgagcaaattaagcttaggacgccagtgacttgtgattaccggtaagcgtgctctgaccgtttccatttcttttcctttcactttgtttttcttttcttatcttacggagcttatttaatggttgtggcgtgaaagaaagtttttactgttagtaattaatgagaattatagaagcagtccaaagaggagacttttatttttgtctcaccccagagcatattaagtcatgccgatctgaactatcatatttttttagacttttattattaactaactgtgacttgctttttaaaccctgaatacttctacctagctaccacattttcagccgaggtatatacgatgatgtgtcctatacatcttaaattattaacaaaactgacatgactgaccaactctattgtgataaaattgaccaactctattgtgataaaattcagatttccaaatgtattagtcatttgattatagagcagattattaccacaaattgtgtatttgatcatagggataaattaaacattatgagaaacaaacttaataaatagttaaaaataagttatctaagcagttaatactgcagaagaatgcttttagagagcaaataatctgtttttaataatccgacgaataatctgaaaaaaaaatagggatgcctttagagatgtgattatggtgaatgtgcttttggaaagaatgatgaactaactgtcctcaaataatcatgtcagctggattaattggagtacttttagtgtactccattgtacaatcaaaatataaatcatcacacatgacatcccacctcagttttgtccagtaccgaaacctaaaatgcgttgcaacaaattaaagtataaagtacatgcaatgccaatgcatatgtcgtataggagtgcatgaaacagatccaattgtgaatgcaactgctgcactttctttcttccctctgatctatagatcaaatttcgttcacatacacatatagatcaaatttaattttgcaagtgaaagtacacatggcataataaagtatgttgagaaacgctcaggggtcttccggctagctccacaagacgtgttgggctagacgatttgggttcgaagtctcaccccttgtaattatttgatattagatcattccctaatattcgtatcataataatgtactacctctgtttcaggttataagactttctagtattgcccacattcatatatatgttaatgaatctagacatatgtacaatcctagaaagttttataatatgaaacggagaaagtacgttgtctaaatcttattttaagtttttgttaattacttgaaccacgtaagaaaacaaggacacatgccctcaagagcttaaaacacttcccctaagagagtaaaaattataccatttcttccctgcaaggcaccaaagggccggccccatgcatccatccatccttacaagtcaatctataagttattagtagttgccagtttgccactacatccaaatcaaagacctggcatagctaaaagccccaaaggatggttggttggttggttggttggtgagttgtctccaatctccaaactccaagaacaagaatgccaaatcaaaagagcacaagtgctaattaagcaaggtaaggtaaagctaggtgtatgcatggaatagtatgcatacctagttatcctcttgcttcactcctccccttctttcctttgaaaaaattaatcttgcctactcctccaagaaacccaactttgcttccatgcaaatgaacaaattgcactagatcattattatattgttgtatttgcacaacataaaagtgatgcccaattcaccatttcttgtttgatccttggttcttgagatttgatttaattcttgtgttgcatgcgtgacgacgatgagatgcctaaggcctggtggtgctcgccggcgatgccagctgctccaccgcgccccgccgccttttgcgcctcgctggtggacggcctcgcgcagctggagagcacgctgttcgtgaggaggacgacggcgatggcggcggcggcggcggtggggcggtgtcgatgaggtggtgcgccgacgccacactttcctgtaggctaaacatctcttgttccaccccttcccaagctcg

SEQ ID NO: 76531 - DNA, 3262 bp, Oryza sativa
ccgccttgcgcccgtgagccaccgccgcgcctcccttgccgccgtcgcccagcgccacccctgagcagcccgccgccgccgcccctcaccatctcccccgtccctttgcctgcctctccctgtttggaaaagaagagctctttgagagcatagaagaacagataaaacgaaagtttggaacagaagagctcttttcagtatagaaaatataattgacacttgacactttatttatacaccacattttaaatatatcagttaaaaagatttccgttaaaatctaattgaaatattatcacgataaataagtagttcaaaaaatatatctcttaaaatacaaatgtaaggttagttggaagatattcttaaaatacaaatgtaaggttagttggaagatattactaaaatatagaatgatgggatatggatgagaaatattttttggatgatactttatacgggcatttggagaatcaaatatagatcatctactggggatgctataagtaacaagaccggtattcacgtggtagcaagcctagctaatatccatctcgtatcataccgttcggaatggagaattccgtttaatagcagtcaacattcatttgtccctgctcatagagcttgagctaggagtacaccctcctcaccctagtgcgtaggtcagtgtacctagagccggcgccttaggtcttgttgagttcgcggaaagaaatattttgtgtgtcacatcgaacgtttgaccggatatcggaaggggttttcgggcacaaatgaaaaaactaatttcataactcgtctggaaaccgcgagacgaatttattaagcataattaatctatcgttagcacatgtgggttactgtagcacttatggctaatcatggactaattagagcaagtttaatagtatagccaactgctagctccaatttatctatagccaatctaatatctcattcatataatagctacatactacactattaatacctggtcctacctggcatacatacactgcgttttggagttcgtgctacagctggctccaaatctgtagcccactcctcttctctctcgttatttatcttcttaaaatatatttgcagctggcttatagcctgctattgtacctgctcttaggctcaaaagattcgtctcacgattttcatgcaaaccatgcaattagtttttcattttatctatatttaatgttccatgcatgggtctaaaaatttgatgtgacgtttctgggaaaaaaatttagagaactaaacaagcccttattgtcgtcacgagtttgccgctatattgggatggggcgacctgattcaagttttggttgggtgtctttcttatatatgtagagtttctattttagataagctactaaagtattttttagaccgtgtaatatacggattagcgactagctagtaatattgctcaatagtcagtcctaagtcaaacctctaggatctagctccaaaagagttgggtagtcggccaatcaacacatgcatatcgatttaactaaatcagaagctctgactttataaagaaaataaaatggcgcaaggtcacgtttgaagtcaacacttaccatgccttatctgatgcatgacgtgcacatgcgttgagtataaatatatccatactgataactagaaacaatgttgcatttgccatatcccatatgcctataaatagaaatagagagatacagtaactctcggccaatcaattcatcagagctagttaattaagggcatgttcaatttgataccattttcaatcttatcaaattttggtaaagttataaaaaaaagctaaatttagtttgctgccaaattttggtaactatataagaaatcctgccaaaattttagcaactcgccgaaattttggcatagttgccaaaatttcaacaatgccaaaatttattaatgttttttttatatcaaagtgaacaggccctaactcaaactcacagttgcctcctcctctcctatggcctctggcgccgtcgccgtttgcatcgtacgtggtgctggtcctgctgcagtcctccgccgtggagcgggcggaggcgcaggcccccgggccgcaggcggcgccgatggcctgcagccagtgcgaccagatgtgcaactcctcttgcgagggcgccggcagcgagccgtgcagctacgcctgcggctcgtgccagggctgcatgcaggcctacttctacaggtgcctgccccgctgcggcgactactgccgttccaactgcgtttaattagcagctggatgccacaactggagagacgggcgcgcgcttgcttttgttgcatttgagtgttattatgttatttaattatcgctatcttggtcctcggtagttatatttatactccctccttccttaaatatttgacgtcgttgacttttttaaacatgtttgaccattcgtcttatttaaaaacttttgtgaaatgtgtaaaactatatgtatatataaaaatatatttaacaataaatcaaatgatagaaaaagaattaataattacttaaattttttgaataagacaagcagtcaaatattttaaaaaaaagtcaacggcgtcaaatattttgtgatggagggagtatttttagaagttgtgtttgatcgatttgtgactctttattaggagtatatttgtagaagccattgatcctttgggtctatgcatagcagccttgcacgtaggtagctttgttgacactgtttctatttggttagaaacaaaatcaatgaactcagaagcaaatatttttttaattatcttcttataactgagaaacaacaaagctaaaacgctactttctccgtttcatattataagactttttagcattgtccatatttatatagatgttaatgaatctagacacatatatgaagtaaaaaatactagaaagtcttataatataaaacggagggagtaaaagactagtttcgatcttctgctgcctaacgagccataccacacaaaaaatggaataagccaatctcgataggcagtccgaactcctacaaccctcattcatgtttcatccatctttgattggttcgtttgccaccttgtcttaaccattggctggatccaatggatccaaattcagcaactcatgaccccccccccccctgtgcctttgctcgccgaagtcatccaggcaagggatgcagaggagacaccccacgccacaatttagccttgcacgaacagatccgaa

SEQ ID NO: 76532 - DNA, 1023 bp, Oryza sativa
cgagtcaacattaacttgtactccatgtgcgatgcaaagctttgctctcttccaaatacgctggactgtacggatgctgacattgaacacttgagcaactgcacgtgtggtgtctttttctagttttccatccttactttttgcaagcaacaattcataaattctttgcctttgtgtgtttgtcaattctctagaactgttttcctcatttccatttgcatctggatttggatttgcatttgcatcttcttcttcttctgagtctgacaactcctctctatcaaagacaacattgacagtatctgtatacacgccatagtcccgaagatcatcctccaaggcttccagctcatgttgcaattcattgtcattgtctacaaaaaaatttacatggtaagttaatgtgtgttaatcagattgtgtagatttattcagtcctaaaatcaagaatgtaaacatgtttgtaactgatcaaagagtaatgaacttttacccagttgaatttcttgttcctcatttccatttgcatgcatatccaggtcatgctccatgtcttgctgataattgtctaaaaaaaactacttgctggtcagtgccgcacaaagaatattgaatatgtttaggatttgcaatgtcatgactcataactgtagtttacaatagtactaactcttccatatttccatatcaagatccatgacttattcatacatctgttcgtaaggtagcattgatttgttgtcatgctaattcagttatgtatttaattctacctctagctctatttaagttctaagtgttgacaagtaatttttttcaggtacttaattcagttcttgcttattttcagtagcaggtcaacaggaatattgtgtctgggactgggagctggagttaaggatgtttcacaattcaaatttcacaagtatgtgaccatctaagcatgattcaatatttcgcatcataaacacgtgatttgttgatgaatattaaatacttaaatttggcaagacgtgtgggttc

SEQ ID NO: 76533 - DNA, 3007 bp, Oryza sativa
ccagacggcgacaatgaagcagacgaggaacaataatgccttcccgtccgtgcctgcatgatgccaatggtgcatgcgttgccagctatgagctattcgtacgtgcactcgatcgatcagtatcttgatgatcttgatcaacaatataatataataattaatcaaaagctgctgatgctagccgcagtacgtctctttaattaagctgcctggctgcttaatcgattgtgtaacatgccagtattttttgccaatcgacttgggcttatatatctcaatcgactctggatcggagtaattcccccgtcacaatacataagaatatataatatgatgaaacacattttaatactataaatctagatagactctacaaccaaatctataatcgaattcgtagtacttagatatattctatttaattaatactagttacatagtcgtgttacacgtgacttttgattctgtttaagtactttgctatatgcaacctcgttattccgtttatgcttatgcttgtatttcttaaattcttttcatgactctgtagtgtgagaccatgaacaaattactccctcgttttagaacatagcaatttttaagcatgaatctagattgggattgagggactcaagagaaacacgtaggggtcttttggctagctccacaatgtggtgggctagacgatctcggttcaaaacctcaccccttctaattacttgatattagatcattccctaatatttgtgtcttttttttctactaaaaaaatagttgcccttctatctcaatattaatcttctacgtaagtacaagatactagataatcagccaattaatcaatacagaattactacatacagtgacatattgcagaatactacaatatacaacatgttcagtgacatattgcagaatactacagtatacaacatgttatgttcgacattcttttttcagtacaactgcatggccaaaattaaagcgaactctagtacagcacaatccatctgctatctgaatttgggatcagtttcatcagaaatagtgtcttgttgttcgtgacagaggaacactctgcacgccaccatggtctcacccaccttcatccccggcgtcacggtgaacgcaactccatctcctccgccacgaccagcatcggcggcggcggcggccacgacgctgtccatgtactccgccgcgtacctgctccctctcctcgcgtacaacatcctcacacttccacggccacaacatcgccggtgcgccgtcaccgccacctgcagcgcccacgccgacctcgccatcgtcgcgaacgccctgtagaaccacgtcctcaggtgcccgcctcgcgacacgaacgccctcacgtccagattgtttctgaacatcgctgcctccatctctgacggcacggccgctaaatactttgttcgacagaatctcgcgaagctggagtttggatgcgccatcaacgcgtcaagagggtcacagcacctcatgatccgatcgaagcgagcaagatcgagttcgtcatcatcttcagcaccatcatgtactgcaagcattgttcgtgacaggtaagcttccagcgagtacctcttgtatggtgaatgttcgtctgcattgttggtgcaatgatgatcagatgaggaaatcaagctaaagatcagctctgcgaaatcatgcaccgatgtcgatgcaaccttgaacagctccaagactgcactgggtgtcgtcaactttttcaggacaacggagtaatccttatgatggttaactgatggtttgctgctactgatctgtttattcagtctcgaattggcactcttcagaccatccagctctcttctcaacagcataatgtctgaatccttcttcctcgtctcagcttccagttcctgcaccagcgaccatcgatcgttgatcagtgacccgacgctgccattccaactgcataagctctgaagagcagtgaccgagtcgagctcggaggtgatgatctcgtcggcgaaggctatctttggaggattataagggatatgggctttctgcagcttgatgtaggctgacttgagagctccgatttcctcaaacagtcttgtgataattagcctctgatcatatccgccacaataatctccaaattctgtcttcgtgtcagcaaattcaggcgcggcacaaatctttgtgattttgcagagcttggagaagcctaatacgagtccaggaacattacaggtgctccttgcaactgaacttcttggtgttcttgactccattggggctgattcagtgaaaaccaagaaacaaaagaagaatctttgagacgacatgggagagtatggtaaaattatctacgagaaaatcaatgtaatcaatggtttgaacttgctttacttctctaattcgacagaaagactaacaaacctctgtttatgaccacagaccaaatgcagcaatatctttcattttgtgagatgtaaacccaacagtaaaccacagactacataggctccatctccactgttttgagcacttgcacaacaaaattcagatactacaatgtactactagtagatttgagcaataagctggagccttgcatttgcatggttgtaatggatagaattggataaagcagtacacaacagatagagctatgcaggatcaagaaaatatgttgcagacaaacagatttatttgttgaaaatgaagggtagaaccgtagaagagcaagcatgaagtacctgggactctgggagagggaggctgggactgacaagtgaaatgctgaattgaattggtgtagagtgaccaagtctgaagctgctgctgctgctgcctgctatgcagagaggaaagcgaaagagcaagcaggagcagtagtacaatgaaggacaagaaatggacatggcagtggcattgggaacaacaaaagcaaaaagcttgcagagacaaggtttttgcgatgcattgtggccactggaatggatagtgtgtgctg

SEQ ID NO: 76534 - DNA, 17007 bp, Oryza sativa
agtcatagggagaaaacaaatcgatcatatttgactcttttccctccatctctcttaccggcaaaaaaagtagtactggtttatatgtaaagtaagattctttaattatgtgagatccggcttaatgcttttcttttgtcacatatactgcattgcaacaattgccatatattcacttctgccatcccattatatagcaactcaagaatggattgatatatcccctattactaatctagacatgttaaggctgagttgggcagtccatcttcccaacccaccaccttcgtttttcgcgcacatacttttcaaactactaaatggtgtgttttttaaaaatattttcaatacaaaagttgctttaaaaaattatattgatccatttttttaaaaaaaatagctaatacttaattaatcacgtgttaaaagaccgctccgttttgcgtgcaggagggataggttcacatcctgcattaccgaacacagcctaaatcttgttgtctagattcgtagtactggatatattaaatcatgttctaagttactatatactgagatgaatagaataagtaaaattagacccaccttaagtcttgatgaagttactactagctgcgtttgggaggacttcccaaaaaaaaaagtattagccattagcacgtgattaattaagtactagtttaaaaaacttaaaaaataaattaatatgattctcttaagtaactctcctatagaaaacttttacaaaattacaccgtttaatagtttggaaaatatgtcagtaaaaaataagagagtagaagttatgaaagttagaaaaagaattgttttagtagtatacagttataaactattccctctgttctaaaacataagggattatggatggattcgacatgtaccagtaccatgaatcgaatccagacaagttttttatgcatatttattctactataatatatcacatctgctctaaatatcttatatttcgaggtggagactgtcgctatgtttttctgcccgttgctaagcacacgccacccccgatgcggggacgcctctggccttcttgccacgataattgaatggaacttccacattcagattcgataggtgaccgtcgactccaagtgctttgcacaaaacaactccggcctcccggccaccagtcacacgactcacggcactaccacccctgactccctgaggcggacctgccactgttctgcatgcgaagctatctaaaattctgaagcaaagaaagcacagcacatgctccgggacacgcgccacccggcggaaaagggctcggtgtggcgatctcacagccgcatatcgcatttcacaagccgcccatctccaccggcttcacgaggctcatcgcggcacgaccgcgcacggaacgcacgcggccgacccgcgcgcctcgatgcgcgagcccatccgccgcgtcctccctttgcctttgccgctatcctctcggtcgtatcccgtttctctgtcttttgctccccggcgcgcgccagttcggagtaccagcgaaacccggacacctggtacacctccgccggccacaacgcgtgtcccccctacgtggccgcgcagcacatgcccatgcgcgacacgtgcacctcctcatccaaactctcaagtctcaacggtcctataaatgcacggatagcctcaagctgctcgtcacaaggcaagaggcaagaggcaagagcatccgtattaaccagccttttgagacttgagagtgtgtgtgactcgatccagcgtagtttcagttcgtgtgttggtgagtgattccagccaagtttgcgatggcttctcagcaggaacgggctagctaccacgccggcgagaccaaggcccgcgccgaggtgaggtttcccttcgtgcatccgcgcgcgcgcaccgcacgtacaccaccacgtttgtcccatccgttgcgcgtgcgcttacatttgttgtttgcttgtttcgtgcgttgcaggagaagacggggcgcatgatgggcacggcgcaggagaaggcgcgggaggccaaggacacggcgtccgacgccgcggggcgcgcgatgggcaggggacacggcgccaaggaggcgaccaaggagaaggcgtacgagaccaaggacgcgaccaaggagaaggcgtacgaggcaaaggacgcggcctccgacgccaccggccgcgccatggacaagggccgcggcgccgcgggcgccacgagggacaaggcgtacgatgccaaggacagggcggctgacacggcgcagtccgccgccgaccgcgcccgcgacggcgccgggcagaccgggagctacattggacagaccgccgaggccgccaagcagaaagcggccggcgccgcgcagtacgccaaggagaccgcgatcgccggcaaggacaagaccggcgccgtgctccagcaggttcattagcactcgcagatcgtgttcttttcctaaccattctattttgttaaacattcatgctaattgctgcaaaaaaacgctctcttggtgtgcaggcaggggagcaggtgaagagcgtggcggtgggggcgaaggacgcggtgatgtacacgctcgggatgtcaggcgataacaagaacaacgccgctgccggcaaggacaccagcacctacaagcctggaactgggagtgactaccagtaatacggtataagaagcatgtgtcgtctttggcactgatgccaaagtgtacgtgttgtatcctcttttttaagtttcagctcgacttcgacgtgttcggtgtcacactttggtttttcagttgtgctcaactgttcatgtttctggttccatggagggccagtgtggaggtcaatgtttaagctttcgttttaaaatctgataataaagttggttaagacctgaaagcgttatcccttctccatttagcgacttggaaaatggcaaatgagcacacaaaatgattggtgcttagaaaccacatttggagatcaacatattttgttgccagggtttacaggataaacttcagataactgttcatcagccaaaaagacaatgaaaggaagaggtcaatggtgtaaatcatagaaatcaatcacacatcacaccttgcattaatttccagatggaacacattacacatcagtatcactatatgcacagcacaatatagtagattcatttcacagatctcgcactgaaattcatttcagatacacaatttagacgatgtagtagcaaacaaatgccacttataatatacccatgaaaaacaaacaaatacacacacgaacgcacacaaaagaatggggggcagcattagcaatatagcatctgccatcgatctgcgctgctaaaccaatgaccatcacggtcagaagccggcaaacttagatttgatggcgcccacttcatcctcgcccatgagaaacgtcttggcgagcacctccatcggcatggccggctgggtcgcgaagagcgcgaaggtcggcgtgacgaggccgggcgactggctgtcgaacatggcgacgaacgacgcgttgccggcgccgacgttgagctggaagtgctgcaggccgcggggcacgacgaagagctccttctccctgaccaccttggagaagagccggttggccgccgtggtgaaccccaccatgacctcgccgctgagcacgagcacgagctccgaggcgcgcgggtgcgagtgcggcgggttgaggccgccgggcgcgaggtcggtgcgcgtgatggagaggcccagcgtgttcaggccggggaacgcggacaccgtggcgcgcgtggagttgacgccgaacgggttgctcgtgctgggcgcctggacgatggcgtcgcagaagaagtcgtcgctcaccacggacgccgtcggcttgcacgggaacccgtcgaccgctgtcgccgcccgcaggtcggccacgcagatgtcctgaagcggcggcgagtccgcgacggcgaggcgcggcgccccggctgctgccacgacggccaccgcgaccagcacccggagcacgacggagcgagacgacgccatcgtacaccaatgtacgtagccaaagcgaatccctagaagtgaggaactaactagctgctcgatttttctcgagagttgatcatggtggtgaccatgcgctgctggctatatgtaatgctagcctagcgagatgcgtgcacgggtggacgtgacgtgaaacgattctgccgatgtggatgctagctgaatcggtgatggtgtcgctgcagctcagcgcaggcggttgacggggtcgcgaagcgcgcgcgtccatggcgtgcggccggacgatagccaaatgaaatcaagtaggcgcgcgtggcggcatgtactgtttgtcgctgtcgagaccggcgcgtcgggtcgggaggacacaccatttggcaggtccccgggaagtagatgcggagtagcttgcgtcgcgtttccaatgacgcggagaagaggaatgaggtgatcacattaagaaatatctacatgatagttttcttcgccgtttgcattttaaaggaaaaaagtccactctaactcccttaaagtaggccaatctaatttgtaccccttaacaagaaaataagatagaacgactccccgaactattaaaaccagtacaacttgactcctctagcaattttgaagggtggttttgctgacgtagcggtgttaacccagttttcatcccacgtagcatgtgggggcccacatgtcattctttctccttcccttctctcttccttctctctcttttctctcctccttttctcttcctcttcggacgcacgcggggagcgagagcctcatcggcggcggcggcgggcggcggcggagtggcgacagcagcgtgcgggtgagggctggagtgggggtgggcgggcggggccagagtgatagcggcggcaggcgctggagcggcgacgacggcatgtgggcgagggctggaacggcggtggcgggtgggaggtgagcactggagcgtccaccatcccctccagctttgcctcgccatctcgatgtcttcgtcgccgtccgcgtctccttccccacctttcgctgcgctgcctctcccctctcccttctcggacggcggcgacgcttcggcaggcggtggcggagatagaggagtagctcgacggtgtggaggacgcatccgagctcggcgatagagggcgggcgagatctcggcggtgccgcctctcccctttcccttctccacccccggcgatagcctcgaaaggcggcggcgctttggcaggcggcgacggaggtagaggagtagtaggacggcgcggagggcgcacacgagctcggcggcgttgcgaccggccctcgcccgtccgccgccaccgctctcggtcgcagccgccgccaaaaaccacgggacgcaccgctacagctctggtccgcgcccactgttgccgtcgctccagctctccccgcctcggcagacgccgcgtgctccgtcgattcaattgtggtgaacaccatctgggatgaggcgatggtggcgaccggcggtgcggaccagccgtcgtgtacctcgaccttgccgtccccggccatcctccccgcagtcccctcctcttgcagccgcacccgtcatcccgcccgccaccgccacggccgaaggggaaataaaagagagagataagggagggagagggaggggggaggaggaagaaggaatagagagggaaaggatgacatgtgggccccacatgtcagtgggtcccacattatttttctgagaatgacaaataggtcccacattttttttttagttctgatgccacataagcaccacgtgggacgaaaaccgggtcaacaccaccacgtcagcaaaaccaccctccaaaaccgctggaggagtaaaattgcactggttttaatagttcggggagtcgtcctatccgattttctgattgaagggtaggaattagatttggcctactttttaaagaactcaaagtggactttttccgattttaattggactcatctactactaaatttgggcccaataatttgggctttaaatagactcaaagaagcccattgttatgttgaaggcattgtatcccattaagatatcaaaagccactttacatccctcaagtagaggttgaattttattcgtgtccctcaaccataaactcagatacagagtatccccacctctaaaaccattgtagaccaagtccctcgatagtattgagagcagttttgactcatgtggcacttacatggcttgtttaacttggtgcagcgttgacgcaatgcgtacttgggaggataaaaatttaaaaaaatacacataagtatccattaaaaaaattaaaaatgtggtacgacccatatgtcatcacccctttctctccctccctcctctccctccccttctcgccaggacacattagtggtgagctgatgtcgggttggtgggagttcactagcagaaacctccaacaagacgagcaaggcctcccggacactttattcctccaaatcctacgatagcatgtcaatgtcgcgttcactccattcctgtgtcctctacctccagcatctatgatgagcacctccaacaacaacaatcgtaggtcttcctcagcgtcctcaccgccacgggtggacatcaccagcaagaacgagcagctcacgaaggattactacacgctaacgcacgatacgaatagaggttactggaatgcgtggtgtgcctcttggagtttagggagcgggagacaggagttcaaactgatcaagaattaagtattggtgagtcgttggggttagcgtgccgttctcgaggccgatgcggtgaggcggcgacacctgaagtctaaactaagagcaagtatagtaatgtacagtcagctggcgaaatcaaccgctgcgtcatccaaatccaacgtggaggagcgagaaaccaagaaagagaaggaaatgggcgagtcgcgagtcgccggctcgaagcgtcgtacccgaggcaaaacgcccgctcccaactcggtgctggcgattgagccggtgcctgctccacaacagatgctttgcacatgcatatattaattgcttagatgttttaattaggtaacgtatcagtcagcttatagtcaacccattatacaggtgagcttttaaagcatggctaagtgacatggcagtggctttcagccggctgctggctacgttactatccttgctctaagagcaagtacaatagcaagctattagccagctgtaaacatattttaatgagataaatgataaaagagaagagcagtgggctacagatttgtagctagctgtagcgcatactccaagacacaatgtgtgtatgacaggtgggaccatatattaatagtatagtaagcaactattgtatgaattggctatatataaattggagctagtagtgggctatactattaaacttgctctaatgcaccgagggagaagagaaagggttgataacatgtggccatgtgggtcccactacatttttaaatttttaaacaaacacccagtgactatgggtcccacaatatatttaaatttttcttatagtgccacgcaagcgccatgtcaatcgtcacatgggataaagaccaaatcaaataagcaatgcaagcatcacatcagtaaaaaccattcttaatattgccgagattcaattcgcactggttttatggttgagagatgagagtagaactcggcggtgaattaagggatgtatagtagactttttttatcatgttccaatccagcaacactgtcgagtgtcgacctcaggttgcctgcttgggccctaggcctagcatatttcggaaataagaattcctcgatgtaatcacgagcttaccagtcacagtcaggcagtcaccagcaatctaagcgcgtcatacatgcgtaacgcgttcacgaagtccatggtgccagccatggaaagctaactctgttggaactgttctaacttctgatatgccagctcaagtacacattatatctcgcttagtccagcgtgacagcgtcaaccatctgatctgaccagctggatcctggatcaatcatcgaagatgaagctttggaagtatcgggcccggggacgacagcgatctacgtacgaaaggctgggacaaactgaggtacgaaacgacgccgtattactgtgttgctgtttgattgccaatggccagtggagattggctcggaagcctaagtcggcagtcaaggggccgaggcgagcaaccagaatcctgtcaactcaatcgatcgggccgaaggtcactgttggtggacgggcgaggctgtccaaaacgatcgattcgacctgttaggcgttaggccattcacaatgcatctacatggcatttggtctcaactgtccagctaaacagattgtatacgtggagaagaaaagaaggtggggcccatgtattcaccagcttcgcgcgtcctcatttggctccgagagcctcatcagaaaaacagcttttttaatcgcatttacacatgagaaagcaggacagagagagagaagggggagaagctgacccaaaaaagtaaatttttgtggtggggcccgcatgagaaacagtttggtggggtccacctaaagacacgcgcccacgccgcattgtggagagaggagcttcacgctgtttcttcgtacgtggcttcgtacgtggctgtttaggctccttagaaaaatactacacagtgctaatgcccttgctaggcatctgtccgcgcgctcaccggcggcggcggaccgggtcacgcgaccctgaccgagcctcaccgttaaggatcacatcatgaagcagcaccaggccaccagcacgtactacctccgtctcagcagccgtggaaatccgtgtccaacgtttgaccatccgttttatttgaaaattttatgaaaattttttaaaaaattagtcacacataaaatactattcatattttatcatctaataataataaaaataataatcataaaaaaaatttaaataagatgaacgttcaaaacgttggagatgaatagtgtaaaactacatttattttaggacagatggagtactgtctgtctgctggatgtcactgctaatcgtttcagactgcatgcgcctttgcctgaaaggcctctgtttgggattgtttttttttttaaacgaacctctgtttgggattgtcgcggatgtgttctggacttctggtgttctaggcgcttggaggcatggatcagcaaactcaaccaacctgatcgactagcccttgatgtcattataaagcatggagcagcaaaccaacctgatcgatcgattagtagtccagtagtccttgatgtcattatacatgttccccatttttcctggaacatgtgccattcaactagtaggacttttatattagagagaaaccacaaacaaaaattgaacacatttttaggcccggtcgctccgccccaggggtgacgcgggcggcaacacctcaccgtcgccccctcctctcccacgcctcgccgccgcccgagcagccgccggtaaagccgggcggctgcaaagacggcggcggcggggctcccctttctcctcactcctggtcaagtggttggggcgccgatgagaccggagcacgaggggcgcagctcggcgaggactgccagatccggcgccgttgaattcggatccggccctcccttggccggatctgggctggacgcgcaagtcggcggcgaaggcggcagccgcggcggcgaccgcggcgcgagggccgcgcggaggaggcgacggcggcggcgaccgcagcgcgaggggcgcacggaggaggaggcggtggcggccgtggctcgaggaccgcacggcggcgactgcggcgcgaggacctcgcggcaacggtggctgcggctcgcggacgtgcgtcaactgctgcttctctggcttgtgtgcacgaggaagtggttggcggcggcgacgtctcttctcccaggcggcttaaaaaacccatctcgtggagctcctcccctcctatggccagatcctgttctggccgtggggagcttcaggagagggtggacgcggcggcttgtgcagaggacgacggtgccatggcgacgtgcgggaacaagccgcgagcctacctgagccgtggggtggtgaactgggctaactggtggctgatgaaatgatgtggtggttcggcgacggttgttgtgtggttcagtggtggcgctggacgaaaatcattggcgaaagccttgcttagcctttggctggcacgacggcggcggcgcctttggcatcgttcccttcttggaggcgtcgttatagcgttttctccacgctaccagtctctaggtgaaaactgtgatccggtttccggacgggcgatggcggcgtttcacgtcgtatcctccttgggggcatcgtcttggagaaccttacccatgcaccatttgccgcttgtggactcctgtgtcagctcgatgtgctagatgcctaggtgcttggcgaggccttgtccttcttggttcctttcttgtattggtggcatccagcttattcgtctgtctctgtcgggtggagtcgaaactgctacgtcgttggggtgcgacgaagcttggcaacgataacatttgcagtttctctctagggatgtgggtgttgctagtacaggctttggcgcttcaggggcttgaatgatgtccaaagtgtgagcttggtgttgctttgctcggtttggcggtgcctacaatgatgccatgatcgccgtggagttggagctgctgggtcgctgggcggctagctcggtaacgatgacatgtgccttgtgatgtcaacgcggtgtgccgcctcttcagcatctcgacatcggtgttcgtcgttggattccgccatcgtttcgttgatagtttggctagagtgatatagagctccgtgtgctgtgtggttgtaccggccacggtggaaagacttggcgagtctctactcgccgagagtttgttttttctttttctgtaacccgtctgggtttttactcctgtttaatgaaatataattgacagttctcctgccggtttagtttaaaaaaaacccaagctcatttttgagagtcaacgttgtactccatcatgcatactcatgtatgagcatcgcgctgctatttctctatgtatctggatgcatgcatcatgcgtacgtctctctcgcgttttcctactcttccgtacgcagttcgtcgattgcgctcttgttcctactcttttggttttcactttcaagtaaacgccgggtaacccccgcaaagaaaacggacgcccagagacatacggtagcaggcccggtttgaacgcccgccggcgccggatcaatccgtgatacccaagggtgccgcgccacgtatgacgtaccaatcccaaatcgagtcgagtcgagtcgccgggagcgcgcaaaggctttagctagccaacgcagagcatgtcttggaacgcgtctcaagtctctccagtctccacacgtcgttagttccatcgatgatgatctgtggcaagcagagccgcctcaagtagaataactcgcccaatgcacgcgtacattcctttcacctaatgcgtagtattggcgtattgctgacacacacaccctccgtcgtttgactgataatttttttctccccgtcgtttgattgataattcgacatgattgacagcgtattttagctaatccctccatactaataaaggaagtcgtttagaatattgatacggtctctaaaacacaactttgacttcttttttctataaaaaatattcattgaaaagtgatatatgtatacttttataaaagtatttttcaagacaaatctattcatataacttttacattttcaatcctcatgatttatattcccaaggtttaacttaaatattatcctaaacgactttctttacgagtatcgaggaagtacttttctctctctttccggtcaatgtttgatacctatatcaccttgattagaataaacactgcgtaaatatgttcaaagttgttattatgcttatcattagttcacaaccaagccaacaactccctctcggaggtctcggaaatacggcttttgttaattaaacgaaagaatcggctgctactgagtctgctaccctcgcgtcgcgtgcaccaggtgcatatgctgctcttttgtcctgccgcggcagcgcgcgcacggcgactcttatgccaaacccacgcacgcaacgcaagcacatatgcttcgttttgactgctccctgctcaacaccacacacgctctcgctcgcatataggcaggcaatacgtagctacaccgtgcgcgcgcgcgcacacgtacacgcacaccaccaccggccggcgtcgagcgctgtttgcgctgctcgcgcgtccgtacatggcggggctgcagcgatcgagcgagacgttccggcggtcggggtcgtcggggatggtgtgggaggacaagctgcagcagtcaggggagctcgggggcaaggccgaggcgccggctccggccgcgcgggcggcggcgcagcggagcggctcgagcggccacggcgggtacaaggcggggcacgtgcagccggcgctggacccgccctccccgcgcgtcgccgcctgcggcttctgcaacctcttcggcaaggacaagcatcatcaggcgcgcccgcgcggcggcgccagcgccaagagccggcgccgctgagccaggccgtccctgccatgtttgtttgttgagatgctttgttagctccgggctagttgcttcgtgcaaagaaaggttagaaatatatcgccatgccgccatgcgcatgatcaaaaagtacagatacttaagcgtgtttctccgtttcttgtacacacggtcacaatgtgcagtcctctttgatctcttgctctctctcatgaatcatgatctgtgacacttcaatactttcatcaacgttcttcatgtctcagccttttctttcggttattatttcgatttctaccttgtagggcttcaaattcgcagttttcttaaggaatatcgtatctatggacctgtttggcatagctccagctccagctccacctctcctggagctggagctcagctaaacagttttcagctccaccaaaactgggagtggagttgggtggagctctctcacaaaatgtactaaagttgtgaagctgggtttaggcagctccataactccactctagactcaactcctggagttatatttaggagttggagctgtaccaaacatgccctatgtttgcaatttcgattcttttccggttgcatttgagtcaaggggctttttactatttgccacttttagatttggcaaataattatttgccacccctatctcaatgacatatgggtccacatgtgtctatgacatgtgggtccagtggtaaaaagttaattgccacatctaaatgtggcaaatggttaaatatctcttgagttaaacggggctaatcataaatcgtattactagcagtccgtataattaactccgttctgggactaaattggaagcgtgaacccggcacgcatcctgtctctttcgtcctctgctcgttttttctcgcttcgtacgtatgcgacgaatcagcgcccaccttcccctgatcgtgcgtactgtagtagtagtaataccggagaactcactccgttccacaatgtaaatcattctagtatttctcacttccgttccacaatgtaaatcattctaatatttctcacattcatattgatattaataaatctagacatatatatttatttagattcattaatatctatatgaatgtagaaaatgctagaatgatttatatcatggaacggaggaagtagtaattagtagtagtaacaatcagtagttgcttcttctccggccttattttacggggtctgacctcattcgtcccgttcagacttcgcaattgccacttgaccctactaaacaaaaactgtcacgcgttcaaactgcagcacgtatggaacttgcctaggaaaaatacgtagatgcatacgaaatgtcgtttgggaatacttgcagggataaatataatcactggtcatacgtcgggctagtaatttcttccacacgaaagactgcatttattaaccgtagcacttacgtatatttcatttgaccaattgacctcgtgctccagattacattgatctaccttgaggtctcgcttcctagatgaatatacttcattttgttgctcttgcaataaatcgtacagtggaaaacgcaagtttgacaaaatgatgtcatctaaaaatacttgtagcacgctggtgcaataaaaccgcatatatccacttgtgcaaaactaaaggcccttcaacagtacgtttctgagttacattctgaagttaacaaaacaacctggtaaaaatgttaaaagagtccgaagcgttggccacttgtacacagatgctgggcaattctgaacagctcccagttctgggatgaaatatcagaactgtgtaatatcagctctacttttaagtcatctatccccctttatctcagatgtaaaactcaaaagatcttttgttgctacagctctggaaaaacataacaaggagggcaaaggtgctggttataagttggaaaataaccgatttctgtagtgttagaaagtgattacttttaccttcgagcaatggcaatgccttctttatctacaaaaccaaccaagagtcctctatcttgacgatcaacatgttctgaaactactggaagttgatccactccataagaatccatgatcttttcaacagtagttagagatgtctgaggtgtcacaggccacattttacacttaacggctccacaaacataagtttgtacaggttcctgtagcatgaccagaaatgagtaacatacagatagaactacaagacgacaaaaatatatgccagttaaatacagttagcatgttctgaattatgattgcacctcagaaaacaaataagaaaccaactgtatttttctttgaaaatctttaaagcaagcatgaaccacagaaacttcagagatcgagactggccaagggatatagatcccaaggggctagcaaactaaagaatatgttattttgatatgttccaatcaacaacagagaaaacaaatgaagctgggggcagctgatgatctcttattcaggaaagaagaatagaaaagagtgcataatggctgtgtatatccacttgaggatatagaggccagattcttatccatcatctaaaaaaaggaaaagagtgcataaataagacaagggtgcatgtccagttgaagtttggtatacataagtcataacttatgaattaagatcaagcagaatcgcagaaggaaaaatgagggaaaacgacagcaaatcacctcagtctgtaccctggtagttttcgcagttctgcagaaatcctggatatctttgagagttaccaagcctattagagatctgttgctctcaattatcataacaaacggttgcttttccacaagcataagatttagtgcctcaactactggagttgtctttgaaacagaaatatatttagtcttcatagcctctgcaacagtaagattttcctgaaaattctcatgcttggcatcatagacacacagtgaactttcaagcttacataggtcggtaataggcttatctgtatccacagaagctccttgtgtctgggagggcacacttttttcctgtttaaaattacttgatttcacctctgaggaatccggcttactcctattgctcctagagaacctctggggagaagcaatccaagatgatactccaacagcaccaagcaaaggtaaaactatacgatagtcctgagtaagctcaaacagtaggaggacagatgtaagaggcaccttgcatacaccagcaagcgtggctgccatacctacctgcaaagatagaacaaaaggaagcaaacatgcaaatcagttttctttgcttgatattttcgatcaatctaaaagaaaatacgcaaaagagaaaactattgcttatagacatattaccaggccatatgcttgaggtgacgccacatctaggaacgggatttggaacagtgaatccgggccagtaaatgtaaacctcatgacctttccatacgccatgcctgtagctgcaccaataaaaagggatggtgcataatagcctccaaccaatccaaaagccctgcacaaagatgtcgccaatacttttactccaatgagctgaaccaatacagctgctgagagtccacttgtgaatggtcgtgattccagcaaaatatcaacattttcaaagccccaataaagaacttcagggtatacaagggctagaagaccaacaataaggccacccaaggcaggagatgcagcctttggtaatccggttgccgtttgtaaactttgaactatctccatagaaagtgctgtacacctagatagtgtagtagacaccaacccacagaagatgcccagcaaaagatatagaggaagttctgacatttattaagtcatgtaaatatcctcatactttcaatctctggatcacgagaaaaaatatgtaaaaacaagatgttattaacagacagtaagactaatctacgtccaggagggtttaagaggtgttttcatacttgacaaatcaaccttactaatggcaaaactgaattctttaggaggatgaggtcaacaagagcacaaatgtgtggtttcaaaacaaaagccaaacatcaagattttcatgttcccttcatttggtagtaaattttcccttcttcaactatttcagttgggcacaatatgttttattttagaatcgtaaattaggaagtgctacacaagttacaacgagaacatgtcaaaataccggacaggcagttaaccagtagaaattatgtatagcctaaatgaaagtattgca

SEQ ID NO: 76535 - DNA, 2060 bp, Oryza sativa
aagtagatttttcccaacattaaatacacaaatgaaaaataaacgtaacataggaatggatatgtaccttctgttgtatattactatatcgcaattctgttatttctttcaatgtctttctattgtagaacatttgctcttcaatggttccttgagtgcttgcgtccacttcaatcattgtgggcaaaaccttttcagcattatgcctataaataaaatgcaatataatccatcagataattttagacaaatcaacaaatatatatatgaatttaaagctactactgcacacctgctcaatatttccatgcttgcaggaatttccatatccaaaaaaacttctgtcgaacttgttactccaaatgataataattctaaatgatcaatgtcgttagtttactaaaactataagtacgttaaattagaaaaaaataacatcctcactttcatattctttaaccagaagtccagtggcgatgaacacagtttgcttcccaagcaaatcgtcgtcaaccatatttgctaaaatatctccccatagagtaattttaactttttctcccctacaaatgcaataaagtcatgtaaaatataccacatagaaagtattagtgctggtttaaatttgcagacaacaatcttactctaataaaaggagttcaatttcacgcatgttgcaaaccctctccctgcttgtgttttttcctagcattctttgctcgatcggcttcatcccgctaagtaagccaatcacatctaaatacaaacaggtctttagtacaaataacaatgtttaaaagaagtaagattatgcacatacctgataactgttgatctttattcaacctactccttaatgttttcctgtctgtaaactcgaagtaatagtccaagaaacattgtctttttgattttacctcttttactatggtatcatgataaaaaaggattttcagattgttttttaggacacggtatttatcatgttccataactttgaaatttttaaaagtatatattgagttaatcttaatttttggcctgaagtggttcgccaattgctttgagatagagacatgtattgagttgccctgcaccaaaaaaatagtatttacataatagaacaatatattaaatcacatgtttacaacaatcatacctctgcatctagtacaatcatctgtataccatagaactcatcaaccattgtaggattaaccgcatcccatagcctaataacttttactttgattctccacctatcgttctttggtgttaattcagtaatcaaattgctaggtgccatgttatctgcaaatgagtagtactgcatatagttactaaacaaatttgacagagagtcgtatacatgtttatgttattttatagaactaattaatacaaactctcataattgtgttctttgataggtgcaaggttacttttttgtgctggaaaaaaaaatgacaaaattgtatacatagatgcaacataatgtacctctaactaatacaggatatcgtaattgttgtgctggaaaaaaaaatgacaaaattgtatacatagatgcaacataatgtacctctaactaatacaggatatcgtaattgtgttcttttgtaggtgcaatgttagtttcttctgctgaaaatatgatgacaaaactgtatagatgcatatgttatttcctagctgcaagatcatgattagatgatgtcatgattgtgttcttttgtgggtgcgtgatataccttcttatgccatagatgattcgcaaggtgccgcagacttcttctgctccgtccgccggaatcgacttcttctgctccgtcgtcggaatcgacttcttccggaatcgactaatgtcgcatgctggcggggtgtatatatatgtatgcaagccttacgaatattgtctcatgtatatggaactaatccttcttgcaattaataatctttcctagtgatctaaattttgctttttgagatttggaatcttgccctgtgtacacgtacatatatttatggaaataatgtgcggcccctacaaggtgctgaat

SEQ ID NO: 76536 - DNA, 1973 bp, Oryza sativa
atttaatagaaatgcgggacatttgtaaattaggtacaatatgatcaattgcaatgtatgacttgccttgctctcgcactgatgagaccacagcaacgtcttcgagaaaccacgaatcgacgaaacgggcgaaatctacgcgacaaacaaagcacacaagcaaaacatgctataagactactgaaacaggaaacaaaaccatttttaatggattctacacatttttatgaatttactgagacttgaatggacttaatcggagctcggatgaattacgtatgatttttagaagattctctgtgtttttactattaaagaaaagccttaatgtatttattgcgcaataattcaccccagggctgacgtcagcacaaggaggggtggcgccgacacgcgggacccgcgggtcagcggcacaaggggagagggagggggcggctggcaggtgggcccactgggcagcggctcaagagagagagggaggggcgccggcacatgggccccactgacagtggcacaaggcgggagggggcgcggctggtggctcggctcggcttcaagccggccggccggttatggcgagggcggcggcgcgcgcgcacggttgccagcgacggcaaccggcgacgggaggcggcggcggacggcgcaaagacggcggcggcggccgaagcggcggcgcgagcgaccctagcggcggcgctacgcggcgggcggcgcggcaaagggagagagaggaagagagggagaccgatcctcaccgaggggctcggccggcgcgagggaggagcgacggcgaacggcaacgacgagagacgggaggatgacggcgacgggttccgggaggacctagagaaaaggttgggaggggttagagagagggagatgaaccacggcgatcggaaacatggccgaaggcggcggtggaggtggtgctcacccgtgcgcgaggggatgagggctccggcgatgaacttcgacggaggaggggtggacggggtggatctcggccacgcgaatcgaacggcggcgacggcgcaagacggcggcgagcctagcgacggctagcggcggccggagtagcgggaagaagcggcggtgggtggttgcacggcgcggggacgatggggagcacgggaggggtcggcgatatggggaaaaagagagagggggtgccggcgatgcttaaataaggggagagggggccgcacgtggccgggagcggcgggaatcgccggccgacgtggggagtgggggaggagagagaggcgggattcggttttcgaatcccggccatctcgggcgcgggcgcgaacgggagggagaggggaaagagcgcgggagacgcggcgcacgcgcgggcgtggctgacgtggcccgggagagacggaggcgtgggcgcggcggcggtttcggcgcggcggcgcgccgggatcggcgggaggagggagacgggcccgacaggtgggccccacctgtcggcgaccccgagagaggaggcagcggggcggcctggctgccggactgggcctcggcctgcggccggcccagcaaggaggagggggaggaaggaggggaatgggccggcggcccatccgaaaagaaaaaaggagggaaaaagggagggaaaagaaaaagaaaaaggaaaaggattttccctggaattaaaatttgcactttagtgatttttaattggttaaaattatttccaaggctctgaaaattccactaaaaatcctgttagcatattttgacatgtagaatccaagaaaaattccacatgccgattccgattattatttgcatttattactttagggtttctctctaggttaaattaaacaatttcttcggacgatttattttatgaatttagagcaagggaggggaacttcagggcgtgacaaacctaccccccttaaacagaatctcgaccccgagattcagaagagctggcgaagaggtgcggatgg

SEQ ID NO: 76537 - DNA, 2885 bp, Oryza sativa
  unsure (1)..(2885): unsure at all n locations
attcctgcagcccgacagtagtgtgctgtcctcatatcatttccaggggtatgaacctgcatcggtattttaagttccactaccgataatccatgtgtcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgagcctgggtccagtgcgattcagcttcggacacttgccagcaaagtggccgtgcttgccacagttgaagcagtgtcctggctttcctacagcccccttcttgggttgttctgactgagctgacacagctggcggatctgactgagctggtgccattagtgggggtggagtcgagttgtggttgtgctgcttactgttgttgtgactgccaccgttgtagtcgttgtcgaagttactcgggtgatagggatggtgctgacagacgatcagggtggaaggcccacctagctgtcccgtcatgaaacgaggcttctgattgttcccctgaggaaagctgatctgagctgtctttctttttcggtctattttgttgcgttgctcttcctggcggatagccttgtccacaagcttctcaaagtcctcatagactccggagattagctggttggtcaattcatcgtcgagcccaaacaaaaacttctcctgcttctcagcatcggtgcgccacgtcgtcagggagccgtagcgcgcaagggcggttgaactcgtgcaggtacctctgtannactgacatggttccttgctagaagcgcacnggaactctctcttctgttgtgccataatcccttcaggaatctgcgccttcctgaagctttgacaaaactctgcccaagtaacctccgttgcatctagacgggtcgccacgtagttatcccaccaggcagaagcgggaccttgcaactggtgtgtagcaaaagcaactttctcttggtcgttgcattgcagtaggttcagcttcttctcaatagcacggagccagtcattggcctccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatggtctgctgccagatgcactactgacatgagctccatcggtctgctcttcgctgcccctggcgtcgctggagtcacggggatcattccttgtcttcaccatctggaggggataggtagaaataagagaaaggaagaaaacagatggctcggaaactaatctttcttatgaaattaagtgccattatcttaatcttgattaaaacactgaaaaagaggcacacaactcctaataaaggctgtcataccactcacacatgatatcgaccgccgactaacccacaagcaacaaacctaaacaccaaaaactagcacgcaaacagactaagaagacgataaagctaagggcggcgactctgaagcttggagcggcgcttgcgatcggagaataggtctgacatctaaagagtacagagggataggaaccaacacatgctaaaaccaaattaaataaagcaacgaatgactcaagtaacttgccgagcatgatgatttttatgcatagaacatttttcatgaacccggataaagacactaatgcgactgaccaaaccatagcttaatgcataaactagttgcatggaaaatgatgcgcataaaattgccccatcgaacatagacacgacctaatgcatatcacccgataaatccccaactgactgtcaaatataactccaaataaaatttttctaaaaccctagaccgagctaattttaaggatccgatccgaatgaacgaccaagatttttcccacaaaccaaagaggcaaaaccccaaatttttcccgaaacaaatccaattgcaaagaatatatgcaatgaaaaggattcagagggctcttaggtttttccatttggcttgtcctacggtcaaggtcggctctgataccaacttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagagaaaagcgagctaagcctgaagacttgactcctgcagcgggcgactccattccacaggcaatccttgacggcagcgacgaaaccaacctcttcgagacatcttcaactgagaaggacttcaactctggtgtgggggaaaagagagcaagactgagtactacccacggtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgaactagccagttcattaagctaaactaggggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggaccctt

SEQ ID NO: 76538 - DNA, 1072 bp, Oryza sativa
ctcgcaaaggagaacggggacattgctcgccatcgttgggccactgatcatcatctggccgacacgacgtcccacggcttcgctgctcagacctgtgaatcgagaaccaaagttcgataagtcaggaggaacgcgcacacaagcaagtcagggtaaatgcaagaaagataccccgaggagaaacctgggtcgtgtcctccggtccagaatagtcaaaggctagatgggctcgagcctggagcgactggatccgtctaccaacgaagtcagcagcgacttcataccccgacaaacctcgtactcggagatcgtcgataacatcgatgaaggactgaagggaaggggtcaaggtgggctttgcggtccaagacgaaatcttgtctggttgttcctcaggaacaacaaagacaggatccgaattttctatctgaagatagaaccacctcgtccgccatttgctatgagaggaagggcactggaaggggatataacgcgacttcaggccatcccggagtcggaatccgacgcatccagataccctgttggactacatccaacgcaactcgtagtagaagcgaaagagatcaagaaaaggctctaccccaatgtaggcctcacaaagatgcaaaaaaatactaaggaaggcaatagaattggggttcaaatggagcaaagaaagaccgtagaagttcaaaaccaagagaagaaattcagaaggcggagggagaaaaccgcagagaatgtagtcctcgatcgcaaccatgcgacctaggacaagctggggttcagtacctccttcttctctctccatggtcccacgaccgggaggggcgccatcctcctgtagcttattcagcgacgcgctggtggaggaggacttgccgagatccatcgctgactggagatcgccggagaaaggactgagattgatgagctagggttttgcgggagcggaaaagacgagaagcgcttggaggttggagggtttcttcacaacaggcagacttcaaaatggatccccaaaactctcttaaataaacgcacttccgacggtgcaaatttcaaggaaagg

SEQ ID NO: 76539 - DNA, 1760 bp, Oryza sativa
ccgcgtcggggctgtcgacagtctttggcccaatggccaatcttgccacagttgcggcaggcgtattcttgtgccggcttgtggttgccaacggcgtaaccctgtgcacctcctccagcgccaccctcagcgcgtcttcagcccacccactgacgcctccgcgcgccttgcgcggcttgcaggcgcctgtcgagggaagggactcccccttgctgccgttactctggctggactcccactgctgccgagtgagatagagcttcccgccaatggtgataggccccgagagaggctgtggctcagcgccgtcgacgacctttaggcgacctaacgcctcctcgatcgacatcgtggagaggtccagcaaagactcaatcgagcgagcgatctgcttgtacttctctgggacgcagcgaaagagcttctcgacagctctctcctcgtcgtaggtgtcgtcgccgtactgcaccatcttctgcaaaagagtgtggagacggagggcaaagtcatcaacatcctcacctggcttgaaggccaggttctcccactccttgcggagtgcctgcagtgttgacttgtgggcgcgatcgctgccgatgcgtgccgcagcgatggcgtcccaggcctccttggcagtccgcttctgggaaagcgagaactgcatctcgggcgggactgcagcgatgagggcatccagtgcccgccgatcctcgtcgtagtcgacgtcgccgtaccggactgcctcccacatgtgccgcacctggagcctcaccctcatcaccgcggcccactcgatgtagttggttttggtgagggtaggccacccaccgccgggaccaaagtccctgaccaccgtctggacgccgtggtggccatggtgccggtcaggggagggagagccacgctgcctgcgagggccgcgcgcgggctccgggctgccgccggcacgcccgcgcccgtctgggttcccgtcggcgggcgcgcggtcccttgggccgccgccgccgccgtggaggtgggctgctgcccaccgctctgcccgctcccgtgccctacctcttgcaagctcctcaagctccctgtcggcggtgatgtcgccggcgatggagccgttgatgctgctgcgcaaggtctcaacctctacctccgccgcacgtgccgcatcttccgccgcctctgcttctgcctccgccctggctgctgccaactctgctgccgccagtctggccgccctcgctgctgctgcagcggtctgagccgttgctcgcctgcgctcttctgctgcggcgagctcggcgtcctgctgacgccgagtgctcgagacgaccgaacgccgagaccgaacgtcggacatggcgcacctccggggggctgctgcgtggagagggggaagggaaaggggaaggaggagcagccggtgttgctgctgctggtggtggctgagagctcaaccgagcttgggaaggggtggaacaagagatgtttagcctacaggaaagtgtggctctgataccagatgttagaacttcaatggctactctcattgagaaaaggatggcactcggagtggggcaattttctggttttcttcattcacaaactcaaaagccatatcctcccaaagaggattggatacatatttatagctgcttgtagcagccatgcagccatgctagtctaagagggtgctgtcctagagcatcccaacaaactgtcctagagcatctcaacatactgtcctagagcatcccaacaaactg

SEQ ID NO: 76540 - DNA, 1986 bp, Oryza sativa
  unsure (1)..(1986): unsure at all n locations
gttcttgagttctttcctggcttcgcatcacgatcagaatacaaaacttattgagtttggcatgcatgaaatctgtaatatttccatcaatgaagaacgcaataccttaagctttctaatttacctttgtttgcatcaaaaaatttcttttcagtgtaccatctctccttgagtcacgcttaattttttatttgctcctcatacgagttgtttggttaatttaggctcatgcccatttccaagtctctttcagcataatcctcatttagatctttcgttcccctaatttaaatgtatgtgcagggtttagggtcctatgattttacaaaaaaacataaataaataaatttgaagtataatatcattaccatatattacggcttagatatatagcactttatagctacacttcttgtgaaattaatgatgtcgtacacacacttatttacattgtaattatcattataaattcaaacttattactataaataacatgttaatatatctaaaagagaagaaggttatagtcgtacacacacagtcacacagacttgatggcgatgctggctctgccaccggccggtcacacccggcacacgggatgcaatgcaagacaaggtgatctgatccgctggttcgtacgtccatggtttttgcacgcatgaccgtgtgctagtgctagccgcttccagcaagtctcgtatgttgtttaaagcatctgactaagtatctctgacatgttaattataagtaatcgcaacataccaaacgggtctagatcacagccactctgcaatataatgttctatcctaatcatcatttgattcagaccccgtatcgatggatcgcaggctgctcagagccgcacgcggcggccaccgcgagtggctggaggctgtacttctgggggccgctccggcgccaaaccacgtcaccgtccacgtcgccgcggccggggagccacagccacccaccgcggcggcgctgctcctggacgtggcgcgacgccgcagggagactccgcgctgcacgtcgtggcggcctccggcgacagcgaagcgttctgagctgcgcgcgcaccatctaccgcagcgccatggccctcntggatcgcgccaacgcgaggggcgacacgccgctgcactgcgccgccagggcggggaacgcggcgatggtcaggtgcctcctcgacatggcgatggaggagnacgaggagcgcggcggcgcgaggttcagggtggccgacgtgctggagaagcagaacggccggcgtgagacggccctgcacgacgccgtcaggctcggcgacgagcgcctcgtcggccacctgatggccgtgcatccgcggctcgcccgtctccccggcggcgacgggatgtcgccgttgtaccaggcgatctcactggggcacgaccgcatcgcggagctcctgcatcagcaagggggcgacgagctctcgtattctggaccggccggccaaactgccctgcacgctgctgtcctacgcggcgcaggtacgtgcctacaagtgaagattgatttttttttcatttctcgatgggatatatttcttatatatcatctaaatagttattatttttcttaaaaaaattaacagcatatattaacatagattgatatgaactatgtcactcgtaatatcaaattggactcttacaactaataccaaaagaaacaaattcaacttaaatagttaacacacattcctggttatatttgtttctttataattttcaaaagttgatttttttatttacatatttgtaaagtaatatatttcatacttggctatcttattgttttttataactatttagggatgaaaacattttctccgcacgatcaatttagatcatatgaaagacccacacgtatacatcgacaaatacactctgatgaggcacgatcaaagaaacagaagcacatcgacaaatgcacctcttggcataagctgggctgcagga

SEQ ID NO: 76541 - DNA, 794 bp, Oryza sativa
taacgggaacaaaggctataagaactttccaaagaaacaacaaaaaactacaccatgacttagcttcatctctaacatcctgcatgacggaattgaaattagctgaaacctctccaaagacacatccacctatgtttccaaatcaaccaagccaccaacacaactaatgagttaaaacccttgcgatgttgcttagccactttctgcaaagcttaaagccaccacatggtgaaaacagtgtcatcgggaccttatctaaggtgctgcaagccaaccaaggacaaaactgagaaccatacacttcttgtgaacacacataaagtgagcaagtgctgcacattctcctcctcttgattacacaatggatattgccaagatggtcaacactgcgatgggccaatcggtcagcagtccaacaacgatttagcgaggctaaccacacaaaagaattgcaaagaggccaaagctcaagttttccaaacttccttccacggctcaaattacatgcccctgatgagtttttttttttgtgtgtgtgctctcattgctgatatcatcatggcaaaaagtgatgtcatacctaaactgcacctcaacaacaaatgacaccaactcatcaccaaaatcagtggcctccatgagattatagctcaactaaccaatcacaaactatcatcaattattgagttattctgctctccaaaccaacaaccgtacaacctaagattccaaattcctaataaatttggaagaaaaagactgaatatgcttttccaaaaaaatacaaaacatat

SEQ ID NO: 76542 - DNA, 659 bp, Oryza sativa
ttcctgcagccccttatttaatttttttttgcaaatataaaagacaaaaaattatgcttaaagtaccgtagataataaagtaagtcacaaataaaataaaaataattttaaaatttttttgaataagacgagtagttaaacattacaagtaaaaactcacaatctaatataggacgaatggagtactttgatatcccacttttctcacaattccaaactagcaccacaaaatataattttgcaggccctcactttcacaccaagaaaactaaacaaagaaaaagtctacggccgcgttcccttctcttcctccttccttctttcctgctgcctgcctagtctagtctaccaccctcctctccaacctttctccttcctcctcatctcctcctccaagccgagccaccgaaattcctccaatcctacagttcgctcgcatctctccctctcctccccgtcccaggcgcggccaggacctccggatcggtgaaaagaggccgccttggtgcttcttggcgccgaatcttggggaggaggtcgctcagattcggtgaggggctcgggttcttgcggggtggaagatgtgtttttggggggcggattcgggttgggggcgttggggaggtgcggaaaggtgggaatttgggggctgatttggg

SEQ ID NO: 76543 - DNA, 563 bp, Oryza sativa
aattagcaccagcatagcttatggatcggcaatgctacatgtgagaagcgttttagaagggatttggaagcaaattgtagcttaaaactttgctatgtaagttcgttgtccaattgcatcgcatattcacatccaagtcggggaactagacgtgagatgtgtcgtcgtatgggtaccgagaggttgaagaggacgacggagacgccactgaggagcccgacgaggcaggcggcgagcgtgacgaggtcacggccgggcgccgccacctcctcctcccaggccgcctccacccgctcaccccgccggtccccgtcctcctcctcggtcgccgcgccgcatcggatggtccggaggcgcgcgcccccgtccccgccaccgcagcggcgacctgccgggcggcggcgggagagagaaggcggggatggggtcgagacgaggaggacacgcgcgggacagggtgccacggacggcggcgccatgaattgggagaggcatctcatattctcatccctagcatactactgcgagtctgcgagagaggagggagtgccgcgaggccacgg

SEQ ID NO: 76544 - DNA, 1338 bp, Oryza sativa
  unsure (1)..(1338): unsure at all n locations
aaggcgctgtgcggcacgctgacgacgctgccgggggtgatgacgccgcagcagtgctgnacgcggcgttgcgggtggcggagtccaaggccatgatggcggagaagcggctggccgacgtgatgaagtcgcgcgcggtgaaggccgaaggcacgagcatgtcgtcgacgctcgacacgtgcaagggcgcctactcgtcgctggccgacgcgctgcagaaggcgcgcgacacgatcaagagcggcggcagccacgacgacctgatgaccgagctgtcgtccgcctccaccttctccaccgactgcggggaagccttcgacgagttcccggacctcacgtcgcccatacccggggcgcagcgccacgtcaaccgcctcgtcagcaactgcctcgacctggctgccaccatcaaagaaaactgatcgatggcgtggacgcacacgtgccgcgccggccggccgcgctaggtttgtaggctgcttctggctgcaggcgagcgtgcaaggctacaacgacacgtactgcatgtactgcgcacactctgccttttcatgtacgtatacgtgtgtactagcgtacatggtgtctgtatgtacactggtcatggggagaatggggagagcatgcagtgcgtatgtttttatcaatatttctcgcagcggcatatataggcgtcttggtcttggagattagcaaaaagaaagaaaaagtgttgtagttgagtccgggatatatttgtgcatcagtgcatgggaggttgatcgcccagaaaggtatatataatgtacttccttattaaatacaagttactacatacaaatgtttttttttcttcatcgacatttgtacttgcaatgagctctgagcttctctctctgatggagttaattattgaacctgatgatataccataatgggccgcacttctgtcaccatcatgttccggcccaataaaaacaggctgtacagtcatcgatacggaccacaccgacggcctagcataaaagaataagttcagtccaggtctcgtctttacgcggagtttgaatcacgaccataaaccacaatactaaatataacatgtctcccaactatcaaaaccagtataaaaataattctcataggatttgaatggcaatttttgctgacgtgacgcctacatgactagtttgaattagttgttgtctaatatgccttgacgagtcactagaaggaagactaaaaaaaaaaagttgaaccaaaatatttaagctcacgtgtccggaataaataaaaataaaaaagtagtaggacccacatgtcagtgggttctactctcctttctatctgggctgcagg

SEQ ID NO: 76545 - DNA, 1935 bp, Oryza sativa
aggtttggattatttccatatctgttgatggaatgaagacgcctagtcaaatcaatctattttctcaaaatggttgagtttagacattcaaagattgctgtgagaagaacgtggtgtacttaattactttatatttagggtaccatcttgaattcttttgagaagtccagatggaattgaaccattgagttgatttcctgtcagatctctaaagaagccatatgcccataaggtatatgtagatgtttgttaatacaaatgatgctaggcaataaagtaaaatttgacagaagttgcgaaacttacaatactgtcaatgaaggtaactgtgaaagtgcatccggaatcgaacctgtcaaattgttgtttgacaaatccctagaagatatgaagcaagactttgcaaattttaatgcaaaattcttacaaacaaggttaacaaattaacattattcaactcagaacgtacaagtattgaagagccttgagatccccaaaagaagatgatatctcaccactcaaaccactggaggacaggtttctgcaaagagaatgtgatcagatgaccctgtttcatacttccgttatgcaactccaatattcagtacgtgtggactcaattacttacatttttattacgtgtttggagttttcatagctgcatgtcaaactttcccatgtaaattctgtcggaatgcacggatcacccatccaattcttcttcacctgatacttttccttgatcaccatcatggcagaagctgtcaagtgcaaagatgatttcgatcagtaacacgcgccaaaacaattaggccatttcacttgtgtgtgtgtgtgtgtgtgtgttctctatcgtctatgtacataccgtcctgaccatatgtgccaatggtggtggtggagaaaacggagtacacctccatggcgttgatgaacggtcgcatcgtcgagttataggtggcgttgatggagatattgtactgcgggtatcgtaggaaggggttggtgttgtagatggcgtgggcgtagagatacactggcttgtagcccttgctgtacatcatgttgccgttgaggttgatgtagaattctcgcacatcacggctgggggggctgagctccagctcggagaagtgcatgatggcgatgtaccccggcgacgggtccttgggctgtgtgtaggctacccatgcgagctcgatgttgtctgtggcaaacattgggacaatagccgtctgcatcaccgccgttggcacctcgaacaggtcgtcgtatgtctgctgcaccggcctcgtcgttgatatctcggtccaatttgatggcgagtcccaaggtgtccatactctgtcgcgtggatcgtcggggtacctggacatgaatctcttgaaaatatagcaccttgaattgactattcatcgattattttcaccagtgtataccggccaacaggcaaaagctgaaaatgtaaaccattttctgtcatccgaaactcaaactgaggtcatttatactataccatactaccgtatattagggtggtcatactaattactacctccgtcctagtaatcgctttgactttttttcttttaacgtttgaccattcgtcttatttaaaaaattagtgcaaatataaaaacggagaagtcatacttaaaaagtacttttgataataaagcaaatcataaaaaaaattccataattttttaataaaacgaaagatcaaaagttataaataaaaactcaaagcgacaagtattctgggacagaggtagtatccaatgattccattctattctattaaaattgacacttgttttatcggtattatagtacaccatcggtataaatattatatggatattatggggaaaatatgcatatttataatttgttgcgcgcgcgtgtgtttggagggacgacaacctccaccac

SEQ ID NO: 76546 - DNA, 1222 bp, Oryza sativa
ttcacctaaatggttaaatcaacatgcacgtaaaggactcaaactcggatggatcgttactcacctgatgatttcggtattactggtcggcccgaatttccatctaccgaacaaggacaggccttgcgtctcggttgcctgcgggtagagcttcttcttgagaggcctgaggtccaacccggagatgaacggtgtcccggtgccggtgttcacgaggcaaacctgcacgaagtcgtccggcacgacgacgatggcctccaggagcgtcgagccggcggggtccgtgatgttgaccatcatccagaagttgacgccgatgtagacgtcgaagattggcagcttgctgaggccgtcgtagttgccgtacatgaaggtggcgcggatgaggtacttgtgcccggccacgagcgaccggagcgtgtagcagttgcgcgcgccgtcggggaagctgcgcacgttgtagtagcgcgccgagagcgccggtgcgaagtactccgccgagatgttgtggaacgagccgccgtcggtgaagccgtcgtccgccgcgtaggaaatcttggtcttgtcgtccacgtagctcgtcttccccgggaggccacagtctacgctgatgaaacctacggcgagtcggcgacagcgacacacattagctagcgataactgcgaaattatggacaatctatgctagatcttagttcattgattggcatgggttgtacttgtagctttgctgtcaagctgggcacgagcttggagtatgccggcggtggcggcgagggcgaggcactagaacataataaaggctgaactctctttgtgatcgtgctctacctatttatagccagtcttaatccagtgagcgtaaccatgcaggtaatcaagttggaagaaaattgcgtaggactgaagtcctacccttatctgaaggacttgattcctctgcacgacacctgtcccacatgaatctcagaatagcctttctccctcatctctccagttcccatttatctatcttcctatcgtcggcgaggcgtcaaggtcaagcactcaagcccgagcaccaagcgcaacgcgctcgtgccctgtggcatcaagctcatgaggacagccgaaaattagagtcaaatttgcctgccgacctgccgcgagaaaaatctttggtttggaataagctgggttatcgattagatcgaatccatctccatgaacgggctgcaggaat

SEQ ID NO: 76547 - DNA, 870 bp, Oryza sativa
caaatgatgggtgccatggcatctaggcgtacaaaatccttggcatttaggtgttattttcactttaatttgttatttttgttgcaacttatagaagttgaatttggtcttgcatgtttgtggagtgatatatttcgtattaatctatgttgtcaatttttttaattttttaataactatttagatgacatgcaaataacgagggaatgtcccctcaagggatgaaaatccacgtccgatttctgttctcaatatggagtgtgcaaatgtgacagaaggaattctactcgcgttaataatcaattgtcactaccatactattattagtttataacgtgttgtcatttttgtatgtatggcagaattagtccgttgcatttactgtgagagcaaggggactaggattgtgcatcctggtgagaagagcttccatggacgtgacacggaatttgagaaggtgatgcgtggagaacgactctttcctggattacagagaggatcctacagcaacattcggctcgctgaaagaaccgatgcagattgggtggataatctggaggaagattgcatctacatcactgcctgcgcagcggataatgatagaagagtgaacccgctcaattacccgcctatgtatcgagagcgtgtgctaccgtgctgcgaagcagcaagtgatcgttcctagttatcagttttttttttcatatatttttcttcacaacattataaggtggcacactgattcggtatccacacaacgctaatctctctacatgctcccgtgctgaaggatcaattattcgtaatcgtaggtacatattcagattaagatcgggagctcagatttcagatcgagatgctgttggggat

SEQ ID NO: 76548 - DNA, 2522 bp, Oryza sativa
attcctgcagcccgaagagaaaagagagttagcctattcaaagatttgcgcaagaggtgccggcggcgaggtgaccggcaggcggcggggcgtaggaggcggcggcgagccgtagagatcccgacggcgaggcggggctcgcctgcacacgggccgccggatctggctcctttctcgccggatccggcgcccccctccctccctcccactagatctggcctctccggcgaggaaggccagctcccgacgacgagacaggtacagcagaggaggcagtggcggcggggttgagggcgcggtggcacgtggtgaaggggcaggcggcagatgtggccctcggtgacggcatcaggcatggggagtccagcctgtgaggcccgcgtctacgtcagtgagtggcgccggaggcagtgaaaaggagaatgtgtggaggtacggcggtgcttgaggtgtagggggaggctggacgatgaggggtgacggagggaggctggcgcggcacaggtggcgccgacggcagcgggaggtcggcgtggcatgcgatgcggcgggcggaggcatgagcaagtgcatccatggccggcggggcacgcccagcgcgacgagtggctgtgaccagcggcgggatgtgtaggcgtggtggtgaccggcgatggtcgtggattgggcttaggtgctaaagggatggtgtggtggtcgggcaatggtcgttgtacaggatggttgtgtggagttttgattggaatcgctggcgaaagccttgccaggccatgggccggcatgacgacaacgacaccattaggcgtcgttccccttcttgaaggcgtcgttctggcgttgacctctcctggcaccaagaaccttcccccgtgcaacggtagtcattggtggactcctgcattgcctctgaagctctacaagcctaaggtgtttgacaaggtcttctctgtcttggttctgtttcttgctctacggcaagtgttcatcattcttatttggttactgctgggtagagtcagagctgcttcgctgtaggggtgcgacgaagttcggcaacgatgacacactgcaatctctttataagattgttgatgccagctgtatgtaggaagtggttccttggttgtttgggctaatgtccttcatgggtatcgtttatgcttgttcttttggcgttagggtagcattcgagtgaagtcgaagctgttgtgtcgtttgggcggcaagctcagtaacgaaaacatgtgtgggctgttgtgtcgccactatgacaagcttggtcgatgccttgtgtcgggctccgtcgttgtaatttaggttatgttagctgttagtgtggtgttgtagttgtggttttcgttcaattttccctaattaactggacactgtaaagtttggtcctgtttactccttaaattggggcaccttattcttaatataaaacgtcggcaatggcctgatcgttgaaaataaaattgtgtaagacatgtgtcaagtagagagacaagtcctttgaacgaggtgtaggacttcggtcctgctctgtaattttcttccgatcaaggagagatggattctaatatgtgatgtgaatgtacactcttttttttttcatgtaaactaaatggttataaaataattttttaaaaaaataacaagatagattatgtaatatattacttcacaaattaacatacaagtttaaatttgacttctctaagtaggaaaaaaataactagtcgattttgaagttgcatattcgtagagtgatacattacatattattaatacctatcctgtcaactttttttaaaaaaattcataaccatttagttgacatgtaaaaaagggtgaacgtccaaccaagtgcttaaaatagttttctataatcaagataattatatcactatcactagcaaatagttaccgtctccatgttttaatatcgggaatgctaggggacgggataccgtcccccaacgggatagctcctctccacaacacgattcgcgtccctcgccgctgccgcgcccgtcccccgtcgcctccgcgcccgtccgccgccgccgcgcccgtcccctgtcgacgccaccgccgccgccgctcccatcccccaccgccgtcgtcgctattctccgccgccgccatcgccgccgcggcgtccgtcccctgtcgtcgacgccgccgccgccgccgcgcccgtcccccgctaccaccaccgtcgccgcgcccgtcctctaccgccaccatcgccgtcctcgtctacaagggacggctgcagggggcgaccgcgtgtgtcggggtgctcctccccaacggtatgcccagctatatctagtaggaatcacctgatacctggtaagtatcatccgatacctcgcaagtatcacgtgagacatggtagaaatcgtctgatacctcatgagtatgacgtgatacgtggtagaaatcgtatgatagatgacatgtatcgtatgatacctcgtgagtatcacgtgatatgcggttggggctgcaggaat

SEQ ID NO: 76549 - DNA, 2923 bp, Oryza sativa
taaaaacattatgaatgaagttcattgattctgagttccaaactgaaaaaagttctactaaaaaatcttgaatatttgaaatttctacatttgcatttgctttggtgtaacatcatgtgaaagttccatagagatctctaccatgaaatggcattcaatcgaaatgagcaaaataatttatcgtgcagcaggaccgccagtgattgatggtatccttccaaaattttgctccatctctaatgtagagttgttctgacgcaaaccagtggattgttaagtggtgtagaagttagagtttagatcgccactattgccattataaaagccattgtttatatcactgacctggtgcttatcctctagctcgaggcactcttgcaactgtgccaccacgtcggtcatagtggggcggtgtgctgacgaaagcgccgtacacttgagtgcaatgtctgcaaccttccataggccattcacatcgtagtcaccatgcatgcttgcattcaccacaccctcaatgttaccccgtgctaagcgttgttgtgcccaatggatgatgctgatgggctctggatcacgcaagatagctggcttccctgttaccaactccaacaggacaacaccaaagctatagacatcactcttagtcgttggttgcattgttgattggtacctacgcatttggtcagtcccaataagtcttacaattagtatttctctaacaaaagaactttaaaaaaagggcttcaagaaagacaacatactctggatccacatatccaggtgtgccaacaagtttgttcgtagatacatgggtgccgttctcaggattgaaaaccttggacaaaccaaaatcagcaatcttggcctctagcctcgtgttcaacaaaatgttggttcccttcacatcacggtgaataagaggagggttgcaccctttgtgtaggtactctagccctgatcattaattcaccatgtaattgaaatactgatcaagcttctagagagagaaaaaatgtaaaatcaaactaaaaatagcattagaaattctaagtagttaccttgagcagattccagcgcaattcgaagcctctctttccaggttaagtatctcccatcatttccttttcctgcaaatataagaattggagatcatgaaaggactaaaaaaataagctggtagatgaagttagttcggacctgcaatgtgttcttgaagggttccttctgacatgtactcatacacaagtgccatatatttctcatccttacaatagccgatcatagagacaaggttcttgtgatgaatccgggttaaaatttgagcctaaagtggtgaaacttgtctatttaatgatgcccccatggagacttttcttgatagaaatttttacatagcaagaaaaagtgcagcttaaaaaattctacctctacaagaaactccttatcaccttggttggaagattcagtcctcactttgactgccacttcagtgccatcctccaagaagccatcatagacttttccaaagcctccttgtccaagaactcgctggaatttgttcgttatcttctccagttcattatatgtaaaccagcggttctcaagccgcagtgatgaattatgcccggagccattatttgttggcccatatctcattgtctcgttttgtcgctttacagaattgttcattgatcctttgtacgtgaagaatggaactagcatcagtagtattcaagaagatgaagtagagcagacaaatgatagcaagacccaccttgtttttttcttctcagtaggcaatagagtagtgtcgtcactgatactatcgcgaggaccagaactataggaacaacaatgtagatagctagcttgctcttgttttttggtggttgacatgagttgccattggtgcaaagatttgggttatttccatatctatatattaatgacataaatatgtttatgtccattttctgaaaaattgatctgcaccttttgctgaagaagactgctataagaagaatgtggtgtcattaccttagatttaaaaagccatcctgaattctcttgagaagtccaggcggaattgttccatttagttggtttcctgtcaaatctctaaaagaagacatacagtaggatattagttcaaaaggattctaaagagtacgtaggtaaaagagtaaagtacatggtcggtccttaaagttggagcgaggtgttacttaggtccatgatcttgaaaaatagacattagggtccgcgatcttgtttaagtgactcattgaggtccaaaggacctctgaccaggttgactggcttacgtgaccgtccagagtggcagtatatttgcatttcgcccccctcccccgcatccgatccaacccttcttccccatatcttctttcagtatgatttctatggtttgcggttgcaggggctggcggcggcagtgacgacgaggagggagacgggtacggcgacgagttggcgagcatgcgcaaagagggagaagggcgagtagggcggtggcggcggctggccagtggagcgagacggcgggcagcttttagggttttggagggttcgacttggggcggtgagggcgaggtggtgtcggagagggtgaggggacgatgaaggggttcgacgccaccaatgggttcggcttcatcactcccgacaacggcggtgaggacctcttcgtccaccggtcctccctcaagttcgacagctatcggagcctcaatgacggtgatgtcatcgagttatccatcggatccggcgacgacggccgcactaaggccgtggacatcaccgcgctaggcggcggcgcgcacaccggtggatcccgtcccagctgcggccagatccctacggctgcaagccgccgtctctcgacgtcccctcgttgtctcctggc

SEQ ID NO: 76550 - DNA, 2660 bp, Oryza sativa
gtactacgtacctttgctgtcaggctgggcacgagcttggagtacgccggcggtggcggtggcgaggcagagaagaaacaacgacgaccgtgccgccattgttgccggtgatgaacgacgctccattgcacatgcagccatgcatgcaggtagcaaagctgctactctctagggacgtgctccatctatttgtaatccagcattccagctagtaaacaagtgaccaagctaataatctcactgtcacaagctaataataactagccaattgatcatcacaaaactcaatcttgattaatttaaccacgtcactacgtcagcgcatctatccagattccagtaacaaagagcgcctcgctttgtgggtcatatagatattcttccactgacgagtggggctattcagaatttacactggccacctctttgtgggcccggcatgtcaatgaccctgagggaagaggcgagtgtatcacatgggccgggagttgacttgtagcccgctggtcaactgctttgctgggcgaaggacttggaggcccgagatcggtggccacggcccgtcgacttgaccttattttccgcgccggaaactatgagcaacaagattattatgcacttgcccactacgtaaaagaatttgttctctctgtcagagaatgcatctgaatctgatctggcagttttgcacaagagacaggcagcgcaagaagatatattttgcctctgacggactgcggctaattagtactaaacataattaggtacctaaaagttttagtaggagtatctacacgactctttggattaaatgatttggtgttttctaaatctccaattaaaacttgcatgcaggtactctagaacaacacaattcagttttaggctcagctgtaacggcgttaaaagaaccaggacaatattcatctcgcataccggaaactggaaacaccggttatgcaagtattcgtcaatcatgcatgagatttagtaataggattgctatgtaagtaatatcttttcaaccaatagggctccaaagaaacatttcaagatcttcatcctgctgtgcctttggtgtctctggcttcacagacacgacgtggtgttccgcaatgctcaaccatcactgctttcagccctgtcaaaatgccaataggaagttaacctctgggcggttcgctttggtccgaaagaccgtgatattattctggcttggaaaaatgtaatttcatcctctgttcatgctctaaattagttgtaatctggactgtaatccatcttgtactcaagtgctattgcttattgacagtttgaatgaaattcaggtggggaatctctcccctccagtgacttggtaaaaaaaaatattttcaaccaatggcaattgtttcttgatttgttcttatctaatgtgcagccaagtcttggcggagctggcggcacaagaaaggagcacatccaaggctacggaagtcattaagggtgtgtttggtttctcgtatgtccccagcctggccgtatccctcatccaggatgccctcagcctggctagggtaatgcaattggttgtgtttggttacttgcatgggtttatcctggatgatatgagatgttgtttgggaggagctgcgggagggaaggtgaggcaaacgagcacacccgctcagcaacgagcactcccgccggctacgagagttcgcagcagagggagcacccacgacggtgcacaggagccccaaaccctagcttcttctcctggggagtgaaatgaggaggggatgtggccgtgcggggaggtaaccctcgcctgcaacgaggggttgtgtgggtgcagttgcgctgcaccggatcagcctggatgcgcagcgatgctcccccctcgcgtttctgctcaacttggcccagacggcgattttgaatccgcctagcctgactcgcgggccggtccagccaaccaaacaagttggattttgctggcttgatgcgatgcaggtgcggtgcacccattcaaatacgccctaattgatgaaggtggaggcgcggggaaggagcaactacaagtggtcactagcggaggcggccatgtggtcgccggcagagatggctgagtagggatggagcaacccctcacggggaggaagcaacggcaagcagctggagtctgtggacagcagaaaaagtaaatagtagaaaatccttttatcaggaatttttgtctaacaaaacgaccttagaaactctaactaggaatgaggctactgagtagcagtaatgagcaaaatattaacctcttccgtgttatgcttgctcctgaattcttgaagtcatttatggcttcttggagtgcgtgatgagtcggcagcaaattattcgcgggcttgatctctctcctctcacccccatcgtcatcggctcacatcattttattacacttactcttatgagtgaatacaatggatgtgacccttgttcatgttacatgatttccattgcttgctagtccactaagtgacatggattccatttgatatctcatcttacattatcaagcaaagtacatttattgtgggaaatcataaaatttggattctaaattcttgataactatattccaagataaaaaaaattattaggtgtatattgacttttctcttctt

SEQ ID NO: 76551 - DNA, 4402 bp, Oryza sativa
agtaaccaatcatagagacaagattcttgtgatgaatccgggttaaaatttgagcctaacaagtgaaattaaccaattatatcccactagcaacaacttggtgtaagtataggcaaagcaaaatatcaactgcagctgaagaaattttacctccgcgaggaactccttagcaccttgattggaagattcagaccgcaatttcactgccacttgagtgccatcctccaagaagccgtcgtaaacgtacccaaaccctccacggccaagcacccgctggaagttgttcgttatcttctcaagttcattgtacgtaaatcgacgattcttaagttgtagtgatgaactatgcccgtatccgccatttgacgacacattgctcactgtctcattttgtggcttcacagaattgctcattgctgctaaaatatgtgaataagcatcactagtgttaaaaggatgaacaagtagatggacaattactgtgtttataacaaacctcaccttgctttttccgtctcaacaggcaacaaagtagtactgccactgatattatcaccacaaccagaactataactattggaataactatgtagatagctagcttgctcttcttttttgctggctggcatgaatcgccattagtgcagaggtttggattatttccatatctatcaatgaaataaatatgctgagtcaaatataatttattttctaaaattgacctggggttttggcaacttgaaaatagaggtgttatggtccttaagaggtactccctccgtcccatacaaaataaacctagtatatgatgtggcacatctctgtctagaactccagattcgttgtgctatgatgcgtcatatttcgtactaagtttgtcttttatgagacaggggcagtaccaaattttgttatcaacttggtaccttctcaagtgttgtaaaagttctctttaattagaagatattgatgtgtatacttaccttagatttagagagccatcttgaattctcttgagaagaccagacgggatcgatccactgagttgatttcctgtcaaatctctaaaggatgccatatcggttagaaatgatgctaagtaaacaatacatgcagaatttggtaaacttgtcaagttactacaaacttacagaaatgtcaatgaaggtaactgtgaaagggcgtctggaattggacctgtcaatttattatttgacaaatccctacaagatattggacaagagatttttcaaatttaacacgaaattccacaaataattttaacaagtgaacatcgtgaactcggaacttacaagttttgaatagccttaagattcccgaaataggacgatacctcaccgctcaaaccactggaggacaggtttctgcaaaagacagtatgatcagatgacccagttgcaatttgcaattaataatctccaacttaaattttttcccccttttattttttttcatgaccacaaatccttactagctcgatacacatggactgaattacttacaggccaatgattcttgcagggttagaaatggcatagctgcaggtcaacttgtcccacgcaagcatcttcggaacacatgggtcacccatccagttcttcaccacctgatacttctccttgatcgccgtgattgcagccactgccaagtgcacacatattaattttcacaaacacgcatgacatgcttgataattaatcttacatgtgtctgcaaccaatgtgcacgcacgcacgtaccgtcctctgggtcagtgccaatggtggcagtggggatgacggagaacacctcgacggcgttgatgagcggcggcagcgtcgagttggcggtggcgttgatggagatgttgtactgcgggtaccgtaggaatgggttccggttgaaggtggcgtcgttgtagaggtactccggcttgaaggcggtcagggaccacggcttgccgttgaggttgatgtagaactcgcgcacggcgttgccggggaggagctgcagctcggagaagtggaagatggcgatgtacccgggcgtcgggtcgttgggcagcggcacggggtcccaggagaactcgatgttcctggaggcgttccgcggcgtgatcgccgtctgcatcaccgccgtcggcgtctcgtacatgtcgttgtctagatcctgcactttcttcgtcgatgatatctggctccatttggtcgagtccacccacgggaaccatatcctgtcgtgcggatcatccgggtacctgcagcaatgcagctcgatcaatcgatcagctaagatcttaatttttttttagataatggaaatggttaacgtaagatatgaatttaaattgaggcttggatttaccttatgacgtcggtgtaatcggtcgggccgaagttgagccggccgaggaggacaaggccctgcgtggcgttcgactgcgggtagagcgtgttcttgagaggcctcaggtccaacccggagatgaacggcgtcccggcgccggtgttcaccaggcagacctgcacgaagtcatccggcacgacgacgatggcctccacgatcaccgcgtcgccggggcccgtgatgttcaccatcgtccagtagttgacgccgacgtagagatcaaacacgggtagcttgttgaggccgtcgtagttgccgtaaaagaaggtggtgcggaaaaggtacttgagcccggcgacgagtgaccggagcgtgtagcagttgcgcttgccgtccgggaagctgcgcagggtgtggtagcgcttggcgagccccggcgtgatgtactccgccgagatgttgtggcacgcgccgccgtcggtgaagccgtcgtccgccgcgtaggatatcttggtcttgtcgtccacgaagcccgtcttccccgggaggccacagtctacgctgatgaaacctgcagccaagcatattacacacgctagcacattgatttcattgtgaagcagcactacctagttgcggatcaaaacttgaaagacaggacatggtggaatgtaccgttgctgtcaggttgggcacgagcttggagcactccggcggtggcgacggcgacgaagcagaggagaagcaaccacgaccgtgccgccattgttcccggcgttgaacgctccattgcacatgcaggcagcagcgagctaactgaactactgaagcataataatagggacgtacgtgctctttttatatccagcgttaatctgcccagtaaataagtatcaaatttaacattcttaatatcacttactacaactagccttttatcacaccatcgaggttagtttaaccacgtcagcactcagcacatctgtccagtcgtcgcttgccaattgtcgagcgccgtagtcgacgcgtcgcatatgtatggactgtttcctctgacgggtgggcctattctgaatttaccaaggccagtagggcagtaggccacctctttgtcaatgcctcgaccctctatggccctggaattttttttacccaaataaaatgaccctgcaactaactggggaattgacgagcaaatcacatattcacatgggttggagttgacttcagtgcagctgggcgcatgattggccagtggactcttgactttttcgccgcgccggaaactgcgaccagcattctgtgtgggcagttcgtgcagatcaaatcattggccatgatttcatgagagctcgttctgcattttgcgtactgcgtactggtaattgttttcttattatcatcaacgattttgccagcttggttgttgatcttgtggctcgtcccagaattcgtctgaatcttatccgggacatctggcagttcggcacgggactgacgggagacacgcagcatatgatgatattctctgacaaactcctgatctgctgtttgtgcgcagaatacttagtagtaagtggtatagtattccagtaaccaagcaggcctaatttgggtaccacaacataaacgcattgcactgcagtgacagagacagaaaaggtcaatatacgatcagctgacgaaacatatcttcagatcagcagcatatacaagacacaacacgagtgttgcttatgagaaatagcttcatcaatagcgcttttcttattacgcttgtagttaccagcaatccaggagagtatccgtggattcatacaggtgatattatgcatattaaatcaaaactgcgtagcgtggcccaggtttctcaacgggaatagcaacagcttctatatagaactacagattggattcatctcgctgttcgaggacgatgacgcagactggtcgaaagggtttgccacatgatggagttcatatctggctgttcgacgaagatgatgcagactggtcgaaagagtttgccacatgatggctggggctgcaggaatta

SEQ ID NO: 76552 - DNA, 1396 bp, Oryza sativa
atgcatgaagtataaattatagataaaaagaaaaactaattacccagttatgaaggaaatcacgagacgaatcttttaagcctaattagtccgtgattagctataagtgctacagtaactcacatatgctaatgacggtttaattagtcttaaaagattcgtctcgcggtttccaggcaagttctgaaattagttttttcattcgtgtccgaaaacccctttcgacatccggtcaaacgttcgatgtgacacccaaaaattttcttttcccaactaaacacaccctaactcccctcgtctagccataatctgccccaccaataccgtcaatctggccccgccagctagccggaaggcgcgaatgatgtcaacgaggcctcctaactagagatggcaatgggtgcataccatcgggttctcttagcttgccccatactcacacccgtgatgtttaaatattctcacttaaatatccatatccatcgtggatacaaaatcgtccctatacccacacccgtgtgggtaacgggtatagatacccatacccatataattgacttgcagcatttataattttgtactataattagccatattagagttgtaaaccatcaatattttctttagcaacaatactattaattaacattagcgttcaaaggtgaggaaaaaaaattatacaaccacattacataatcaagaaatcaaataacaatttcatataactagactagaacaatacttaagatgtgaaatgagttttatgctatgatttagtagtcatcgatacttatattgctcatagtttgactcaatcaacggttttttttcacccacaggttggtgggtacgggtgggtaaagaacggacccatagccatgtacccaatagataagagttttcgcccgttagtagacccatgtgtataagagttagaacaattagcttctaatagagtaaaaacctgtcgggtctcgggttatgggtctctattgccatctctactcctagccgacctccaccctttcccgcatctcctccttaagcaggcggcggtatggtgcccttgccccgctgattttcctatctctgcggctgcccgctttcggattcaccgtcatcctaactagtcgatatagttgggtcgtttgcccctaccactagcacgggaccactgtccaccttgtggctctgatgctactaagggtgtgttcggcacccccccttcccaatcccatctccctcgttttccacgcgcacgcttttaaaactgctaaacggtgtgttttttttaaaaaagtttctatacaaaagttgcttaaaaaaatcaaattaattcatttttgaaaaaaaaaatacttccaccgtttcataatgtaaatcattttattattgt

SEQ ID NO: 76553 - DNA, 3401 bp, Oryza sativa
cggtaacccgattggaggaaagaaaatcgggcgcaactaagctactatatggctgccatattagtatactactttgctttttcaccactttatccatatatgtatacatgtggctatcttcaaaatttttttcctcctaaattacttatcggattttcgatccgatcgtactattatatttgttacaattaattttttttataataagagatcacatgattattttgctaaaatataatcatatgtttataaccgttaatactaaatgtttcatacgtaatgcgacatgtttcaacatatatttttaatgtattacacatgaaaaataaatatttcaatgtcttttttttcaccttgtatagcatgacgtttcagatgtggctggtaaagtatcggacataactacccctactctctcttctaccatatacttgctctctcttcattccattcatgcatataggcttgtagcaatctttgaaatatttttcaactaaattacttatccaatatataatccaaacataatataatattcattataattaaatctttataacaagatatcgcatgattatattttaataaaaaatatgtttcaaaccaataaaacacattgtttcatacgtaatagcgacctatttcaacatgtgttcttactatgcttcacaaattcttaaatgtttcaccatgtactactcaacatttcagtcatcggtcaattgaaacgttagaccgtctgattttttttttttaggaaatcagacgctcgatttgtagagggcttgaattttaggtgactggaaatttgtattttcaagagcttaaaatctagcaatacatttgaaaaggacacgactacatagtgcacattattggaagtaactacacttctaaaggagttaagaaaataaataaataatttaaatatactcaatattagactcattttatcacatattttgagcaaaatggatcttaaaagtaatataaggtctaaaaatatataggtcatcaaagattctataaaaaaacattatactagtgtaatgacatgttagcctcagtagcatgcacgtgaatcgacatgataactagcagatagtatgttgtcctcttttcctgtcaagtggtctcatttctttgactcttcgtcaatataatatttacgtgtccgtgtctcagtcaacatcaattgattgatcaatataacaactttcaatgcttagatagttacctctattgcagagctaagttactctacgattttactaaattacttttgaaattaagtaaattactttaaatgtttgaatatattaaatattaaatttgttttatcgtatattttgagtagagcacgatggtacaaacaaaaatgaaaataatatatgatttaaaatatataagtcatcattagaaaaagaatagactcgtgtaaccaatatttagtttcgatggttggtggtgtatagcgatacctgacgccacgaaggttcctcgctttgatgccattgcaatggaagcaagcctatctctccgacaacatgaagacgcggatggatggctggcggagcgtcgtgccataagacaaaatcaagaatgctctccatttagatttcccacttaaagaaatatccaaacgtaacttgtgcaatgtacgggttagagactagtagtaaattaactgctcctgtaattaattttaacatcatatcatctcatagagagcacggtagcagtagtaccttaatactacatccgtcccaaaataagtgcagccatggatattcgtgtctaacgtttgaccgttcgtcttatttaaaaaatttatgaaaaaattaaaaatatttagtcacatataaagtactattcatattttatcatctaatagcaataaaaatactaatcataaaaaattttgaaataagacgaacgatcaaacattgaatgtgaatagtataaaactgcacttattttgggacggagggagtaatagtttttctcacgcttttctccataaattgaagaaatgacagaaaagataatgcaatggaacgccgggctctccggcgaagccgacgcgtccggcagcacagcgctccacttcgccgcctcggcggacggaccaaagatcgacatcgagaacagctcactcctccggtggctcctcttgccgtgcccgttccaatgccgccggacaccaaccgaacttctcctggagaccgacccgtccttggcctgccagccggacggcgacggcgactaccccatccacgtcgccgcgtccgccggcaacctgaggctcgtcgccctcttgctcgacaagtgccccgagtgcgccggcctccgcgacgcccgcgggaggaccttcctccacgtcgccgtcgaccggaggaggcaggaggtcgtgggattcgcctccgacgtcgatggacggggtttccggcggcggcgatcctcaacgcgcgggacgacgacggcaacaccgcgctgcacctggcggtcgtggccggggtgctgagagtgttctggtgcttgtttcggaatcgcagggtttgcttggatcttgccaacaacgacggcctcacaccggctgacctggccaggagtaccattccagcgggtctttactccaacagaacggtacatcacttttacctcactagggcatgtacaaaaatagtgtccgatatggtcttttaagtaagacatattatttaaagaatatactgttacaatagttgagacaacaagaactcttaatcattaacgtaccaaaatatttttttactacccttcttttcttttctccaccctcatacaacaaaattttctttaataaaagttaagagttgactcttacctgttgtcatgtatagcaaccatgctttttttttctctcctctctctcttccacgttatcaaatttacttacatggcaataaagagagaccgctattatacacgtttgtacgtgcccttagatcaggccctttttaataatgtttttcttttaaaaataaattcacaacaattaaactattttatatcaaatcatgtaaatctgcattttgaaaaaaaaatagtacgaatatacttgtagtattgtatttttgttagaaacatggaacgaacataggcacccatagcacgcgcacacactatttttgtgagcatcttcaggactgagtcggtatatcttgagattgatgaagtcctctctattgatggaaacgccacctaccactaaaaaaataaaagcggtaaatacgagcccctttatcaaatctagaatttaaactagttcttagaaaaccacaccgtcaactaacttaactattaatattatagcacaataaaatataattaactttgatggataaacgaagggctgcagg

SEQ ID NO: 76554 - DNA, 586 bp, Oryza sativa
gaatatttgaagcatccaattaatgctgggtgctactactagtatcaacactacagattggtgttatacacctaattcgagtgatatggcgccaaaacataagggcttaaaagaatccaaccggtctaatcaaattcaaaaactccatggatggtgctttgccacccaagggtaccctccataatcctcaagcagcgaggcagttacaagccttttatcacttcatccatcatcctacaaaccaactccacacccacccatcacaatggctatagatctaaacatattagcagaagaagaggaagatggaggggctttacctgacctcaatgaagcacaagccaatctagaagaagaagttcctggaaggtatgttatccaggtagatgaccttgctcgagttgcttgccatggaaatgatcaagttgtacattcttttgatctcaacttgggagcttttgatctcaacttggaagcaacagaagaacaagaacaactgcatccaggttttttacttcatctaatctttctcaatgcataaaatgggttctttctcagtgcatgttgattgcattagtaaatctgg

SEQ ID NO: 76555 - DNA, 1009 bp, Oryza sativa
cagtagacattgtctgatgcattgcttggaatagctcggatcatgtaggtaggatctgcaaataataatagggaacttcacaacttagtacaatagagaccagtaataagatgtgtaacaaccttatcctgtgtgaagcaaacatagttacctatatatttaatagtcatctccatctttttgctcttgaagtggtcctacaatagaagttatgaatagtgagtagaagaaaaagatgcatgcaagaagtgagtaaaaggagtgatacttgaaagtcaaagtgaactgtatggcaaaagtcatcacagttttcagtgggaattgcttagtgttttagttacctatattaacaagagcagcagacctgaattcagaagcaaaattaagtgttttgtgtacctttatcttgtgagtcagccaaagaccaatatcaagcagtagcttatttcctgatgcatcttgctgctcagaagtagataaacttttggctataagatcctgccctgctccctcagcaacaacaataaccatgtgcttgttctctttcagccttctctctacatattgaagcaacccaccttcaccatccatataaaatggggactctggaattaagcagcagtcctgtggagatttgagatccaaaaaataaataagtacaactcttaggtagacctcggaaaaaaaaaactactcttaggtagaagtagatttgtggggtaaaccagaaaagtaggaatctcactactgtatgaagaggggggataaaatatacaggaattagacagaatggttgcatctgcttaccacatctcgacttgcaagagtagcatacattgcaatgaaccctgcaagatgaatataacagtttaagggcaatagactgaaatacatactagagaacagatagcagagtaatcaagcattcaagcttgaaatacagaaaaatcaagagatcttctgcatgagtacaatcacaggcaaaaggccaaaatgggctgcaggaatt

SEQ ID NO: 76556 - DNA, 3117 bp, Oryza sativa
gccaccaatatgaaaacaatgaggtaacgataaaataatatttaaatagatataccgtatgctactgcaatgcattgatgaataggatctattatcacattctttcagcaaacagcatacatagcacttgtacggttgtaccacagtggtaaattaccttgaagatctcatatgcacccttctgtgttccatctcctccaatgatatagacctgggtaatgtacataagcacatgagacaatgaccaatcagaagagctatatcacataggtgcaaacaaccgcatttacctgattaattccacgatcctgaatgttgtcaacaatcttttttgtatcatggccacctcgtgatgtgccaagaactgtcccacccctcttgtggatgtcatcgacactctttggcgtcagagtaaggtaattgctagaatagaagcccttgtatccattctatgataggtaatataaggtattaagaggtagaagatctggaaatataatgagaactgaacgcagtaatgattcatgtttatagttgccatggcaagcccttgtcagaacacatatccattgttctaaacttataatacaagtatacaaatttataattgcattttactaaaacaatccaaagcagcttattcaatttgccactattttagtagaataatactataaggtttgaatatttatggaaatggacattatgcaatacaaaatgattgataagcagtgataagaatctgaagatcttatggtaagctggcatatcctttctggaccaaagaaaaattagaaagatggatcaagcatgtctggaaaatgcaagagtagtatttaactagagtatttagggcctattcactttgatgccattttcaaccttaccaaattttagcaactggcgggatttcttatatagttaccaaaatttggcagtaaactaaatgtagccacttttttggcaactttaccaaaatttggtaaggttgaaaatagcatcaaagtgaacaggtccttaacatgcgcaagctgtctttctcagtgaaaaaatatgatactgtaagggcctgatcactttgatgctatttttaaccatactattttttggcaaagttaccaaaattttggctacgtttagtttgttgccaaattttagtaagtgcatatgaaatgttgccaaaattttggctaccaaaatttaacaatgccaaaacttggtaaggttgaaaatggtagcaaagtgaacaagcccttaactatctattgaagtattatgtaaccatttagagaagggcccacacctgtataccatagattttgctgacattatacatgtgcgccaaaccacagacgagctctctgatgacagtgttaagaccagggcaaaggcctccacaagttacaatgcatgctttcacttcatctgactcaaaataaacctaaaggttcaagtccaaatgtttctgttagcccacgcgcaagtgatgagtttcaatagttaaaagagggggcagcatatcataccttctgacgaggtccagcacgacggaagtgaaccccccgccggctgttcttctgaacgaccacctgtaagcacagaaatagctacctgtaaattcaccatcgactacaacatcacagtgtaaaccataattaacactgctttaccttttggggtacagtgtcatcttcattaacaaaatattgcctgataacgataagaacaaaagtttcaggattacacatggcacaaattacaagctcagatattagaagaagaaaaaaagtggaagatcaaagccttacttgacagttgaataggctggatgatcttgtagtggattgggataagtctgcacatatgaacaaaatagcaaatcatcagctcaattcacatggaccatggtttcacctttccagaaacaattcaatccagcacagtgaattggctataactaactcatgctttggcagtgataagcaaccagccaatagtgacagttcttccagtggagatatcctccaatctactcaatcaaatttcctatcccaaaagcagagaccaaaaagcccaaagcaacaacttattctgttactacataacataaagcgtcaatagcattgcagcgaaattttgacaacttaattgctctgttctatcatgccccctttcgctcctaacagactaattggctcactgcatgtccaagctcaaattcgacagtctaaaatcagcacagtatccaaaatggatttccaaaccagaaaatctgatagaaaaaaatcccgcaaacatcgcaaatgacagcccccaatcagggatccccacccagatcacttcgctattcgagtatacttagctagagctgcacttcacacagtggcacagttcaacaacgcaaaggccatcacaaaccggaacgatcggagcatcaccgcagcagcagcttgcgaatcgaagcaacgggaagggagtgtcgggagggggccactcacgggggcatcggggaggtggtcgacgaggtgcggcacgtcgtcgaggacgtagccgaagtccccctcggagatcttcacgtaggcggcgtcggcgaggctgacggaggaggcgttgcggagggcgcggaggttggggtaggagtcgcgggagatccgcacgcacgtcgcggagaacggcagcgccgccttcatcgcgtgctccggcgccgcggggggaggcccgctccgcgcccacggatcctcgtcctcctcctcctccagccggcgctgctcctcgtcgtcgtcgtccggcggaaggatgatgtgggaggacgccatgagaagagcaagtggtcgggatcggaggaactcgctttcgcttcgtttcgcggcgggtttggggaggcgtaatcgaggtttagccttttgcgggcgagaagcgaacgaggtcgtctgtttttcctggggtttaataatggcgctcgatgtgtgagtgagcggcggtggtggtggtggggtcggagcgtcagcgaggggtccggtgcgggccgtgcggcggcgctggttttgtgagccgcgcgtggcggtttttcggaggttgggctaagtttgacgccgtggaaacgtgtgggctgcagga

SEQ ID NO: 76557 - DNA, 669 bp, Oryza sativa
atcgatctcacttgctgtgttcgagctttcgaaggtcttggaggttatcaggtatttgtattggtggctgctgcctctgcctccacccgcttctcgtgcaacacgtgcgggaagagagcgagcgagcgcgtcgcgttttcatcgcgcgcgcagtaagaaggccgctcgctcgcgcccgtcaacgcctaggcgacggcttgacgagatcgcagacgttgatgcgcctgcgcccggaggattggtcaaatactggcgccacggtgggcgcggtctatgggctggatcaccctccgtttcggacgcgcggactgaccgaccgaccgatcgatgcgttacggatcgtacaattggcttactcctatgcgcatattcgttcagcggttcaggtgagcacggaatctgctttgaagattaactgcacgctaatcttgtgtccgtggcggataagcttaagctatgcgtgccgtatgagactccattctttcccttcacttttgcctttgggatggacttcctttcccgattcgccgacttggctgtatcgggagaaatatattcactgcatcggaaagccaccagcccacgagccatggtgtgaatatcagatcaacgtgaaaaaaaaagccaatcatactgatgcagggaggtaatcagctgatcaatggacgt

SEQ ID NO: 76558 - DNA, 1123 bp, Oryza sativa
accgtgggtagtactcagtcttgctctcttttcccccacaccagagttgaagtccttctcagttgaagatgtctcgaagaggttggtttcgtcgctgccgtcaaggattgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacacaccagcacctccacctccacctccattaggggcagcagcagcacctacacctgcacctccccttccccttccccttccccttgtagttccacttgcactagcactaagtaatgcaaaaaattagcaatgacaaaataaacaaaatcagcattggattagttaaaaacaaggaaaaatgctagtagcaatgaatgattcacactgatgtgggtgcatcacttgggtcattgatcccctctcctgttccactttgtgaagatgagagcttcctcttttgacttgctgtgagacctccctggcaatgcttcgctgtatggccaagctcatgacattcactgcattttttccttttactagtgctagcctcatcagaagctcttatcctagccactcttggtcttccaggtttccttctcaacctaggcttcttgattttatagcctagatcaacatgtgcccactcatccttagatgccattggattgaactgtcctgcataagccattttcaacatctctatagagaagcacttatccacaaaatcatccatttgtacctccctattaagctttgcaatgaaagccaaagcatgatcacaaggctttccactcacttgccaagccctacaagtacatgtcctttccttcaaatttactgcatgtgtaatggtgcccacagttacttcaacagttccagacccacatatcaatacctcatggtttttgagggtcttgctttttgcattcagagtgttagtaatagatgggattatcctttcatccattttacagggctgcagga

SEQ ID NO: 76559 - DNA, 682 bp, Oryza sativa
aacgtcaatattgacacatcatatctggagccatctgattatatctgaatggattgaacatcttatgaactttactcaacacaaaagttcccacagataatcattatagttaaggcaggaaaacaaaacagaaaaattggagcagtccaaaatttatataaactaaacataaattgcagccaagtggtagaatgctcaacacaatccatgtagtgcaggtatcagcttttcaaatgtgcatgcatataataataaagcagaagtaactaatggttgtgctggacatgtaacatatgtatgaagaacattatacctccagtgaagatttctcctcatgtaatgcttccatatccagttgaatgcgttgcagctgcataacataagcaaatatataaaagagattcagtagcattgggacgactataactgtttgctagcgagatggattgcatagatcataatcaaacctgtgcttcattatcatgtttatcatcagctttgttgaatctatcatccttttttctatcttcgttatcagaggagttcaaactttctgatgaattagtttttccaccctcaagcttctttctatgccttccctcaatgaaagatccatggaatacataaatacaattgcaccaaacgaccaaattgcaagacaaaaacatgcagcggttacatg

SEQ ID NO: 76560 - DNA, 561 bp, Oryza sativa
cataaagaaataaaattccgatttattaaaagaagttcaatgtaagcagtcaaacagactccatagtccatgtacttaccagcttattcaacaatctgtcaggcacgggaaaagatgggcaataatatgtgctcaaattatttggatcatctgaaccagcagtactcccatatgagaaagggacagaattataatcagcccaacctgtatctgtcccatttcctgtataaagaaaagatgtcagatgtaacattgtttaccacaagcaacataaaatatagtgttgaatgtagaggaagacgtgtagatgcaaatatgcatcttagaagaaataaagtcccttacttgaactgattaaagatgctcatcaactaaattcaagcatccttcctgcaaacttacaaaaggtacaacaaaaaaatgtttgggtccaattagcattgctagttgtgctacttgtgcaagtattgctcactctcactatatcgagctccataacaatgtaactatttcctagtttggttgctagaagaatagctactgcaggaattcaacagagag

SEQ ID NO: 76561 - DNA, 1525 bp, Oryza sativa
tgggcgaagctgcaggaggcgcggttgcactcgccttgcctccacagcgcgcacagcttcgtcttgtacgccgggccgcggcggggaggacccatcatctccctcatctctctttcaccaacccaacccttctcccgcggcggcggcggcggcggcgaggaggaggaggagacgagacgtggcggcggccagtggggagacgagaagagcaaagcacgagtgccgcacggcgagttcgggagacgggacgacgacgacgacgacgacgaaatgggcctcatagcaaagtccggcccatgtggcccggcaaatcaggcccatgttctctgcgcaccattagcggcccaaccaaacaagcccaaaccaatgataatattccttccgtaccaaattataggtggtctttttttttttacacaatcttcaattgcatacttgaaccattaatttattctatgctatattcccgatgaatgcttcaaaatatgaatctagtaagataacgtgtataatatttagcactgttaatacgacgattaggggcaattgttattagtcaaacatttaccgagttatttttttcttgtaaaagaacaccctataaactgtgacaaggagtaataagtttccgggcaggagtagagaatgaagagtacatacgatacatgagctgatactgctagcagacaggagtacatttttttcatactacacatcatccagatccagttattgcaggaaggcatctcaacaccacgaacacagcattccatgcgagataggactggcacgattcaggaaggtcgtatacatcaggaggattcagggaggtcgtcacatcaggaagaagggcgagccgattccgaataagggagagttgcagactccacgcatgttgaagcctcggagacgctccaggttcatcacgtcggagtgatccacgaacagattcacctacattcacaacgcaacacgttagatacacctggaaatgcctcatgaacgagtctaagcttcttgcttgcaaaatggtctgtcagcatagcattgtaataagcatagcattgtgcacagcttcagggtctcagggaagaattgaagattcgtttacccgtggcccgtatcttctgacaaccactcggaggtgttggggttggaagcctcgaacatggtcttctcgagcccgagccggcctacaatcttggcgacgatgtctgcccgtagagagtcagcgcgctggcaaatgtcgtcggcatcgatcatgatcatgtctgcccctgcttccaagcacctctcggccctccttatcaacaggtcaacatcctcgactctttctgcaccacatcaaagtgaggaaggcatcataggaaaatgtagacagtacaatcacagagccaacagcatagccaaataaacatacggtgatagtattaaattgctttgtaactaaattccccaaggaaaaactgatgttgacaaatgtatgttgagcaacttttcccttaatgctgttttcttgcgtttg

SEQ ID NO: 76562 - DNA, 974 bp, Oryza sativa
agcaggacatgtaatttcttttgactatgaatcctggagccaaaatggccaatctgatcagctcatgccgtgccaactgagcacccacgttgcatcaccgcttactgaacggtatcctaggacttgctaacggccatgcgtggttggatcatgccattatgcggtgacaaatgaacaaaaccctgccgcatttcagtgccggttgtcgatcaatcaggccatagcttagcccattggcacgaactgaactgttaccgatcagctcaaactttttttaatccccatagcccagtattattactgtattttgttcaaagattagaccagagtgtgcattgtacgcagtgccaaagattctcctaagccgcagacccatttacgatccgttcgtccgtttctggtccccttggaagtagcaaaacgtctcaagactgaagagtgagcccatgtcactggcatagtccatgcataagaccaaagagcaatttcagaggccagccagtcccaattgtttttacctaccagtttactccaagataatgccggcctctagctagctgcatgtgccaatgagacccgttcagtttgaactttgcatccatggagacagtaatactctctggccagctgaaggtagaagaagaagaaggcaatgatgaggaatgaatgacattagcagttacagacttacagttagcagtgcacagtcattgcagtattcaggttcttccccctgttcatcttgtagataatttctttcttgaatatacagtgattagtactatctgctttagttttggatcctttttctctagatggaatcatggaatgtgtgttgcgtgtcttgttaaaaatggagtggtttgattggcagcaatcggattgtccggcgaggaaggggagtcgccggagaaggggagatgccgacggtgtgggcggcgctcaagaagtcgctcaactggggctgcaggaat

SEQ ID NO: 76563 - DNA, 5634 bp, Oryza sativa
aacttatgcccaaatatttgtttataatttcaaataaatattttaagaattattggtggtagaaattttaaaagtttcaccatcaattaatcatacactttaagtaggagggagtaatattttttcattgcttagttttctttgccgagttggctgaaaataatcgactagtttttgctatatataaaggagaggagagcaacttgcgagccttttttttctcttctgaatagcagaatgattttacaatcactattcaacgtacgtacgttatagacaaacaaattaactgttataaagttaaaggaaatatgttttaaatacattcatatataatttaatttaaaaaaaaactagataaaggtccgtgcgttgcaaagaatattaaaagagataaaataaaaaataattagaagtttttagcatagttagttcattaagcatatcatatgatgccatatccaaagaaaaacatttacgtgtaaggaccatatgatttcgcatgttattttgtggcgttagagacggcatcatttaaaatttaaagtagtatagaaaatcgccccatgaatttatggagtatatataggagcttgaaagtgtgtcggaagtcggatctatcaattcttccttccaaattagaacagacccgtacgtataaaacaacattgttgttagttggcaccccccgttagaacacaaaacaccaaataagttcgttcgtcaatttacatgcctgaatttcagaggttgttgacacgagcgaacgtaagtaacacgcacaaaagactttaattagcgcatgacttcgaacacgcacgtgcggtctcgatcacaactcgcacgggcccacgtgcatgcacacatatagggtgtatttagttggggaaaaagaaatttttgggtgtcacatcgaacgttaatttcagaactaattttagaatgaaaaaactaatttcagaactcgcttggaaaccgcgagacgaatcttttgagactaattaagccgtcattagcacatgtgggttactgtagcacttatggctaatcatggactaattaggcttgaaagattcatcttgcgatttcctccataactatgcaattagtttttctttttatctatatttaatgctttatacatgtgtccaaatattcaatgtgatgtttttggaaaaaaaatttggaactaaacgggcccatagtctcgcgcgcgcgcacacacgaacacacttagtacacgaagtagtagcttgtatgcttacgccgactaagctgctgatgtcataattaggtttgcaaatggcaatgacgtcaggatgacatgtcacatgtcgcttgtgggcatatgcatgcgagtgtgggcggaatataatgcttgtccaactagagcccttccagaaggctacaatttcaggactaattctataaaaaatgatgaaagaaattactaatatatttagggtttgtttagattgatgccattttaaactataccattttaatagagttgttaaatatatgcatccatttagtttcttgccaaactttggtaaatacataagaaatcttatcaaacttttgacaatgccaaaatttgataaggtttattttggctacaatctgaacagcctcttggtgtgaaatttatgtgaaatttcgctgtgctgttaagggtgtagtagtggttgttaagttagtagaggagctttctacctggataagtactgctccctccgtttcgaaatgtttgacgccgttgactttttagcacatgtttgaccattcgtcttattaaaaaaatttaagttattattaattcttttcctatcattttattcagtgttaaatatatttttatgtaggcatatcattttacatgtttcacgaaagtttttgaataagacgaacggttaaatatatgctaaaaagtcaacggtgtcaaacatttcgaaacggagggagtatgtcgggtcctaatcgtgtgggatatgtatgatagaaggccgttgaaaaatgatcgataaaaaattaagaactaatttataggtaaaacttttgtatttactcatgatttaaaatccaatagtagtagcttttaaattttaaattttggttgtgcaggctgataaaatatcaagaaaacgacgagggacgtttttttgcacatgatgggtgtagacaaaaaattgtgaagcggagataataactacagaaaattcgagattttagcattattattgatttattgtgtggctcaaatgggagattagaccggagaaacaatgcatgccatggtcaagattgagcagagtccatggtctatatgcatttgttttttgaactgtggtctatgcatatatacatccaaagactactaaacttgtgttacacggttttgaacttggacaagtatatacaagcatgctaatagccagctagtgcttctagtgtccaagacacagagtttcgtcaccgtggagtttaattaggtctaaatttaggtcttcatggaacattccgttaaaggtgccttctttagaccaccttggttaaactaattttacaaattattacaatggctaaactgattaatctaatgttatatattttatctctttgagaaaactaaaattggaccgcattgcaagctaactagacgttttttttttgcaagctttctctattaattcaaaatatgtaggtcagtggcggatcgagaaaatcgatttattgatgtcataatatgtctattggtgttatagtatgctaattatatttagatcatgatgttatattatatggataagcagtttcgctataggttttaccgaaatttgtcggtgtcgcctgacactagatccgtccctaatgtaggtctcaaagcattctccgcttttcgtttttttccctaaaaagaacttattttgtactgtacgtggtttctttgcacttaattttaattcttttgttcatgttctattttccaataatcgcacccctaaatgtccatttttctctttgatttgatgatgactaaaatgtcttcacgtacgacttctactctcgtctttgatccatagctagtacacaaaggggacaagaagaagttgaataatccctttttgataagatgggtgaaaagttaagctgacgttgttgggttaggcgtgacagataaatgccaaacagagccgctcatttcgtaaagatatactacttgacttgaaatcacaagtacacaccaaggacaaagctagatggttagtgagatcagcagtcgagagaaaagacaacttcataagtgatattggaagataagtagtttgaaatctgaacctctgaacatggcatgaaacttcagaacagtttcgtgttgtcttcaagcttgcaaagactattcaaagttttcttaaatgagaaaaatatattctggccttctggggttcatgagatcgaacggtaggcacggcacaggtgtgtatcatcatgcgaagatgatttgattatttgattgttaatcacgcttaccaagtgttcctgccattcagattctgttggaaaaagcagaactacttctcacaactttctgttctgaacatcagaacatggacaactcatgctagagaacatttgatggagttgcaggggctggagctttcagttgaacttgtctctataaaatggcagttgaatggggctgaaatattgcaactgaaacagatgattttgctgtgaaggtaaaggagtttaggaaactgaatttcatcttgtcagtgacagtttaaggagttcagtttgctccaacatcttacctttggagcctcaaccgatagtggctgcaaatatgtggagatttaggccgcgttctaaactgggtttcagctgtactaattcatcgtttaaagtgagcaccctttccaaactgataaacaatatgttttgtggtaaaactttatatagataagtttctctaaaaaatcaaatgaatccatttttaaagtttacaatagataatacttcctccgtttcaggttataagactttctaaacatctatataaatgtggacaatgctagaaagtcttataatctgaaacggagggagtacttaattaatgctaatggcttatattattttttctgcggctaactagctatcctaaccgctatatagagcgcacccttacttggctagacatcgcatccaaaatctttggcagaacgagaaaagatttggttctctgtagtatctcatgttcacttgccaaacaaggatagtgcagagcagtgatttttaacttctgttcttctaactttctctgaagaaccttgcttggaagctgaatgtgtaagtaggatgggaccaaatcttcagcagttaataagtttcagttaagcaattgattactagttgtgaaatcttgaggacactcttgccaataggtagaatgttagcttggaattggatggagcaacgcttcactgatgaaacctggttctcctcatgcaattctcagcattcagtagtaatcatcaatcaagctgctaaacagaatagccatggcagttactacctcagtcctaaaatatataaaaatctataatcaaatgagacattttctagtatcagattcgtattactaaaaaaaatattccatccgatactaagttcttatatattttggaacggagagagtaagtcggaatgcatcaaacggatcccaatgaaattgatccgaatctacgagagcgcaagcgaatattactacagaatatcaggggttacatgcaaaaagttcttcttcccattcccctgaaactgaaaaagatttggcacgaatcgaaccctccaatccattgcttgcccttttttgtgtcctccagcttctagaaacttctagaacccaagtaagtccaagccgccgccgccgccgcctacagttgcttgcaagccgcattggcccaggtaacacgcccgcgatgtgctggtcattctggtgttgataggaattcacagttttgatctctctgctccattctgtagcctccaggtttggcgctcaccacctgttcgacgaaatgcggcaagagggagcagatgtgcgcggcagccacaagatcaagaagacgactgctgatgtggaaggcgggggtgaatggatcaacgccctcccggaagaggtcctgcagcacgtgatgtcgttcctgccggcgaagcaggccgtccggacatgcgtcctcgcccggcgctggcgccacctgtggaaatccatgcctgctctgcgttccatccatggtatctgaacaagcacgatgtcaggaacctgaacaggtttatgaattgtttgattcgctaccgggaccgcagaatgccactagatatgtgcgagatcaaaatcggtgcttttggggagggctgtggtgaaccacaggttgactcacttatcagatatgcctctgttgcgcaaagctcggataatgaaggtcgaattgcatgagcacaacgataactttttctcatagccaagttgcctgttatctcccagcgcttgacgtaggttagagattagtaatgtgccattattatgtggttttgttgattctttgagcttcccagcatggaggccctatg

SEQ ID NO: 76564 - DNA, 2452 bp, Oryza sativa
ctctaggatttgaactccgggaacaacttcgtgaacttcatcattggtgatctcccttcatcctccttttagctttgcttaattgtgccgctatagatctagtcgctatttgtgctttactcttgtttgtgtgatagatctacttgttgtgcttcattggtggatcagacagtctgatccaacatcagactatctgatattttcggatagtctgactgtggatcagactttccgaccttatatcagttttagcttccgcataaagttttaaattagcctctaggccgaattgaccctttcaggtagatgcatatgcgcacgagtgaatttaacatgttgtgcggcaagcaaataatatggctccgatgtggctgggtgaaataatatcatgatatctataaggacccaaggcttggcactagatggtacctaagtgaggacaaaaggatatatatacacaatatgttttttaaaaaataaatctaagtagaatcatagtcacgtaaggatggaccatgtagcatatatggaggaagagatgtggcaatgttgtagctaactagtactccactcaatagcggtcttctttgccagcaaagagataggtgtgaacccccttactcatgtgctgagtaggatatgagcaggaggaaagtacgtgaatgtcatgacgggaggggcaagggacattgagcatcaagtgccaacatgttgagtaggaggagcagagatcatgatgggagcaagcagcgagaaagcaagtgacatggaggttggtaggagagaaaatgatgaggaaagggggagatttggggtttgtggctatgatagaagtcaggagtgagatgacaaaggtgagcaattttgttgatatataggctaggatgagaaatgtgggtaatttcaacaatgtataaagtggagttcaccatcatcattatgtccttttaaagtagtaaagatgtttcgtgtctatagtcatcaaattttattagtgcctattacacattaaactcgtcacaccacctcacacacttccatacccaaggtgacctcacgtagcattccgctgtaggaataatgtgtgcacttgtaaactttgataatgaattaggggtgaaaacagatcggaatagcggttataccatatcaccaaaatttaaagcaaactcaaagcaggcggtgctgcggggagtagaagatggggacgaccagaggaggcgtcaacgttgagagccacaggcaatgacgcgtcgtacccgcattcctgcttcgccgcttgtgtgcgcatgggagtgtgacggcaaacctgcctagcagcttgcattggttcgtcctgtgtgtgagagagataggttattaggtcaactaatagatggtctgtcttatgtgaaatgggtcaaatagagtggttccatgagatgagaaagtcgggttatctaccaaaccctccaccagatctgcaggatatcgccaacaccacgtctagctccgtatccatagccaaattcgtatccgccgaatatctataaacccttactatatcctcacttcggacggatttggagtggagtggattagatattatccgattcactttcacccctataacgaagcaacttttctggtaattgaaatctaggggctagatatgcaaccttatttttatttaccataacctttattatgaacaaacaaaccaacaaaaaattatccaaaatgttgccaaacacacctatataagggcatgagtgtagcaacaagctagccaacaaatgctaaataatgaccttatacccatgtaaattgtggtttttgtttgttgcctttggtgttaccagtgaaagacggtgatgagttgtgtggactatgggaaaaatcaaagtgaggctgggaaaacatgggagcaacaccgccgtcatttcgcaacagaagtcaatatagattgtggcggtgttgtatggtgaatatttgtactaaaaataagaccatcggcaatatagattaatgtatattggcaatacaatacctctgcttttttaatatagggtgtgtttgaattttattttatcaaactttgatcaacacaattacttagctagtgaaaagagtgcaacttgagctataaccaaagctactttaaacatacttaatatatttgtctatttatataaatatttttagaaaatgaataatcaaacatatttcaaagactagaaaaaatgtctgtgcgttgcaacgagtgaaggctattttaatcttattattgttcaatgtaaaatttattgtgagaattcgcttggatatatattttctagaaaattatgacaagttagcatgcgagtttttttaaagagatttcttatatgagcctttctgtattttcaaaaacgaataaagttaaaactcaactcaaatacggatctgtatttctaaaagcgaacgaatttaa

SEQ ID NO: 76565 - DNA, 4948 bp, Oryza sativa
  unsure (1)..(4948): unsure at all n locations
accaaataaccggcaaaaacatcttcattttttataatagtaaagatttagttcatgttttgagaaaacgaaggtagtacattttattaatctacattcaggaacgaatgaatctaaaccccgaatcatggctgattcgcaggacgaaagaccatggtgcatggcttatggttcacccctgcctatattgccaaacgtgattatgatgggtgatggcattaaagctactgtctctattttaaaatatatgggattttactcatgtagttatacacgaataaaatcgtttaaattttaggactttcaccaggttgctgcctgtttgacacgtacggctacccagagcctggaaaaacccggtcgtccgggcagtgagttagtttcgacgtaatgggcctagagtgaaagcaaaatggacgatccacacaggcctagggccattagcaaatacaacgccaattattcgtggatggatgaaaattgaggcccatcaaaacacgtgggatggcctggaatggaataagttcactttaggtctcttaatttgttgccggtctgattttcgtcctcggtcgaaaaaaccggatataatgtatcgcccaacttataaaaccagtgcaaacgagatccctcagcagtattgaccccgattctggctaacgtggtgcttacgtggaccttttaactatgtcttcgtcctacgtagcattgacgtagcaatctgatatggaaaaaataaaattgaaaaattaaaaattacaacaaaatatgtggggccatatgtcagtcaaacaagaagataaacatagtgggacccacatgtcaatgggtcccactacctccacctcacccccctctctctatctccctccccctcgctcctaatgggnnggtcaacagcgagtcggcgacctgcatatgcatagcggcnnagcgtcggaggtgccctagcgaggcagcgaggagnggagctgcagtgtccagcatgtggagaagaggatgtaggcgagggagcccggtgagctcgagctcgccatcccggctcaagcatcactaggcgttgaaggagtcggaggaggaggccgagccatgtcgagggccaccactagcagcagtgacggaggaggagaaggcgtgggtggtgggaagacaacgatgacaatggggtcgaggccgatggtgcctatgggcgagccctggtagatcggggggggtggattttctcgacgctggggagaggttggcggttggggggggggcgtcggcagcggtagaggggggagatggcggcatcgatgccgagagagacgtacaacagagctccttgccggggacggaagtggagaggcatcggcctggtttgtagaacgagaagggtgtgtggcggatgggcaagtgggtggcaaggagacaacgtagcaggcgagctagttaagcatcaggcataacgaaccgatggcgggcagtgaccttggcgaggtgaggaaaccatgactgttatgagggcggcgctgcggtggtcggccaactcggcgtcaccgatggggttggggagcgaggagggccacagaggctaacagagcaccgttgtcccaagctctcccgcccgatggcccaagcgacgaacaacttataggtgctcgccccccgcccgctgttggtccgcccactgcccctctgttccagctgccgcccctgcttcgcccaccacccatctgctccactcgccacccctctgatccggccgctgccgctcgcccttctccttgcagtgcatgggagtgaggggggataaagtgaagaggaaggagtgaggatgacgtatgggaccatatggacccccatcttttttttattattttgtgtgtaactgacatgtgggtcccactatttttattattttccgagatcgaattgccacgtaaacatcacgtcaatgtcgcatgggacgacgacctagtcaaaggagccatgtaggcgccacgccatctaaaaaccgggcacaatactactgagagacctcgtctgtatggttttgtaagttgggggatgcattccggttttctggactgaggatgaaaatcagacttgaggacaaattgagggacctaaagtgaacttattccatggaattaagcctgggaacggatgaaccgacaaccatgtcaccaaaattatcgatttgctacaattccacaaaagaaattaaggttttactatttcacttgcgatagatttttgaactcttatcttttgatttttcgtccgtaggatcttgtatcaagattcgtgctcctataaatccaacttgcaattacacttagttacatagcactacttaattacaatacaccaaaattagattttataactactagcatagcatattgtccatgcattgaaacaggatctaattgatgaaaataatcgttaacctattattatcattattttccgtactattaaattctacatatttgtaaataacatatgtgcatatggcctcacaatatcactttttcttcataaaaaaatagagatggtggtgggtggggtggtggatatgtgggtcattcggccacacatatccttttttcactcaaaagaagtagggagttgttggtggaaccccacgtgtcattttttcattctaaaaggtagagagttggtggcatgggtggtggcacattcaccgctaactaccaccactgctattttttttaaaggagtatagatttttttcttagattgaggaatttttattaggtctctttttttattttatttaaaacggaatgtatctgttggttgaaaattccataagatttaaagctccgaatctaagaccctcttttgtttaggctaggcttattggcctagacttttaagtcagcttattggcttatatgatttataagacaatggatttaatgtcctaagtttagtggttgagtcatacatctacctcacataagccaaaaatacctcacataagccaaaaaagcttctccaacctagcttttggcttaatagtgttaaagtggcttgtggcttcaaacaagccaaacggaaaagctgcttgtttgtttaggtttagacttttcgacttataagttggcttataagtctaaacaaagaggacctaatattaataggcagtccaaaagattattacaataatagttgaacgttttgttataaaaaaactgaaaatttgtttatctggtaggtccgggttgcaccttagacccgcaaagttaaaattgtagtgccgctgcagttttgctaaaagagttgtattattttttttaaaagaaatagtcttcataattattgtagctctttgtctttttaggagaattgtcatggaagggattttaagccattattccattcattcactttttatagcaccggtgcatctcatttaactttttgaacactgtcagatttttgcacagttgctagtagtacgtgaggctgtttgttgatagccacccttgtggttagacgagtttgatcatattaaacgtgtgtttggttgacaactataagtgtgggtaagattacttcactgcaaactgaggatccatgcctaagagcatctcctacagtctcttcaaatctaactctccaaatatcaatttggccaactctctatctaatttagccagtcaaactcttatttactccaacagcctctctattcatcctctctattatgagcctatgatagggggacccacgtgtcagtctttacaaccctttcttcttcctcatctatccccctttccccaaacccactctgctcagctcgcagcaggtgctgccgccgccgccgccaccgctcggggcgagctcgcgtggatgcggggtggccaatcggctcgggcggcgaacacgatgacaggagtgagatggcggcgtcctctactacatgccgcaccggctgaatccgccggggcatggcgatgacgacggcaggcgacgatgacctcggctggcgacggatctggcgacggcgccgacaacggctggcgacggcatcgacgacggctggtgatggtgcggcgtccggcaatgacgacctcggagatgacggttgacgatggcgccgacgacggctagcgaggctcaacgacgacctcgcggatctggcaacggcacgatgacggcggtgttcggcaacagcggatctggcgacgacgcgacgacggctggcgacggcgacagcgccgacgacggctggcgacggcggcgtccggcaacgacgacctcgacagcaccagcgatggcatctcgacgacgacggttggcggagagagaaagaggagagggatgttgttggcgtggggcccacgattggctaggctattttggctggccaaatttggctagtggaaggaggactttggccagcccaatagccagtctgttggagggtgaaattgagccaaaatttccaaaatttaacttaaagagagggataaggagaccgttggagatgctctaactggtcttaaaaagtatggcatggttttactttgtggctaaattgtagctttgattttgatggcaaaatctttggtgagcttggacaaaaaggtttggcaaatctaggcagatgaaccttgcagattgtgacaatctcatgtgtccaatgagaatgatgatgtccatgctctgctcccggaaagaagaggcaaaatccaaggagaaagaaaagaaaagagagaaatctactgattcgccgcagcagcacatggatatggataagctctgctgcgcactgcccaaataggaccatcatgtctgggactttatatccttaccctctgttcgttcgtcttagagcagttacaatataagccagctataaatatattttaaagagataaaataatagcagactataagctaactataaacatattttaaaaaaataaag

SEQ ID NO: 76566 - DNA, 870 bp, Oryza sativa
cccccccccctccgaattttttaatttttgttttatttgtttgatatttttttcacgcttagggacacacaagaaccaaccatagaaaaattgaactcaaataaacgtaatatgtgacatgtagaatttttcctctcctctcctctctccgaactagtgcagaggagagagatgtgcaacttttttatttttattttatttttttgatatttttttcacacttaggaactcacaagaaccaaccatgtaaaaaataaactcaaacggacgaaatatgtggcatatggaatttttcaaagctccaccgaaaaacttctctcctcgaaaacacaatcttgcaagcggaatttggaggttttaatatcgccgaacccgacaaagcggggagaatcggatgtaactttttctgtagatgtccgtgcatatattatttgcctgattccgagtccgtatgagaaagttatgcctattttaatagatgacatattttgtccatttcggtagagttttgaaaaattctacatatcacatattttgtccgtttgagtttattttttatacggttggttcctatgttctcctaagtgtgaaaaaatatcaaaaaaatgaaataaaaataaaaaaaattgcatctctatgtactgtttaacttatatatgtcatttcatgtggttatattttgaattagattaagtaatttcatatagtggtagagtgcattatgtttaacatgctgatcaaagggttttactaaaagagttatggtctaattttagtgaaggtgcaaagtagactaagtggtatgctagatattttcagacttagctaagtggtagttcgagtttaatttttttttgtggttggttgtat

SEQ ID NO: 76567 - DNA, 666 bp, Oryza sativa
tcaatatgcaacaacacatacaatgctttgtgaaaaatcatcaataccatacctccggcttaggatttttagctctatcatcctcctctgctgccggccgcctctttggtggtccaagatggctggaggcacaagaaatacatgttgaattacaagaatagttacgtaaacttaataaagtgaatgcataaaaaaaggataaagctcacctgaacataattggttgctcacccttttctttcattttctcttcatattcctggcacagataacttgaaattaatgggctaccatgtgtggaggaaagaaaaataagctaatgatagtacaatccatgagattctttggccattataagttcaaatcaaatgccacccaaatagacttgaaggtgcagaagcaatgggtacacattgaaaccaacaattaaacaaaaccattttgcacaataacatctcagaaatgtgcatgattcataggaaccttaagttggattgtaatagagttgatacaaataattgaacaagtcgtatctctgccaatgctggggtatcctattctttgtgaaccaagacaattgtcatagtacaaaaatgtcacggaaggcgtcgacaaatcattatccaatggcacatacagtaagagaccagtatcaaaatatcccca

SEQ ID NO: 76568 - DNA, 928 bp, Oryza sativa
aaattcagctagaaatgtatccacaacaatacactattattgcaacaaaaattagcttgcaccaagttcactcaggcacccacagatatcacaatttcatgacagctgtggcataagctaagctaaacagtcatgcagaatgtatacaaggggctaagcaaagctattagtcgtgtcacacacgactggtggtttaaatttgaatatctgccagggcaactcgttgaacatacaactgtgaagataggcaatcatgctctattgatttgacttggtacagttgtgttgcacagcaactgatatttgattatgaacgtttccccattttcacaaaactagatctggaatattgttttctcatggggaaatggacatggtttctgagtacatgaaaacctactcgtgagccctaacgcaaagagggctcatgcttagttcatgtcaacaactgcaatttgcagtcagactaattgagctactcatcaagagcacccaattccttcatatcttccaagaatgccatgtaggaatcatcaatgctttgtggcttggatactgaggacgaaggccggggctcagatctaattggagccactgacggtttcagggcagaagatgatgttgttgctgactgttgcacctttggttttggtttgaggagagccgattctctcttaactcgaactgatgcaggaacctgtaaaaaaccaatggtttttcagtacaatggtgcatctaaaactatgtaaatggaacacaaaatatatgaatcaattagctatagcaatcttagaccaactcagctgtttaaaagttcgtggccaatttgtttatttatgatgacataaagggaaagcaaatttatgtaagtgttaagagaaagcttaatagtgggctagccaactataagctcatgtggaggaagggg

SEQ ID NO: 76569 - DNA, 6321 bp, Oryza sativa
cgtcgtcgtcgcgagcctccgccgcccccgctgccagcctatgcacagtcaacctccatgcccgcatcgggataggattggtatgggagaagaaaggagaggaaggaggaggaacgagagactgacatgtgggacccgatgttaaattggagaatgtgaatagagagactgttggagtaaaatgcaaacttggctctccaattctttagatggctggccaaatgctcatttggagagcttaaaaatagccaatctgttggagatgttctaactgacaactgacagcaagtcaacaactcctccaaccaaagattctgggatattctctatggcccctattcttttctccaacaaaagttggaaaaaattttggatactcgtggcacgcttttcaaattgttaacgatgcgtttcatgcgaaaactttatatatgaaagttactttaaaatatcatattattttattttttaagtttgtaataattaaaacttaatttatcatatgttaatatcacctcattttgcgtaaaaaatttaatgaggattgaggagaaaagaaccatatgtaccaaaaccaagatgaatttgggcacatcgatgtgatgggcctgtttacctttggattgggaatgagatgagcaaatccggcctggcccatattcccttgtgggctcgtgcaatgttgggcccttacggcctgcctatgcgggcaaaaaaacctatccttcctctaccacatctagtaatttccactgacatgtggggtccacacgacggcctgttcccacgagcccacctgtcaggggcggtagtttccacaccaagagacattaccgcgttcagtgcgcaaagcactgccactttgcacactgacaggatgggcccactagcagccacacccaccaatttcctcctcccttcttcctccttcctccttccgctcttcttctctctcttctctgcatctctctctcgtcgggaggagaaaggaaggaagagggtggcaggaggaggaggaggccccccccatccttcctccctcccctgcgctgagctgcgatggcggacggcaacccggacggcatcaagagatacacccctcccgtgcacaggtccgcctcgttttgttccttcttcaatccttagcgtttacgtgagctggggggactcgtaggcgatgagaggtgtggcgtttcttggttggaatctggggggtggccgtagtgaagaatcgcattgggagagcgagttaggaggaggggcgggttgctttgcttgaatcttttgtgggtgagctgatttggttggggggcgtttctttctgatttgggaggcttttgtcgaggagcttgttcgattggatatttcgatttgggtcttttctgagcgtatttttttactgggtatcatgcttcgaggcttgggggcatttctgtgctgatgtggtcgggatcattggaagcttggtgtgttgccgttttgcttagatttgggcggtatattagattttttgagctgctttgatgggcttgatctgtggtgccacgtacaaatctgtgtccagtgtaaatcgaatatcgttttcttttatttggtgttctattggacgttggctttttgtgtttgctcataaagaacgtgtgggttttagtacatatatctttttgtcgcttgcaagctgccgtttttaagttttgtggtggtttattggctcgctggtctctctttttagcttttttgagaatgaacaaccttagcaactaacttttatccttaaaagaatttttttagaaaaatctttgttcaagctacatggctaatctaatggcttatttcagggcatgtttaatgctgacctaactacctgttttagcaagtgaaggatgacccatgattggaatttgggttagcgaattaagctaacatggcttagcaaaactctgccaaacagtcggtcagcttgtataagttaacgcatgactttaacacaacgcatataatgactagcataaagactatcatactttagttacatgtactgccagatattgaaaattgtcctttgataggtgatcgcgtaatcacaatttcacaattataagtggagttcacaatgaagaagtagatttgctaaagacatattgttcaatcagtctatcaccttgttgatttgattagttgataacttgatatggcttctttgttccatctttgtatttatgagctaaatatttattttgtttgaaaccatcagttatttcttgaaatattctgttgtctgcagtctaatgttagttattatttagttttaataatcttgctacatatcatgcatagatatgctttctgatggctatctttactgaatatgcttcaggaaccgtgctaacaatcgacgcaagtctggaggtaaatcacatttaccaattgaatcagttggatttcatgatgttttggggatttattatattttcctttattatttgtttggcttgactgctatataaggtctccaaattagttgataaggtcttatctagttgttggttgttatggtatcaaacttaattcattattcctctagtagatttctatgcagtgaaactgccatgtttcttttccacaaatgggctgaaaaatatgtgccttacaccgaccatgttgataaccactctatatctataaggaaatccttgcaagcaaatatccttgtatgagcccccctactccattgtattaatgatgccaatactctgtacaacatgcaacttcatgcatctaatgcaagctacctgcaatcataatccctacaatcagtcatttacaagtcaaatgtgttttttactcagagtttacttattatgtccaatagctgtccagaatcttctaaccttgacatgtctttatttgattatgcatatttccaataatttttttatgggctatcttttccttatccatgtgttttttttaatgatttatctgtatgtttaagcataacaatttaatttatgaggtgatttttttttggctgacattgtaacacttttgttataccaaacagatagggctgagaaggctagttatttgtacaataatgatggagagaagagccatgctccttcattaaagaaccttccaccaattatccctcatgagacttttttcagcaatcctcagaatgattacagtcaaacaagattaatacccttggagggatgttgtgccagtgaggctgcccagcttctcaatgaccgtatgtttctcagagagaccaagcttcccttttaactgcttgtagaatttctatgatataagttctatctttttgactttctgggaattgttgcatgttattgtggtagtgatacattatgtctacagtaataacatactactccctttgtcccaaaatataagcattttttagcatagtgctaagtcaaccatttttaactttaactattaatagcaaaaaaataaaaaaaaatcaataatgtgaaattgatgttactagatttatcattaatcaaactattattatatgcaactctttttatttaaaacattttatttctatagatattgttggtcaaagtagcatctcgaagactatgtcgtgatccaaaaatgcttatattttgggacggagggagtaagtagtaaaagcacatgcagtatattacagaaccgcccattgctttaataagtttacactggctgataatccaatattcagatactgtaagttgtaaagaaaaatacgtggagcacctgttgtgatttattttggggttctctgcatgttagtagcatggaagaatattcaaactgtgtacctactgcttatcctatcttttttgttcattaatcataccatcaactgttctctttatgtgcaattgtgcatatgccaccagtaatttaccggaagttaggcaacttttaatcaaggatggtctaagcatatataacaaatatgtattcctacagttgctgtactaattttgaaccaactttatttacaaccattcttcttatgtgataataaacctttgctgcttttcccctgtaggttgggctgcagcaatgaacttgtacaatgatcagtcatatgattcccctggtgagtccttaatcaaattcaggccgcatgatgggagatttactatgtcatgaatcatggtagaggaatctttagatattttaggatcaatttctacaagacctggcatactatcctagacctatgtttaatttagataaccgtttcataagttatgatagaaattggaggtgaatataaagtgttggcaacagtagtgacgccgcacaattatggtgatagcaattatagtactgtatagcaattcgtgatgttaatatgttattatgaacaccatcaagtacccaattgtgcactcaagtgaattttcatgtcagttgtaccaacgggaagcactaaaccaaagcccattaaatgctgttgatgttttgccagataagccggtgatgtactctggatctagtggatcatcatggggtcatggtcacatgaaacttcctcatcaggtatattgaacctgcgattttgtcatactgttctcctacgtcttagtttctgtactctgattccttttctgtggtcattggtagtacagatgaacttctctgaggagttgcgccgtgccctagatgagcaaccagtcacaggaccgtctgtcaacacctggaactaatcaagctcaagctgcattggagtgctaagatttacaaaaaagcaatctattgccagttcgctgtgtgttgtatcttgtactgaaactgtatgcatgatgcgactataaatgctttactctaacttgcaactcctttggtttataacagaaacggcaatcctgcccatttgtaaccttatggatggaaagccagcctgctgtatcatgtggagtactttagcatgcagaagtgcagactatataaaccaatgctatatatatatccctcttcttaagggtgaacttttgcagttttgtcagatttgttgcttcgaaagcatttttttgagtaaccttatttatttaagtgaagaatgcaatttgatgtaacatgacaaaaggctcgaatattggcttaagtgaacagatgtatgataaatacacaagacacatctattcatcactgaattttgtggagcagcatctccaaacagtcattgcagagaacagtaaataagtagcacagcaaaatggatcagctattagtgaggatgaaaaatgtcggttttaggcaaattaacatccacctgttgtccgcttgaatgatgtttaaagtaaacagagaggccatgcatctgaatctacaagaaacgagattttcgtcgataatacaggtttgtgactttgtataactacacaaaagagaatggtggacttaagagcctgcataaatttgacaacgtttgacaacgggtgccggtgggcccggtcgggcgcgagacggagacgagtagcacgattagcttcgccgcggctgaggggaattagttcacttggtctggtctgaaattcatctataaaccgaaatatcagatacaaagaaaaaatggttctatagcattgaaaattcatgatttgagttttatattaaaagttttgggttcactttaatagcattgaaatttacattcgttttaatttttagcactctgtcaggaattcagtcaagtttcatacttattttattttttttgtcaaagaaaacatgcaaaataccgataatgtccttctattctttagcctttccgttctcccatcttgcgctcatcctagacttcggccgccgtcctagagcccatccgccccagcagccctcaatcttgcccatgccaacaccctcgaggccgacactcgcctgcggccgccgccctcgagaatgcccaggccggcgctttcgagcagcggagctcgatcgccataggctgccatggcgatgctcgtgtctgggctcgccatgctcatgataacacgtcaccatggccaccggtaattaagttcttgttcctgcacacacagtgatgttgaggcggcgcagattgatcgaccacgatgggctgatggcagtgacaccaataggggcaccaagaagaacctggtgagcagttgagacgatgcaggttgcattcgcatcgtccctggcgttcgtggtcagccgcttgcctctactagtgagcactgaacagcatcggcctggccgatttcagcgtgggcggacgcctacattgttagaaacacagatatgttagttaaagataagagtcaa

SEQ ID NO: 76570 - DNA, 19332 bp, Oryza sativa
tttgtatgtaatcaccgaaataaattcaatagaaattttggcatgacctcccctcttttttgaagaaattttgaagcttgctcgggcagctggaggaggaagaagacatatatataggggtgggactttagtcccggttggtagcaccaaccgagactaaaggtcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctctaccagtgctggtatatattcgttgcttgggaacatcccccccccccccacacacacaccaaatgcatggtacataaagaacaaaaccaatcacaattaatcttcccttatttaattctacgtattttcttaataatcgtgtttaactcttaaactttttatattctgagatgaatgtagtaatatttacgagttatcaaacacatttcatttgcatatcggtagttccacgacttttctcaaactaataatgtgccaaaaaaatcgttaaaaatttaacaagatagatcgataaatggtatatcactatacaaatataatatatatatatatatatatatatatatatatatatatatatatatatatatatatatatatatatatatatatatatatatatatgtatgtacccgagctcaaatctgttcatcgtagccactccgattttaaatctgtgttaaaaatttaacaagatagatcgataagggagatggaaaatctgcacgcgagtgcacatatacccttgacccccgatagacacctgtccccggtagtgtaatggtttcgtgtaattgatcattaaaacgtagagtggtcttgtacatctcgatggcgcatatggcgaatgagtggtaggtgtcagcacagagcgatgtggttttgacatttttacccttcagcgcttgaaggtgtaatgatcaccacgccgcttcttgtgttgtttccacagtgcatccactcagatagctaaaggcccacaacaagtgttgtttttttatgccccatcgatgccatcacctaacattactataactcagcaatgcgcgcctgacgccatgcatcgtgtcagccatatatgcgaatttttttcagagaacatggatccgtctcactcggatggatgggtcacaatggctcctgctgatgtatctgcacacaggatacatcactccattgacaagatagatcaaggctccctccatcctaaaatataaagctcaaccactcataacacaaaaccaagaaaacatttaatcacctttttggttggatcaccttgatacatgcaagcaatatgattgaaaggtttgatggtataggatttaaaacaaatcaattctattggaccaagaggtgttaattaatgtatgtatacatgtacgtcttatattatgagacataagagaaaagtggctgtaccttatagttcatactccctcggatgggataggacatctcatcctagattagtttttttgacggagaaagtatactaatttgagttttctgtgttatttttgttataatttatacaagttaaattttaacttgcatatttgtgaagtgatatattacatagaagtattcatctatcacatgtgctttttttgctcagagccagcggaaaatagactactgcttgatgacaaatctgtgagctagatcgatcacgataccatcaatgtcatcgctgttacctggctgcccactcaagggcatctggaaaaggttgcacgtgaaagtcaattcttgatgacagtatttttgtgcagcgacttactacctccgtccaaaatataagtatttttagaaaatacagatttgcactcgggttcatatgtacctacaatctacaccgttgatgtgttccaagattcatgctgcaaaatgtacctaaccttaaccaaatgaatatagggagaaaaatattaggattaggttggttcacaatatgtataacatgtatgttgcattttttaccaaataatttttttcaataccaatcatatatgacatttatatatatagtgcattgtatttttctaacccttattttgtttataacatgatatttagtcaaaatgagaaaccaatatatctacaatatcaccaaattgtcatcttgcaaaaatgatacttccaaaatgatatatatatcctaccatcaaaaactacaaaaacaaggtaatttatataaacaaggtaaactacataaacaagttttacatacaagaaatacaaaaattacataaacaaggtattttacacttgtaaaaaatatagtataacgtaaacatcatgcatcttacattttgttagcacctaatatacttgccttaagattcgcacaagctacatatagggtgtagattgtgggtacatgtgaactcgcgtgtaaaaaatccaactcctacggaggtagtacctcccaatttatcatactccctccatcccaaaatataagtaacaactactcataacataaagaacaagaaaaaatttaatcaccttattaattaaattacatccatacatgcaagcaatgtaattgggagacttaatggtacatgaaataaaataaaccaaatttaaaggaccaagagatgataattaatgtatacatgtatacacgccttatattataatataagacatagagaaaaactgattgtgacttatatttggatagatggagtatcatccttgctcttcctggaatcgagcttaaaagcctgctacactttaagaacaaaaaaaaaagtaataagggatcaaaaaattttgcctaacaccaccctacatcttgatagaccgtgcagacatatttatgcagaagtacgttgtcgtgtactgcctagtaaataaacacatcttatccactactatgtcagtcccaaaatacttatcattttgagtttttatttgtaatcattcgttttatttaaaaaaattataaaattattatttattttgtttgtgatttgttttgttatcaaaaagtactttaagtataacttatctttttttatatttatactaattttttaaataaaacgaatgctaaaacattgcaaagaaaaaatcacattgacaacaaaactgtgggatggaggatacgtgctgctggcttcctacagacgcacttaaaagtgccatctgctgtcttggtgtcccactgactctcagagaatcggccattgaagaggaatagctcctatctattgccgcctgtactaatatgaatggcgcttgctcccgcagcaccaagggcaaaacaggaattctcgctctcggtacctgtgtagcaatacgtacaaggtactacatgctctatgtttaacactgcctgccgtagtactaacaagccatccaccatcattcttgtgacccctacatcacgaatctccgagcatctgacggcaaggatagtgggtacatatgtacccgagctcaaatctatgtgtgtgtgtgtgtgtgtgtgtgtgtatatatatatatatatatatatatatatatatatatatatatatatatatatatatatatatatatatatgtttgtaggggtgatatactgatatatcacatatagatatatcttgttcttttttgtttccaaatttgttgataacattttaaatgctatggaaaacaatggtatatcctctcgagagacaaatagacttcctccccatatacacaaggaatcaagacatgaatgtcaaaactttttctcctttttgaggctataataaagttataacccactaactcctaaagtttataatgcaaagatgccacatcattagccactaacaatcattatatttaaacatcatgcaaaaatgctatatctattaacttattaaagaaatagaaaaaaaaaaggagcctccacgttcactcttacggtctagaaattcttatattaatcggagaaaagaaaaacagagtccatatagaaataaaatttagaaatagttgaaattcggaattaaaaaatgaggaatattagaagaggagactatagtccatatataaatataatttagaaataaccaaaattcagaattaaaaaataaacattatcagaagaagagtatagagtccatataaaaatacaattaagaaataatagaaaattggaattaaaaataaggaatattagaagtagagtatagagtatatatataaatttaaaactaagtaaaattaggaataaacataataaaattaaaagtagagtttagatgtccatataaaaatacaatttacaaattactaaaattcgaaattaaaaaaaacatgggaagaagagtcttaatacaatataggaattcaatttagaagtaactgaaattcgaaattaaaaataaaagaatattgaaagatgagtttagagtccacgtagaaatacaattagaaataataaaatttcagaattaaaaataaataatattagaagaagagcctagagtctatatagaaatacaatttatagttaacgaaaattcggaattaaaaaaataagaaatattgaaagacgagattagagtccatataggaatataatttagaaataacggaaatttgatattaaaaataattaataactaacacatatataaaatataatatgaattacacattagtagtttcataaagttagtacaaaatttaaaattatgttgtcattttaatatattttaataataaattgtgaaaacatatatgctattatatgagagaaaatataatgatgctagccgcgcaatctgcgcgggccaccatgctagttatctataattttataattgattatactataaagttataacccattaactcctaaagcttaacatgcaaagatatcacatcatcatccactaataatcattacatttaaacatcatgcaaacatgctatattatctataactttataatttattatactataaagttataacacattaactcctaacgcttaacatgcaaagataccacatcatcatccactaacaattattatatttaaacatcatgtaaacatgctatattatttataattttatagtttattaaatttttagagctcttgaaatgcaagcatgttaaatcatcatcccacaaaatccacaaaatatttcaatatatatctcccttatttttttataatattctatgtacatatatttcattctcacttagttaatgttatttctttcttctctcattaagctctaccacatcaattgtttttagtgctaaatggttaatctatggcccaaattatctctatcattttcttttctcattaagccatatcaactcaattatttttagtttttagatgattaatatacggtccaaactatctccctatatttattctctcgtaaaatcatatcaccttatttttacatttaaattatcattcaatatactatttaaattaaaattatcataaacaacgttaacttatgtaatcttagttatctagctatgttacacattatttttatttattgttgtcatactaaactcctgtagcaacgcacaaggtttcacctagtgtgtttaaatatatgctcccatcattgtaaaatgtaaagaattttggtcgaatatgatacataatagtaatacgaatctgatctaaaatataagggattttgatcagcattgtttagaaggatagtcgtccttctgttccctcccctcaagtccatgcatgcatgcatgcagcgcagaagcacaactccctttgtgaaaatcagaaaaacaagaggtttgttaacgaaatccacgctcttacagcgtattctggtcggacgggcaagttgcagtacgcaggtatgagtaggacaaaatctctctcgaaggcaaatactacatatatagctgaagccttccttgagtttccttcataaggatttgcagagatgctcttgttctacacatcacatttgcgtcccgcactaagagcatctctaatagagaccatagactcagtcctaatcaattttcgagggttaagatataaaaactagattcaacaccgaccctagtaccctactaaagctcccaaagtgagaagaccccccgatcctcctcccaagcccctagtcctggggctccgagtacggcccccatcgacttatttttctagcgtgaaccaaaatttcacttcgcgtgatctagtctcacccgcacggcactatgacctggatctcctccggcaatcgccgttgactccccccacccacctccgccaagatcgccccaaaaaggtgaggtttttcctacctttgttgcagtcgtctacagggcctccgcttgcacgcctggcctccgcctgcatgctggtcgttcacacgctcggccatcgtccacctggccacacgccgcccgcccgcccacacgctggtcgctggtcgttcttatataaatttcaaatgcacaaactgcacaaagattttgcataaaatagtttattgaggaaactctattcattccttaaggggatgtcccttcgtttttacacattgcttaaaaagttataaaaaattagtaggatcaatatgtgatatgtcactccacaaacatgtatgttcaaatttaacttatacaattaggaaaaaaattcatagaaacgcgtaattcgtggttaaatttattatttttgttttgagttgtacaagtcgaattttaatttacgtgtttgtgaaaagaatatatctatcttagaatgtttttattttttatgacattttaaacgtcatgcacagtatgagaggatgccccttcgaggggggaaataatttacttccagttcattgctcaatttcatcggcaagcaatctcactttcaaagaatgacagtcacaaaaatattgctactagtaacaaccgcaattactgagcagctgacaatacatacagttaattaatcacaaaatactacaaatagaagcataaatatgcgggggttaatataactaattaacttgtgggattaattaattgcttttctatggattgggaacctatcctctaagcacgaaaaacggaacaatccattagcacgtgattaattaaatattagctaatttttttaaaaaaatggatcaatgtgatttttttaaacaactttcgtataaaaacttttttaaaaagcgcaccttgaaaaacgtgcacgcggaacacgagagagatgagttgggaagactgaacaaagaacacagccctagtgatatttgtgatcgatcacaatggcacgtagaacacctcccagcgcagtatgagtatgacgacggccggagtgcaggctccgatggcgatgaccaggtacgccagccaccgctccgtggggaggacggtgaggtagacggacgtcatgagggagacgatcatggcgaggcaggcgacgacggtgaggcggtgtccccaggtgagctggtcgagcttgaacttgacggggtccctccacgcccagatgaagcagaagacgacgacgatggcgctgcacatggcgacggtgttggacaccacgaagatcttgaacggcgccctgtcggcgtggatggcgagccccgtgttctggttgtagccgccgggcatggtgaatgtggcggcgaaggtgacggtggcgatgagggtggccacgagggtgtaggtgccgacgctgagctcgaagtactcgtcgttgctgccggagcccggccgccggctgcgcagcgactggtacgtcgccaccggcggcagctgctggttcttgcaccgccgcgactcgtacttcttgagcttctcccagaggtagacgacgtaggcgtccatctcgccgccggcgacgcgctcctccacgaggctgcgcgccgagtggccttcgcggttgaggaggcaggggtcgacgcgggggtccctgagcagcatcagcgccgacttgatgcgggccatcttcgcggcgaggtggagcggcgtgtcgccggagttgtcgccgcggttcaccacctcggcggggcggacgcggccgaggaggcaccggagcgcgtccaccttgccgctcgacaccgcgacgtgcacggcgttccggccctcccggtccagcatctccgccgcgtcggggctgtgccggagcagctccgccgccgctgccgtcgagccgtagtaggccgcgacgtggagcgccgactgctgccgctcgttgcggcggtgggcgaggtcgggcttgtggtcgagcagcatccgcaccatgcgcttgtcgttcttctgcgccgcgaagtgcagcgccgtgttgccgacggcgtccgtcaggtcgatcagccccggcgccgtcttcatcagcaatatctccaccacccctgctccacacacaaacacactcaaatctcttcaaatttgattcaaatgcctcaaaaatctattcacctttttttttaaaagtatccatatacccctctaaactaacgatggaagacggtgatctaacactttaaaactggactttcaatcccaaactttgtaatatcattcattatttaccgctaagatagttttgaaaatcgcaagcttaaacaattactcccagtatcccataatatagcaactagcaatctaggataggatgtgacgtttcatataatgaatctggacaggcctcctgactgattcattagaccataaaactaattatccggttctaggttgctaatattaaaggacggagggagtatgtagtttttgaataattaataaaacatatttacatatcatcaatcattggttattaaatttatacttatataatgatgttatgtgtaagagcgtaagcatggtaagaaagcaaagtttaagtgaaggtttgaacatataaatgttactccctccgtttcatcatgtaggtcattctaacatttaccacattcatattgagatatatgtctagattcattaacattcaggggttggatgtggaaaaaaaaatattgagtactggaattcatcaaaaagagtactctttgaattaatttgagcaaaatttcttcttacgggtgtggccgccgaggacggcctggtggagggcggtgccgctgacgttgtcggcggtgacgaacttctcggggacccatggctggtcgaggatcttgtcgacgacgtcggcgaggccctcgcgggcggcgatgtgcagcggcgtctgcatgtccacgttgggcgtgtgcccgcagttgggctccgcctccagcagccgcagcgccaccgcgctccgccgctgcttcaccgcctcgtgcagcggcgtgttccgtgtcttgttcatcatcatcagtggctcctcctacatacatacatgacgtacatttttcgcataaatattatagtcttaaatcttaatccaaaattgtatggtcaaaatatactttatatttccctacacggagggagagtaacgtaattatcaactcgcaaagcactcgtaggagcaagaatgtatttatttgaaaagaatatacttcattcgtcttgaaatataaggctctatagctctgtaaaaaagggaatcgacatttgtacaactaaaatgacaaaatatatggtattactaaattcattttttgaaagaattttcacaccatgttaattttatggttgtttatatttttaaacagataaaagtatatcacaatgagtgatgtcttttagtgattaccaaaaggtactaacacacattataatgctgaatttgacagctctcgatttcttacatatgagatttataaaaagtatcaaattctacattgcaaaaaaatggcaactctcttgtcacaattatataccggatggtcgaatttcttatattcaaccagggttcaaaattctaaaacgaaatttctgaaacttcgagtctattggaccccacacctagaaaactatttggcctaaaattttcaggttatttacaatttttttttgtgaatttagaaaattttatttatatttgacaaatcgttgtgcaaattttaaatagtgtcaaaacgaaatacccgaaatttcagttgtatcggtacccaacagaaatagcctaactgaaatagtatcaaaccctgtattcaaccggtgacgacgaattaaagctagaagaaagaaaacggacggatacctccggccaacaaggcccagccatggtgatgaaggtgatgagcatgtcggcgacggccatcttgccggccctggcggcgaggtgcagcggcgtgtccccctggtcgttcctggcgacgaggaggtcgccgtgctcggcggcggcggcctcggcgaacgcgacgcgcccgagcccggcggcgatgtgcagcgccgtgttcccctgcggcgtcgtcgagttgaggatcttgccgccgccctgctcctcccccagcagcgccgccaggctcgccgtgttcccctgcaccgccgccttgtgcagccgtggatccatatatgcttcttatttcctctaccttctacctaccttagctacctagctagagctagcctctgtacagtacagtgatcactcctctctctgaatgtctgaatgtctcgtgtattcttctgtcagtgtgtgtatgatgagatcgatcatggaggtgatggtgatgcagcaatggcgatgctgatcgagtagttgtaacttgtatgtactccatgtactatgtaggagtagtgtggatggattctttgcttgtttgtggtgggcttgtgcagttgtgccctaccctgccatggaagctaggttcatggtgctttacttgctaaaccgaatgtgctaaatgctccattagaaaatatatatgcagtctgatgtgctctgtctccagctcctgccacagcatgctttactggccgtcatgcatgtagcacaaggaatcaaagctttaagatggatgtggatatatattacaatgtttgattactctaatttcctcctgaaattataaagccatgcgataggtttggaggcagctttgccaaccatatgatccgcattggtgatgacgacaaaatcattgaagaattaattttgatttttcaactatccatataaagaggatacgagattgagagagaagtaaaatgcaattaacttagtagtagttgttaactgacttcagttagagagaatcacaactttgtctcaagggtcaagcgtcatgtggacatggcaacgacctctgcctcgctggccttgacgctttgtgcatgacttcatgtcgctttgttggtgggttaattatgtgattgtgcaagagtggataagtgggttttacgggttttactttgttgaggtataggaaatcaattaaatagccaacaaaataaccaatttatcaatgcatacggccacatcctaatctttttgcgaaactttttgatatgccggtgcacacccggaacccctgggtctatctttgctcgatgagatcccatggacagaagaaaatacaagagaagagtcttatatacaatattatttccatggtgttgttcatataaatcgttacagtatcatacggggatttacccaaccatgccgtcttgatatttcatgtggttgattaccgttttcagtaattgacaactaattcagtgattcaagtggttgagtaaaccatttttctactaataaaaatagaagggttttttcttccgtcgacaagtaaatataacacggtaccatatgatctaatactaatactagtagaaacttgatatatctatcgataggtaagacaaatttgtctatcaatagtggatctcagctcctttggaacacaaggttttgttgagttttttttttaaaaaaaatcatctaattaaagttcaccctttttagaggagtcgaggccggaacttcttggtaactcgtaatagtaattataacacgataccatatgttctaatactaacagtagtaggtacctgttatatggatcaatagataacacaaatgaacacaacaaacgtggatcttggttcctttggaacataagattttgttcgtttttacaaaaatcctctaaaacctatcctttccaaaggaggcgagcccaaggattgcaactagagatggcaatggtgaattcaccgtcagagatcatgcctgcgtccccgtcaccgcggtgaaaatatttcaccgtccccgcccccgtcaaccacgacggagctataatttctccagccccgatcaccacgcggtgaatttttctccgtggtgaacccgtccccggttaaacagcatattcacagccatggtcggtagatggtggcggcgacagcggctcccggtggcgcagcgacgacggttgctgcaggcgcggcgacgacggctgctgcaggctagcggcgcgtcaacggcggctcccggtgaagacggctgcaggcgccgcgccggcccggcggctcgtcgacgaaggcggccggcaacggcggcttcagtctcccggcgaacggcggtgcggcgaacggtggctcccgggctgccggcggactggcgaatggcggcggcgcggcatgcgtgactcgggtggagggctggaggctgctgtggatctagatgggtggaggatttggctttgacctgttgacttagggttagattatatatatatgcctactaaatgggcttcaatattatgggccaatacatctaaaaagtctagaattcctcccttgtacattacagtcgggtcaccgtgggggccggggacggggaatggttcaccgtccccgcccccgtcatccccgatggtgagaggtttttaaccattctattccccatggtgagtagatattaaccatccccgtcacctaataggtgaattcaccacggggaaacggtgaacgggtccccattgccatctctaattgcaactccagttcaaaattttggacccccggggggggcaagtgattattttggctaaaattttcggtttttctcgatttttttaatttgatcaaaatttagtcaaattcagtaaaattaggctaaaatttcaaaaaaatctgtccaaaaagtgttgaaaatcctgaaattttcggtagaaacgaaatgagcgaaatttcggacatactagcttgctaagatactatgccacaaaagttataaggtttattatggttgaaacagtggtgttttagcaaactatgaattcatttgtatggaactccagtaacatacataccctcttttgagcattccatagaattcctttcacacacatgtgcagcttgactagtaacgtgtacaactccgtattaattgcacactgaacattgtggaatactccactatatttcatcaggacaaaggtgtgtataatactgttttgttatcacaaaacaaagaaaatttaatacctaattaaaaagtcctatcttgttaatttacatgatcttttgattcccataaacacgtacggatcataacccccaaaattatccaaattatcccaagaacaaaagctgcacaaacaagatcaaatatatcacatcacaaatccataaataattaaaaacgagctgacaaattcccagaagcaatttttccttgccaaaaaaaatcactccgaccatcatcagctcagagtgcaagcaacgctcccatcagcagcagcgccgccatcgtcgccgcggcggccgggacgacggcggcggcggcgccgccgctcggcgacgagcccggcggcggcgaggtccccggcgcggagctcttgatcgggcacgcgtagccgcactccgccgggtcgaccacccggtagacgcccttgctggtgagcaggtagacgtcgccggcgttgtcctcgccgaaggagaagatgtagcccagcgacggcagcgtgctcctcgccgcggcggcgtcgcaggggatcggcgacctcccggagcaggcgaacggcagcggcgtgacgtcgtacgcgccgctgcccggcggcgactcgaggcccgcccaggcggactgggcgtagaggtcggcgtagaggtagcggccggcgaggcaggggtcggtgccggagcggtagacgtagccgccggtgatggaggcagagccgacgttgttgttgacggcgctgtgggcgtagcccatcaccggcgggatggcgtcgatgtcggcggcggaggtgttgccgccggggctcgccagcggcaggtacgccgtcgtgccctccagcacccgccacccgtagttcccgccctttatcaccaggtcaacctcctcgtacgacgactgttttcaaattccacacaaattcatcaactatatggcaaatttggaccaccaaaaccattttgttaaaattaaaatggactaaattaatcccagtgacatggtatcgctggagaaaaatactactccctccgtcctataatatagcaatctaaaattggatgggacatttcatagtacaacgaatctgaacatgtatctggaccggttctaggttgttatattatgggacggtgagagtattagaagagagagcagtataaaaaaaagctatcactaggtcaatctccttggtgttgcctatttaaacttacacaaaatcatcacaattatatggcaaatttagggggaaatacaaaacaataatttcttaaaatggacgaaattaatcatgtttgcttaaatatacgagacatggtatcgctgaaaaagaatagtaccagtagggaccatcgtaaaaatctttgtaccgatatatgtcctattactaatagagatcgccgtaaaatttgtcttaaaggaagggaatgtggcacctgtccgacgtcggcgcagtagaggtcagagggcttgccggagtcgaagctgcaccgccacgggttcttgaagccgagggcgaaaacctccggcgcaaacttggagtcagtggagaaggggttgtccttggggatgacatagtttccccagcctgcagtgctattgccagctgcagagtttgtaacaggaagatcggtcaatcatcttgtcaggggttgttgcaactcaatttcagaactcaccaaaatatgaacaaatttctgaattcaggtactatcctgaacagtgaattagttgaaagttgcttttgggggcatttgatttgattatgaacaaattccagaggaatagagctaattcacacactatccttttttttgaacttaattcacacactatcctgaacagttctgaataggattgcacctgaagctcaattcgtttgaaataaaatgaattttattttgttcaaatgttgctttttttttgggggggggggggaggggagggggggcatttgatttgaatacgaacaaagctaattgacaaactatcctgaacaatgttacctgtcaggactggaccttaagttcaattcgctgggggaaaaaagaaatgaatttttagttgaaaggttgctctttttctgggcaatttgatcgcaaaatgggggagaatttgggattacttggcaatgcgttgacgtcgatgcggatgatcttgccgagcagcgacttcttgttctgcgcgaagttccacgggtcgccgacgctgccgccgtcgcccatcatcaagtagaggtagccgtcggccttgctgaagaggatctgcccgccgtggtgcgtcgtgaacggcagccccatcgtcatgatcctcctcacctccgccgggttcgccgccgtcgcctgtgacatcaaccgctattgagttacatgcatcgaccaatttaacccaaatacctaagctgatgagaaaagacggacaattcacttcatatccaaacacttccccctcaaatcttaagtcaggattcaaactcgtgatgagaaaagacggacaatttactttatattcaaacattaccccctcaagtctcaagtcaggattcgaactcaaaacttttggctctgatactactattgagttgcatgcactgactagttaacccaaaagctaaagctgatgaggaaaaaataacaattcactttatattcaaacacttccctctcaagtcttaagtcgatatacgaattcgagaattctggctctgataccgtgttgagttgaatgaaccgatcaatttaaacaaaaagattaagctgataaggaaagacgaacaaaccaccaccgctggcgagcgagaagagctgggtgtgcgtaccgtcgccggcgagccggaggaggcgttggcggtgtactcggcgatgacggtctggaactggcacggctgggcgccattgtcggcggtgagcttggaagggtcgcagccgacgtcggagttgcaggcgcagcggccggagcaggaggcggactgcgtcttgtcgcagctgtaggagacgaagaagcggccgttcttggcgaactccgggtggaacgcgaggccgaggaggccgaactcgttgtcgaagtggacctcgtcggtgatgtccaggaacggcgtcgccgcgtccacctgcagcggcttgccggagccctgcgccggcacggtggcgacgaacaccttgccggcctggttgttgaggaacacgcggttcgagccgtccgggtgcggcgccatgttcaggtacgacccgttgccgaggcgctccaggcacatgccgctcgccggcggcgcgacgcggctcgcgtcgaacgccgcggactcgccgtcgaagcacggcgcgccgccgccgcccggcgcgccgcccagcgcggtgcagaagtcgcccgacgactgccacacgtcggtcagcgtcggcgccgccgcgccgccgcggggcggctggaacggcgagcccgggatgcgcacggccttgcaggtgtcccacaccgtcgtgcagtagtccgtcgccgccgccgccgccgccttgccgccgctgagccggctcgcgacgccggtggagttgcacagccgcggcaccgtccgggggctcgtcgtgacggtgaacagctcgccggcgtacgggttgcatctctgcagcagccggcgacctcatcaaaccaagaaatcaaatctccatggaaattccggcgaccaagcgaaggagtcatcataccgcgcagaggatggacttgacgagttcgccgcacggcgtgccggagatgttcatggcggcgaactgcctctgcacggcggcgtcgtccgtcgagttgcagcaggccgtgccattgtagccgcagaaggtgagcgatccgttcaccgtcctcgggaacgctgctccgcggccaccatgatccaaaccatcagttgcaattcacaattcaatcacaaagaaagacaaattgcaagaacatcatacttgaatccatgcacaattgcgcgcaatggccatcccggacggcgaggagaagcacggcggcgatggcgaagagtagtaccgccccggtggacgacgccgacggcgccatggtggattcagggaaggagaaggtgtgaagatgctcagaggcagaaatggtggacaactagtttgcacttatatactagtatataagtagaaggcagccattgaccaatgcaagatcaagaaattcaagatttggtagtaaaagaaggcaaacaagtggtaatttttgggtagaattaaattctgatttctgaaagttcacgtgttggatggtgacaactttctgtacacattatatatcataagatgagcattagcatctggtcatgcactccaatttgcaattaattaaacaaggaagtcgcatggagagagagcagacaaatgtgcttgtttggattgtgaaagtgacaaggtgaaatcgacagcaaatttgtcaacggcctatttgaagtatggagttcagagaatttgctcactgcaaatacccaatgccccaatcagctgaatattttcactcttgaacctgaagatcccagatccatcggtttcagactttcagtgaactacaaactacaatattgtattgtttttttatgccatcaggaaataaagcatgcagtagcatcaaagctacatgtaacttgtaaaatcttcatgtcagagcaagaaggtaaagttggtgttactctttaccatctattgtcataacaactaacaagtggtattagagattcagaacatcttgacagtttttcttttctcgaatatgcagcagaactgcatatcattgcattaagaaggaacatcttggacagtcaactgggacatgatagttcttcagtggccttgtaaaccctcttcatcactgtactaattgaacaacaaagctcctggattttcttaaggttggttgtcaatttacgaccagatagttcaaagcctgtctaaagagacttacctaattgcaatttcctttttcatacaggaccattgacacaagtggggatatatcaatagatcatgaaggtccaaatgtaacagaaaaaaatgattagacagcaacagttgaccttggaaagatatgaaagctttgagtcgttgtagtttggattaattaaaggcacaggaaggtaggttactttggatacttgaaatttgtgcttcttttaaggcccccaagggaagatttttagaagaaaattgtttacatgaggatactgaagtcaaagagagtgagcaagtgggtttgtattttgacactggataagagtactcacatggatcaatggacttataaacagtgggagatatctcacactggttaggggaaaacccagctatgatcactcagtagtagtggagctgaagttactactaattattagtatcatatctgacagtgattttggtctcaaaagttacaaatgacaaagttatgcatgctgcctcttctgtcaccaaatcatcactccaagcctttatgtgcctatatgtaatatattatgatatagggataaattttataacctttttacaatgttcaaataacaatgccttttgagggaaaaaactgaccctgggtggtaggcaagtccaaaataatttttaagtgaatcttttgagagcttcgaaaaggttagatgaaacttaaggaaaatgatatgtgaaaggattttttttccctacatgcaaaattatacaaaaggagttgactatgggcatatggattgatgtgcccagaacaataaagttacttgttcttagggtaacattttgtatagcatttaaataaagaaaattacctatgcaaagctaaatatggaatatttgacgga

SEQ ID NO: 76571 - DNA, 554 bp, Oryza sativa
  unsure (1)..(554): unsure at all n locations
aggagaggaggaaggggaggagtttgaggagaggggatgaggaagagagttagagatgatagatccgatgagagggtgtgagattcgatctttctaagttgtaactgtggaggaccaactgggtctaaagtggtgatctttagtctcggttattaacaccaaccgagactaaagatcctcggccccctgacatacatctgacaagggatgaaccgtgtcggtgatatgggaccgggagtattgcgcccggaggcttgaggcagatggaatcgcccacgtggcttggcaccttcggggacgtcgggcccgagggtgaggtgtccaccctcctcctgatttccccgagggggggtcgggtggctnctgccccnnccctgngggccggggtgcccccgccccctgtggggtttgccctctgtccctcggttgggtgccctcggttcggctctccttcccgcttttcttgcggtctggttccgcgtgtctcgttgcttgccgcgccgtgctgcgcgctcttttttccggtctgtgtcccgtctccgcccggtcggttc

SEQ ID NO: 76572 - DNA, 1965 bp, Oryza sativa
gcggctttggctgattgttgtgcagagcaacgtgggatcgctcgcaatttatagcgttagaatgtagagatttggagtttgaatgttcgtgtaataagattggactctggattaatttcttgtacgtaaaagcagattttagtttgaacgttcatgtaacgagattgaactctcgactgattttcgtacgtgattaagagatatctaatgaacttattacgggtgcaaagtgtatgatgttttctcatctgtgctttcgtttaacgttaaggatgcaatagagaacatcatgatacagcctgcaatcctgacgatctcaaactacatgggtgaaatttttcaaattttcagatataagttgacagaatttgtaagtttgcagttgttttcatacacacaggaggagaggagaacgccattgttacggcacatggagtctgaagctaatacttcgtcctgatacttatctgaattctggattacgctggctgaacaatttttgcgagtccaaccagtgtgaagctgtctcttttgttttgattgcctcgaagagataatataagctcgtagtagtaataattcttaatttctggtgatattgaggacatataactcttttttttcagataaaccgcagagtattcctttgttttacctcaaaaaagaaaagtatgtcgttgtccagagttaaaacttcaatttgtaattatcagaactatactgaagatacgggactctgcagtcctgaacaaataaatgccgtctcgtcatttggatatatcatatatgcatagttacggcaattgcgtgatgaagtctggagctgatacttctgtttgtaataaaccagagatttaaaccaaacacaagaattttgatgagtccaatcagtgtgaagttctatctctgggttcgcttgtcttccagatcacacagcttctagctattctgaatttagattgatattgaaaacacagaattcttcatatttttagataaaccggagtactatttcttttatgggaacagagagttttttttctatgttttcctccagcattggtcttccagaatgtttgggttaatgagaagcctaccaaagcaaagcgtttgtcgatcatttattttatagattctggagagtcccgtttatctgtttgaatcttttcttccggacatcacagatcttcaaaagttcagaatagatttggcttcgaattttaggatttcactacagcttgcaagctgcaagcaacaggggcatcaatctggcaagcaacaacagggcatcaacacgcatagcggttcaatagattacgtaactcgacacaggcagcacacagtaaaacatatactagcataaaaacctgagataatatagcatcagcactggcaatctggcacaagtcaaacagcctcaaaatcatagtacatctcaagagataagagataacaacgcattacaggagcaacagctgccaagtgccaagtcggcggctaggaagagaggacaaagcattactggagcaacagttgccaagtcggcgcagcagcaactttttcagccgtagccaagccaccatcagcaatatacaagctaaagaagaacagtgagcacatcagccatagccaagcaatctgcaatcagaagggtttgatctgcaatcaaagagaaaactatgtgccaaaccggtagcaatacaaatgtgtacagtacacagtcagaacaagagcataatttagacaaatttgtttgtcagatcaaatttttaagcaaaacataagaaacagcacaaaagggtatagcagaagcaaaatttggacacaatgattagggatcacttattcattatagttcttccatgctgctctaccacagcaaaacgtttcagacaccatcaaaccagacttaaggatacacattacaggtaaatagtacacaatgaaacgggacacgaccaagga

SEQ ID NO: 76573 - DNA, 4188 bp, Oryza sativa
cgaccgcgcaccgcttggctttgggggattacggcgtgtccggcgtgtgcgagtgcgagtacgagcgtgacaccaccctccgcgcgcggccgcggcgcgatccgctcgcgatgggtcacgggtggccctgcgttcgcgttggggcactacttggccgggcagcggcagcggctggccggcgtgggggaccgaccgatattcggtatcttggtctgacgtcgacggccccggcggctgcggctcccacagctgcctgcttttgctttggaggctttcggcaattcggctccgtgtctacgctctctatgggtcaacatggttatcttcgaaaaataaaaagacccaacccatccaactcatgatgatgcgtcgaaatggctgaatttgcgaggttttcttttcttaagggtttggagggtgtaccgtgtacgtgtcaccgagccgctcgggtttgtaggtgaaagtgtagtatcacgcatgtgcgaagggtcgatatatacatgtgatgatgccaggtgccagcggtacggccaaaagatgatgccacgtgtttcggagttgctttttgtagttttgtttttcttgggcgcgcacgtcaatcgattcgttacgtggtgcaatgaggcggcgtttgctttactccatccaagtggttgggacgattttgtttttgtttacgtgcgtgggagctgtcacgtttctcgtgtgtttagcgactattttgtgaggaaaaaaattaagcatgagatcgtggagcatgtgagtactgttgtcatcgattcctctcgtaaatcgtagcacgccattttttagatgaaaccgagagatggcccgagaccatatgccaagagctccctccacgcgactctaaaaaaacagaaaatagagatatcaccggatctttttttaagttgcaaattaggacgtatacgtacacacaccacgctcacatcacacacaacacacgcacccacacgcgtgtttctaacacacgttagaatttagattggagacctatatcttaatgcacgggaaacatgtagtagtattaaacacgcacacatgtatacccttatatctgatcggaaccaatcgagtcgttccggaggaaagaggggaaaagaccccgggtgagcacgagcgattgcaacggacattcagcccattgtatttggaacgaaacgttatcgcgacatacttgaggcccattgtagccccttgcatttgggtcgaaacaatatcgcgacgtacgaggcccattatatctgcctaactgggccggaaaggtattgattgcctgcaacggtaacgtggcgcacgtgtagtccatcatatttgcccgttcgggccagagcggtatagtggcgaacgttgggtgggcgggccatttgtcgtgcaaggccgcgcatgcatgtgtacgcgcatcatcatccaccgctcgcgaagtcgccatctcgatcgtacgaagcgcacttgatcaatgcactggccaccggtgcacttgtcaaaatgagggaaacaccagggcggttctcccattcatgctgcatgctgatcttccaccacgcgagggcaaaacgaaacgatataatactagtactagtacatttactatcgtgtcgcgtcgacagcgacagcgacagcgagaagagaggatcgtgcgatctgatcgagtagctagcgctttccagtcgcgcgcgaaacccgcccgtcgcgccgggcaagcaagcgcactgcgactcaccatcgccatcgacgacagcgacgctctcgctcgcacgctgccaacatagggcctgtttggtatggagagctccacccaactctactcctagttttgttggagctaaaactgtttggctgagctccagctccaaaagagatagagttcgagctagagctgtgccaaacaggcccatagccccgcgtcccttgctccggaggtggaagtcgtgcttattacactccccctatcttataatatagcaaccttaaaccaaatatgacatattttttctatttcatattataagttgtccgattcttttattaatcaaaattctttagatttgatcaaatttatagtaaaaaaagcaatgtctacagcatcaaattagtttcattaaattaaaagttaaatatattttgataatatatttgtttttattgaaaaagtttgtattaaaaagtaaaatggcttataatataaaacggatgaaataaaatagtgcaacaaatataaacagacgggagtaccaccagttgttattggattacaccctcaaaactatattcattatactatgttacatccgatttaagattgttatattatgagacggagagagtatctttgttttttaatatatgcgctgttgattttttaatagacgtttggttattcatcttatttatttttttgcaaatgtaaagaatttttttcatgtttaaagaacaattgacgacaaaacaagttacaataaagtaaataataattacataattcttttatgaaacgaacgaacaaacataacttaaaagattaacgacactatatattaaaaaatgtgagagtatttcctaaccacatgtgctggagtggcatgtcattggcggctaataatttctctccattatcctgagctagaggaaagcaagaagaagctaactaccaaagggaacaaactgtgtcacccaccacggggcccacctgtcgggctgcaagtaggggcagcgtatcgatcaaacagtaaaagaaaattctgaacgaaattatgctatttattcctccatcaagctttgtcgtttggtggagctttcatggatgcgatatgataatccgaatccagcaggggacgggatattttcgatagctcatacgctatccggtattggtgagatgccacaaaaaaagaatgtgtcatctcaaaatctcaaccgaccggattaagcacgaacgtactcgatgcaatcgccattccaaacacggggcaggacactgttgccattgaggcgccggaaactaaaagatcccctaaataaagcaaaccaggattggacaccagaagccattatacgtgctgcgcaactgttctccttttaggagattccgcgaaagaaaatgaggccatcaatgtcatctctaacctttttttccctacacagaatgttctcctgaatcgtgaagggatagctaagtactacatcaatttaatacggtgtgtgcacgttgtaagtgtctacgtttgtaccgtgtcttttttctaaaaaatagaaaagtgcggataacggattgataatttcagaacagtctcttttgttcactagagcaagtaattaaaaaaaggtcaaattgtcaagctatatattataaaccggtacagttttattatttttttataggaatcagtctagtcttgcacgacaaagtgttgaaaatttcaacagacaagtcatcacacagcccagtagcccaccatccttccggttctccagctacgcaacaataattcaactccaaaccaaaacacaaaaacaaaaaaactgaatagtcgtcggcaagtgttctcacgaaccgacagaaaccaaataaacaccaccaaatccacccactccccactgacaggacacccacaagagagacggccccacccgtcagtgacacctatcgccccaacccccaaacccaaccagtaataattttaattttaaaaaacaccaaccacgcgcgcgccttttcccccacaccggaataaacaatatcccggcggttatttcccaccctctacctctcacctgcacggaagattttattaattaatgggatgtattctccccttctctcatcatatgcttcccactgttctagttccattccactgacaaggacgcttgatgattagtagtagtacgatttacgagtgctaatggaattccgcgtatactaatcgtcctccggtagtagtagcagtagtacgctcggttcgtggaaccccactctccaatccccaaaagcatccaccccacggcgcgagatcccaactgcggccgcgggattcttcggaggagtggtgatcgccatcggggtatggaggcggcggcgaagctgaagaggagcatatcgcggcagctgtcgtcgggggcggcgagggtgtggcggcagctgtcgctggagccggtgtacactcc

SEQ ID NO: 76574 - DNA, 6478 bp, Oryza sativa
aacaagaggaaatgcatacattgtagagtaaaacttcagttgaggtccaagtatggggcagatcgaacaatctcgcggacagagcaagcagaacttatgtttctgcatcagggccaacacaaattattctgatgggctagggggtttttccttgggatgctttgatccatagtgatcaatcaattgtttctcattggccagttgaacctacacaaagaaaagcgatgtttcattaagttgataccacatccacatgtgcgtgcgcatgcaaaaatgagtcaacatggtgtaggtcagatcaagcagtgaccagtaatagattctaattcagttacggaaaaatgtatttataccacacgttttcgcttggtaccaaataatactacaatttttttcaccttaaagaaataatatgactgctaaaatcttccatctataccgtttatcaaattgggaacagcattgtccaatgataaaaaaagatgtaggatgatgccttcactgttactccaaccagtggtggaggacagaagggggctgcttcatcagttggaatcagaactcactggagagaaggctttataatggtatttatactattcacaacaacaacattaacaattagcagaacttaacataaatagttcagatggaagatatgagcagtgtgatattttcccaaaggggaaaaaatgtggtactaataggcaccaaccaaaaacttgcagtacagacactgagatgcaattttctcctttaaagatgctcatctttggacctacctctcgactacacactcatcagtataatataaccaaaactgagaataaatgattgatccaactacaaattttgcctagaactatattccccaacccttcctgattgttcaaccataacacagtattcatcagaggcaggggcggatccaacgtgggtgcaggggaatatagttgataagataggaggtgctaaaggtctcataatagcattttagcatagtttaatactgagattatgtgtttatatcggtgtactcagtatttgagtccccccaactttttgtttctggatccgcccttgatcggtgattatcatagaaatggtaatggacaaacaatataacagcagcaatatctcccaaaagaacatcactagggtaatgtaatcatactagttccacccttggcaggcaggctagatgcagtgcttagagagacgaagttagaacaattacaataatagaaaattatcccctatgaaatttccacatcaactccctgtctctccttaccccgtaattggggtgcatccggggactatagacgaagacggacaaaatcgatcactcggctcgagattttcagatcgcatgggataggagcatagggctgggtggatcgtggatgagacgataacaagaagctaaagatccagccatcccctcgaatcctccatgaatccatccaatctagcggtctagccttagggctggggagggaataccgaatacggcaggctacaagctactggttggattagcaagcaggaagggaagaggagacggattcattcgtcaccttgcagatggggcagatgaccttgaggccgacggcgcgggcctcgagctgggaccccttcgacttctggttcttctccgcgttccgccgctgcgcatcgatcttctgcttcccccgcgtcatcggtgctcctcctcctcctccccctccggagttcttccccttcctctccgatcaatcgatcgatcccgacccgagagctccaaacttccaacaaccaccgcaacagaatccggattcttcttcccttctccctattccccgcttcccatctcatcgccgtgggccactgggccgacagccttgttggacctgcaggcccagtagtacacaaggctatcggcccattagagcatgattaattaggtggagtattagtttaaaaaaacctgtaaaataaattaatatgatttttaaaacatttttctatggtatattacgaacattttacacggtgcaaagcgctggattcaatttttattccagaacatggtaagtggctgagtgcacgtttggtttgcctgtcagtagaaaacataggctcaactcttgcatcatgatctttactggacaagaagccagcggattggcacattacagagaggaaggtaaacaacaacaaaagaacagcatcataacaaacaacataactgaacgaacggaatctgactacaacactctactacaacactctgctgtaacaggtagcaaccaaccgaccaagcattttattactgtcctttcttctcacaagacctgggattacaacggaaaggagtagccacgaaggtacttggaatcgacaccggattcgcggaccagcgccactcgccctgttctggcgacctgtggtcatggacggaatatgcattagcgaggaaagctgggtatattacatgtggatatagagatcggatttctatccattatctaaaaaatagtgaggaaagtaaacgccgcgagcatgggtgcgaaagcatacggatccattgtcccagatagaaaggagacggctagcaacctagcatatcatatttaaagacataaagcagatgttggcaaatgatttaaaattattttggtagtcaaaagcatgtgttcacttcggcaaaagtatccattacgtgtggagaatgagtttttgagacaatgtgtgttaatacggtaacagtatttgcgcagataatctgttgacatcatttcacatcacataaccacatgagcaacaaacggatgaggtgaaagaaaagtacaaaaagaattcaatatacctcacagatgccataaggctccaacagcctttgtaatgcaaccatcttgtcgagatccccagtaagctgcacaatcgcggcaagttatcaagtatgcagaagtcccacaataatttgaatgggcattaaatgagtaaatgacagttgtggttcagctaaacattcagtgtttctgcaggctctgtgctgctaaacagtaaagcacaacacaacttattaggacaaaacactagaattcctataacaatgctgcgggtaaaattatatgctggcactttgttatttgtacatagatcggtgttcttcgtaaatgaagctgattaagctaataaagaaaagtttaacaatcacaagccacattagccataaaattaaaattacctgtaacgtaacagtgtgatcagaaacatcaacagattttgcccggaagatttcagcaatatctagtatgtctctccgagcagcagtgttcacagaaaccttgataagcataagttctctttcagcaaaaggcaagtgagttatatcttgaacctgcacaaatcatattttttgaattaatgcgactttactaccacaattgactgctcttgaaaactgcatatgatttacctcatgcacatcaacaagtttgttaagctgctgaactaacttctcaatggattcatctgttccaggagcaactgttgtaatacgcgaaaggcctgacttttcagctgggcctacagcaagactctgaccagtagtatggtcttgttaacaactaatcaggcatgacggcgaggtaataactattcgaaaaaaagaaaacctgtatattgtagcctctgcgagcaaagacccctgtaacaatgttgagaacaccagggcaatcattgacaaggatggatagagtatgtgatcgaagtccacttgactgcaccaaataaaatcatatttagcttagaacctgcatccttaattttgtatacattaacatgtatatttaacactgaccagcttagagctacagagacatttatatatatatatatatatatatatatatatatatatatatatatatatatatatgactggttgctgattgtgaagatggaaaatgtgaactcagtgtagtcacattggaactagattcggttttgaatacatacaacataagttagacatagttttttttgtctcaaataaagtttggatatagttgccaaggttcatatgggacctaacactgactgaataatgcttttatctaaactgataatattgaaacttacatcttcatcatcaaggacgccccagtgagcatcaagtacttggttcatggatgaaccctcataaggttccacaggatagacatcgccctgaacaattaaatagtaaaagtgactaaatgttacaggaatcagtaacatattgcaatagacaggcatatacgacttgttatgttactcatttctggccatcaaatatattagcatataacttatgctatgactaatgcacagatgctataccaaaagttgaacaacgttagtgtgggggtgcctgcttatgtatcatcaggtctcatccaatgacataaggtactagtgaatatgcatttcagtaaccccaacatgaacgccacctgtaattctactccacagtgtgcttttcaccaccaaagaatatgttgtcttcagtgaactcacctcacaggactgaaggtaaatatttaaatagaaatatggaataagttcagagatatggcacctttatagcatactaattgtgtttatgcactaagttattatcgcttatagcattacattgttctggaaccaatactggctaacatctaggttcaactgcatttgttttcgtaccgagtaaaatgcactctcaacataaccagctaattattcaaattatgtaaaaataaaatagaactagatgaaggactcatgagattttttttctatttaaagtacaagaaacataccccagcattggatggttgatcaaaacttccattgactgtcttatttacagaagtaagaagagaatttttgggcaatgcctctatgagatctgggtaagaagcagcagaaaatccccagaagcgggcagttgctccaattttttcacgtctcaaagcaatctgagggggaaaaaagagtcagcactgtgaataacacatgtatgcatgcatgataaatgcaaatagaaaatggtcaagaaaatacttttcccgttctacaaatttcttttatcccaaatttgctgaggttcctttgcacagcaacaattttgccaggatctccagttacctacaacttgatcaaatacacatcaaaggaattcctacaatcatatgtatgtaaacctgttggaatcaggagtctttacctcgatggtaagggtgttctccgaaatatcaacaactttcgctcggaaaatatcaactaaaaccatgacctgacaatcataacaagattttgtgcagtacgagtgagttccaacatgcctgttgcttaattcactacacaaagtttttacactatgcaaatagcaagtcaacagcacatgttacctcaggacgctgatctggttcaacattaatttttataagcatcagctctctttcaacctgtggctccttagatagatcttccacctgcaatttttagccggcacaagaattaaggagagtataaaatcaagagaaagagaggttaaaatgaccatgctatccagcgttccagacttaactaccttgtacataggtgaggaatggttagtgcgatgtttcgtgtgaacacgggagagagagactatgtgatagataagggaaagcaatgaacattttcaataattgaaatgcaatgcaactattttaaacaaggtcacatggcagtatccacatatttatacttatcagatgctacagtagcatttactgtgctataactcaagtactcaacgaaaagcccaagatactcaggaatacttaggttataatagaaaacctggttatttggttacaaatgaaaacattgaattttaatttttctgctcccggactttattgcataaattgtgcagacaagagaaatagagcacattacattgaccagaatatgtctgtacgtgataaaatgcaagtttgacattcaatatagttagcgagatactcacggaaaagagttatttattcttactcttagaagattttcaataaagagggctaatgttttgaccagattaagataaaaggtttctgcccttggtatttctagctacaaaagatgctcaagagcaaggcacgttataaaatataaacagagttgatactgtagaaattccgctctttatagaacaatattcaacattggtatcttcactctgctgacaccaatcgctgtcaaagaatcttactgagggccggaagcttatcagatctataaatggcaaactaaattggtttaagcatcaaattcacatgaccccaacaaattttggagcaagggggctcacattcaagacgttgacaagcttgttgagctgctcgatgacttggttgagcaccctggtcgtgccggagacgacaatggtgaacatggccttgtccttgatgagccccac

SEQ ID NO: 76575 - DNA, 1447 bp, Oryza sativa
aagaaggttttgtgctagctggagatcatcgcatactactcgatacatctgccaaaattaaattaagtttttttttaataaaatttggtccaatttcaccagtagtgaatggtttcgaaactattcgggagcggttcttttgatagttcagttttataaaccttggctatcccacatcatcctttaattaaactgtatattccttccaaaacaaagatgcaaattaatcatataaggcagggtaaaggctatgggcgttcatatgaatgaacacatgtttacgagtatgtgtttgcaccgtgttttgcaaaaaaaactaattaacataggtatttctcgacttggaaaccaatatatatatgagcagatcaagcagcagtaggtacacttaatcctggataaaaacaagagagaaaagaaaaaagagatccactaataaaacaaaaaaaaatcaaagaagaagaagatatcaagagaacactctatttaagtaaaaatttaagacatcatctgcatatccatccatccgtccgtccatccgccatccaacggacagcagctaccgaagtatttatatcgtagtacttaattaggcggacgcggcggcgccgcctccgccgccggtggcgagctcgccgccgacgcggcgctcgacgagggcggcgcggagcgggttcttcatgacgacggtgaaggcgaaggtctcggtggggtcgggggggccctcgccggcgggcgggacccagcggaactcgcggaccatgttggcgagcatgagctggatgtggaggacgccgagggtggcggcggggcagatgcggcggccggcgccgaacggcatcatgcggagggcgcgggtggcggtgatgtcggtgtcgaagccctcgccgccctcgaggaaccgctcggggcgccacgcctccgggtccggccacgtcgccgggttctccgtcacccacgccgtgtagaactccacgctggcgtccgccggcacgcggtacccgccgagctccgtgtccctcgtcgccgcgtgcgacagcacgaagtggctcggcgggtgtcgccggaatgtctccttcaccaccgcctgcacatgcgcacgccggcgatcgagcgccgcgaatccatccatttcggttagcaattcagcatatccccaattccccatcacccgtatcttcttttttttttcatttttttttcattttattatacaatgaaatgaagcgaactgcttctctgtctcacaagaaaaacaaattataggtatgagtttggacaggcgtataaccagattcaaaactacgatacaacttttttttttaagaatggttttactcccgttgtttcataaaaaaacaaaactaatatatgatgtgatacattatagttaatacttatatagataccaagagattagttctcaacaattaatactacacgttat

SEQ ID NO: 76576 - DNA, 861 bp, Oryza sativa
gaacaccgccgccaccacatcgccgccagcaccgccgccgacaccaccagcagcacgtcgttcatgtccaccatcttcgacctcgccgccgccgtcgaacactcgatcgatcgatcactctcagcttcttcacctcgtagcttggtatagctcgccggagtggaggaagagtgggtgggtgggagagatatatagcggcggaggcatgtacacagtggggtggggggagtaaatgcggagccatctaccatctgaaagggagacatgaatgctcgctccagtgtgacattaatggcgagctcgtgaaagctcagctctctgccctaaccctaaccctagccgtggtagtggaaaatggaagaaaaaccagcggcttggcccgtgatgagctaacctggctgtccaccatggccatggccgctgctgttttttttttttcttcagccgttagccatttgcttcccgcgctttaattcccgcgttcggttgggaagacgacccacacactcatcactcggagtagtactctactgacgcgtttgcaaagtagcaaactggcggctgcacacggtttttcgtttatgcacagtaaaagcatctccaacaatcacttcaaatttgactctccaaatatcgggcctgttcattttaatgttattttcaaccttaccaaattttggtaagttgccaaaaaaatggctacatttagtttgctgccaaattttggtaactatataagaaacgtaccaaaattttggcaactatatcaaaatttggtaatgtttttttttatcaatgtgaacaggcccatctatttggtcaactctccatttaatttagcaagttaaactctcttttact

SEQ ID NO: 76577 - DNA, 1192 bp, Oryza sativa
tcctgcagcccagctaggattgatctagcttcgatcggaacgtacaaaaaaaatcccaattcacgaatacgagacaccaaaaccacatgaagatcaaatgggagattatagttccattctcttcggatcaccactaggcgcaattttcgggggaatctgattttcgtacaaacatcataaaaagaattcgcacatttcctaccatcccatcaaaaggtcagtcggtcctaatcagagcacggagataaattcccacggttacgcgcgtcactactagatttgttcccgaacgattcgcatcaatacgagacctttcccaattccaaactttttagatcacaaagttccaaacccataatactaaaaacgaaaggaaacataatacgaaaaacgaaaggaatcagacatcagatcggaatcgaggcgcttacccggtggggaggttgtcgacgtaggtgatgagcatcttaaccatggcgtggctgtccccgcgcaggcctcgctccatctcggtgaccatggcgtccgagatgccccgcagcagcgccgtcggggtcgacagcgcgtgctccacgtcctcgatcaccgccgccaccttcctcttcctctccgccgcggctccctccaccagctccaggtccctcctcctccgcctccgcgccagcaccaccgccaccccgaccgccgcggccaccaccaccgccgtccccaccgccgccgccttccccatcaccgctgctccgccttcccttcctccgatcgatccaggtgcccgagacctccaccgaattccgcttctggatccgaggctatggcgctctgcgagatcctctcttcccccctcctctctccggccgcgtaggagaaaggaggacgagagccactgacttgggcgttttaaccggtagcctcgagtacccttcgcctttgcgccataagcggatccgcactcaggatttgtacggctcagatccgctcttgtttgggaatggacggcctggattgggtgtttgtcgtaagtagatctggggtggttggcttgacaattgtgcgattggtttttggtcttttggttataaattatcttttgaggtgagtgatttttctaaagataaaagataatttataacggatttttgggaggccaacacggacaagtgcggtgcggcgtgatccaattaacaagaaaaca

SEQ ID NO: 76578 - DNA, 504 bp, Oryza sativa
ccgtttttatcaggcaaacattaacttgcatttattcgtttgatattctcgaatgtgtaaaataatttctttccataatctagtgattgttgcgatatgatcttccattataaaaccaccatattcccctttctttgaactcatatcaatctaaccatttcccatcaatccataggtgcagtcttgctagaaagtggtgaatcgtgaaggccatggctcgcaacaaggtgaagttgcagcggatcatcaatgatgcgaagtggcgggcggcattcaagaagcggctcaagggctagaagaagaaggcaagcgagttgtcgacactatgtagtgtggatacatgcctcatggtgtatggtgagggcgaggtgcaagcaacagaggtttggctgtcggtgcaggaggcgacgagggttcttgagcgcttcaaggccatgccacagctagacagatacaagaagacgatggatctggatggcttcatcaaggagcgcaccgacaagc

SEQ ID NO: 76579 - DNA, 1840 bp, Oryza sativa
ggcgctcccgctccggtgagggggagagaggcgcggggctcttggttcttggcgcttccgctccgctgagagggggagagcggaggagggcggttgcgacagttacctcccggcgcgcaaggcggctgcaatttgaagtagctctcccgttagctgacaggtggggccgcacttcctcagtcgctgacagtgggcccacatgctccatgacgtccttcgtgcagctgcaggctgcagcctgcaccacaccagacgccacgagctcaccgacgtccacggcggccagcagagcactccagcagcgtcgtccagtggcgccggtatgtgcgtgcagcatcgtaccggcgcggcggcgcccccgtccccgtggtatcgcatcagaacagaaagcaaagcgaacgactccctcccagtcatttcaacgaacatcatatgtgcgcatcgcaggtagaagagaagaccaccatttgtctcaaacaaacaccgccgccagaagagcttgctcctcctctccttcctccaacaccaatcctcaatcttcaagaagaccaaccccgccgttgtcctgcttccctaacctcatctccctgattccctgattccctgatcctatagctctggacgccggccaaacaccttgtggccgatctggacccccaactccccttctccctgctctgcatcccccaagaacctccgacatcagcgcaacataggtaaggtaaggcttcttcccgacgatgacgacgacgaggccgtgcttcctccgcgcggtgtgcctctgcttctcgcaagggaagggagagactagaagcatgggttgatgggaggagagatgaaggaaagtgagaccgacatgtggctcacattcctgatgattacatctttgcacagttaaacccctcccgtacttttcacttatctctattcccaaaccaccccctctctcactcggtcactccctccaatcctagaaggggggcaattttcacccgccaatgagcggggatggggacccgcaaatttccacaaacaggggtggggattgtcagctaccctcgggtgacccagcggggccctgggatattagatatgccttaaaaatatagtccattccaacaatacaagcccagttaatccaataagtcactcatataaaaactaaaccctaattcaccaatcccccatcccctactcccactcccctcaccatcctccacaactgtcgttgcccggtcgtctcctcgtccccttcgcctccgctcgtcgccgttgtttccactccgcctctactcgtcaccactccacctccacctccactcgatatcgcctgtcactacactgcctccgctcgtcgttgccatttccgcttcgcctccgcccgtcggcacaccgccacacggccgcgtctccacttgccgcctccttcaagcatcctcgcctacgagtgcagtgggcccccggaggggccgaagatggggatcgatttcaacccgccctccactccgaggttggggccgggtggacccgcagaggagcggaaagggggtcgttccagcccaacccaggcctaccctgccctgttgccatcgctacccaaccctccaaaaaaacataatggaaccgctaaccttttgtcgacggaaaatgcatccccaaaacttgtagattgtagatttagatcactggatgtgcttcataattcgtgctccatgtgcgtcttctccaactccgatgacctcctcttcttctccggcgctggtgacaacccaaacttcagcagagggccgacgaattagggtcccggggtggggtggggatgggaggttgggaggggaaa

SEQ ID NO: 76580 - DNA, 24446 bp, Oryza sativa
  unsure (1)..(24446): unsure at all n locations
agctttcaaagtttgttttaaaatataacagaacttttctactaacattttcttcctaaacaaatataaccatacatcattcaattttttaacgtaacttcacttcttatccaatcacactccttttcatttaattttatatattttcttaataaccgtaatagaggttgtagttcattgctcaatttcatcaggaaacaatcacattttcaaagaatgtgacaaaaacagtcacgaaaaatattacctctatcccaaaatacttgtcattttgagtttttgtttgtaacatttgactattcgtcttatacaaaagattatggaattattatttattttgtttgtgacttgctttattgtttgctcattcatcctttttaatattttattttatttaatatttttatttattttattttgtttgtaacattattcatccttttgaatattttctctaactttttaaataagacgaatggtcaaatattgtaagaaaaaaagtcaaaacgacatctaatttgggacggaggtaatattaatactagtatcaaccgcaattattgagcagctgatactaatacacttaattaatcacaaaatactactctatccattccaaaatataaggcacaaccactcttaacccaaagactaagaaataattattatcatctcatagtctggattaccctaataaatagaatgcatgcaaccaataaaattagatatctgatgatgaacgatgtaaataatacggagtaatattttagtggaaacgatatgatagttaatgatatgtatgcacgccttatattatgaaataactttaaaaagtagttgtgccttatattatggaatgaagagagtactcaaatatgttgggattaattgcttttgtgatttttaattggtcataatggcacgtagaagttagaacacctccttgcccagtatgtgtcacgacggcccggagtgcaggctccgatggtgatgaccaggtacgccggccaccgctccgtggggagggcggtgaggtagacggaggtcatgagggagacgatcatggcgaggcaggcggtggctccacgtgagcttgaacttgacgggatccctccacccccagatgaagcagaagacgaccacgatggagctgcacatggcggcggtgtgggacacgacgaagttgcgacaaaccaacaaagaattaaaccataactaattgggaaatctaaatatcgagagcgttcttggttttgccttattgcgcaacacatccgacagccgtcgagattgctacctggtgatcgatcgccaggagcgatcaggattcgatccctccttccctccacccgatttcctttcttggcaccgtattacttttctattttagtaaatttatacaccttaaatttacatagtttagagacccaaagtttataaatcaaaattttatatatccgattcaaattttataaatcaaaattttatatatccgattcaaatttgaatttgaattcaaatattttttatatatagtatttctatacatctaaagtttatacacctaaagtttatagacctaaagtttataagtcaaaagtttacatacccgattcaaatttgaatttggattcaaatattttttatatatagtatttctatacatctaaagtttatacagtttatagactcaaagtttataagtcaaaagtttacatacccgatttaaatttgaatttaaattcaaatattagtttatagaccaaagtttataggtcaaaagtttacatacccgttttaaatttgaatttaaatttaaattttttatatatagtatttctatacataatttttttcaactttgtgttttttattttttaaaaatttatggtgtagtaagaagagaagaagggaaatagaaaggaagagagtacctatataggggatgagcgatcatccgcccattagccgcccccgacagccgtccatccgcgtctacgtgctatcgaaaagacaagaagccttccacttcaatggcatcaaagcgaggaacctgcacaccaccaaccatcaaaattaaagataggttacactatcctaatctttctttttaacaatacatttgatgacttatatattttaaaccatacattatttttcactttcatttgtaccattattctctactcaaaaaatacgataaaacgagtctaacattaaatatattcaaatatttaaattaatttacttaaatcgtagaaataagttagttctgcaacagaagtaactacctatagcattaaaagtagttatacttatgttgatgcgaaaaacacacattgggtctgggagaactgcttagctccagtgcaggtccaaatcttgatgaggtgtgggcgtgctagtcagtttgatccagtaactgataagatatgtaaacagcagagccgatcggctgtcaagccgatggagtagttctagccgatgccgatgccgatgccagccgatagcgatagggttttgagctatcggcaatatgtccagtgtaaataatgatataaaggcagtcagctggtgataataagatataaaaataatataatccagtagaaatcaatcggctaacaatatgatatgatataacaagtactaatcctatggtcaaagcatacaatattagataaatcaatgaaacctttgttgccatcggctaaatccaacttatatgtatatgcaatccttataagccgatgcaacgtccagataacttatcggctagcaccccgataaaacattagcatgaacctatcggcttaacaagatttatattatcaacaaaaatctagtaggtcgaacttaaccgatgcagcatgagattgtatatgataatctaatactcgatgagccaatagatctgtctaatgtgatggatataacaaatctatttacaacaacattgtgattgtagagatatatcggctaagacagaagatcggatctaaccgagacagttccaactaaaccgatgcttctctaaacacaatgcaattatagatagaattgagatatcaggtaggcaaatatatcaaccaaaccagagcgatccaagagatcgaagcgatgtagccttgaacaacactaacgtagccgatagattcaccagggccggcggaacgtaggatttatcccttcgctggagatcgaaccatcaacagaactgaaccgatgcagccccatgtcaggtgccaaattacgccggttgataagtaaaaccacagaaaagagggtggcgatgctccgagagtagttgtattgatcgagagatattttacagtgaccccaggtgtacatatttatacccatagggagatactagtccttgtcgaacaagaaagaaacttttctaaagataaaaggaaaacataaagtccttattggacactaaatacattttcctaaagataaaaggaaactaacaaatactgcctaattaatagataaactgccatgccgcatcctccttgaactcggtcacttctggataaactttctttaatagattaattttcttaatcgaatataacaagaatccggctattggcgacttgataattctcattggccgattccaggactctaaagccgatactgactttaggccgataataacttcgggcttaccaaattttggcgttaacaactgaccgattagttgatgatagctgagatacgaaaacgtgtatgttgtactgaccaagagacagagaaatgagaccacttaccaggaaaaaaggataacatattatctgttagttatcatgtgattcacgtcaagtgcatgttgctgaggctaagatgtcgttacactactatattttcttttttcttatagaatctatgatgacctatattttttagactctatattattttaaagatccacttgaaccatcatactctacttaaaatatgtgataaaataagtctaatatcaaatatatttaagttatttattttttaactctaaaagcatagttacttccaataatgtgaagagttacttccttacagcaatatagttacttctaggcaaaatttgttacagacatccaaaaaaacatgtaattagccgagggatatcgtaagatcgtgaaacggctaagagacactctaaaaaatgtgtaattagctgttggacactttcaccattattttattatttttgggctgaatggagagagaaacaattcaaaaggaccagattaccctcagggctgacaggcagacatagctttgagggaggtggcgacgacttccacggcaatggccttgaccggtggcgaacaatagcggaaggcggtggactctcaagccatgtcgctgaacaacaacgagtagttgtcgtctgcggtggtgacgagcaccggcatgcattcgatgatgatggctccctcgatgcaatggatcaccacggtcgtgcgctcgtgcccgctatgcgtgctgctgctggtgcaggtcacacactggcccaatggcgataaggaacttcttcacaggcgagacgtgaaatacagcctcactaaggcgcttgtggcgttctacccgttcgccggccagcttggcgtcgatggagctggccacatccaaatcgactataccggtgagggtttgtgccgtgccgcgccacgccgtgagctacacgacttgttcgccgacgccagacttgccatgcgtgctgaactgctgatgctggttcaggtcatgtacctccgaggctccgatgtggcggcgtagtgctcagcctggcgagcattgcccgtgcctccgccgaggcgctgttgccgccgacggagacgccgcacctgtatcgggactcggatgtgcttcgaccacaagctgctcaccacatgtgccacgtgtattatgctaggtcgctaggaccactcaagcagcgccgctggcatatgcggtgatcacgttaagcaagcagcagctagcaaccagcaggtgcaagcaaatcatcatcatgctaaacaagcagcaggaacaagggtgaagaagtgaaaaaagagaagggcaaaattggcacttcacatgacttctctctcctcaacccgatgtatatattattttattgcttatagtgtccactagcaaattacaccttctttgagtgtcttttagccgtttcacaatcttgttatattccttagctaattacacattttttgaatgtcctgtagcaaattttgcccttctaacgccatgtggagttaattcgctacagtacaattacttctaatatcttgaagaattatttctatttctatttatatttacttccctctaggagtgtatttccttttaatattacgaagagtgacttctatttctttaaaagttacttccctccggtagtgcaattatttttaatatcgtgaagagttattttctatatgacgcaagattttattttttaaaaaataatatagtgattactttaaataaatactatgtatttacttgaaaatcttctctacacttatggatttactccacttaatttcttattttcaactcgtcgtaatgtaattacgtctaatgctataaagagttaattctattgtatagctaagttatttttatgatttaataaattacttttagattaaattgaattatatttaaaattgaatcttttttgtcacatattttgagcgaagtacaatggtgaaaaagatcttaaaaataatatacggtttaaaacatataagtcatcaaatagatttaaaagaaagatacgtcagtgaccaatctatataagtgcttgttgctattttaaggtggtaaaggaggatttatacgtcacgtgggatgaagttgtctgtggtttagccaaaccagcgaccgtgcacagtgtaatcgtgtccataactaatatagatacatgtgctcatagctatcctatctttctataaagttaaggcccactaaattctaaagttcaacatgcgaatatatcacatcatccactaataattatgacatctcaaatctcatgcaagcatgctaatttattaacttccagagctttaaaatgtaaacatgttaattaaattatcaacccacataatcacataatatttcaatatatatctctattatttttttataatatcctctgtatagttcatcctcacttaaattttagagctttaaaaatccaagcatgttaaatcatcattctacataattcccaatatatttcgatatatttttccataattttttataatatctatattactacacaattcatcctcacctaattaatgttacttctctcttctctcattaagccataccacctcaattgtttctaaccatcaaatgattaacctacggtgggaattatctctctcattttcttatctcataaagccacattatattacttttacatttagatcatcattttatatactatttaaattatgataaaccacatcaacttatacaagtttctatatatcgtctaactgtcttacatattatttctatttattattatcataccaaacttctgcagcaacgcgtaggggtttcatctagtatttattatttttgttacaacttgtatgagtcaaaccgtgtattatttgtcaaattttcgtgtaactgtgacatgtaagaaataaggtgacatcgatctgtcgagtgattgcatgagtcccattaattaattcctatatctgtatgtctccattactgttgtgagacttgacgtcaaccggtagcagtgtcttctgaacaaacggtatgtagaaagcctccttccctaatatgagtatcacgacgaccggagtgcaggcgccgatggtgatcaccaggtacgccggccacctcttggtagacggaggtcatgagggagacgatcatggcaaggcaggctatgacggtgagcatgtgtnnnnnnnnnnnnnnnnnnnnnnnnnnnttgacggggtcgcgccacgcccagatgaagcagaagacgacggtgatggagctgcacatggcgacggtgttggagacaaggaagatgtcgaacgccgcgcggtcggcgtggatggcgaggccggaggtctggttgtagccgccgggcatggtgaaggtggcggcgaaggtgacggtggcgatgagagtggccacgagggtgtaggtgccgacgccgagctcgaagtagtcaccgttgccggagccagctgacctgtggctgcgcctgcgcagcgactggtacgtcgccaccggcgggaggtgctgcaggttcttgcaccgggactcctcttgcttcttgagcttctcccagaggtagacgacgtaggcgtccatctcgccgacggcgagacgctcctcgacgaggctgcgcgcggtgtggccgtcccggttgaggaggcaggggttgacgcgggggtccttgagcagcgtcagcgttgactggacgtgcgccatcttggcggcgaggtgcagcggcgtgttgccggcgctgtccccctggttgatcacctccgccgggccgatcaccttgaggaggcccctgagcgtgtccacattggacacggcgacatggaccgcgttcctcccgtccttgtccttactctccgccgcatcggggctgtgctgcagtatctccgtcgccgccgcgatcgagccgtttacggcggcgacgtgcagcgccgactgctgccggtcgttgggccggctggccagttcaggcttgaggtcgagcagcatactcaccatgcgcgtgtcgttcttctgcgcggcgtagtgcagcgccgtgctgccggccgagtccgtgatgtcgatcagatccggcgccgtccttatcagcaatatctccaccacccctgctccacatgtgtgtatatatatatatccaaggcttaaattttctccaagtttggtttaaattcagcatttgtttgttcacatgtatgcatgaggatcacaatgccaaataaaaccacacattttctaaaagaagctaacccgggaaaagaagaatatatattaaggcctcctttgaacggtaaattaaaaaatgggggaaaaaacgtaggaataagatatcctattgaaatgttcactgttcattcatttggcttgcgcagaattggagcagacgagaagcatacgaaaatttccttcccctatgttaattttcaaaaggaatttcacagttttgctaaaaaaaggaatttcattggagaaaaaaaggcctaaaaagctatttttctattcctaccgtagaatcgaggcaagtactcaggccccgtttggcacagctccagctctcaactccaacttacctggaactggagttgtgccaaacattccagatcctccgtttttaggagcggagttgggagagctgctccacaaaattatactacggggtggagctgggtttttactgctccacagctccactccaccccaaaagacccactgccctttaattttttagtgtatttacataaaaatgccattaaactacacctacccacctcctctcctcccgttctctctcctcccccatctttctcccgagtcccaatagctgcggcgggcggtggtgggcggcgtcggccacgacggcggaggaggaagagggattgggggcgatggcgtcggttgccgcggtggagggcgtggcggtggcactccggtcggtgctatcccgcggcgggacgacgcgcgggcggcgggcggcgagctagcaggcggcggcggcggcggcaggcacacggcggtagcagggcgacaggacgacacgcgggcggtggtcagcgagctagcgggcagcggccgtcgggcagtgggcggcacgcgctgcgacgacgcgcgggaggcgtccggccggcggcgggcggggcacgcggtgacgacgcgcgggaggcgccggccatcgacgggcggggcacgcggcgacgacgcgccaccgtcggcgggcgacgccctgggattgggctgccggcggctaggtttccttttttttttcaactctttttgcaatttattttttttttcaattttttttcagatctagagctgaaaactagccaaacacttctcaacgagtctccaactccaataagagctagctcccactagagtaggagtttggagttaggagttggagtttgaagccctaccaaacggggcctcaatgtagacatcccttttagagtaaaatttcataaaactctaagttctgaggcatttgtaacgtaaatccctaggtattgcaatttgtttcattaaaccctgagttttgaggcaaaaatgttacgtagaatcctgattacaagcttatatcgtctgtttgacaaatatatttattcatattaatggtaataaaatttcttttaagtacatatacacattagctggtacatttttaacaagtgttggttatcgatagtttgattatttgtgtgtattaactagttaatgtgtcattatcggtagggaattatgttgagctttttcaatagtgtaatgcaaaaagtgagaaataaaataaagtacataagagggacttgtactttgaatctactaatatgaatttgttttgcaaatatcatgtataacaatggaatatgagctttttttttacataaatatggggcatcttgaaatattttgccctaaaatatgggatttttgaaacaaatccaatatatgggctattacgttacggatatctcgaaaccttgggctttatgaaatttagtgattttactaattactccactaacattattaacaactattaccttttaattctaaggcaaataaattttctttattattatataagccaatagattacatcaactatgtccaaacaaacttgagcaccttataaaaaagagtaaatttaatagaatcctaggttttggggcatgcataacgtaaaatcccatgtattacgatttgtttcacgaagccttatgttttgaggcaaaatgttttaatgaaccctacgttcaagcttacattgtctatttggctaatatatttatgcataataaattgtgaaaaaatagtatgtggtatttttaagtgtacatacacagtagccactgtttcaacatatgtgagttatgaatagtataaccttttttttaattaggcaactagttgacctaccatttatattgaggattgtgttgactttttgcaatcatgcatagtgggtgaggaaatagataaactggggtgggagggatgcacattttgagcacacttagaacatataatttaaagtactatatattatatgtaaaatgagtaatttacataaatggggttccttgaaatattttgtcccaaaatgttgggtttcttgaaataaatcacaatattttgggttttgcgttacacatgcctcgaaaccttaggttttgtgaaatttactctttaaaatatatatagtgtacatattatgttttagattctaaatggtaaatttagaataaaatctaaattgtattttttaaaaataaaatcagaataaaatgcaattttcaaatcagatatgaaaacatcagcatagagacaaaaaaaagccaatttgtactttttaaattaaatttctgcagaagagtttttgtgatgcttgatgtttgaatgtattttcgggtggtttcatatactgtcacaactttgaaattaaattggtatgcatgtctccattactccatataaaacaaattagcaccataatttctagctagcatgtgtgcatgcctacatgcatgcattattaagtttggaagggtaattatgacatttaatcatatttcctcatatgctgtgatatattaatatcaatgagaaaatatttttgtttcgaaaaaaaatgaataatcaactgttaaaatctattgtatcatcttagctctttggaggtaagaaggagcaccataaaaggatctttgctcgtgaaatgcttcgagttgcatggattaaactacaagtatgagttttatcgctaacttatactccctccgtttcacaatgtaagtcattttagtattttccacattcatattgatgttaatgaatctagacatatatatctatttagattcattaatatcaatatgaatgtggaaaatgatagaataacttacattgtgaaacggaggaagtactcaatatttttatgtttcataccaatcaggcaccatttttatatgtcccagttgtttttaaatcctcattttgcacacacattactgttcaaagctatcatatttttctattcatatgtttaattttcattatattcacgaaagaattcccctatgcccatgaaagtttagccgatcccttctacgtccctcgagttttgctcactctcttatagctcttgaattttggttttgatccatttcatacccattctcttagttgtctagttagttcttatagaaagatccacccttaggcataaaggaaatgtggaattttgtagactatattgttggatatggaacttaattactccctctgtcccagaatataagaagttttagggttagacacggttattaagaaagtagatagaagtgagtggtggagggttgtgattggatgattagtggaggtaggtgggaaaagtgaatggtggagggttgtgattggttgggaagaaaatattggtggagaagttgttatattttggtacaaatcttgagggctaaaaattattatattttgagacggagggagtatataagactattgtatttatgactttattgtacaaaggtattagtattcagaaagttaacttttacataatgacaaaatatattttatttatttatccatagagtatatgtagcataattttatgacagaactgcaacagatatgtccacctttgtactccctccatctacttttaatagtcatatttctaaatttaaaaaaattatttttgataggtatatttgaatccaacaacctatcatcttaatgactttctcgcatttaatgcgtgactctctattcttccacacaagattggatacataggcatcgagaaatgtaaatattaatgaatcgtttgtttacaaggaatgactagtagcatgtttaaatggatgataagtagaattacttatccttgatctgtgtactaagatgaaatatgactatcaagagtagatagagagagtatatattatataaaggaatgctaaccaaaacaatgtttacatgctacacacactttaatatatattaaaatttctatgcatcatacttcccatacaacaagcatatgaatatcatagtgtcacacaacaaattactacatttctaacaatagatttaacaaacttctgcatattccttgcacatctaatggcaaaagtaacttcttttacaccgcggttaagtatgaaaggaatcaaaattaaaattcagggttatgcaagagagtgatgaaaattgaggggcatagaaggaaacaactacaaattttaaaggcatagaagaaaattttctctatatttataggtcccaaagaaccatatgtgtgcgatcgggaaaggaggttgagaacttctctcccgcgcacggctatcgggaaaggaggttgagaacttctctcccgcgcacgcaaaacagagtatctgattagcatattattaattaaatattagctaaaatttttaaaaaatagattaatatgatttttaaaaacagcttttctataatatttttttttaaaaatggactgtttagttgttcgggaactgaaaaatgagaaaataaaagttgaaaaaatgggaaaaagaacacaaaccaaaggagttcttacgggtgtggccaccaaggacggcctggtgtagggcggtgccgcggacgttggctgtggcgacgaacttctcggggacccatgggatgtcgaggatcttttcgacgacgtcggtgaggccctcccgggcggcgatgtgcagcggcgtctgcatgtccacgttgggcgtgtgcccgcagttgggctccacctccagcagccgcagcgccaccgcgctccgccgctgcttcaccgcctcatgtagcggcgtattgcattcactgttcatcatcatcagttggtcctcctgcgtggatgtgtataattaataataagtttaggtaaatattacatgtgagaaaagtctattcatccctcgagggatgtcccttcgtttttcatgccacctaaaaagtatttttttcttgaaaaacagtaagatagttaaatatgtgatatgcaatttcaccagcatgcaaaattaaattcagtttatataagaagaaacaaaataaaaatttcctttaaatagacgcgtaatttttattcagatttattgtttttgttttaaattgtataggttgaatttgaacttacatatttgtggaatagcatatcacatactctctctattttaaaatataaatatgtttagctatgaatctggacaaacacattcataatcatagctaaaaattactcacttcattttatattataagtcgttttaactttttttcattagtcatttttaagtttaagtaactttataaaaaaatatagtaacattttcgatacaaaacaaacatattatcagaatatagtgaatgttagttttggttaaactaatttggtgttatagatgttgctaaatttttcgataaacttaggcaaacatatttagttagagataatccaagaaatgtcattgacaagcatccaaatttaagaaatgccatcgataagtatgaattctaagaaatgccactgtacaaacgattttatttcagaaatgacatcaccattagggttacgtccattccgtgccgttaagtgctataggatgaacaatgtatttgacggcgctgtcagggttatggataccacatacctaatagtagttgactacatctcggcaggacccaccacataccatgtcctatacggaaacaaccttcggatataggaggagttccgataaggaaagacaacaaaagttcttcatggaaacgacaaggactactcggattgtatccatattggtttccctagttctacttagacaaggggacacctatgggtataaatacaagaccccctaggaggggaagagggcggacacccaccagggagaaccaacgcgatcaacacggtcaccacgatcgagaccccccatgagacaatcaactcccaacacaatcaacatagaagcctatatacgccaagacaagccgccggatatcgacatcagagatacgcctagatcgaccctatccggtaccttcagaggccggtcgtagggatctagcactgtctctgattccgtcggccgcgagctcgaggagaaaggctaccctgttgtcgactacgagtcagaccttcagaccgccatgtcgacaacagttagatagactaccccacatattgtacttgtgtgattatggtgaataaaaagcaacatcggctccggccaacaggatgtagggctattagctgattgctcaggggcccaaacctgtataaaaatccctgtctccatctcttttacctcagtctcgcgtatatcctagcaccgacgatccccatactgttcaaataccgtagtcgagacatcaaacgtcgacagtggcgcgccaggtagggggattttggtgcttcaggatttcgacaagataggtttaagagatggattcttcgacaacaagctactcgacgacttcggctgtgaggagatccacccggccagaatacatctctcccgacgagactggataatcgtcatcaactatttgatccggcgagatcggacaagctccaaaatacagtcgccgtgaaggataatgattcaatatcgtcagatacgggacttcggttcgtgctgactacacggtgaactgacttccgtcgccaaaaatcgactactgatacgaccaggtttaccgttctaattttaattttactcatatcggtattatttcttttggctactaattgtatgttcgactggtgttttcctgtttatgaatgcactgctgctgactgagtccgagtcatgatcactagttacgcatacatatatgtggaatccgaacacctatagtcagatcaataatttattatgtttatctagagcatgttttttatacaatatctattgcgcggatgtttccgacgttaaaccaactacggtctaacgctgggggctcgctctgttatcttctgtataaatcatgcttgtttacggtttacataatgccctgatatttacatctgctcgttatatcctgataatgctagaagatccatgcagtttttgagtacatactcgatattatctgctatatgtcttgtcttctagaaaataattttcaggaacaactgagcactcgagtaggttgtggtcgagtacgctccattatcaagaacattctcgacaaatgcggagttatcgcacccaacctaccaacgaagaccgacgacctatctcatagcaccggccatggctggactagtcgagaaaaggttgttaacggataattcctcgcgaacgtcgtcagcttgatcacccgacatgattgcgaacggacatctggatatgctataagttgggtacgtgagtcatgctggccacatgagatacacatgcaataaaccaactctagcacttccattggtgttcgagagataattccgctcgctcactggttttcgcaccaatacgtagcaatctctcgcaccgcaacttccattggtgtttgagagataattccgctcgctcactggttctcgcttaacttcagatggtcaaggtacgactacaacagcgtagcggtcctcgcaccatgacttcagatggttgaggaacagctacgactggtctttgaccggcagcgtagcggtcctcgtaccacgactccaaatgatcgagggacacctactcaccggttctcaaccagttgatcgtagtgatctctcgtacatttgcttcaagtggtcggctacttccactttaagtggtcgagttacgactacagcctggtcctcgaccagcgatgtagcgtctctccgactacttccactttaagtggtcgagttacgactactgcctggtcctcgaccagcgatgtagcgtttctccggctacttccaccttgagtggtcgagttacgactactgcctggtcctcgaccagcgatgtagcgtttctccggctacttccaccttgagtggtcgagttacgactactgcctggtcctcgaccagcgatgtagcgtttctccggctacttccactttaagtggtcgagttacgactactgtctggtactcgaccagcgatgtagcgtttctcccactatttccacttcaagtggtcgagttatgactactgcctggtcctcgaccagtgatgcagcgtttctcccactacttccactttaagtggtcgagttacgactactgcttgattctcgactagcgatgtagcgtttctcccactatttccacttctagtggtcgagttacgactactgcctggtcctcgaccagcggtgtagcgactctcctactacctctatttcaacaaagttgatagcaggtacacaatatcgctaagtgttttacccagagatcccttaccacgacgacacctagtgttgaaacctatcctactgtccctttacgccctcttgacaaggcctccgaggaacctaagggaacttcggctggggatgctcagagccgataaggccttgtcggatcctgtagagacaaaagaccatgtaagatctggtcgtgtaagagttctcgccgtgcgtattaaccaagccgtgtaatcggaaattgacttttccaacttcacggctgggggttaggatcagtgcttattcaaccaaggcaggtcaagggtccaagagccttatcctccgagaacgattctccgacgacaaggctgggggctagggagagtgtatgactctacaaactgactgatcgaagtcagtaagagagaagacgctcatacacaaaacattggtcggtaaatttaattcattttcaatttaccatacatattataacatgtcaccctttgggcattcgctcgggggctatttctatttgatattcttttctgagtattgatttcaggaaaattctattcgacattgacgaacactccatgtctctatggttctacaccaagacaaagctccttcgcagactctacgccttctcgatcgctcgagaacggttgctggatctcgacaaggaatacggaatgaagagatggtgtacccgccgagatagaatttcttgacttcaatccaaattctcgattacagcaagacatgagacttagtcgtacactctgtactttcttggttgacatcagagattgactcagacaaaccctttaggtacccgcacgaggctgacaaaggaagtctaacgttatctctgaactcaccgagaacggtcacatgagctagataacagttactccaaggtctgcgcgtggttgagaatatgaattcgttcatttgcattgaagtcgggggttactgtcagggttatggatacaaaatacctaatagtagttgactacatctcggcaggacccaccacataccatgtcctatacggaaacaaccttcggatataggaggagttatgataaggaaagacaaccagagttcttcatggaaacgacaaggactattcggattgtatccatattggtttccctagttctacttggacaaggggacacctatgggtataaatacaagaccccctaggaggggaagagggcggacacctaccagggagaaccaacacaatcaacacggtcaccacgatcgagacccaccacgagacaatcaactcccaacacaatcaacatagaagcctacatacgccaagacaagccgccggatatcgacatcagagatacgcctagatcgaccctatccggtaccttcagaggccggccgtagggatctagcactatctctgattccgtcgggcgcgagcttgaggaggaaggctaccctgttgtcgactacgagtcagaccttcagaccgccatgtcgacaacagttagatagactaccccacatattatactggtgtgattatggtgaataaaaagcaacatcggctccggccaacaggatgtagcgctattacctgattgctcaggggcccaaacctgtataaaaatccctgtctccatctcttttacctcagtctcgcgtataccctagcaccgacgatccccatactgtccaaataccgtagtcgagacatcaaacgtcaacaggcgcagattggacggaaccctaatgacgatggcattttttggacacacacttgtcaatagcatttcttggattttgacatttgtcaattgcatttcttggattatcacatttaattaagtttgaccaggaaaaaaatcaaagtgacatagagtattatattttaggatggacgtagcattaatctatcttactaatgattttttggacgacaataatccatctccgaggtatgtgacctggtgccagtcagccggtttagcttaatatgttcagcccccacctcctccccacccacacaaacttttctattttattgttggatccgcctctgtagctactgaagtgtaacagcagcagcactaggccaggatgccactgaacagctgcagcgccggtggcagtgtcgatgtaatatgtgttcccttcgtcttgaaaaaacaacattgataataattataggacataaacgaatatggatatgagccatattcagattcactcatatctagttttgatgtactaagttatattccatccttaccaagaatagttttcacttttctttgacggagggagtactccggagccagagctgcaccagtacacgatagattttcgtggacgctatccccttttgtttccatgcgattcgtaagtggaaccgcacgaaaaaataggggaactggcgcctggctgtcgcccacacgggaaaatcaattttctcgtgcggtcctcctaaacggaccgcacagaaaaatgagccgattttccagtgcggatctattaagagagccgcacgcgaaaatagtattccctcttttccctctcacccacttcaaaatttttcctcatttatctcttttaatttctcctcacacccctcccctcttatctctcttctctctccccctctctctgtcacacctctcctctcgtctcctttcggcacgcggggacagtggcggcgcggcggcggcctcagctccacacggcggcggtggaggtacgggatccggcgggcggcggccgtccccgcacggatccggtggccggccggcgttcccccacgcgggatccgctcccctccccagatccggcggaggggaagggcgtcggtggcggtgcggccggaggggagggtggatccggcgggcagcggaggcgggcggcgcgaaggggagcatagatccgtcgggaggcgggcggcgcagatccagcgggcggcgacgcagaggccgccaccgatgaggaggaggaggaggaggcggcggcggcgccgccaattctagatattttattttcttgaaattttattttttttcggtttttttcccgtgcgggtgtcataagcggcacacacgaaaatcggatttttgcgtgcgggaccgcacgcaaaaatcacgattttcccaaacatctgggtgcgtacaggccgtccatccatacacaaaaatcattttagccgcatgcaaaaatcggtcatgtagtagtgctggaggcacccacaactagagattcatcgtgcatgggtgaggtgtgtgtgcacctatgtgtgagcattattttttttttcaacgagtgatccgactggaagaagggttatgcgaggactttgagatcaacagatttcgctttggtcaacccttatttactaaattttcacattggattagagttagacttatattttcacttaaaaccatatatagttaccatcatttacactttggaccgggtttcacaaattacacatacacatagtacaatgattgtagatctgatctcatttcttttttgtgttagaaaacttagaattcaataatttgtactaacactacagttggatattgtaaaacatgtaatatcttttctagaaaaatagttcttaaacttaatatttcttcatttttttctctagtataagggctgtgaatgttcatatgtagtagtaatgaagtcccattagtctgatagtctatcatataacatgttgcaatcttgttcttgtgctaagcatagttgcaacggaaacttttctaggagaagttcgaatctgttccgttcggatattgatcggtcttggtttgacatggtttacgcgttactggttctcggaagagtcaatttctccattagctataccctttcttaccctacctttggacttggcaaatttccataccattgtctcttgtaaaatgctaagcacctagacaacagctggtgtgatggtacctataaaatccggtccaaagtgtaaaaaacagtaattatacgtggtgttaattgaaaatatgaacctagctattacccaatgtaaaactttgatcaataaagatggtccaaaataaaatttactcatatagagtaaattattatatcaatttagttaaccggtctgggaggttgttttatttagtctatgtttttttaacggatttagtctacgttttcaactttacctcccttgtttttcacgtgcatgcttcctatacactgctaaactgtatatttttaaaaaaaaatctataaaaagttgctttaaaattatattattttaattttaagttttaagctaatatttgttggatagtatagggagagaaatattgtgtaatgtggcttaacttgtattaagtatcagggggaccggtatatatggaagtacatggaagaggagataaggaatgattacagatatggaaggtatccacataaatcaatcatatcctaatatactaatctaaagctagcagtgtttgccagctttgattgggccacgtggcagtctttttctttcaaaataaatcctagaattatgtgaaagaaaaaaaaggaaaaaagggcttgagcgttgctgcattgaagctctcctgttatgaggtgctagatctcttataggaataactagcgattaatctagaagaatccagggcatctaaaatattttgaactaaggaccaaatataccaagagcctaaccacaagttgatccgagtactactctctataccaagagcctaaccaaaagttgctttaaaatcccgccgccttgtgcagccgtggatccatcatatattactactctctatacgtacactagctagagcgcacaattgaactctccctttgaattgccgcagtgtggcagccagcgatttgtacgagtagaaatgtagcggttggttggattcgttgcttgtgttgctgggtatatatgtacctctcctgtcctgcaagctacgtgcactggtatatattcgttgcttgggaacatccccccccccccccacacacacaccaagtgttaccaaccgggactaaagatggctcagccggtttagccatctttagtcccggttggtgttaccaaccgggactaaagatagagctgacctttttttttttgcatgcccctgttgctgcatgggttatatatatatatatatatatatatatatatatatatatatatatatatatatataaaccatgcatatatatgtttcaatacatatatatgcatacatatatatatatatatgtatttatacatatatatgttatgcaaatgcatatgtatataggtatatatatgaacaaaatatatttatattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaaatttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtatctgtctataagttcgaaaaccttgtcaaacgtagactcttttttatccattgagtcatatatgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatacagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctatagaaatcttcttttctggacttcgaggcttgaattgtctcttgacttctgatgcaacgtaagcgtcaagctcctcttgcgtgcaatcgtaccccgggtccttgttcttgacggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtacatccattgccgatccatctacatgagtcaaaaaaaccgcacacaaataattattcttacaataatgacagtcatacaataattataagatatctttattcatacaaaaatcataaaatatcacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttcta

SEQ ID NO: 76581 - DNA, 3584 bp, Oryza sativa
tataggacactcatatggggcaccatggtatcaaatacacaaaatcactcaaatttttcaaaattttcaaattgtgagtatatacctagttataataactcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtagctaatgttaatatctaagtaattgaaaaagtttcatactcatttgaattaggtatatactcaatttcaacaatggtgcccgggcaccatggagcaccaaacaaatttactatatatatatatatatatatatatatatatatatatatatatatatatataattttttatatcgggatgataatgcactttagccattggttctgaatgggcttacagatcacttttatccctcaggcagaactctatgctataaaaaatgctgactagtcgccccgcttttcaaaagtcatttcatgtttcatattgtaggtattgatgtttaggctcttctatgtatatttctcctgcatccaatggatcatatatcctgaaggttcaattttgagggtttgtagaagaatatgatctttggcaactagaattcatgctaatttagttttttttttttactagcataaggcatataaaccctgttacatgtagaataaaatcctgattgttgtacgcagccgagagcaaccctccactttcctattggtcaagtgtcagttgaagagaggagaaacgaagcggatgagaaaatgttatccctttatggaattgcaaaatctaatttcttggatggcattcttactgcccagtacagtgaaaacgatattaatctgagatattgttataaggtgatttttacaatctttcactttggtttgttttccagactatttgtttaatttgacttcaatcatacgctctctatggcaggacaatgaactaactttaattcccagcgtgtccctgccttccaatgctgtatccttaggcttcaaaaggcggtttggtccttctgataagttgaggtcagcatttggaattgttgccatgcctattgatctattagtcatttgtctctaattgtctctggtttgatatttttagccaccacatattcatgctttgtaggctgcaaatttccacaaatttttcttgacaattatacactcattagtgagaacatcaagaaagtttcagaactgaaaataacagacattggaggtgttttgacctcaatgactacatctgtacggatattttatctcattaaagttgaaaatacttgcactatttagaaatctgacttgttacaattgtgtaccgcatgttgtagcatgatttcgttatgtgatgtcctgcttgagcatggctttcggataaattttatggataaccttgtcatgtcaagattttgcaaccaccaagcatgtttatgagcatatctacaagttcctgtgtgttagcaagatattctgcatgaatgataatggtgttcatgagttttacatacttcaactgcaaagttatctgtctggcatttttttttcttcacaaagcgttgaaggatatggtgattgcttagcatcattggtaaatcaataattgtaaattttcattggctgatcaattgctcaatttcctttatattcgtgttaacattacagtttaatatggttgttgggatgtatcgactgcataaggccaatttaaaatttggaccaggatattttcagttatgcccaaggaggcaaaagggttttgcatcttcatgcataatctttgacatctggtagttagcttctttcccaatgtgtctttttaatgttgggttccccttttcagctatcgttatgactttaccactgatgactggaatgctgtttataagcgcacagttggtaaagatttcaaagtgaaagctggttatgattctgaggtgcgagttggatgggcttcagtttgggtatgtatttacagcctccttgttttgctatatctgcatatcttacattactattggagcaagagaattagagaatacaaaatagggttcttttagtgatctcatcaaaatctcgaagttttttcttgtccagacgaaaggtttaaacacacaaaactttccatttattaaatctgaaaccccgaaaatgcacatataccaaagttctttttttatggccatttgtaccattgttagccatctatgcttgctgtgcgcgcgctagtgttgcagatatatgtttttttaatgatcaataattaatataagcaatgttgtgtaaactgtagactgtatctttatgcctttcatggggggatcctttgacagctgttttgacaatttcttaaactacgacagttttgttgaagtgctggtttttatggctaaaacatgcaaaacctgactttgcatcattagacgatttgtccattgaagctaatattgccttctgatggctcaagtgtactgtacttttatgagcaattcgtgagtttcgttttcttggatgctaggtgggtcaagaagacggcaaggcaaagaccgcaccaatgaagacgaaacttcagctcatgcttcaagttcctcaggacaatttccgcaatcccaccttcctgttccgtgtgaagaaaagatgggatctgtagcatatgctacattatatactccatttgtatggggataccagtattgggtactcgggatttggccaacattttgttgtaagctgcgtaggatggcttgaaaaaaaaaatccatgaagcctttccaattctcatcatgtaattctgcctgctgtacataacggccatcgttcgttccgcacataagcaatttgatttccatgtaagattgttcacccctttactcgaagttctgggctaacttttccggagtgctatcggatcttcactccgattccgaatccgttttcgaatactctgttgatgtcctgctccgatgctccgagtcgacatcgaaatcggacagcctacggcataaatagagccatagagggacgcgcgcgatgccacggactatccacaaacaccaacagctgcgtcgcatcgctagccaacacgtacgtacagcgcgcacttgcacctagagcgccatggcgagtagggttcatccactcctcgtcgcgttcttggtggtgctcctcgtcggcacatgccaggcaaggccggctccgggaaaggcagcgtcgtcgtcgtcatcgggagtggtggacggcatcacggccatctacaacttcggggactccatctcggacaccggcaactacctccgagaaggagcggccgccggcgccatgatggagcacaccgtggcgcctccttacggcgcggccatcggcggcgccacggggcggtgctccgacgggtacctcatgatcgactacctcgccaaggacctcgggctgccgctgctcaacccgtacctcgacaagggcgccgacttcacccacggtgt

SEQ ID NO: 76582 - DNA, 590 bp, Oryza sativa
agtgttcagttgattccatacatacgttgaagtaaccacaaaaccggaattctttatacctccggcaggtcggaggtcttaaatgctgtaacccaaggggagctttcgtacatcagggaggaacgactactgctagacttctttttgccacccttggactccattagtgcatcaatttgttgactgcagagaagaattaaaaggatcgatgagaatctgcaagactaggcaatgcaacagattgtctgatcgtcaaagtttcaattactaaagagatacattcatgtttcatcaaccgtatgaactggagggaaatttcagtaattcgttctgactatgactattatttgcaaaagcataagaaatttcagactcaaatagcagattgtcttgtcatcaaaatcttcgttgcttttgagacacattcatatttatcaaccatatgaactacacaaaaaaatcaccaattcttttggactattatttgcataagcataagaaaattcagactcgaatcatataaccaaagtcttaattcctttacattcatgtttcatcagacatatgaactggagcgggacaattatttg

SEQ ID NO: 76583 - DNA, 9343 bp, Oryza sativa
ggggtgcgggaggctctggaatccctggctcggggttttttccgtttacaaccctggactactgggttattctgttatgtatttctgtgtctgtatgacagtgttctactactgcagtggtattattactcgactgaacagtaaatgtgactgtcagtctgttaagttcagtggggacccactcattactacatgcaggaaaggctgatggcttttttagccaatattttgaacttgaaagtagaatttgggtggttccaacttctaacagtgtgaagtttaaacagtgatcccttgtttggtcgtatgatttgtcaactctttggttgtgcaaagaccaaccacgtggactcttgtgtctaggcaaaatcacttgaggatgtgttcggctgtcctatttcaactacgatacagccatgttgtacagtaatttgtgtcattgcaagcagctgtgtgggtgcattgcagcagtcgaacacaccctgagattgtactcccatagtcccgtataaaacaaacttaggatacatcataatataatgaatctgaatagaatggatcacatcccgttctagatttgtatttttactagttagcaacattgaccttttctcgaaactttttaaatttttcttatggatagaaatcaaacttctactttttggatattttctttaaaaaaagcattttaatttgccataaagcatggaagttcaaacaactaaaaacacgtgttactttttttaaagctcatctttcaataattctagctttgcttgaaacttttttcaaccagaactacaatatcggttatttttcacccttgatttttaaaaccaaggagaagcattgacggtgattttggttaaggtgtagtatgcatgactccacctattagagtttaaatcataggaaacataaatgttactccctccgtccgattcgtagcgctagaaaatattccatccgattctaagttcttatattttagaacagatgaagtgtgcatatagggttgcgcttttgatactcctttgtttcaggttataagatgttttgactttggtcaaagtcaaactacttcaaatttaactaaatttatagacaaatataataatatttatattatcaaattagttttattaaattaataattaaatatatttttataataaatttatttttggtcaaaaatattactatttttctataaatttggtcaaatttaaaacagtttgacatcttataacgtgaaacggagagagtaggttttcagtgaggctatttttttagaaaataggacaaacgtggcctctacgtccgatcggatgtacacagccaattttaggctatggatgtgttgttgatctttgtctgtgttaaggtggtgcattcaaggatatctaagtaaggtagtggtgtgcgcgcgcgtatatgcgtcttctaagtagttgtaaaaacaaaaactaaacaaaaaggatacctttggacatatattttttactccgttttgttcgtaagtaatcttggacaaaagaacaccttgaattggccgatgtacgagcctgctcttggccaaagcgtgtaaattatgagaggtttatggtattgaccacacatgtatcaatttacattggaagctccgttcacataatccttttcagggtgaaaatgtattgtcgatgaaacaaaaaatgaacacaatgtgccgctgtgctccttgctttgtctcgatcagtctccggggttgtgaacttgtgataccacagcgttattattggccgagggaaagatttaccatgtactaaaacatatccagggcatcgaacgtactcttgctctacaaaaatcttgtgtggaagatcgccatttctactgatgacctggaactgatcgtcataccaggtactactagtactcatttttcctgcaatcagacacgcataaacacggaattgctgacgatcagcaacatcaacagccgctgttccttgcaaacctgtcgtaattaagcacacggagacggcgatttgcagcgtcgtcttcagagacacacactgcaagtctgcaatgcaaattcagaactactcctaaccagcaagacgtagctagttaacgacagagccacgcaaagagaacgcgaccgcctttgcttcttcttaaggcggagagggaaaaagaaaaacacgaatctgataacgagatcgaggtcaacgggagcagagatcgaagaagcatacatgacaaaaaggaactcctattgcagccgcacctcaaatgaaccagagaatcgacgaaaccatgcatgcgtctcacgaacttgtttgctgatggtcatctaaccacgcgtgcccaagagccaataagccgactgctgcatcgtcaattattctccaatctccaggcatgcacgggtagctagatgaccagcaacaaaacaggttcatgggtagcaataatctcacctgcacaccacgaccacccctagtattctactagtagcaattagcaagcccagagcataatctggatatattgtcaatgagaagaaactggagctggacgcctggaagactggaagatggggcgaatgagatgaagctgctagtgctgtattgaagcgaaggatatattttggatcgggtaggtgcgtgcacggaagggatgatggtacgttgatgccagcgaattagaggcatattcgcgaggaataaaccgtcccccgcagaagcacgacgacatggaagcatcaagtaattaagcaggagacagtcagcaacatgtatgtacgtgcacactctgtagtgacgctgacgctgtgccactggctgactgtactgcctcttctgctaggtggagatgatgagcgtagatttggatcaacggtcttggtaaattagccgtgacagggaggagttgtaccagcggacgaacgcgtggattttgcggttgtccagtcatgaaaaaaaaaggaatactctctcttactcgtagagaaagtcattttggacagtgacacggtctctaaaatacaacttttacttattgtttctataaaaaaatatttattgaaagtattatatgtatacttttatgaaaatatttttcaagacaaatctatttatataatttttatattttcaaactcaacaatttgagagttatttatgatttatattttcaaggtctgacttaaacattgtcctaaacaattttctttacgagtacgaaggggtattatatatatccagatatactcctttcaaaaaaaaaatccagatatgagcgatgatggggcagcagaggaaggggactgttcggaacggatgaaacgctcgcaaagatgtggataatttgtaggcaaaattgttcccctctcggactgttctaccatgtgtacaaccatcctcggggcagcatcgtggacttgtggtgagagaggcctgcggcgctatctacgagggccacgtacgactccacgtgaccggcccacggggggagtcctaggtctaccgacgcaatgggctgctacccccttgagatacaggcgagaggccgagagccagcccaacctgcatggcccgcgcgagtccctgacgtcccccgcggcgcgcggcgctggtgtgagtgtgtgacgccgtgacggtgtacgccgccgcaacggattccacccggcgcagcgcgctgcgcaaccagaccacgcgcgggcgccgcacgccagaggcccagagtgcagacgcccgcctgtgccgatgggtggagtggaacagaagaaccaaagctccgggaagtattttctacacgtgtcagtacctagatggtcctgtttggcacggctccagctctagctccatctctcctggagctgaagctcaaccaaacagtttcagttctatctaatatgggagcggagctgggtagagctctctcacaaaatgaactagagaggtggagctgggtttaggcagctccataactctactccagactcaactgctggagctaaatttaggaattggagctctaccaaacaggctctacatgcagtttataaataaacagttatataaaaaattataaattttaataagatagcttatgataatataagacactgtacaaacataaaagtctaaattcgatcaacaaaataacagaattttttttgtcgtacaagtattattcattaccgatgttaccaattattttttatatttttataactattcaagtcacgagcaaataacgggtgtcatgatagctgctgcagagaaccctgtcaaccgagctctgctcgtcagcccgtccgtcgtgctgctgcttttgctgctccctccatcctaaaaatacttaatctagaagaggatgtgatttgtccagatcgttattcagagtccatatcgtggttgagtttttttaagatgtagggagtacttggcaaggctagcaaagtgattcgctatatgtagttatgagctgatcattaattgattgcatgctgcttgcattaaaaagggcgatatgtgagcatttcttttccttcaatctacgtcaaggtcactgctcgtgctcggcatacgcctcggagagtggatcgtggttaaagcaggaatttagtatactaccatcacaaagtctaagcacatgattttcgccaagacgatatttgctatggggataagaatacgagaacaatacgcaaaatgacaatatataacgcagtaggagttcgttaacgtcaataggcgatgctgaatattttttaatgtccagtgaccagaatacagcggcgccccctgttttgccctggtttgccatggctgctagctgtcactgctcaaaagcagagcggcggcgacggcgaccaacaatttgtgaagcaatgccaagctaagtttctctatcatttaaccacgtactgtttcattagtctatggcactggccacctgcctcacaagtcacaaatttcaattttcaaacgactatgatacaggcaagttggctttgctagctaggcagtattaagatgccaaaccgccacatagctagcttacatacacgcaattagggtcaaacattttgctctctactgcttccatagttccaaagacatctcaggaaccaacactgtttgctcaaggtgactgttcagtttcctatgtttgccgttccagttcttgtacatacaatgctttagatgtctcctagttcatgcatactcttctttctgcaatatgtaccagagatttatcagtttctttttttttctcgcaaaactgaactggagtagggaaaaaaccgaatctttaacatttgatcacatttttttttttgcagggctagctagctgctggtgatcacacagcatggcgaccaagtacatcatcggatcagtggctgcatccttcgcattcgcctatgtctgcgagatctacatcgcggaaggaaagcttcttggaggtgagctagcttaattatcttctctgaccaccgagatctccttagctaagctgcctagctagcttaagtacgtagcttgcagtttatgtgctctttctcttgtgttagtgtttattagtttgtgtttacttcagtttatttgtgttttatgacttgttgaggtgtgctcgtgattgagtgaattggtgtaataattgactgtaactcgttaagtaaaggccgatattctattccattatctaaacaaagtagcttgcaggtcatcagcatctgaccactgcttgcttgcacatgtgtttcttggcaaaactaggcacgacgactcggaccatggcgactgacgagtgggggaaggagacggacaagaagttccaggcgtggccgcggacggacgggccgcccggtggtgatgaaccccgtcaggcgccagaacttcatcgtcaagtcgtctgaataaatcttcttcatcagccctccctagcattctctcggggaagaaagaaagccaatattgttgcgcgcgtgtgctgattaagcccgtgcacaattcacctcctgtttcagactttcagttaaagcaaactagcatgtatttttgctgtaatttttgtgttaattcccggtgagaaatcagctcgaaccgcacggttaaatgctatagcatcgcgacgatcctcgcagtttgtttctgataatatttagtgttcttcagggacgaaaatgatactccgtagaatagtaacctcgaacaatttgtagtatttatgttcgaaacagatttagaatttgttttgtttgaagttgcaaacataatattcagagagccgcatcaaaattccataaattaaattcagtatacccggcacactttgtcgttccttggtgcaatttgaaaacaaggggtttggagcatcggttgctataggcctatagccttgccggcgaaaataagatgactaattactcaatgatttgtactcaaatgatcgaccaggaattgaaggtagcaatgtagcattcatattgcaaaatctgtagtacattatattgaattgtttcttacaaagaatacatatagccagaagggctgcctatttccagttagtaaagtaggggagtgttaacctatattgaatctggaaataggaagaaaacctcatgtgcttaaaaaaaatataggcctcatttagaatgtaacttgcctacgtttctcttaacaccatgaatgtgtttttattggaaaagttatagtcgaggcaacttagaattaagcatcggagcatgtatttttatggtataagctttcagaaggtgttcttgcatacatgaaaagaagaaaagcaaagaaaaaccattgaactaattgtaagtgtagaagttgtgttgcattacctatttacctttactatgttgaaagtgtaacaaaatatgtgcatctaatatatgaatgtgtgaaccttgacactatcaatgaattctcaagtgttgaaatccaggagatttgtatggtagacctatcggatccaccaatcagatatactccatctaacacccataaatacaatttaaaatacacgtcaacattaatgcatgaaaaatcataaatgcaatgagtgtctaagatcctaccgtgcctctctctatataaactcctctaacatatacaatagagtccatatcgaagtaatattcttctaatatgtccaattgtccaccatgaatagaaggatgggttactcataggctgttgttttcatgtcttccaccttgccatctgctctctaagacgttaactttcactaaactgcaattttaactttttgtttattaacctttgtttgatatgtgttcaataatctatttcagttttggatcatttttcgaatttgacaaaattacatgctacaaagttgagttctactaagggaatatgtataagcttacatgcacatcctgtggtttccctcgctctccgtactactgcaggactaaaccaaatggttcatcacaatgttgttgtgaacgatacttcttcggtgatatcagaatgacattagaagcgatcaattggtggccttcttgcttggtcaatattgaaaaaaaaaatgatgttcaggattgaatgtaatagtctaatactattagattccatgaatgtgtacaacaatataataatcaataaattctcaaatcttgaaatctacaataaatgcaaatagggatatgtccaataaatctaaccatctaggaatcctgcaaaccatatacttgcgctatctaacacaattaatgccactgcaaatatatatcaacatcaatgcagggaaaaacataaatacattgaatgcctaaggtctattgtgcctctatacaaactcctgcaaagctctaacatataaagtggataagattgtgttataaatcatctaatatggccatgagaaggatggggaacccattgactgctgttttcttggctgttatggtcatgtcctccaccctaccatcttgctatgcaggtactagggatatatgctctctaagactttttaactttcacatcactacactttaacttttcatgtattaatctttgtttcgatgtgtgttcaataatcaaatgttggctttgaatcatttcatcgtgaaacgtgaagccgatgaagggacgtgctacgatgtcatgttctgccggggtgatgtgtgcaagcttagatgcagataccttggttaccctgacaatgctccgtgctactgcaagagtaaaccggatggttcggcacaatgctgctgcgaacgatcatcactctgatatcggaatggaaccagtgattaatggtggctttcttgtttggtcaatgctatatatgattcatgattaatgtagaagccattgatccctacttgctcttgcatatgtaaattggcgatcgaacaagtattttcaggtctcatgcatactcaataaacttggatttgctatttgttactacttcactgaaatttctaaacatttgttttcatttggagaatttgtgattgattactactagttcctcgcttcatgctccttcaattgcaccaagaggatccgtagaacatatgaatagaataatctgtagaagcagaacaagagcttatctgtaattgtccatatgtgatacgtatatttcgattttattgttgattcgtcgacattgaatttggtttttcagacttgtgtaaatcgatgaatattctcttaaaaaaacacaagctggatgtatttggtgatgatgatttatcatttgagttgtacattatgttcaagcgtaaattgcgaggtttgtaactctgccatgtttaagaagattaagattaagattctgagaaaccagtttataagaatatagaaaatatttggaatagcttatgactgctgaagattctaaatagttagaactaagagtatctccaagagattatctatttagctctctaagttaaaatttagccaacatagaaaaaaaaggagctccaacaaactttccaaatagacaaattgctcctatgactagccaaatgtagccagccaaatgtagccagcctcttccggctggccaaagatgggtcccaccaccactcccagccccatcctttctctctctcctgtccacccaccactggtccataggagcgccatcggcgagcgaacgaggaaagcacgaggcggcggcggcggcggggacgaaccgagggcgccgtcgacgagcgacgtctggtccacagtccgctgcagcaggcatcatcgtcgccgccagcggggagccgtcgccatatgcatcgctgctgccgcgcgaggagttgtcaccgccgccgcctcgcgcgcgtgaggagcaccct

SEQ ID NO: 76584 - DNA, 7073 bp, Oryza sativa
  unsure (1)..(7073): unsure at all n locations
ggtccactgtgcccggcagcttacctgctgctggtttagctttcgtaggttgagcttggaagaagctagggttagggtttgattgggctgttgcgctgttttcttcgtggttgcaggtgtaccgccctttgctgaacatctcgggggagttcacggcggaggacctcgaggaggcgcttatcactcccaatagtactctagatgatgtgcacatgccactcctaaaggtgagtgagccctcgggctgttaagttcatgtcgaatttgttgctgctctataggctggaatactctgtctgtagttctacctccacgtggttcattggttcatcatcagagagaggatagaagttgtgtccttgtgcttgcaagaagtaataattataatttttttgggttctttgtgactttgagttttagcgctgttgccagttatagtgacgtttttgctgatttttacatttaatgtatgagaaaatgccataatagcagctacatgttgttcttgggcttatgcttactctgccataactcgaatatacctcgttaacatttctgtgtatatttgtatttgatcatgttgtttgtaactcctattttgatgtcttcttagacaatacacgctattcgattagagctatcagatagactctgcattatgcatctgtatgttagtagatattttatgctcaaataaaaatgtaatagtatgtgaaagttctccatggaatctcatgatttttattgcacacgcagtcaattcctccagtaacccgcatggctatgggacgtggaacctgggtgaccgtcctatgtagaaagctaagggattggtggcattgggtatatgattaatattctatgtttcagacaactttgataaataatggttgcagattccattcaattggtgaggtattaactgtctgaactgcaggttgcagaaggtgatataccaattgttgcatcacatgggttagtttagctcacaagaaatcattgtgtaatctcctgctacaaatgtatatttttttcctcagcattgttttcccaactgtttcatcttccacagaactgaaattgaagcatacaaggttctagaaccggcgactcgtttaattatcttgaaagcaatatgcgatatacgtgtcgaggtacgtgcttatttttcttgtcctttcctagtataaaaccgaaggaagtttgtctaaatgacttgattttttgaaattttctaatacgcgctgtagtatattgttataatcatgttgacattcttctgaataaaatctcatcccttgtcatttgtatcccgttatcccacattcgtgtccttgcaatgttgaaaacaacacttgaatatgatgactggtatttcatccactaatccgcttctgcataatattgttgaaacattttcatcgacctgtacaattctggtgccaaaggaaattcttcatcaattcattaaaaagggaacaataataccctttgtctattcctgcatatgaacctgccagaagttaaagatacattgttgctaaacgattattcctttgaaaaatgaaagcagctgttacttttctatgatgtgcattctgtgtaagggataactactagttccaattaaaattgtagaatttctttttcaagatacacttcctcttttatacatatgtgtaggatattgcctattgtccctttctccttgcacaactgtagagtagaggattctgcattaaccctgatgcttcatagtagaaaaataaaattgaagatgatttgaactacttcctgaagtttaataaaaatacatgcttgatagttgatagtgaacacataatttgcctgctctcttgggcaattaaataaagtggagcaagagaggcatgagcacaagtctgttgaaatcttaactcaccaaggtatgcaaaaatattaaaattttatatgtgaaaaaaacagaggtactatctgcaggggacatgctcgtaatagctaggttgggattattgttgttttggatatatctggaaaaaagagagaggcaattttaggttttgaatcgcatgagcttaactagatgactgattcttaagcatatattttgcagcaagaggatatccggaatttcattgacagttccctaaagcatggctatgacctttctacctttcgtaaagaacgaatagggggtgatgcctatggaatctcatactggtgggtattttttcctagttgctatttttgaatggactgtcctggaagtttcttgttccgatcccattaaggggtgtgctgatcaagtctttcagaacaggtatgaagatgatccgattctcgggcatagattatatcgtgaaattagacgagtggaacagctgaagaaagagccaggaaaaagatctagggggaaaggagggtctataattcttccagttgtgtcctaccagtgggaaactgtcgcatccaactttgacgagtttgatgatgttgcagtaagttgagttcctcatatgtggtgtagaaagtgagttgtagtgtttttcctgaagacttatctttcgacaagggtaaaatgctatgtaacctcaagtgtaaaatgagcatcgttattagaaaaaatgaggcaagagtaaatgctccactatcttataatatggatatcttaacttgcacagggttatagcctatatgattaacttggttacctacacaccagccatgagaattaagtatgtaattcgaaatataaatttgtaatctcgtcaaattgaattaaaaaaaatctagtaaggcatttactggtaagaatacaaaaaattggaactccatgtttatccaggtaatctggctgcatgtggtaaccagtcaggccaagtgcctaggtttctttggtaaactggcttttgaaacctttgcttatatgcatcttttcattctcccatactgtgctgccatctagtgtttaatggttgatcacatgttttcaaaagtatgttgatagtagatagtggtgtaaccaagtcgacttaattataatccccaaccaatagattagtacctaaataatgttcaaaaactttcttgggtcagaacggagttcatttggaataagtgctgatatgaaccattcaactaaagctactttggactgttattgttaaccttgtggcttgtgcttatatttattaagtgtagtgacatctaatgatattatatacttctgccttaggaaaaactcttttcaagtcggaacaggacagaggccaaccttggcaagaagttgaagattgaatatcttccagatattgaaaagatacataaagtatgtagcgtgtttaacccagcctgttttgccagtgaaagctgtttcaagcttgttaattaatgatttacctattttcttattgcagaagaaggagaggttgctcaaaaagcaacaaagagaagcccttctcattgatagcttcttggctccagatggatttaccactggtcgctctcttcgtgatagaaagccagtaacatacacttttggtaagcaccaagagtctaaggctgaacctcggtatagttatgaagatatcccagaatggaaataccatcggtgtggttctgtcatgtggtccagaggtccccacttgtcagtctcatgctagatggtattatccaatcatatatctttgtgatgctactttgttaatttttctttattttgatagcagcgatgctttgttgcaaatgcttcacaattattaaactctctcatttatttccttcacattttagatatccaggtgatctacgtcacttgctcactgttttatttccctacgcattgatatatgccagtaaaaagtcttatttattctcagcagcaaattactgatggaattataacataactcctgaaaattttaaattgaagtgaatctatgttggctagtttaatacagatttatctgacttccagctgtaagataatatagtcagtaaacttccaaaataaaggctgattgttaaatagaggttgctaattgatagccagtaccatgtggtggaactgatctagcttccacattttgcattcactatctatcattcctccattcatgtccatgacaactggagtatgttatatctatttcattacttctgttcagttaacttcattgattcaaattaaatgttttgactctacgtatggtgcagatgaatatgaccgctcaataagtgaggccataaaaataacgaagtaggtggatcgcatctattgctcagtaattttcacttggaataaaaaaaacttttttagagacaccaacagtttagcatacttatgtgcccctttcatgtgcaggaaaggagaaaactctgctgagcctgctgctccagccaatagaaggatccttacgccaagaccggaggcatcgagcaatggcaaggtgaatggcctctcaccgactaccaatgaatatgatggaaattcttcaaagtcagatgactaccgagatagtgatggtgaagaagaaagtgagacacttgatcggaggtacatctttcatagcatttggcatttatcacttgccccattggaatatatgtgttgatgagcatccatggtttgtattgtagcaaccgccggaggaggagatctcagagatatacacgggactttgtcgaggctgtctcagatattgacccgaactttgacagtgacgatgaaatcatgggggaggcagtctatgatgaggaatatctgagaactcgaaaacagcagaagacatcaagtgcttctgaagaggatgaagagttccgatatagacacgaagncantgnnaactgggnaatagaagagagaagagagaatattctttgaggataccagtggagagatttagnnanggaggccacnnanacagacgcnaaaagaaactgcaanaactcgtggcnncggcgaggggccaagcttagatctgttgatgaaatccaaacaggtcttaggcgcagcaagcgttcttctcgtcaacgcattaattaccaacagtatgattattcggacacagacacagagggaggaaaggaaggaaaatccgatgcatcagatcctgatgctggttttgatgcagaaaatgatacggaactctcgacatcgagtcaagagcaagaggaagatgaggatgatggccctgaggaacaaaaggacaatagcgacgacaataaaatggatgaggatcatgtaatggtggaaaataaagaagagcaggaggagcagccgcagccacctccactgccaccacagcagcctgtggaaaaaatggaagctcctagtagagagattgaaactgtagggagaacatttctagatttaaatgagcttgcacctggaggtggctttgacgatgggccaagcctgactatgaaagatgaggatatggataacagttaggaaataagttttgtaatacaatcgagtttagtaggcgctgcttggagcaaggtgtaactgcgtgaagtcgtgggccattgccatagatgaatggtccactagtaagatgacacagcaatatctgaacagttttagatgattgctgttacatcgatttacagtgacaaaagaggcgaggttccaccgaggttgtggtgaaaagagcttcaaatgtaacagattgcttgtttgatacttgggggccatccaaagggagtttttcattctattgttgtacactacacgaagggcgcgcatcggtcgctgctgtattatgtccagactgattgatgctgtgttgctgccagatacaaacttgtagcctccatttgtttagctctaggcgcgatactgttgtcgggaaattcttgcaacattcatatggtggaaacttgtaatacacctaagtgctgctcttctcggcatttcttacggctatattccacttgtagaatgtagtttttgagtctaagtaaggcctgtagctcttgtatttatatctgtcaacctgattagattggtacatctgtgtgcagttgatgacctgatactactgagctagtaggatttctccagctaagggtggtttgtttggaagtcgcctttgcgtttatttctgcctgagaagaacggaagatgcagctgaagactctttggagtttgggattaccttcccaagggatttctagagattcttgtttggattccgaaaatttttcatattcgtacactaactaaatagtttcctacaatactcctgtgaaattcccttgtttcaaacggatatataaatttattccttctaattctgaccacatagacaaacaattaataataattatatattattaaaaattgaagatgtttccgtggcctgtcattcgtgtttgagtcggttataaaaattaaagatgttttcgcggttcgtcatctgtgtttaagtcggttttaatctaatgttttggttttaatctatatctcttctcttctatatctatactattataaaaattgaaaatgtttttattatattttggtacgtcatctgtatatgagtcggtttttaagttcgtttgtttgtttttggaaatacaggagcaagcttgtagtaattttgcaagcatacggtatactgcttcgcgcggaacaaatggaggaaacacacacgcacacacaacagaacataagcaagaacaagcaaatcatgggtgaatcaaacatatttacgatggagcttgcacacacacacaagctagcagtaccggaaatcagtgataaatggatggaaagatggagaagaatgtagacttcttgttagctgccgttcttttgctttagttcgacatccgtgtatgagtcggtttttaaattggaaatacatatctgtatttgagtcggtttttaagattgttcacttttggtaatacataaggaatcatataagaaatctgttaaaatatctcacatgctaacttgagacgatcggactcctaactgcagctcatgattttcttaaaaatatatatatccaaacgaactcccacagagcatttcatcttaattaaaccatataacaataata

SEQ ID NO: 76585 - DNA, 702 bp, Oryza sativa
tgaaaagagaaccacaccagaagcttttcagctgcttcacagatcttgtctacctttgcttcagataatcccttgattcctgtcaggctctacaagatggatccatatattgaaacaatatcagataattatattgtaagacagaaatgggacaattgaaagaatataatcgtcataaaccagaaatagaacaagtgggagatagcatgaagatttgggaacccaattttgcaaccttctttgtatgcatcatgaggccattgcaagtgtagataccagcatcctgcagcttcttcacatctccagagtttatcccttgcgagattactgtggacaagtgcacgagagatggataataatgcagagattatgctcaattgctcatagttcgaattcatggatatgaatgaataatttgcaggaagaaccatatgaagaatgaaacccagggagaagtcaggatcacaccaaaacaacttactaatattgaactcgctagaattagggagccaccagaaatcgtaaaagtacaagagggactcaagcttaaaccctaaaccctccaagtacacaactggttcaactaatatacactcaagttcaccaaaacacaactggttcaactaatgggcagaaccccacatgtttgaactagccgggggcgaattccgacgagttccaccaaacgcgggctgcaggaat

SEQ ID NO: 76586 - DNA, 631 bp, Oryza sativa
cagcctgctgtaacacctgatcaacgctgcggcgcactgcacggcttgtcctgttcgcagcttgcctatgacagcaaatttaccactcccatcttccgtgtattcaatgccaagatgtatatttcgcccagttgatatctaggtcaaaagatcttttacctgaccattctggtgttgtgattcctcaatgaggtgtaagggtgtttgcctgtgttctagctctgttgttagttctgaattatgcttcaaaactcttcttttttagctctgtgttcgtcagataagctgatggatttgctcctgtcatgtaaacaaaccttctaagagacagcagtatctgattgtctgaattcatgattgtgcattactgaagatttgtcctatttccccccatgtgcttcactcaagattcccagattatctttgtttgattatatgctagtactactattattcgtgagaagactggagtatgttccgttgtgaaattgaaatgggattcacgggaaaaacaagattctgaattcaaatatgtggtggtgtaaggacaataactgacgacaatcaatgtggtacagaatcaaatggaaataggactcaccagtaccgctgcagagagcgtacagaaatg

SEQ ID NO: 76587 - DNA, 680 bp, Oryza sativa
  unsure (1)..(680): unsure at all n locations
agttcttttcccatcaaactatgagatccaccagtaaacttcaaaccatcaacaaaaggacctagagaatccaatatttcctgaaatagaacaggaaatgacagccttgagaacgagctgttttattccttgaaatccctaaccaggaggttcattctgttttcaagtgatgtactcctatctagattctagaattttcttcatttgaaaggaaacagtaatataaaatcttcctagtcacagcttcaatgcagcaataaagtagccagaagttcatttgcattgcaagtaagcatcctcaattctcaaattctcaaatggcattaagcacttcatataatcacgggaccatgctatgtcgacataagagggaacagcttggttaagaatctaactgataaaactagctgtagctgctacgcattctgacatccacaaatgtaccacttgatctacaaactgacactgatcgttgatcgcacagactgaagattccaatatggtggccctgtttaggaattaacaaataaacaatcaagtcacgaagaattatgcagcagatagggcttcatttcaaacacgattcggtgggaatcagaacgcgattaaaagttaaaactacaccaaattccacaacccagcagcgattcgtagaagcatgaaacanaaatggggatgga

SEQ ID NO: 76588 - DNA, 3746 bp, Oryza sativa
attgaggggagaggggagagggaagaagaaattagggttaggttttcactggatgaatcttaaagcgatctaacagttcataatttccaagattttaaggggtattttctatcaaatgacatatagacagtcccaaaaaataattagaaatgtcaaaatagtataaaccacacccaattatcacgcttgttttgaaatttcaccttataacctatttagaaaattatcacgtacccctaaatttttacccaatatctccctctcccccccattttactaactcttttacatacccttgaatattttgtttagatcccttccctaacctttccgttaattgattgttaaattcataccattttgtgccctttactatgaacaagctggagtcggactcatcccatagccacgttcgttgagcccaccctgactgaatatgacttgctatgaatccatgcggaaagaaatagagaaaatcccttgtatacccatgaaaaaacttacctaatctcttctataccctccaattttactcgatctcctgtgtacccccaaattttcactttggtcccctccatacccctcccgttaggtttccgtttgatctgtagcgtgacctgtgtgttacattgtcagtattttcaaaaaataccaaaatgcccctgccagccaaccctaggtaaacagatccaatctccttctcttctccccccatcctctgcacgccgccagtctccaatcgcgcggtggccgccgtcctcccgtcgcgcggtggggcgccgctggctcccaccccccccggtcgtgcgcgccgctggccgctgtcatcccgtcgcgaggtggggcgtcgccagccgccaccctcccgtcgcgcgcgccgccggccgccgccctcccgtcgcgcggtggggcgctgcgggccaccgccctcctgccaccctcccgtcgcacggtggggcgccgccggccgccgccctcccatcgcgcggtggggcgccgccggctcacgccctcccgtcgcgcgcgccgccggccgctgcccttctgtcgcgaggtagggcgccgctggtccccgccctcccgtcgcgcggtggcgcgccgccggccaccgccttccagtcgcgcagctgccgcccatagccctctgtcgcaggcaccgccggccaccgtcctcctgtcgtgcggccaaagtccgataccctctcgtcgctgcgccgccctactggtaggagtagcagcaattttcatttcttcttcttgcagttttcatttttgtttgctgttgtgatgccttacaaagtgtttgacatatttgatctgtcatttgcaacatttgtgtatggagtggaaagttggtttggttcctgcactattgggtatggaaatgaaattgtggtatgtgcatcatatgagctgttctgtatggatgataaaaatgaaattgatatgaagtgctctgtatggatgatgaaaataaaattgtatgaaatttatatgaagtgctctgtatggatgatgaaaataaaattgatatgaagtgctatgtatggttactactattttgattgatgatctatgatgatcttgatgctcttattgatccagattattttgtttcacagattttctcctttgtccacattcctgttgagtgtaccaattttttttacacagcaaactgatgtcactttgattttccaaccctattattttttttcaaaacaaatcgttcgatggattgcattttttttccaataccacaataaaagttttaaactcattattagtctcataaaatacacatgttgtgcggtcaacatattccaattcttttccaatctacctgcagttgctcctccatctaaagggcattatagacatttgcaaccacacataactataaaatgaagaaaacctaacgggagggcatggaagggatcaaagcgagaatttaggggtacagaggggttcgagtaaaattgaaaggtatagaagagattgggcaaatttttatgggtacacaagggattaactcaaataaatagaccgaatcagttagttgcatgtgtaaactatgatgggagcaatttcaacatagtagtattaggtgggtggtttttttttacataaaatacgttatgggatagaatttgaaaacaacactgataattagggtgttttatgtaatttcgccttttaagttaggcaatttttttgctttaacccacaaggaataagtccaatttaacttcatcaaatatcagtccgatttctgattcatatttctcaaatgaaaaaccggatatatcgattgactcctataaatatttaaatccatgcgaaacaataacttttgacatgaaatatatacgaattcatgcatgcacgatgaatgaatcaatatatatttacgacaataacttaagtttctgaatcgacagattaagctcatccttgtgctgctgctttccgcagtagaattcggctgggtgcagaacgcgtccgggcgggcagaaggcacaatcgttgccattggcggcggcggcggtgagatcggcatcggccggcagctgctggagcacggtgcatgtgtcgacgaagaagctgtcaaggacatagggggtgaagcggagctccgcgaaaaccaggcaacgctgcttctgccagtggctgttcctcgcgcgagtgcgagccacgaagttgatgtggaggtagatttcgcctctgaatcgggcgcagcaggcgttgatgggaggcggcagggggatgagcttgctgtcctccacgggatcgaactccaactcatcctctgctctgctgcagaagaaggcgtggtaaaaggggaggacgtccatgatgtactccacgcgccgctctttctccgtcactggcatcgtccttcttgtaccccgacgaccaactgctctcaaaactgaactcctcaccttacaacaggcttccccggccatctccaataagattgcgcatgacaaacctgaccccattgatcgatcgatccaagagttttggttttcttgtttttgagctagccaccgtgattgattgatctatagatcgattggtgcctggtgtgtgtatttgtaataagcaaattaattaacacaaatcgatcatgattcggatctgaataagattaacttcttatcctacctggattggattggatacacagaattctagttagaaccggacattcgtaatcctaatccaatttactaattaccactttatacgtacaattattgatcattcttctttaacaaaaaaagggacggatcgtttttgtgggtggggggtccgtatttatttatttatgtgggccggcatcctccctgggctggcccatttaccaacacaaccgccttcctcgacatatacacgcttctgcaggggcttctctgcaattttgcaaccgcgtcgtctcgtctcgtcgaggagaggatagagaatcgaatccatcgccgcctagggtttccttccttgtcaatcgcgcggccgcggcgatgaccacggcggcgcggccgacctgggctccggccaagggcggcaacgagcaaggcggcacccgcatcttcgggccctcgcagaagtactcctcccgcgacctcgccgcccacaccacctcaaggccaggtactctttcccccttttcaatccatccacatcaattcgattcgatttttagctatgtgcgtgcttcgtgtcgtggagatttggatcggata

SEQ ID NO: 76589 - DNA, 7049 bp, Oryza sativa
atattgagcttaattatgttgcttgaaaaatattatgcattgataggatcgcacttaatctgtttgtcccgtctgcaaggcagattggcggacctacctagtttgttgcatttgatccttcctttgttaattgttataccatgttcccttgtaaccacccagttgcgcctcggaaatcgtgcactctgcacgagtatcgacggtcgccttcaaacttaaaatctgaaaaacaacttgggtaaaacttgggttttacaaaagacttggaaaacccgacacctgggtcggtgcttgcgaactaaataaatttccaaaaccgcggaccggggaacgtaccgggtgtacggtttcccgctcttgcacttaaggaccgtttccttagaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttgaaaatgccttgtcatgaaagcttggaggtctcccgacgtggctgatccccacaggctgggtgatccgggttagtaatgtcgtgtgggtaaaatgtaccccctctgcagaggttaacaaactgttcgaacagccgtgcccacggtcatgggcggatgtgaggtgattcctagcgtagttttgtttgactactccttgtgaaattgctgttgtgaaaaggggatcgatgtttggaaaatctgcagctgatgggatcagctaggcccgggtggccgtttgaaagttgttggcccgggtggccgtttgaaagttgttggccgggtgccaatcttgatcaattctaaagactgatacattgcacatactccgaccagacgagacgcactgtctcatccgtgtcgtttgagaagcactcacttagttgttttcagaaaagagttcaaataaaatcaattgcaaaaacaacagcctttccttgaagcctgcattaaacacttatttcccatggcttgctgagtactcccgtactcacccttgctctatataaataatcccccccagttgctgaagaagatgaagcggatcccgctgacaaggagttcttccaggagcaagccggctacgatgagttttagggtttcggcctagttcccaagtcgcgactgtgttgtttggtccaagtcttggcttccgctttcctttttgtaatgcagttgtgagctcgggatctgtccgcagcccaacatgactgtacctctactctataataaagagacctctgttgctgtgatattctgtcttcctgtgataccagcactgtttcctgggactggtatcgattaacaggttaatttggagcgtcacgggctagttccggtcgggactagttcggggcgtgacagcctgtcatagtacttttattgatgtttcccttaaaaaaagatggccttaaaaggtgacatataaatataaatatatatgaccgaaaaaggagcttgggaaagcatgaaggacacacgtatataatccacatatttagtgatggtgtgtacatgtatatatcactagctctcccactgttgccaatgtgacatgcatgtactgattgcatccatgaatatatcaaagcttggcgtgagtaagtactcaccgctttccacaaaactagctacttaaccatgttgagcttgctcaattcacagacgaaaactaattaacaaagttttctagctaaatagttgccagaaacaaattagtcaacgaactgcatgaaaaagtatgctcttttctttttaacttatctaggtttttacttcaactttaatacaattaattaattgggcagttctctcctgtaggtttgttttttttaaaaaaaaaactgtaattatatgtgaaaggacagagatcgatcgagtggtagttaataagcaattgtcccaaaactattttgtatatacttgcatagaaaaggtaaaagtagccaggacagtgaaggaggatcggaacaagtgaaaatttcggtaaaaaaaggaacgagtgaaaattaacataagtagtaaaagactaaggacagctagctagcactgttaattactagtagaagtactgaagtgagaaaagaaaaggaaataaaaaactgaaagatgcatgcgtgtgtgcgattagactagctattaccttgatctcaaaaaaggaaaaaaatgaaaaaaaaaagaaagaaagaaagagaagaagctgttaattaattacctcttcaaccatggacaagatcctggccttcctcctctcgagatccaggaggtccatggagctcagagacaggttgccccacgaacctgaaccctccacgtcgtcccactttccaatcttgggattgggattgggaggtctctgctgcttggcgccatccatggcctcaacgtcgaggctgcagaactcggcgagcagcgccttcacagggcccaggtacttggaccccctcagctgaacattaatggctgcgccgccgccagctgctgatgggcaaccaacgacgacggcggcgagcctgctgcgccggcagcgttgttgtagagggagagggaaacctgctgctgcgaccacggcgatggcaattgcaaaccccctcctcctcctcgtaggtggtggtggtggtggtcggcggcggcggcgacgtcgtggagggagaggaggccggcggcgtggtcgaaggaggagatgatggcgccgctggcgtttgggggcgacgacatgtccaagaggtggtggtgctcatgatgatgatgatgggccgccatcatcgatgctcgcgcgcgtgtgtgcaaatttgttgtgtgcttgtcgtcgtcgtcgtcttcgtcttcgtcttcgtcggtgcctcacactgatctctctctcttcttctcttctctctctctataaggctacaaataattaaaccatggtactactactgtatatagctctagtctagtatagtatatatgtgaaagtgatgaaatgtgtgctagctagtttgattgtcactcagaaaagtcagctacaacacctgcttaattgttgctaactgatatagctacaacctgcagatgtcaagatttcatgcaactaattaattatatgcatgtgcaagtgcaagctagctagctagttagacacatgcaacaacaagaaatattaagctagctagatagtactggatatacctatacatgttgggtgcatgggtggctaggaattaattaattaatatatatagattggcaatatatatacataattaattcaattcttggtgtagtaactttttttttgtctctgcccctccatggagttggactgattctatatatatctgcttgcttaaaaatatatgaggctatatataaactaatgtgactaactatatacatacatgtacggtgtatagtgtattgaatatggatggatggaagattattgatatgcatcaacatcatatatcgatcttcatgcgtgcatgctcccaccaacaaattaaattcaatctatctttctagctagctctagctagctagttaggttgcatatactggtagtactaggtttgattgatctcctccttcctacctctgcaatgaagaaattaaacccagtttttctttattttctttttcgatcagcagattgcaggtttagttgtgctagcttattgctccttttgtgagagagagatggagagtaaatattcagaaaagtatgggctgacagaaagaaaatatatggagcagtagaggttgaagtggtcctcttctctttctctctctcacacaaacaaatctccatcattgatttggattttggagtaattaaggggagaaagtgaaggcagcaagaatatttaagagattagttgtgctagctgccactcataaactttaagagacacgtgaaatatataaggttaattaattaagtccccttctcttttttcgggtatcatccatggaatatataaattgtgtggaatgctatattgaaacaaatcagaaagcacatataaagagaaaattttatgatccttgagaaaatacactgaggaaattaaacgaggaattaagtaatgcaattttccaagtttaattaaattcgaccaacagctaacaaatagagctaatgcttgatctatctagctattaattgtacacatatcgatcttccactgaatttattcgctttctacatccatcgtctctgagtggacctgttttctctcccagctgctacttgcctccggtggtccaaagcttggaatatgacacaaattcctcttttatgcttgcatgatcggtttctctggttaattattggttctcattccaatcaaatggatatatatgcatgtacgggccacaaatttacgaagaactatctacacaaattaaggaaataatgtcaaatttttgtgtataggttatacctcgatttcgaggctacaggaaacagtacgtcctgcaaatgttgatataggatagatatcatcaacacgaaattaaaccaagtacattagctaaacttctcctggccagatcgatccatatatataccgattgattgattttcacatgtagcgctagcgcagtacgtactactttatctttatcaattgtcaagtacataactctttactttagttatctattactccctccatcccaaaatgtttgacgccgttgacttttttaaacatatttgaccgttcatcttatttaaaaaaattaagtattattaattctttttctatcatttgattcattgttaaatatacctttatgtatacatatagtcttacatatttcacaagagtttttgaataagacgaatggtcaaacatgtttaaaaaaaccaacggcatcaaatatttagggaaggagggaggatgtttcaattcgtgcaagcattgaagcgtatatatactagtagttatgtttgctttcttgttatacagatattatagtttcaacatgaatcccgattccctatctagtttggccctttaatttgtatccagagagattaatattacaatttcactcccgtactactcctatgtatggtaacgttctaaattaattttgtcctaatatgaaacaagatattgaagtactctcttcgtccaatgaaaaaacctggacggagggagtacatatgctatttaaaaatatccaactgcaccgatgaaaatatatataaagatgatttcatcaggtgcaccattaattatttgcttctgtgggaagctagattaacttatacagtgtgcaaccaaaatttgtccatccactgtatatgttaaattatatatttgtcagcatcattataagtaaatattattgtggagaggagcacaagttagttggagctaggcacatcaaagaccccatgcatggttgtacgatgattgctactgatgaaaagacctgcctgcagctggccactacagtacagtactactactagtagcacataatttagcatgtggcgaatttggggcgtgcacacacatacgttacatactgacatacacacatgtagtaaagattagagatgtctcccaatcgtgttacattatagtactatacatacatatataggagtagtacttcctccatctattttttgatagttatatttttaaatctgaaaaaattatttttaataggcatatttcaatccaacaacctatcatcttaatgactttctcggttataatgcatgactctctattcttctacacaagattggctacatgggcatcgagaaatgtaaatattaatgaatcgcttatttatgagaaatgactggtaacatgtttaaatgtatgataagtagaattacttattcttggtctgtatgccaagatgaaatatgactatataaaaagtagacagaagggagtagtatatatcatgttcttcagattatcagattactttactagtagcactgctgtatctccaattctccatggttgagagagatgcatatggatcgtccgtgttggttgtattaacaagctatctgcgagccaactcacttggttaattaggatgtggaatctgtccacccagctagattcatccaaaataataataaaaagagatgatcttataattttccaagatgaggttgtagtttctttttaaagtctaagtctaaatctcgagaagtatagtaataggttttagtaattaaggtattgttcggttaatcatcccactcttaagaaattcgagagggatctaaagatgaataatttcatacctactattgagctgtggaatttaaacatcctcaatgccctccaattcatcccttatgggaatagctgaacaatgcctaaaagtggttatgatcatctttggggaagtttttttttttttttttttttacagaatcttgaactttctcgaacagtttactagattgctatctaaattataataagaatccatagttatataatttagaaaataactaaaaaccaatagaacatgtagtatcaactgtttctcataattttaagctccccaaacatgttaccatgtatgtatatatagtaggtatggatagatacaaatgtgcatgtgcctaatattaatttattattaatttgatgccaacatgcaactcctttcaattagatcataaccttgttttttcagttacttgcgctaataattaaccacacatgttgttaattgacggtatttcagctacagtaacaacaactgttaccatattttgtgacgatcacattcttttttaaccatgtcatatcaggcacagcacactacagtaggcacgattaattgcattagtcgttgtcgcagctagcgcaccgatcaattgagtggatgaagagggtttgatcaagagaggctttcattcgcccacgtttg

SEQ ID NO: 76590 - DNA, 9312 bp, Oryza sativa
  unsure (1)..(9312): unsure at all n locations
acacacacacacacatatatatatatatatatatatatatatatatatatggtgcaggccctagggaatgtaatgttcaagtgttctgcgtctaattaaattaatttgagattcttgggagatttgcaaattgcaagctagctaggtctgctagcctttaatttcttatcctctactttaattttggtccctgtttcatgcatgtattgccgatatctcaatctctcctagctaaccggccacctagttctgcccatgtttctttcttcttcctcgcaccaacgctcacactgccacctaataaccattttttaatctttaaatgcctctttatttctccctccgtattttactgaacaatattgttcactttttatcaacatttgaccatttattttattaaaaaaatttatgtaattattatttattttatgtcttgatttatcattaaatattctttaagtatgacataaatatttttatatttgtataaaaaaatttaataagacgaatggtcaaacgttgttcgaaaactcagacctaattgagcaaaaattgtgagctaatattattacagctggaatggaatggggcgcagatatgagatatcaactctaacaaacttgatttaactgattgaagtagaagtgttacagctccgtaaagaagtagagatggatccaccaggatcgagcttgatcatgagactgggccttcaaaaccgagaccagatccacccatgcaccactagaggtgggcaaaaataatcaaggaccaaactaaccgagaccaaaaaatctatcaacgcacaagtccaggttacccatttttcagttaattcggtcatatgccttagttacccatattgaccaacaatagcccagtcagcctaatagccatacatagtgaatacccactagagaaaactatatatatatactttctgcttctgctcgtacttggcatttagccgtcgcctcatgctgccagatggtccatgcggcggcctgtcctactgttctacgccgttgcccgaagccggcccgcatttcctccgaccctctttgcccatgcatatgcatatgtagcctcgtcgtgcagtgaccgatctagaaataaatagtaggggatctgaacaaattacaaccctcttttcatctatatatagcaaaaagttttagtaagggcaaccatagtcctcgcgctaatagtggagacttgagactccgccgctcccatgttagatccatccctgttgtcgagcacacgtacttttccaccccaaccagctcacaggcgcatcgtccacctcttccaacctgcgcgtgcatcatcctactccaccatcaacctgtgcaagcatcctccaaaattttgctgagatttgatttgtgtgttttctcctctatatctatctgcaatttcgatcacggtcgagactgagaccaaaataacccaaaacgaatagcttggttctcaaattgtttactacacaattcgctcggtctctactttcagatgaccaaaatttgctccaagaaattttcagggagatcaaaatgctcacccttacctatatccttccggccggtttcaactccgagtctccaacccaaaaattcttgacccttgagcccatagggctgcttcatgtccatgcattaattaaggaaaaggaaaacggttgttagaaaagatataaggcatgtttgatataactcctactccaagagtgaagcggagttgagaagtggtgggaatgccgctccgcttttaaattgcaatttttaggatcggagcagtaactctattctatagaggagcaattttgtgtgtaaccccagttttacaggacaaaaatgttgagcatgactgtatgagccgtatcaaatgagtcaatagcatgcatggacttaaagtttaacgaagggttcaaaagtttagtgctttaggatgagaaagtgtttaggtacccatagaaatttcaaatattttgttaattttagtttgaagacgacggcgcgcgatatatataggaaaatgttgatgcgtacatgtatacatatgtggtggacggatgggaaagtttacctgcatgacggaccacgtacgtatgggtacgatcgatcgatcaccaaccaacctgcagattacttgttcacttcattcttagacgacctcgccaatagcctatagatattcttaatttgtcctagcaaactgcaaacgaaaaaagtcaatcttaattcaccgaatgatttttcattctcacagcattcgttttgtggtccattgatttcgggtggcaagattcgtgcaaaacagtgtggactcctctgctattctttttataggagcgctagaaatctgccgaatgatttttttatttccacatcatttgttttctggactgtcgattttcggcgtcaaaattcgtgcaaaacagtacgtgcttctctgccattttttttacataattgttactcctggaaaacttttgcaagcattttgttcccaaaacttccatattaattagtgaccatcaaatcacttcgagatttgtgcgtaaagaaaaaaatgctagaaaatttttttcacacatgtcatacataagatcctgatgctaaccaaccaaaccatagttaaataaaagttttatattaattatatcatagttacagtatagttatagtgtagttacaatatagttacacttaaattatattatagttatatctaaaagtttttcgctccaaaaaaaccctcccattacatactttaatttttcgttcggggtttatatatcctgacgcatggatatattatgcagctgtagttgcttcattgcttggaatcagtataccggccgcattaggagattttagtgcatggatagactagtggttcggcccattattgttgaagcccaggtttgattgacctgcaggctgggcttgctattgtagcccaagcaccatcctattctattctaggaataagttcatctaaggtcccttaacttgtcaacgaatccgattttcgtccttcaccacaaaaccagatacaacgggtccctcaactatcaaaaccagtgcagatgaggtccctcggtggttttgacggtggttttggctgacgtggcacctatgtggcaaatttgacttagtcttcatctgatgtggcattgacgtggcgcatacgtggcaatttgatctggaaaaataataaactttgtgggacccacatgtcagtctcacacataaatcaataaaagaatggtggggctcacgtgggccccaatgtcagccacaagtccctctcggctttcctttctcctcctcttcgctctccctcgtcctcgcggcggcggcaggagcatgccggcggacggagcggcggagaggcgggcggagcggcggcaggccgcgggcggcgaggttgccggaggaggaagaggcagaggaggaggtcgtcagcgagcgcgacagctacactccgttggccgctccgcccgcgatgcccagttgaaaggcgctgccctcctcgctcggtctccgcgcgccgcctccctcctcgccttgccgccacacgccgcctccctcctcgcccgaccgccaccgctgacatcctcgatggtcacatttgggtcggagctgcccctcccctcgcccggccgcctcaaaaaacccaagcttttgccgccgccccgactggctgaccatcccaagaaagaaggcacctcctcgtcgcctctgctgcctccacactgcccgcggcgtgagggccctagacctccgggagggctccggcgaggtcccggcggaccgcgagttggaaatgcaattaacagattcaaatattcaattcgcttcttgattgagcaagttataggtgcaaggattttacttatatgtataatgaagctattaatattccctcttgtgatgctatatttgcgatatgcttggctctgtctggatattggttgccgcgagctttacttatatgtctgctgctgctagccgtagttgacgaggagacgcagagcggcgagatgtcctcgagggcatcacgctaggcaacgccctggagaaggagaagagcaagctacgtggcggcgatgacccgtcgcgctggtccgacgagaagagcggcagcggcagggagtggtcaagcctgggatggcacggcgatcctcggcacgagcaagcggtactgcgcatatgcgaggaaggctcgtttggcgacggacggccgtggcagtccgagggttggcggggagaggaggggcggcaagccggcggcgggttcggcctggtcaacggcgaatcggcgatggcggggcggctgggtccaacgatgagctccgtgagggaggaggcgagctccttgtgctccgacggaggaggggctcccactccgtcccctcgtactcgggttccggcgacgagaacggtggtggtggtgacgagaacgccgcgagcttccatggcaggttcttgtcgcgtccggtgcgggggaggaggtggcgtggccgccgtgttccgtctcgccgccggcgccatccatcggtgggcaccggtcgatgccatccacgagagagagaagggtgaaggccgaaggggaagatgaaaggtgatgaggatagagatgacatgtggggcccacgtgggtcccaccattttttaattattttgtgtgtgaagctgacatgtgggtcccatgggttttattatttttttcatatcggattgccacgtaagcgccacgtcaatgccacatcagatgaagaccgagtcaaattagccgcgtatgcgccacgtcagccaaaacagcagtctaaaccgccgagggacctcgtttgcaccggttttgatagttgagggatctattgtatctggttttccggttgaaggatgaaaaccggattcgttgacaagttaagggacctcagatgaatttattcctctattctaagaggataaaagtccattcggccctagaagttggccttaaccaacccccctcccctaaaaaaaaaacttttaaaaccgtgtactagaccttcaaaatttcaatacgagggcatctgacctctttataacgttttcaatcttttttttttggttcttctggggataagattcaaagaaaattaagctcaggaggattattgggatgcctgcaggccggcatgaaattaataatatatctgacttaatatgtaggagtaatatgcgtggcgagcatgtcctgcaagcattagtcacacacattttttaaaaaaataaaaatgaaaacaaattaatcgtgcgctcatcaacatttggcgcgatcgatcattaacgtggcaggcaccaactaacaagagctagctagatcgatgtacccatgcatatatactccagtagctagctacaatcaaatcatacgtacgctagctgcacatccctcgccgccgatcgacgacaatagcatggccagcagctggaataatccggccatcttcctcgccgccgcgctggcggtggcgacggcggcgcaggtcgtcacggccggtttcaccacagacttgtactggcagcaacagccggcgcctggtgccgtcaccccctacaagacatcggactggcacgacggctccgccaccttctacggcgacccctccggcatgggcgacgacttcggtacgtagtatcgtcttcatttcatttgcttttctctccggccatgaacgccgacgagctatataacgaatgcatgtactactactgctatataggtggcgcgtgcgggtacgtgtcgaacgacatcgtgtcgctctactcgacgaagacggcggcgctgagcacgccgctgttcgccgacggcaacgggtgcgggcagtgctacgagctgcggtgcgtcaagtcgccgtggtgcaacccggggtcgccgtcggtggtcatcacggggaccaacctgtgcccgcccaactggtacctccccaacgacgacggcggctggtgcaacccccggggcaccacttcgacatggcgccgccctccttcctcaagctcgcgcagagggtcgccgggatcgtgccggtgcagtaccgccgcgtgccgtgccagaggaccggcggcgtcaggttctgcctccaggggaaccactactggttgctgctctacgtcatgaacgtcagcggcgccggggaagnntttgggtctccgtcaagacctccggtggcggcggcgcctggatccaggcggcgcacaactggggcatcacgtaccaggtgttcgccgcgctggacaactccgacggcctcaccgtcaagctcaccacctacagcacgccgcagcagaccatcatcgtctccgacgccatctccccctggtggatcaccggactctgctaccagggatccaacaacttctactaatcatcaatcgatcgatcatcagatcgagttcaaagttgcagtggttcatctcttcattttgtttcttcttcttggcttgctctgctatgcgatgcgatgctagctattgtcaaagttcatggactctctgtttctttcttttgttcatagaacgggatgcatttctagttcaatgtttatgctaatccatcttctgttgagagaattctttttccctttttcaaaactttcaaaaatggtggattgattatgatgtatacttgatctccgcataagttcagtaaatatatatatccctgaaaacaaagtttggtttcctctctgtgtatagctgtctggactctggaattcgtgccaccaactagatttgatcgagaatatcacacatatatcaacttcttttcaaagatctaccaccacatacataattgatatgattattcaatttgattggtttatgtatatccgatccgaactgcacagcatgtctgttggtcaaacacaagcctgaatacaatgctgcatgtataggcgccactaccttctcctcatagcaagattatataatatcgacaaataaatttagcaacttgctacaaacaaattgtgtataactcgctcagtcaacaagttgatcctcatcaacacattcacttctcttctgtgaactgtttccacaaccacttctgtaaaatctgaatattttcaccgtcttccaatgaccagctcagtgtcaacatcaatatcctggacatgctggttctgattcatctcgcgcgctggagccccgattggagcatgttgcaccttgccctccacaaacaagaacgaacaagaagaaaagattcatcatcatgcaaaagctgacatgtatagatggatattaacaccggtcactgtaagttgcattggatagatagcgccttttgccccacatgtcagtgacattattggcagattaatccggcagctagtaggtgcagtaaataggcgtgtggttgatgatgagttttttaatgatacctgatcgaggagcagtgcgttctcctccgacagaatcttctcctgcatgttcagtttcgtcagttaatcacacatggatatatagataatcttttgagatttgtatttgtatcaacatcttttgtaaagcagtacactccaggaagagacggcttgttgaggcgaacaagtgtttccatctaatcatactgatgtattactaacaagttatgcaaaaatcctctttcagaacaataattcttgtcagccatgctttgatatatattatattcagatacataagtgcatacctgttgttgtagctgtgaaatcttatccatcagcttcttttgctgcaatgttgacggacaacaagaaagatatttatgtaaatctgatcaaaatgcatatatcatagagatattcacaacagcaacaacatagatagcacattgcgaccatttgcttgccttttgtaaacggatgctgcttaggctcttctccatctgcatctccaggccatgcagttcttgcaacgagcatgattccaggttttcgccctgcatcttcctacgtgaaaaatcattttcatctagtcatgtgaatttccccaccctaataattaggaacatatagtaattgccagtctgcatgatttcatatatattctgataaggaataatcattgctattatagttaccttgtgtatgcctcaactgtgtcaatctccattgctaaggtttcggattgagatttcatattctgtatgcagtagttgtgaagaaaaaaaaattaatgcaagttgcacacattatcgtcatcgatcctaacagtatatgatcatggttgatagatatgaggaattcagaatgtatccacaaggacctttacagtaagttcacggggcttcttgtttgcaggcgcctcttgggtgtggctaatgtagcggtcgattgtcccctccaggctgaaaaaagaattccagagttgtgaaaaatagtttattacatggaaatacagataatatatatgtgttcataatcaagtaactgaacgtactactactggatatcagaccaaagtaatgttttcactaaaaatagcagcggtacttatatacgttaatttgtgcctaataagataccggtatcagaaacgaataaaaacaatacaaatttcagcaagaatagataccactacatatgtacatgaaactgactattctcaacaaacttaaattgtaaatggatgtccattaattctaggaagcattatagatgatgaattaaggatccaccattgacatttaatttatctgataacaaattaattgaaactagtatactaaaaaacatcaattaatataagacatgaaataaattgatacttcctcctgtcagaaatatttgacaacggtctaacacccaacaccacaggcgacggctgggaaccaggacgaaaccctaatcttcacttcactttatcttctcttcagggccggggaactatatatatatttatatagagcaagggtgagtactttcgtactcagcaagtcacgggaacttaggtgtttaatgcaagcttggaagagaggcaaggttgttttgcaaatcttttatttgaagacattttgaaatcactaagtgatttatttctttctaagtttgggccgaaaagagacttgcgtctcgattcgacattaagagatgtttttttttcaacagctcatttagtaatgtaccgacctcccgggtcagatcattacttctcggctcccagagccattccatttgattaatcggctcccagagcctttttcattttctcggactcccagagtccagctgcccagcagcacaacaatccgcttccactcgggaag

SEQ ID NO: 76591 - DNA, 5042 bp, Oryza sativa
tcccaaacagcaaggctcctattgtgaatttgtgattgctgaataattgaaaatgccactaagatgtaaagcttgtacagctactgtttattcatgcgtgggcagtgactgtatttctacgaaagtgctctctgtctcagtggtggcaatgacaccatgtttagaaagttgcaaatgctttgctgagagaatattcatcatggtgtagctggcaagcatagttcacatctttttatgctctgatttgctgctttctttacgggcatggcactggcacgaagatatgtgttctcatgttcctacaccttttgagctttcctcccctctccatggtttacgaggtaagcaatctgaactaatccattgttatacagtaacatcgattctaatgcagtttaatggtttgtttgtgcatgcaaaagcaggtttactggcttactgctatgtaaagttcttcagattatggtagctgatttgtctcttgattttgttttcaggaacctgagctatctgccagctgaccaagaaatacttatttcatcattaaaaaaactgaccaagaaaaaaaaattactccattgtctaaaaaaaaattgaccagaagtagtcaggtcaacctcagcatgtgctgcagatgaggtaggtttttaccaggtcgacctggataatatattgtataacttgctgctcagaaagaaagctctgttgttgatacgctgttcgtttcagtagttatcgctgttgtgttggcatttgtcttgccaaaattctctagtcccaactgggcgtgatgagcgattcaacactcaacagctatattacactaatgcagttggatggtcagatggtgtcattcttacttcttttttgtccatcatcatatggattatcgaaatcgtcgcaaaacaagatggatttatcgaaaataattgggataatatttgatgctgctcttgtaatatgagctagcgctttgttggcgagttggacactttggattggtctaagagccattgtcagctatggcacgtgcattcttttcagcatctcgtgtttttctgtcaaaaaaaaaaaaaactggagaattggtccagagtggcatgtattccagaccaagattctgtggccgcgtcaaaccaaaatcaactctggaaacctccatgattggaacccaacaattttggacgaaacaaaaaaaagaactttaattcaaaaccagcaaaggattgagagaaggcgaaaaataaatggtatcccgggagcaactgttcttgaaagctatggttccttttgaactaatgaatttcgtggaatttttataggaatttcactggataattaccacagattatttgttttgcacctctaataaagcattttcttaacttttcttaattaaattttttttcttctactgcattgcttcaaccacttatcttaagctatatcttagatttatttgttaaaatattcaatttatgcctataaaataaataaataatccgcgacaatgatcacaggaataccatctccggcctatttgccactcatagccagagtgagcaactgattggtaggcaatcatatgggatatgggatagtgatataacatatttcaactaaaatagatattcctgatttggcaattatgaaatgttgggcaaccaaaagacacagtaccaaaataccatttgaactaaaatagatattcctgatttatagggcagacgaagtacttacttgcatcatataaatttcatagaattttcatatcaattgcacacaaaaacagctcaatgattttgtgcaacatcccaaataaactagaactaaaataaaagagtactgctatacgtacgacccaattgtataattcatgtacaactaaaaacatataatcatatatcaataaaaaaagagcatgttcatacgccctgcatccgttaacaacacttaccaaaatttagtcgcacatgagtcggacagttggaacgtatgtatagcaatttccaaaacaaaattaaaacaccgcgggaatacaaatacagctctgagtagcacctaaaatcccgagttcaaatctctatatgagcgaatttcaggtcgggttatttgcagggctaagttctaaatttagtgtctgaatataaccgactggatgtagaggccgagtaaaaaaatatcattctctaaaaaaaaatacagctctacttcttctcctaacctcctttgatcgttcgttggtttgttttttttttcttttctcgcgtacagctggacgcttcgtttgcttctcccgttccgtctcttctcctctcctcttcttctcccctctcctctctccacttctactctcacctctcgctaccaaacacgcgcacacgcagccgagatcgagagcgagctacttgccctagcagcagcagcagcgaggagcgcgagggggcggcggcggcggcgtgcatggcgggggctccgtcgaggtcgcgcggcgacttcgaccacctcatcaagctcctcctcatcggcgacagcggcaagttttacacctcctcctcctccccgcctcacaaatcagagctctgtcccgtgctgtttcggattcctctatggctttttagttgcttgctcgctcgattcctggttgtactgcgctttctccctctcttctgctgattcgtgtggtggtagtactagtactagtacttttcgcatctcttaatgggtccgtggccgtggggggagctcgggggaggagcagtacgaggggttcttgttgccgaggatttaagggatgggatttccgtgtattggtttaattgttggagtggtacgtactacgtagcagtaattgggagctttcttggaggactgattagctgctgatttgggttttggtcggttgctaatcttgtcggggaacattctccaatgaggagtgagaaccatgctagtatgtgttgcatccataagtagctatggatagggatttctgtaccgattggaggttggtcatgtcgcaattggacaaggacttgtgaagtaatttgccgagattagcctgcgaaaatgtttcgtaggtgtgcaatgtctgtgtgcgatattgttcggatcataggtgattgtgttgtggttgtgcactcctctttgatcttctgtttattgcggttttcgttgaggcagtgggttcctggggattttcacgaattttgctctccagtagtttattagactaggatgatagtaattgttttggtttgataggtcgatatagaaatggaacaaaatgggttataactaacatgggaatccccaaaaggtgctctagtgtcataaaagttgagtaggtcttagattttcagcatttcaccatggttgacatattttgttagtctaaaataggtaggaatagagattaggacttgaagctatattggagccaaaagtcattaattggaagggtcctttaaatccaacttgtaccagctcagacaccattactgtttcagactagtagtgaaaatgaatcatcacctcatcctcatttatttgttcagatgctgaagttttggccttgtttcacagtcgtgccagaattgttcctcatcctactttaccaaaagtgctgaaattactcatcattaaaataggactaggtgtttttagaaagaaccttcatgcttgtccagtccttcattggattgaaattgaaaattgttagttgatcatccctttgtagtgatattgcaattcctcaaggcacatctgactatctgttatcaaatttatcggatgaccacatgattgatttggtatatctgatgggtctccaactccccattttctcattgtggtgtttgacagttttgttctgtctttattatcttcagttcgtgtgatgtctagtggcattttctttctcagataattatgttatcattcttatttggcacttatttgtttaatgggttaatctgcaggagtaggaaagagttgcttgcttctgaggttctcagatgacactttcactacaagttttatcaccaccattgggtattcacacaaccattaattcttctatttttgggcattcacttatggaagccaatattctaaatatgtttatttttctttatgtaaagcattgatttcaaggttcggacagttgagcttgatggaaagcgtgtaaaattgcagatttgggatactgctggtcaagaacgtttccggacaattacaactggtatatttttcacttccttttctgctaatgactcacatatggtaatatggggcaaattatgaaaggcgacaaattcctgatatatgacctaaggcttgaacactgacagaaatttgtcgtcgaaacgaatatgaacatgaacaattgtcaaactgatgcaatttcaaccaaacaatatgatatattcttttagattcaaatctttattttttttggaatagcacataaagttacccttttctatgtgctccaatgaggaagaaatgcataataaaaatgtccctctttgcaaatgtattttgcttggtttctgaagctgtagacattcaatatgcatattcatatgcccaatttttattggtcatctggaaacctttaattgatgacgacatatataacctgtgaattagagaatgggcatttatataagcatgatggcagtttctcatatatatcctcatgtacttactgaaaatctggcactataatgacccgagctattcagatttacccattgattgctaagcaagatttctgcaccttatttgatccttttcctttctgcagcctactatagaggtgctatgggcattctgcttgtttatgatgttacagacgagtcatccttcaacagtatccatcatacttgtgcatcccatttgttgacagagtgcaaatatatatatttttttcttaactgatgtgtagacattagaaattggatccgcaacatagaacaacatgcatctgataatgtcaacaagattttggtgggcaacaaggttgatatggatacaaa

SEQ ID NO: 76592 - DNA, 1620 bp, Oryza sativa
ctgctggtgtgttttggcaaaggcaaatgtgctgttgctagggcattgccaccctgtctcttagagcattttgtggcgtcctgctaagctgaaaaggaaggggatatataaaaaacagacaaactcatcatgggctggctaaatgccattgctgggttaataacttaacagtactacatgataaaaaaaagaattaaaatgtttgtgaattagattggtgatgtgtcagaggcactttcttttttgttttcatctgattttcatacgatggtttaattttaagcagattttctttataggtatcgaagagattgcaggagcttcttcttgttttcttctcagagatgtttcgctcagagaattggattacaatttagctcaggggcaccaccacaccatgtgatgtgcagcagtgcagtttgaatttaacgcggcaggccacaaagaccttgttcagattgttgcgtaaataatcatatcaatgttcgataatatcaaatgatatagttttgtgctattaaattttggtagagttagggttttgttgccaaaatcaaccttaccatttgttggtaaagctaaattttggacaagttgaaaatgtaaaggtaatgtttaccttatcaaatattggcattattttatgaggagaagtttctagaatcttgctaaattctatgggcattaccaatatttggtagcaaaccaaatgaagccaaattttggcaacttgcgaaataatggttcaaaatgacaacaatctgaacggcccttagatgtattgggtttgaagcctcaccaagttttgataccgttttagtgaaagtttctagaattaattatcaaatcttgttaaattagtatattttttatttgttatccattaaattttggtattgttaacatttagttaagtgaaagtgacaataaactgaaagtgccctaaattagattaaaaggggggggggggtcaattttaaggtgggagaatattaaaagagacaaatcaagggtagctggtaaacaaactggagaagcaccaggaaattacgtgtttcttactacaagcgaagcgaggtcagcactcaactatttgatcagacatgtggcgttcatgcatggatggatcatggatggaaggtgctagtgttgaccgttgagtcaatgcgctacctttctagaaggagaacggacatggacgcctgcatgtgtggaatgtcctcgctaaaacagcttattttaacaaaataaaaactaacttataagtaaaacttatatatattacgtagtgacttaaaagctactccctctgtctcataaaaactttatttttagatttatatgtccaacgtttgaccgtcaattttattttaaaaaaattatgaaaaaaatattaacgcataaagtactttttatgtttctagaaataaaaaatattaatcatagaaaactcttaaataaaacgaatagtcaaatgtcatatccaaaaattgaaaaataaagtctttgtgtgatggaggaagtaatgctgaaaaaaaaactacgataaaaatatctaaaaccaacatctaaattgagttcaaaatttaaaattttgactttacctttgtcttattaggg

SEQ ID NO: 76593 - DNA, 656 bp, Oryza sativa
aataggtttagggagttttgaatgagattccaccatgtccaagctcaaccagtcacctaatcatcattcttacatattttagttgttacccacagtctaatttatagaaagggattctatgttagatctaagcatagataagcccaacctagagcaactagtaagtccatcatatagggaaccatactagtcattttatcattttactaaggttgacaagagcatgggtagcaattcaataacatggctatataacgaggatcacaggaatattaactattaaataaataatagtgaacgttatataatttataaaagtgatgcatatagaagtaaaacaacatagttttttttgcaaaaatgggattcaatatgttcaaggaatatggtatgacttgccttgctcgaagagaaggtcttctgacaacttgacctgcacttcgggaacttccgaaacgacgacagctacacgaaaaaaaaacagggctacaaatctaagaaagaaacgataacaatacataacaacatcaaacaccggttccttaagttataacaaaaattaaacaatttgaacgagtcaattaggagctcgtatggccgagaaacgaccaaccgaattttaagtgcaattaaaatggatatttcagagttgttta

SEQ ID NO: 76594 - DNA, 1202 bp, Oryza sativa
taaccgattatgagacccgtgcctgggttaaagaatatagcattcagactgaatcgttcatccctgttcttgagtacgatgtaaagccattgctggtattagatgatgggaggatactcatatggttaggatcgacaggactactgctcatatatgatccaagaaccagcagttttgcggaagtcaagatgagacatcttgctgaagttggcatgtacacaggaagcctactgagtttacaaaatggtgacatggtgtagcattgtaatattatgttacacacttcagtttgcagttaatcacttatgcaggaaaccatttctattgcttttggttttggaagtcatttttggacacaaccataaaatgctggggttgatctcatgttgcattggagccagcaaagctgttgcaaattcttgaagatggtaggtgtctttatttatttattttgtacattcttatgtaaacataacgtagagtgtacctgtcagcatacattctggtatctgacataatttaggggaactgcaaccttacttttcagctgcttgttgggtggctagtgtgacttatgtgcaatttgatattttgattcaagaaaaataccaggatgatctgtgttatatgtgaaatttgcatttcgaatcttctgtactatattctcgtttacttctggaaatgactctttttgcagccggttgccagtcacttgtattcaattcaaacagaatattgtgtaattcagaagacatcaaacacaactgtactctgctcatcttctgtgcctaaactggatgctaatgaaaatgagttttgggaaattcaagtgttcgcaattacttgacatgtacagtccatgaacaaggatcaactaactcaagcctgaacttttctaaacttcagacctgagagtctgaactcaatccaactcgtgcagggttcatttttggaattaaaaaagaatcaagtaagaattttactgcctttattgcagataatcagataataattagtgctacttaagcacattcaattcaacctatcaacaactaatgatcttagcctgctaataaatacagtgaccgttagaggactaagctcctatacatctctatttctacatctacagaagaatctatttctacaaaaggacaatgtcactgctaatccatctctagctccatagatcgaacagctca

SEQ ID NO: 76595 - DNA, 3094 bp, Oryza sativa
tatttcgtcaaaaaatatgattgatggctgattcttctgagcttcctcaaacagtagcttgagctgcctttcagcctctccaacccacttactaagaacatcagctccttttctcatataaaagctaaccttctgaccagctttagaggcagcacacgctaaggcacgagcaatcaatgtcttccctgtaccaggagggccacagagaagaacacccctaggaggagtaatgtgatagtttgcaaaaaaatctggataaagcaaagggaagaaaaccatttccttcaatgcatcaatgtaatcggacagcccccctatatcattaaaactcacactcccgtcaacctggagaggctgaatatcagctcctcccttggaacttggtccagcagtttggatccctggcataagtgaagaagtactcactgtgttgtcaccctgatgaccccaaccggatgctccaacattcagaccccatgctcctggacaatgcatatccaatccacctaaaaaccacggcatacctcctctcccaccacgcatccatggcatggatggaccttcatctggctcatccacaagaagagaatcatctgaatcatctggcaatgagaatcgagggcgcttatgcatgcgtgaaccaccctttttcaaatatttgctgttctttggaccaattccatgtactagtactctacggggtgattgtgttctgtgcttcccttccttccgtggggagggtctacgaacttctgaacgatccctgagatcatatctcctcctcccttcttgttcttcctcaccatcttcatcatctccatccgcttcagcttcatcacctccatcaacttcctcctcattgccatcctcttcgatatcattaccattttccctcctatcttgtgcaggctgttcttcagagctttcctggtcatcctcagattcttggtatggatgaagtctttgtcctcggatagatcttctaggccgtaaaccctcacggcgaggaatggagctagagttggacagcttcttgcgctttggcctagctgacacttcgtcatccactttattctttgaagatcgatatctgggcctctgaaaatttcaagagaagaggtgagcaggtaaaaacaataataagcaaactttgcatgtactgtgcactagtctctgaaactccacaaactcaccataagatcatcatcttccatactagaactatcggtgtcatagtcctccagatttacagacattcttcgctttcgtgttgaacgacgtagatttgctgcaatagactacaaaaagaactattataataaagccatatgagaataaacaaaggaactcttacgaaggaaaggcaatacagttaaaatttgcaggaaatagatttttcataaaggagcatgatttgtatcaacttgaaaccgagcaataacaatctaacaagggtcaaagctccatatttaagcaatcatgctttctggttctccaaatattcaacggaaatctatggtcatggatacaaggatgggtgcagcattcataaaagaaaataatgttctgtagataaaggtgctagatgagttatataaatatcaaccattgccttaccaactgtcatttgttaaatgcttggtaagaaaaggctcctgtaagaacatttttaaacttagagcgtctactaaatctacagcaacaaaaaatacataacccactttagaactttgctgtaacattacaatgatggaaatgtggtcacctctttgattgaacaatgaaattactattttctaaaagtagcaacagctaatgctcttagtaaaaatgttgttttataaaaagggctgaagcagaacaagaaatttgattaggaaggaagttaattcaagtaggccatgcaaatgcgcaagctatccagtttatttcagaggcaatattgaattgaacttgaacatccatatagttatatacagataaatgaacaaaaaatatagcaaagataggacgattttgaccaaatacagcaacggcccaacaaattcaaccaagttactaacataacaccatcaaagtcaacagtaatgctgaactaagcacaacagcctccgtactttatatcacaaatatttaacagttacaaaatggaagtctgatttacttacaccaaacactaacaataataccaagcaaatccaatatcactctatcaaccctctcaattatctcaagtgcactcttcaatgcaatgaaagaccaagaccaccactacctccatcagcttgacaacaaattaaataaagtggcatgaacacacacataatatggaaacaaagttcacaggctcattaaacaaagaatgacaagcatgcttacatcagcaggcggtgccctggcagctgacttgcgaagcagcttcttggcaatctgtgatgcagccgctctcttcttagacttcatcttcttgcgtatggctggattgtagtacatataattgcgaccgaagtacttgggccgcttacgcagccggtcactagtcctcactggtgtcaccgatgcatcccccttcccttccatccccaccatcgctcccacctcacgtcctcatccacaccacgccggccattgctccctaagtcaatacaggtacaccaatagcccgtcaattttagtaaaatccccaaaccctagcccccaaatccaccaagttcaacaatcacggataagatgtaacgatggcaaatttcgcactcgcacattgcgaaatggaacccgctcctcattccccacacattaaatccccagaaaatgggttgaaaatgacaaaacgatggaagaaaaaaaatccgaatccacgccgccaagcaccgatcagacagccacgacccctcgaaacccacccaccacgaacgaaaccacacacccccactccacaaaacccgaactaaaaccctccgaaatggacggaagcgaagcgcgggggagccccggaaaacccggggggagggcggccgcgggggtttctaacctcgaaggattcgatcggcggggagcggggagcccgcgcctagcccccgcccggattcggcga

SEQ ID NO: 76596 - DNA, 15962 bp, Oryza sativa
gtgttatatgagacacacaacttgtcgacgtttgaggtcgcgactacggtatttgtatgtatggggatcctcgtaccaggttatatgcgagattgaggtaaaagagatggggacaaggatttttatacagaatcgggctccttacctgtcaaataatagccctaaatcttggtggccaaagccggtgttgctctttattcatctagatcacacaagtacaatatttggaataacctatctagctgtcgtcgacttggcagcatggataaccaactcgtagtcgatgacggggtagtcttcctcctcgaatatgaactcatcgagatcagagatggtgctagatccctcttgctggcctccataggcaccggatgggggatgtctaggctaatctctgatggatctagcggtgtgtgttggcttctggcttatccctctcctcatatgtcacgcccagaaattcacgaaccagaatttctaagctgaatgtgtattaaacccctatccaggaccagccagggtacacaaacgacaattgttgacatacagatccacgtcttacaaaaatataaaagattacaaatgcagcggaaaagataaaacaagctagacttggaaacttgacttctgcagcggggcgactccactccacaggcaatccttgacggcagcgacgaaaccaacttcgacaaaacaactcccactaggaagatcttcagctctggtgtgggggaaagagagcaagactgagtactacccactgtactcagcaagttataccggaagaggaggtatgatgcaggatatatccaaaggaggctaaaggctcatttgcataaagctagcatttaaaagcagtagttgaaagcagtaaaacagctgtagtgatttatcaatattaaccaatcactgtccaacgctacaccacgttgcaacaggcccaaaccaccacctgaactaaccagttccattagctaactagatgtgagactaatcacggtgaatctggtcgaccgcccataactgcgggcacggctattcgaatagttttactctgatcagaggtgtacaactgtacccacaagacacagccccacgacacattcccatgcaccgacatgccaccacgacataccggaaagaggccgtgacaggacccttcgcataaccccctctaaccgatcgcaccacaccttagggttcgcccccgtccccagcaggcaacgggcagcccccctttcatgccgtggtgaatccggaagccgatcaaccggacaccccggctgaaccaactccatcacgcccaccctcgtctgggtacgtcggctagaggaaagctacactacaagcccagccgttgcccacgctggcttgtggtaagtacggtaagttcttccagggtatcccgcgaaccggtccttaatcgctatgggcatgactaacaaaaccatgcacccacagcccaccatgtagtgtattttaattaaccaacaccattacggtggcactaaaccaaagctatgccaataatcaaagtctatgctttaatgtgattccctttttgtgtactagtagaactaagcatggctaagcatttcctaaaccaacatctagtcattttaatacccgagttagcaatggcataaggtaaacaatatatggctgagtagtaggactcatcccacatgatattgtaaaacaatgcaatatttaatagaaatgcgggacatttgtaaattgggtacaatatgatcaattgtaatgcatgacttgccttgctctcgcactgatggaaccacagcaacgtcttcgagaaaccgcggatcgatgaaacggccgaaatctacgcgacaaacaaagcacacaagcaaaacaggctataagactattgaaacaggaaacaaaaccatttttaatggattctatgcatttttatgaatttactgagacttgaatggacttaatcggagctcggatgaattagttatgatttttaaaagattctctgtgtttttactaataaagaaaaggccttaattaattactgcgcaataaatccccagggctgacgtcatcaagggagggggcgccgacatgcgggccccactcggcagcggctcaaggggcctgtccaccgtggaccgggaccacgtgggtgatccaccgccggtccacgggaccgacggcccggggccgatcggacggtgcgggtggcggcctggcacggctcggctcggcacaaagccggccgaccggccatgggggtgcggcggcggcgcacgcgaccaccggcgacggcaagcggcggcgcgagcggcggcggatggcgcacaggccgacggcggcggccgaaggtgatagcgagtgcgcggagagcggcggcgcgcggggaaaagtgggaaggagggaggagaggggctcctcaccggagggcggcgaccggagcgggggtgaaggtggcggcgacgacctggcgacgagaaggggcggacgggcgccggcggcacctaaggagggggaggagaggggttaggggtttagaggaaacccgcggcgacaaaaatggccggccagagttgaagggaatggaggggctcaccgacgtgcgaggaaaccggagctcccgaggggttcgggcgatgtgaggcggtgaccgaggtgctccaagcggcggcgaagctaacggcggcggcggcttggcgcggtggcggctctagcggcggcagcgcgtagctggaggcggcggcgagctgcggcgcgggcggcgagcggcgcgagctcggtaggattcacgggagggagcggcgagagcggaaaggggaagaggagggcacggagaacgttttataggcggagggggaggcagacgtggccgggaggacctccgatttcgccggcgacgtggggaggagagagaggagatggggggattcaaaatgcgaatcccgccccttttcgagcgcacgcatgtgccgggagacgcggggagagggcggcgacgtggggaggacgcgtgggcgatgcggcgtgggtgcgggaggagcggcggaggtgggcacggcggtttcggcggtggttgccgacgtggggcaggcggccagaggaaggggacgaccccgacaggtggggcccacctgtcggcgtcccgaggagagatggaggggcggcttgggccggcccacaaggaggagggtgcgcgtggcggtggggtggactgggccgacggcccaagaagaggaaaaggagggaaaagaaaaagaaaaggaggaaaagattttccctgggatttaaaaattgcatgtgctcaattttaattggttaaaattatttcgagagctctgaaaattgcactaaaagtcttgttaatgtattggagcatggggaactcaagaaaaattccaccacgccgaatttgattattaaatgcatttattaattgaggattagctctaggttaattcaacaatttctttaggcgatttatttaacaaattttaaagctggaaaggggaacttcagtgcgtgacatcataggagagcttgtatttatacccatagattccccctgtctatgtagaactagggagaccgtacttgccgtttccatatagaactatatttgtccttccttatccggaactccttctatacacgaggtatgattccgtataatacatggtatgtggtgggtcctgccgagcttagtcgactactattaggtatgtggtatctataactatgacactactataaaccgataaaacatgtggtagccagaatgagttttatcggatatgaccattttcttgaagcaaagttaaattagtacatgattcttacaaaaataaattacttttaaaaacaaatgggttgctaattttcggtgcacaacaattatgatcacaattgaaacatatacacctaaacaccgaaaagacaaacatagaatttaactatttccatctatacattacacatataagtttaagtttttaatgtcattaagagcatctccagccgagcggccctccatcctacgccgacgtagctctgccaatagcggcagggatgacgtggcttccccggctcaactcgatcaggcttctcgtcgatgagtagatgtagggcgtggcattgcagcctcgtccccaagaccccaagtgtcccgctagtcctctatcccaccgcttcccgagcagccgagcaggacacagcggtagcctttatcgtcacttgtagctggtagcgatgatttgtttctatttgtaatgcactaaaatttgttttcttcctttggaaaatagagattttatctttgcttatttgtagggattgagatttaaggggatatgatgctttttttagcaataacccatataaagacctataagaaaatacaggggatatattttaggaacgtattactagaaatacagctagcaccaactttcaaccttctttcttagatgttgcgacaattgtattgcacttcttcgttgatgtaaccatatacaaatatacgcacgggtcaacccccaacattttttctaacatcatatatgccattcactcaaaactcatagcttagctttgtgcacatcaatagcttacaactaagtagaggtaattattgttgctatctatgtttggttttatcttaaaaataaaatattgtaaatcataaagcgactttgaacaatcgagacaacatcactaatggcttaaggttttaatgtttgagctagcaccaaccttgtgacgacctagcatatgtaacttttttcagcggaaaaaatccttatgtatccaatcaaaacatgtagttttctatatattaattaacttacaacttagtacttatcattgttacattgcatgcttgaattaccttaataagcaaccttaataaacatttaaactatagtctataaaacaacttagagcaaaccagaaactatcatcaatgcttggaaaatatcatacctcaccctgtttccggctttcccataaaaaaaagagaaaagcattcgaaaaaaacttccattttcttagctagcttagccaaacataccaactggtatcaatccaagacaagtaaaactattttcttaacacaataggatcatgtatgtcattcacttaaattttgcagatttacgcaaattaattaaattgcatgcaagcaccatttattattaccatctatgtttagatttaccttaataaaatactatagaccataaagtaactttgaacaagtaagaatacatcactagtggcttaaggatttaatgtttgagatagcaccaatctcgtgataactcatacttttctcccagggcaaaaattacaaatacatccaatcaaaactattatagtttataggtaaaaaaaactattagtttatgtatattaattaatttatatctaagtatctatcactgactgggaatatatcctaataaaccttacaaaccgtataatatgtaaagcaaccttaaacaaaaccatgtattttagcatcactggttggaaagcatcagcagcagcctcatcacctcatcaaagcctctgttcctggcttcctgcctgccgcaggaccaaggaaaacccaaaccatcaccccccagaaaaaaaaaagagagaaaagcatcccaaaaaaacaatcagagagaggagaggagcaaaaaaaaaaatccccaatcctccatgaagcccaccacttccttccctcccgccgccgcggcggcggcggcggcggccgacaacccttccccgtcggcgtcggactccccgtcggccacgttctccgtcgagcggcgcggcgacgcctccgcgtcgtgccggtggacgctcccggactttccccgcacccgcgcccgcaccttttacagccgctacttcgaggtgggcggcttcgactgccgcctactcctatacccgcgcggcgactcgcaggcgctcccgggctacctctccctctacctccaggtgctcgaccccaaaaccccgacgtcgtcgtcgtccgccaccaccacctcctcctcctccaaatgggagtgctttctcagctaccgcctctccgtcgcccacccttcccccgatccctccaagtccctggcgcgcgactcgtggcaccgcttctcctccaagaagcggtcgcacggctggtgcgacttcgcgccgtccgccgccgccgcctacctcttcccgccgcacgactccctcgtcatcgccgccgacatatcggtgctcgccgaggccgcctcgttcgccgaggccgacagccgcttcacctggaaggtgctcaacttcggcaccttccgggagatggtccgcacgcagaagatcatgagccctgccttcttcccggcggccaatgccggtgggagcgactgcgggctccggattagtgtctatcagagtaatgtatctggcgcggaccatttgtcggtgtgtctggagagcaaggagcccctggtgcaggcaacatcagggtcctcggcatcagcattgccgtcgagtgccgggggcagcggcgtgcccgatggtgaccgtgggtgctggtgtctttttcgtgtttcgatcctcaatcagaagccaggtgggagtcacatccacaaagactcgtatggccggtttggggctgacaatgccagccttgggtggggagattacataaaaatggatgattttttggctgcggatgggggttacctgcttgatggtgctgtggtgtttagtgcttcagtgcatgtgatcaaggagtcaaactcgttcactcgcagcttaccgatgatagcaggcatgagtggtgctggcagtggacgagctggggctagaaagtcggatggacactttggaaagtttgtgtggaggattgagaacttcacaagattgaaggagctgctcaagaagcgaaagatcacgggtctgtgcatcaaaagcagaaagtttcaggtcgggaatcgagactgccgccttattgtgtatccacggggtaagcattctagcaaatgttttctccatactcatctggtagtttgcaagatcaacttgtggatttctgctacataagtacatatactgcttatagaggctaaactttggtaacatacccaggcacacacatcacacacctgattgatttaatcagaactataacatagctaaatgtgtggggtgcttttaactgtttgaaaattttggaatcaaggttaagtggcctgtgtaaattggaacctggaaatggaaatgaggtaaatcccaaaagattaaaaaaaaactagtttagctactggctagtatgccactaaataaattaagcagcttgggtttcacatttttcgttttaatatatgatcaaatcctgtttattaattaaatgatacaaatgaattggtttgttgcataaatcgtgccaattctcctctcttagatgcagcatatggtcatttgaactcatcttttaaaaactatagatgcctcaatttttgttaagtacacttgttttattaagcaggctcgacatcttctaaaaactgcagatgccacaattttttgtcctatttattgagttctctgcgaacgtatggcttcattgcaatctaatcgttgtcactttcctatcaagtagctgttgagtatggtttacttatagttatgtaactgtatactttaagaatgcgaatactcattctgtcagttggttctcttaacatttctgtaatcagggcagtctcaaccgccatgcaacctgtcagtgtttttagaagtgacagatccccggaatagcagtgaatggagctgctttgtgagccatagattgtctgtcatcaatcagaaattagaggagaggacaatagtgaaagaatctcagaaccgttactctaagtcagcaaaggattggggatggcgtgaatttgtgacattaactgtcctattcgatcaggatgccggttttcttgtacaggacactgttgtttttgctgcagaggttctcattctgaaggaaactgctactattcaagagcttagtgacgaagattctgaagcatgcagttcaggttctggatgtcagattgattctttgccaaaacgtccatcattcacgtggaaggtggaaaatttcttatccttcaaggatattatggagacaagaaagatttttagtaaatatttccaggctggtggttgtgagttgcgtataggtaaaggaagttacttttcatgtcttgtgccatacatttcttgccttttgtgctcatcttatcacaatttgcaggtgtatatgagtcgtttgatacgatctgcatatacctggaaagtgaccagccatctgggtttgatcctgataagaacttttgggtacactataagatggctataattaaccagaagaattctgcaaaaacggtgtgtaaggaatcatcaatctgcacaaaaacatggaacaattcagttcttcagttcatgaaggtctcagacctgttggacactgatgctggttttcttgtccgggacactgttgtttttgtttgtgaaatcatagactgctgtccatggtttgatttctctgatcttgaggtgagattggatttgctgtttttcatgtggcttgttcctttttgcttcctgtgctgggttggggtaaatattgatgatagtcatgatactattatagttactccaaatacatccaaattgccttcgtgttgtatagcatgcatgcttctaaccaaatgttgttgcagtacagtaaaatccaattgttcatatcgaatgtgattatgcaacttgacatttgatataacatatgacagagatcaaaagaataataagttgaaaaagcttaggatactcatattttttggtgatttgggtcatattggattagttgctttggaatgttggggagtatagtgactcaagtcttagaaatgctaacactctttttttgtatagtatagctgagattagtaaataacagggattgcacaagctgcatatatatatttttaatttagtggatacattatgataagagattaataatggaagttgacaacatgtaacaactatagtgctcaattttttgtgacgggaatcatatatagacataggctataatttaaacttctgtgaagaactagtgctatatcatttgataattaggtgtatctatttagttggaacaacacacaactacaaaggtgcataggtgaaatgttcttttaagcatttttacagaaaaaaataaattgcaacactggtcagatcgaatattgtgtccattttccatttatatgtacattcttcattgaactacccaaaaatcctaggaaatcaaaaaaatgatttcttcaaatccattgtagacaacaggactaaagcacgacagtattccatgccaatggatttcaaagtctggtggcattactgacatgtcaatttcaaagtccttaagaagatgccaggttctgggcactattaggctgtgctcgtttgtttgggttgggaacccatttgctgcgcacggaaaacggagcggaccattagcacgtgattaattaagtattagctaactttttttttcaaaaatggatcaatatgatttttttaagcaactttcgtatagaaactttttgcaaaacacacaccgtttagtagtttgaaaagcgtgcgcgcggaacacaagggagccgagttgggaaagttggggaaagaactcagccttagtcaatattcactagatttaaggacataagcatgagtagcagtccaggtgttcttctattcgttttcctgtattcgggtggtagcataacattatggccttctagtcttttcctatactgtagtattgtacttggataactgttgctgttcatgcctggtagaaaagctctctgcatctcttatagtagtcacacaattgcaggttttggcgtcagatgacgaccaggatgatttgtcaacagatcctgatgactttattgagtctgaagacagcgaggatatgagtggtgatgaggaagatatgttccgaaacctcctctcgagagctgggttttctcttacatatggtgaaaactatactcagccgcaggttactttaagagagaaaattctaacagatgctagtgcaattgctggatttcttactggtctgcgtgtttacctcgataacccagcaaaagtaaagcgcatgctacttcctaccaaagtatccaccagggctggtggaaagaaagatgtttcaaagtgcgactcgagttccacaagcctcatcagtttgctgatgggagttagtgtcttgaagcaggctatcatagacttgcttcttgatataatggttgagtgctgccaaccttcagaagaaagaccagcatatgtctcatcctcagcaagttccaaaacttctcctgactcgaatggggctagctctccaccagagctcaatgttgaaggtgaactgacagaatgtgctttcagtaataagtatgaaaggctgaaacctggcaatgatgatatccatcataggctttctgtacaaaacacagataagtgtacaaatgatattcctgccagagttttagaacagtcctgttctccccctgaagtatctggtgctgatttgctagaagatgaaggctctgaccaggcttccagggtatgacttaaagtttcctattatggtcagcttcttttttatctttcttctttgataacaataataagttgctctgctggattttttttttcagacaaaatggccagagcaatcagaggagctgttaggactaatagttagttcattgagggcactggacagtgctgtcccacatgggtgccctgaaccaagaagacgacctcagtctgtccagaaaattgcacttgtactagagaaatctccaaagaagcttcagccagatttggttgcccttgtcccaaagttggttgatagttcagaacactctcttgccgcttgtgcactgttagatcatcttcaaaagccagatactgagccttcgttgaggttaccggtaagatttcctatttgtcactatgtgaaaaaaaaatgtatttacattgtttttattaactaatggctacacatttctacatttgtgtttctatattgtgactacagtgtatcagtatctaaggttagcttatatagtaggccagtaaatgattaaacatgcacgtgaactctgatacctaatgtagttctttgtctttaacatcacaggtttttaatgctctatctgagctagaatttgattgtgatatctggaaacaagcatcttttcatgcactcgaattgttggctgattcaaatgatgagccacttgtagaggccattacatatgttctcaaggcagcatcacaatgccagcatattgctcaagctgtatgtttaccatccaagattatgttactttcctattttttaaaaattatcttctcgcttttcttattagtgtgcctttcttgttctccataggctagagctgtccgatggagactaaaagatctgggtactgaagttcccctgtgtgtgcttgatttcttgtctaaaacagtgcatagctggtcagatgtagctgatgctttgttgaaggatattgattctgactgtgagcctgatagcagttgcctctctatgtcctgtagtactagtagtacagacgagttttcagctgaagggatgcattctttgcaaggtcaagctgtacatggaaaagatcatctatcagatgtttttatactgatagaaatgctgtcgatacccagattatttgttgaagtttctcaggttttgcagagggctttattgcgaggagcctttgggctgcaattagtagccatggtgttggaaagaaggcattctcacaggttaagtcttaagtctgggactgggactatggtgaatgattcacagaacaagcaagttctgttagacgggcagtttgaacatttgcctgtccaagaagatgatttcacttcagtccttgcacttggtgaggtattatctctatctacagaaaccagggtgcaagattttgtgcggatgctttatgctatcatttttaagatatataccgaggatcattatagatatagaattctgaagggtcttgttgaacgagcaacaaatacttcagatagctgccgagcagttgacatagatatggatgtcttggtatttcttgttaaggaggaatttggaattgctagacctgttttgaacatgttgcgtgaggttgctgaagttgctcaagctgatcgtgcaaatctttggcaccaaatatgtgctactgaagatgagaatatgcgtttgcgagaagacatggatatggaacaaacaaaattcactaaggaaaaagatgtgttaatgcaacaactaactgagtcagaggcagctaatgcgcatctaagggtatttccttgtcattcagctgtttggccggactattgttgtctatttctagcctaacctttttcttctaattttcttgttattgtagtctgagctaaaagctgagaaggatcgttttgtccgggagaagaaggaactttctgagcagatgctggagatggagaatcagttggaatgggtacgatcagaaaaagatgagcaaattgtaaagctaactgctgataagaaaaatcttcatgatcgtctacatgaagcagagacacaactatcccagttcaaagcatggaaacgcgaggaactaaaggttagagtgaactaccataaagacagcatgcaatacttgttcgcgaccaaaatgaactgtccacttctgaagttctagtgttcatttctgttgttagatgctctctctgttccatattgcaagtcatctacacgttttttcctaagtcaaacttctctaattttgaccgagttcataggaaaatgtaccaacatctgcaataacaaataagtgcactatcaagacatatttcatggtggatttaatgaaactaatttgatgttgtaaatgttggtgcatttttttataaactctgacaaagtttgacttaggacaaaactaaaatgatttgcaatatggaacgaatggagtaccttgaaatgatgctaactctttacaaagtctgtcttatccatactgaatcccatcttttgttctgcacttcgatactattatagatatatgttactcgttattctcaacatgcctgtgcacctagaccttggttctctatattatgcgaatacactttctggttaatttggcatgctcttttcagaagttgtggatccacacctttacttctggtacttcctacctgcgatctgtagttgccacgaatcaagatccatacattgatttttaacaattctttcatggccactgcagcaccacacatttcatgtcaaagtttgaaactagcacatagtatcataagaatgtgattccagcatgccttgaggagcaaccgataccactacaccacgtgcaggattattcatgcatgataaattgcaagtgcatgttttttggatatgaaaatcatatggagcaagccattttggctttttttttttgtgttatcattaccttacatgttactactgaaagttttagtgacatcaactacatcaatgttttcccatcaaaacttatgtttttgcatgctacagaaaataaccaaggagaagaatgctttggcagagaggcttaagggtgttgaagcttcaaggaaaagggttgatgatgaattcaaacggtttgttgctgaagcacagactcgtgaagagattcggaaatcacttgaaggtgaagtaagaaggctgactcagacagttggacaaaccgagggagaaaagaaagaaaaagaagaccaaattactcgttgtgaagcttacatagatggaatggagtcaaaactacaagtttgccaggtcttccaccttgctaactttttacgttgccaaaataactagtagtcctaatattaattatagaattatttttcaataccaaagacaccctttatctttctagtagaaaactccttatggcgcagagttgttttccacttattaaaattagtcattaaaataaagtaatttggagaacagcaactaagtaatagccttaatgtctaattatagtttatcttagttttaaccatggatcaaatttgggtgctccacttttttttgggtaccagtttggaatgttttaacaactacatttccactttatattgggaaacgattggcctaaattcaacattctgtaaagagcatgcaaaaatgttgaaagtaggtcattctacagtttatgtagtagattgtacggcgttgaaccaccagtcaactgataaattgtggcgtgcgtaacattaaacgtgcaattgcacgcatttaaggcatgtttgcattcagttttttatatttctgctcttaaatgattaaatgattttggaatgttcagtggtatttgtaaatcgtaatgatgaaaaagctcaccgtatttgtcacaattcacttttttcttctttaataacttccccagaccttttcacactatatttgatttctgacacatatcttcctattgcagcaatatattcacaccctggagacctcaattcaggaagagatggcacggcatgctcccgtgtatggtgtcggcgtggaagctttatcactggatgagcttgagacactcacaaacatccacgagcggggtttaagacagatacatgcaattcggcaaaggaaaggtagcagtcatcgcttgagtgccccttcgctcccgcacgtcccaggtttatactcctcgcctccttcaatggcagttggtctgccgtcctcgctgatccccacatcgtccgtagcacctaatggtgcaggcatccatggaaatggccacatgaatggttccatgggtagctggttcaatccaacctaattcagaagatgcagcaccgcaacaccggtgtccattttgtgcatcaattcgacgtatcacattttgcctggccgtatttaccagctgctgagcaatccaacgtgataccctttttgtcctcgccatttggtttggcttttcttgcttgtattttgaactggtagcgccgtcggcttgatagatcaaagagcgttaagggggtttccgcatggaataagttgtaataatcaagataatccgatggaactaccaggtattcaggtgcaagtgggaaagctatcgaaatggttgatatcaccaattgcttggttatttctaaaagcattgggattttttttttgttcaaacttctggaaaggtgcaacatgagaaaagtattccagtttccataggcgtgtctgcctgttcttttactggcatgtcttctgtaccggtgtctagctttctcagtgctatgatggtgctcacatagtcacattagtgcacactttcctttgtttatgcacatggtctgaaacctgaatcggtcatccaaatttcgaaataaaagtcttaacatgaatatcttgagaagaaaaatcaaggctacacacgttattgtcttcttgataaattgaaagttgacgggcttgttagtaactgtcatccaattccaatatttgcactgtcgtaaaaacgtgaaatttgcacttgctggctaggccaatattcgattaatttgcaagtagttgggcctaattagcaacacgccatcgaaggcaatctttcggcccaatcacggcccaggtttgggcgagagcctcgggtcagtgtcagtgtcctctcgaaaaacgaaaaaagggaaaaaaagaagaaaagaaagaacacaagtggccatgggggatgagatgaaaaatgcgtaacttgtctcttcccgtcgcacgttttcacaagacgtgccaaatcgaaatgcctgacctagacgtgtcaaaaaatttacaaataaataaacagaggtttact

SEQ ID NO: 76597 - DNA, 2839 bp, Oryza sativa
cctcgtgtaccgttggagaaaacaggtagtacgtcgtttcttgtctctctgaaacctagcactctctggaattcaaaaagaaggcattatcttcgaacaaaagtcattctctaagacccttctatgaaaaggcagaacattttttccttttaaaaacaagatgagaaaaaaattaattgtcgctatcgatattcctacctttatatttttaatcctataaaataaatgtgaattgtaacggtcaccatctcgacccattcacaactatatctaatagagaaaaagagttttgtaagtatataccttcaggtgattctgaaactaatccttcaattccgttatataagacgcaaatgctttggacacaaagaccaataaaagtttgtgtgactaccattctacgcgcaactggtttgcttttcctaacgacgtctcacttcgccagtgtgacacacgtgtgcaacgcttaccacatccacgtgcttcgttcgcccttgcatgttgagttctatagacattgataggccatgcagccatgcgcacatcccttgaatggatgcggaatgagaattatatgattgcttaccacctattatgttgggacttttgaaaaaaaaatattacatcttgtataataggatatatggagtaacagaagaaaaggaaagaggatttttcatctcaaaagtttgttcaaatcgaattaagaaattattaaccttacaatataaatcaactataggccatgcttacggaattggggattcaagcagaagttgatgaccagtagtttattatattggtagttatgagttttagaatctttagtaaaaatttaactgttttaaggggtagagattatagaaatagttaccattgtttgatgctatcgagcaacgcacagtcgttatgaatataacttagaagcatatgccatctatattttaacggagcacggcatcttccaccatgataactttacaacgtactaatcgttgtttcttttaaggacacaagagtactattccacgcccaaaatccacccaacaatattttatagccagtactaattattactccatccattccgttttaagatgtttgacgtacgtcgtaaaaaaatagtattttttttgacacaatactattccacacccagaaatattttttgcacgctttcatgccctatataaccgcccaaattatgcttttgacacaatactattccacagccagaaatatttattttttgcacgctttcacgccctatataacagcccaaattccgcgagtgacgagtgcgcaatgtgacaaggcggctgaggccagacaggacaaccaccaaactgccccggttgttgtacgattgtccttgttccctccgaaaccggcactgcgttccagtttcttttggtctttggaaacatcctagttcactggggagctagagaacaagtagcaacagacacagaggtacaagagttttttgtcctgtaactctacatatagaagcataaatgacacagaaagttgcaaatgtgcagcatgctggattggtagggataaacagagtcggttgcagaaattgacacattgatctctcatgtttccaggcccaaaattgacttaatatttcagcgatttagattttggtggatcagctatacatgtatgccgaaaccatgaaaagtactagagcactagtttctgatgattgttgcttgagagtgtgaaggtgatacaatgattgacagcaatttgtgttaatcatcatagagacaggaaagcacatgggtgcaatttaagtcttgttctgctaactaggcatccatgccacttggtgctttgggttgaatcagtcatcattgttttggtcattttcgtcatgatgattgtcaccatagtcaacccacgggagcagtgattccaggaaaaccaacgcaggattgcgccctgcaacttcacggggggcacggggtctgacctcaatccccagttcttgttcagctggcggcatctcatgtgccattccaggagcaaccatgaatggccgcaattcttcaggggggagtgatggtgttgtgtcggagaagtctgaaacaagaagatgagagtacctgcaaaataagaaacaacttctcaaaactcaaaaacatgttataactccaaagattaacagataccaaaaattgggatataactacaggcgtaggtggattttgcttagtgtcatgtataaatatttaagtccaccaaagcaatatgtgaaataaactgcatatctgtagtgtttgtactccctcttgttttttttgtttgacgttggttagttcattttttatctaaccaacatcatatataaaaggaaagaggtaatattatatatcactatcgtacatgctaagactacagatccaacattgccaacaaattaagaatggagtcagtaaggtagacggctaaaccatatattgttatgtgaacgttcagaccaagataaaatttacaactcaaattgcaacaaagaaaaggtattggtagtcagtggaaagcaatatcataactaaataagccttcagttctgggcaacaaaaatcatattgaagtgctctccttaaaataaaaagggaagatgtaatcgaagagcagacagaacattgacactacgcaaaaaaatttggagcaacttactcattcttatctgaagagaatgcttcttttctaacacatgcccagtcctgggcctctctgttatcctgttttagtgattcaatcaccaaaagagcagcatctttgagtaaattctgcagttctgggaacctccacatgatgtaatggc

SEQ ID NO: 76598 - DNA, 591 bp, Oryza sativa
gccgcgccgctcgacggagaacgtggccgacggggagtcgacgccgacggggaagggtcgtcggccgccgccgccgccgcctcggcggcgggaggggaggaagtggtgggcttcatgaaggattggggatttttttttttgctcctctcctctctctgattgttttttgggatgcttttctctcttttttttttctggggggtgatggtttgggttttccttggtcctgcggcaggcagaagccagaaacaaaggctttgatgaggtgatgaggctgctgctgatgctttccaaccagtgatgctaaaatacatggttttgtttaaggttgctttacatattatacggtttgtaaggtttattaggatatatttccagtcagtgatagatacttagatataaattaattaatatacataaactaatagttttttttacctataaactataatagttttgattggatgtatttgtaatttttgccctgggagaaaagtatgagttatcacgagattggtgctatctcaaacattaaatccttaagccactagtgatgtattcttacttgttcaaagttactttatggtctat

SEQ ID NO: 76599 - DNA, 967 bp, Oryza sativa
ctggcggcgacacggggaggggaggcctcctcctcctcctcccgctcgacctctgcggcggcggcggcggcggcagggtcctgcggggcggtctcccgctcctggagcactcgccggagcagcctggcggacatggcggcggcggcggagcacgccggcgaggacgagatggcgcgagggttagggtttgggcgggttgcggtgcggtgcggtgcgacgcgatgcgatgggatgggatgcgggctgcgaggcgtgaccgagtgagacgattttgagatggagagttggagtcggagacgaggacgatgacgatgactcgatgaggaggagaatttttttgcctttcccggattcgggactcgggaggggttgaaatgtgattttacgtaaaaggagaggatgcgttcggaaatttcgcgaagatgttttacagcatcatcggaattcagagccacccaaaaattggatcccctaattttcttcttgggagtatgtaaacagtaaagtaattaggatgtagtagtacaagtacctttcttgtatcctaccccctccatttcataatgtaggattttctagcattacttatatttttatatactccatccgtttcgaaatgtttgacaccgttgacttttttaaacatgtttgaccgttcgtcttattcaaaaaatttaagtaattattaattattttcctatcatttgattcattattaaatatatttttatgtaggcagtatctttcttgtatcttaccccctccatttcataatgtaggattttctagcattacttatatttttatatactccctccgtttcgaaatgtttgacaccgttgattttttagcgcatgtttgaccgttcgtcttattcaaaaacttttgtgaaatatgtaaaattatatgcctacataaaaatatatttaataataaatcaaatgataggaaaataattaataattac

SEQ ID NO: 76600 - DNA, 1692 bp, Oryza sativa
ttgtttcgactgtttcttccattagtagtgggcatttttttttgatagtagagcttggtcgtcttcactaattgattttattaatgccgctactgttctcaactctcaatccagcatttgcttgctggctagtatgaactatggtctgttctatctgttattctatcagtacaatttgcactgtcagtgcttgagagttgagtaaaaattgttgcttattgattggacggggttacaagtttttattaaaagtaaacacaacctttcttgaaggtttcgaactgctaactttgcaaccaatcttctgacttgtaatgttgtctcagtactcatcttttgtgctttgaagaatacatcagggttttacactttgttccttggaattggaaaaaaggtgaatccttttgctttgcaatgtactaactgaccaacatgctagttcttcagtttgcggaatgttcctagggagtgtgtttggcatgtcatggaatgtgagctatttacaactcgtgtaatccacattaggcatcatttacgttaagctgcctttacatgatgttagctctgtctgtgtgcatgttctcctttctacaatgtttgcacacatgttctgtatattaacttttgacctcatatgtggtgttgagatgtaatattcaagcatacagctgttaacaatatatcagacatatttaaactttgaagagatttatctagcaaatgcacaaaaggtgttttaccatttcccatagtcttgattgctgaatataattattgcaccatatatagtaacacgattattttattttgtatttgttctatgctaaatattttttcgttacattcaacctcagaattcaggtggctttggtaggcatattgcagattcatcaacgaatcatcagaagttaaatcaagcaaggaattgtacagcacaacctttttctcctggaagttacagaagctcagttggggtatgtttgtatatattcttatctgctgtgatccatattcttatctgctgtgatcctcttggctgctttaatattttggtttgtgggcatataacaaaatcttatggtactatatggtaatgtgtgttagtaggggtaagattttctatcttgtgattctgttgcgtttttcattacacatgtttgtgtctgatggagaagttttgggagtgtaacagtatgctttatcaagacaagtcattgagtagcctagcagtctaagctaatgcttctcgactaaaaataatcatgaatgattgatagtaattaaataatacatttgtgcatcgttttgtctgctcattctttatttagataaacagaagtatgaatttatttgctaggaaaaagaaagaacaatgaagtcagtcccatagtattttgcctgctgtctattgtagataacttgaaacttctctatatttcttgatgcaactaaatatgtttcccagatgtaacaaccagcacaacaagcacattctcaaaagaatgtttcttttttcttgtattttacaggattccagtataaatcaagcgatcagtccagctcgctctttggatatcaagggtagattcaggggggctgattataaccttaagacatcaacagaactcttgaaggttctaaatcgaatctggagcctggaagaacaacatacagctgatatgtcagcgatta

SEQ ID NO: 76601 - DNA, 707 bp, Oryza sativa
  unsure (1)..(707): unsure at all n locations
atcaagaacccatttttgtgctttgttgctgcttgttatatggagtttattagagtaaaagccttttcttttccgttggtcgtgtagacgctgcagcttcggaagatccgctcttcgtggaagttgaagccgacggttgggaaagcgagcaaggcaagtcacatcatccttgaacatattgaatcccagtttataaatttatgttgatttaaattactgcattatcgctttatttaaattcccgcgttatcactgttttatctagccatgcctatttacctttgttatgaccttattattgttattgttattatttccttgttcaccctagaataaacaaaaccccaactagtggacactctactcacggtaccactagtatgattttagatagatgcttcgctggttaaataggcaacattaggtggttttacaactctagactttggaatattcatatcacctggacactatggaatggttggattattgtggaattggattcacacctccccctctattcaaaatcctcaaaatggttttaggctgggctcggngtgcatggttttgatagtagcgcctcggccatataaggaccggtcttcgggcctctgttgcaaagcactaccgtacttccacatgtctagtgggtaaggcttagtttgtggctcagtctggttataaacaaaagtacacggatggagatg

SEQ ID NO: 76602 - DNA, 21726 bp, Oryza sativa
aaatggcccgaggaaaaaccggcccacaaaaatccgagggaggcaaaatagactttttcggaggagattgatttggagagaaatggagagatttagggtttggattcaattcaaatttgatattcaaactcgagggtttaggaatgaatcaagggagactcaaggaaatgattcgagatggggatttgatattttcggaaatggggataggtatttggcggggattcaagggatgtgattgaatttcggagacttgagtcggatttggaatcttgaggtggacgattttgatggcgatgagagggaacaacgggatttgaattgaggtccttggcacaacctagactcgcacacaaagaacgaaaattttcgcaattacgattttgccgaaatagtttttaacgactcacgaaaagcggagcgttacagatccaccccccttacaagaatctcgaccccgagattcgaaggtggaccacacacacgaaaccaaaaaggatcttcagacttcttcacagcttcagactctgctagtctttcttcaacttattgttgcgtgcttgccgcaaaacggtctggtactctgactcacttagaattcttcatcttactgtggctctgctcttgcctgtggaacctgttcttctcctgctccttcaacttgctcgagattcacaacttttccgtttgtttctacttgcacatggttcagacgaccttgtccgacgggcggtgaggtcaacgaggcagaaccactgtttggtgactttgaactttttggtccagatacgttgggaaggcttgttgttggttggactcgttttgacttgactttctgagggcagcaccatgaatagtgtcccatctcatggcagatgaaacattcgactcctgccttataaccacgtctttttgaaggtgtagggcatggtacggagttgcttccttcatggctattactgttgatcattgtggcttgctgaccaggttctgacatagtcgaacgagacgtagaaccggaactagttgaatgctgagatgctttctgatagtattgtgctggcgagtttgtttttcgacacaaatcttcttttgcttgaatctctagggacattactttgcgtctcttgtattcttgcatctctttcttttcttggatgtcttggcacatgtcgcaggatgcttttgctcttttgtcatcagggaaggttgaacgtactgcattaacatttggcgaatttgggcttccttggggatagaagggcatccttgaggttctcatattagcttgtagtggtgcatccatatagggtttttgggggcagtgtctcatgtaatggccaattttgtggcaaatgaagcatatgaatccgggaacgtgtctgatcttctttgatttgagggtgggggacttgggtaagttttggcaagattgcattgtctgacattgtgggacatcttgcatgtcaacttctgatggcaaggtctttcttttgtgacaactccttctttaatcatgctattttctcgcgatacggatttattgattgagttctgaaggttggggcaattattagctcgaagtggggttttcatccctgtaatcatcacatttaagaattctttgttcttctctttatgggtatcagtgccttctactgattgtgttccttgtatttctgcggcctcattcttactcttgtctggattcaccttgggctgtggtagtagcagttgttgttgtatagaagccaaattttgagctatttcttgtagcatctgagtctggttggctagaatctgataaatatccattgaggagtgttgatttctgggggcaacttccttgtttggtccaggaacagtattatcagtcttggcaacttggttggggacttgttcagctagttgatttggattttctgacaaagctgggtcttccttagaaccaaggtagttgcggacacaagtctgacaggttggttgaggtgccatctgcttcagagggactgagatctgaccaacgcagaaagtagataagaagaaaaggaggaaaacaaaaacactacatcaaaacggttttcgaaatcacagaagacataggtggtgtgttccagccggtaacccaactggtctaacacctgaacacggactaccaaacaaaactcacacacgcactagttcaccacaactcctaccgagcgtgtgacggtactaaggttagcctaccaacaagggcttaactaagactcctaaaggcttgagcacacctttcttcaactgggcgtgaagacaggtttactctaggataaaagtcaaaacgaacgactagcttctacttttggacacaaaagatttttcgcaaaactagagctaaaggggacaacgacaccttagctttcacaaatatttttgtactcaaataatgccatcctattaaggggtttcgatcctagggccaacctatgctctgataccatctctgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaaaataaatagaggacttatttaccttaacttaggttgcagctcagacagcccgagaatacaaccgacgacacggacgaggcgaacaccaacaacagcagcagcagcggaaccaacggtctaacacccaacaccacaggcgacggctgggaaccaggacgaaaccctaatcttcacttcactttatcttctcttcagggccggggaactatatatattgagtactttcgtactcagcaagtcacgggaacttaggtgtttaatgcaagcttggaagagaggcaaggttgttttgcaaatcttttatttgaagacattttgaaatcactaagtgatttatttctttctaagtttgggccgaaaagagacttgcgtctcgattcgacattaagagatgtttttttttcaacagctcatttagtaatgtaccgacctcccgggtcagatcattacttctcggctcccagagccattccatttgattaatcggctcccagagcctttttcattttcttggactcccagagtccagctgcccagcagcacaacaatccgcttccacttgggaagcctagtctatgatgcccgcagacatcccgaatcacacagattcgtttctgaccacttaggtcgtccatctgccacataggctgattctggttacgattcccacaccacaacaacttttcacaaagcacaggcaaacaaatctacgcaacgggaaccacctcacatccgcccatgaccgtgggcacggctgctcgaacagttagttaacctctgcagaggggtacactttacccacaagatacgaacttattccgaacacccgtcggtatcggaggttcgcaacaaagcctttccccagccgacccagggttacctcatgccacatagaaggatcaaatcctcacataaacataggccattttaggcgtgcacaaatcaaactccaaccaccttgatcggtaagtgagcaagcttctcgtccttgccttaccaggaacccggtttgtccgaccccgccccggcgttcccaactattggcatgcgaggtttccctgaaccgtctagttacttagccagggtgtcccattccaccttgtggttgcactttggttatgttcggtgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgtcaaggaatcagggtagtatgacctacggaaattagtgcgactactgggtaggtccgtcgatttggcatgcaacccgaggccaagcaagttaagtgtgtgattctaaaaatgcaagttgcaaacaaaataataatgatttttcaattataggagcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagactaattattagtgccattgaaaagatctcaattttacggaattactggaagtggaacggagtcaatcggatgagcggttgagaagacatgaattttggaagtttaattggagtttctggaataggagaaatggtttatggaattttatagaaataatattctcaagaatattattgacagtcactgacgcgcgggaccaaaggaaatgatttgtggaattttggaataaggaattgatttatgggacaaaggaaaaaggatttattaaatccctggaaaaagaaaaggatggagggatgtcaatcagacttgtctcgggtggcattggcgcggcccgagggacttgcgcagctcgggcgagcctaatgggccggcacggccgcgaggagggcggcccaaggggcgcgcggggagagagggtggcccgtcggggtgggcgcggtccaccgcgcgggacccacatggcagtggttgggttcacggtggggagggtgcacgcggaggtgggcgctagggtttcggatgcacgcggttcaggcgcggcgcgccgggtggacggatggcggcgggcccacgtgcagccgcacggcttgccgtggaccgcgcgcacgggagggaagacggagggaggaggctgactgggcgcgacttgacccaatcaagcgggcccgggactgaggtggcgtccacgtggaagtcacgtcggatggggaggcagaggaggccgggcaggttgatccgacggctcacggcgtgcggcgggatccggcgaacggcggcgagccggaaggggcagctagcactggcggcaggaggaggagaaggggaactcattccacggctcggatcaggaagaggacgcgcgacgacggccggcggcggcggccaatctcgccggcatgccgacgtggccgcgcgcgaggagagcgaagggtgcgcgggcttgggtttagccgaaccggtatggtgttgcgacgcgcacgcggtgacgcgggacccgatggtcaccggcggcgcacgcacggcggcgttatgcagcggcggaagcggcgacacggcgcggagacaaaggagaaggccgacggccttggggcagccagggggaggtcaaagggatccccgggggcgtggcggcgagaggaatcgacgcgagagaagccgacgatggcggattgcggcggcggcaatcaccggagagcaaaaaaggggaaaacacgacgagacgacgagggttcgattcaaagggatgggagcatctccggggttcaaggaatccattcccggcgtcggattggacggagcggcaccgaggttggctggcgacgagagacggcctccgggacagagcatggcggccggcgagctagcgcgcggtgcaagggcgacgagcggcggttcggcggcgagacctggggcagtgtccatgcgtgttcggggggctagccgagctaccacgcgagctagggagggagaggacgagcaagaagggagaacggagggtggcattaccaagccgagacgggcgcagtgacgagcggccgacggctcgggagcgagctctccggcctcgggccgaggaaggggaggaaggagggtgcccggagtcccgcgtcacgcgtcctcgcacgcaccggtctcccggtgctctgcggcggacggcgacggcgagagcagaggaagggcgacaatggcgcagtggagtaggagtgtgaagtgggagggattgagatggaatggggagctcggcttcgggttttataggcgcggggtgaggcgatgtcggtttggggggagaaccgaccttggcggtcaagcgctcggcttgcggcagcggcggtttcgtgggcgatgcgaaagcggcgacggcgtggatgctctgggcggcgaaggcggtggatcggacggccgatttcgaaccacgggagcgcagggctggcgcggtcaaggtgggagcggtgagctggcatggtcgcggtggtggcgtgggcgcgacagggcgcaaaggtggcgtcagcggcgccctgtgtacgctcccgcaccaggacaagggagagagcgagacggccttgcccgcaagggaaaagcgaaaggaggaggaggaaagggagccttgctccttccgtttttgggcggcgaggctggagaggcgcgtgggattggcgtcgccacgttggcggcttgtggcatgcggaggcggggccatggtgacgcagcggatgacagcgaaaagggaggagggctggtttggcggcgagcgcggaccaaggcggtcgacgcggcaggggcgacggtggcgcggccacagcggtcggccatgagcggcgccgcgcgcgggagcatcggcgtggcgcggtcaaggtggggcacaggcgcggcaggacgttgtcggcgtcctctgcctccgcgcacaagaagacaagggcgagaggagagaggccgggtttagaagggaaaagtgagggaggacggtggaaagggaagcctctcccttccgttttgggcggcgggcaggcgaggcgcgcgcgggaagggcggccggcgaattcaaacggcggcggcgggaatcggcgccgaggtgaggagaaagcagagagggcgagagagggagagggcggcgctctctcttggctcgggcacgacgcgcgtgctcagcacgtgggaagggaagggggaggagcggctgagaggagatgggccgaggagaaaacggcccacaaaaatctgagggaggcaaaatagactttttcggaggagattgatttggagagaaatggagagatttagggtttggattcgaattcaaatttgatattcaaactcgagggtttaggaatgaatcaagggagactcaaggaaatgattcgagatggggatttgatattttcggaaatggggataggtatttggcggggattcaagggatgtgattgaatttcggagacttgagtcggatttggaatcttgaggtggacgattttgatggcgatgagagggaacaacgggatttgaattgaggtccttggcacaacctagactcgcacacaaagaacgaaaattttcgcaattacgattttgccgaaatagtttttaacgactcacgaaaagcggagcgttacatcttaatgcctgaaatgccctttgactaattgactaaaacctagcccaaatttcacgaatcctcaccgccggcgaccaggtgccgccctccccgtcatccggccaccacgactccaccgccggcgtcctggctccgccccccaccatgcctccatcgccggcatcttggcgccgtcgcccgcagcgccgccgcccttcccttcgtccgcccaccaggcctccaccgcggacatcctgaccccgtcgcccgccgcaccgccgtcctccccgtcgttcaccaccacgccaccaccgcggatgtcctggcgccgtcgcttgctgtgccgccgtcctccccatcgtccgcccaccacgcctccaccgccggcgtcctggcgccgttgcccgccgcgccgccgccctccccgtcctccgctcacaatgcctccatcatcggtgtcctggcgtcatcgcccacagcgctgccaccctctccgtcatccacagcgccgccgccctacccgtcgcccgcagcgctggcgccctccccgtcctctgcccaccacgccttcaccgtcggcgtactggcgccgtcgcctgcagcgccgccgcccttcccatgctctgccaaccacacctccaccgccggcgtcctggcttcgttgcctgcagcaccgccgcctcgtccaaccgcccaccgcccctccactgccggtgtcctagcgcttccgtccccatcaccatcgtccccggcgccgctgcaaccgccgtccccagcgttgctgcaaccggtcgcccaccgccggcaaggagctggccctccttgatgacaacaaggaggtagccatgcctgtagaatgggctaggggcaaataggtctttttagagctctaacagaggttaactagacggtgatggcacattttagaggttaaacaaaacacggtggtacattatagaactttacaatatcagtggtagattgtagaagggtgacaaactcagtggtactgagtggattctctctatatactatctaaaacactctatatatgaccaaaagttcccccatacacccctgcaaggaatgagtcatgcatgtttaattagcacctatatttgacttacctccttgtttcacacgaaaaagggttgacatgaaagtatgatgctttgggccatgcaagaaggctgacatgccaacaatttgatgatcttataatgacaaatagttcatgttaattatgtagtctcttcatcgatcgtgcttattagtcatagccaaattttgaattttaaaacttaattatagagttaattttaaagttatttcatcttaatctgtttttcagcaatgggttttaaaccactaataataacacagatatagaatttatattcataaaattagttttggcgtatttgttcattatattttttttcatagcttgtgatctgccgcagctcaaacaatttgcaatggatttaatttgccctcattttttttatatgaatgctttgtgtaatcgctatacctctaatttgacatcaacaagtagtaatgtaatttggttaaggctatggttttgtgaaacattatatggcataaaacgtgtggtattacattattattggtgttagcatgcattatattttgtttgcacagttataattataaaacagaaaattagttaattgatctctcttgtcacaaaaaacagaattacgtgtacatgtgtctgtatatttatggccgatggatatatagaaaatgagaaaaaaaaataatgcctatgcatatgtaaatgtggtggtggtttggtgtattaattgaaaaagcaatgtgtgatagaaatgaatgacatatcaattcaatatatagtactactaggaaatagtagctactccatatatagtagttgtagattgcatatataattctgagattttataagctatatactccctccgtcctaaaaaaagacaaaccctggtttccgtgaccaacgtttgaccgttcgtcttatttgaaaaaattatgaaaaaaattaaaaagacaagtcgcgcataaaatattaatcatgttttatcatctaacaacaatgaaaatacgaattataaaaaaaatttcatataagacgaagttgggcacgtaaacctatagtttaccattttttaggacggaggaagtatgacgcaatttacagtgtggaggtgagaaaataaaatggatcgatctatcaaatccatctgatatcaaattaaagctagtagtacgctgctacaccagctagtagagaagcagaaacagtatatttcatgtagtagctcgtgacaccttctttaaatccggcacgtacggatcgaactagctaggggaataataagggtgaaaaacagattagaaagatgaaaaatatcatgaggtaatttagtaataaattagggaattaataagctagtacagtagtagggaagaaggaggagggcgggatggtggcgtacgagggagcggaggcgaagtggaagaagcggccgcgcggggagaagacgagcagcgccacctccgcgtcgcacagcaccgacagctccgacgccttcttcagaagccccttccgccgcttcgagaacgtcacctgccgcctcgtcgtgtcctcgatccgccgcatctctcgccgcccgccgcgccgcctctgctgccctcccgccgccgccataagcagtacgtgcgtgcagggtatgcgagagatctactccggctcgccggccgggaacagatcgatctatgtcgctgctggctgcagaggagaggagacgtacggatcggatagggaagtagaagaagaaagcggcggcgattgaaagaatgaatgatttggggggccttgaattgggttacctgattttcctcgcaaaggaaagcatcccaaacctggaaacacttggcatatatggtattcgccttaaatggcccttcttcctcccctcctccactgcaccaatgcccgcttcacacttcataccacatatatttttatattttctttatttatttactttctgaagaatatgctttgcatcagtcactgacatgctgggcgctcgctatagccaaatacatatatactccctccgtcctataaaaaaaccaatctattactaccgaactagttgggtggcccgcgcaattgcgcggctagcatccatataaaattatctattttttccatatgattttatttaaaattatcattcccgtgtttcaaattttattgcaccttatttctttatcacccctttattgtttgcttgatctatcactacgactattcattgtctttagaaatttcaaaaattagaccttgtagcttttacagatcattgtctagttgactttcgttctcataatttttagaagtcccatcaaacatcgccaatgtactcctctatggcccgtttactatctcatctctttactatccttgggattttaaaaatcgaacataattattgtttgtgttctttttactttctgaaagtcccgccaaactattagcggcttcgccactatactcctctacggcctgcccgctgcctcccatcctttttgtcattgagattttgaaaatcgaacataattatcattggggtttatttattttattttctataagttccgccaaccgccataaccgtgctgcttaacggtgtgcccgtcgtccctcctcttaatcgttattgggattatatttttcaatagtctttatttttattacgaattttatttatttataaaatgtattccagatgaactcctattttttctttttctaattttaggatttagtttattttaaatttagaattttagttaatctcatatagtgctctgattttatttaaaaatatcattctcgtgtttctaattttatatttttcagtcacccctttatttgatttctcgatctaccacattttctttagaactttaaaaattagaccttgtagttcttagagttcattgtcttgttgagtttcgtttttataatttttagaagtcttgtcaaacgttgtcaatgtactcctcttcggtccgtccacagcctcatctatttattgtctttgacattttaaaaatcgttcataattattatttgtgttcttttttattttctaaaagtcctgccaaattgtcaacggtttcgtgcaaaacttatggttgaaggagtttgactgcccagctggtttgccttcctgcacatgattttgtacaggacgtgttaattgtgcatatatactatttctaatttagctatgcgtataggacgtgattgtctcgtgtcagtaaattaagtttggtaatctgattttgatttcagaggctattgagcacatgtcaaatgttattttcgcgctttttcatgaaaacatagtcaagcttttacacctatttcgattaaatctcaactcttataatctagatctattatgatctaatggtgtagactttttatttctctctgattttcgtgaaaatttctagacctgtagggcaaacgtgatgtctcattttaaaattatcttaataatgtactttttaatgatactcatataaaaatgtagggaggatgtcttcagaaatttaaattgacgtgtacatcttagttcttatttgtttgaatatctaaaaggtgcttggtagtatttaagtttagaaacttgaaagcaaaagagaactcatataacttataatttttaaaattagcatgtgctaatcattaagagcttgttgtaattaaggagtataattatcaggcatcgatgattactaattatatgtttgaagaaaaccaagaacgtgtccggttgataggccagaagctcaaaagaacctttctactttgtccggctgggaatccgactctgaataggagtccaaacatgatttatataatttctaaagcctgaataggacttatatatatacgatcaatctcaaccgttataatctagatctactacgatctaacagtttaaatatttttctttttctccgattaacgtgggattttctagcctctacatcaaacgtggtgccttattttcaagctgtcttaattatataatagatagtatagcacatcttaatattatgcatctggacatacatctgtccagattcatagtactaggcagggttcctctcaccgttttcggtgtggttgccggacccgcggtaaccgtgcggttacagcgaaaaccgtgtggtaaccgcgagacataccgtggtttataaggttaccgtgcatggtaaccgcgataattacgtggtagccgcgcggttttgtaaaccctggtactaggatgtatcacatgctatcctagatttggtttttatgggatagatagagtatgtgtttatttgcacttatatatacatttgtagcttatcacgcattatctattcttgggatatgttagaatgatttcaagtcagtctctagacatgctcgtacatactacaagggataccgtcacagtaatccataagaatcagttttactttcaaaaagagcatgccaaccaaaataaaggacgatcggaattgttgatttcgtacgtcattaattcctgcccgacttgggataaagctggacgacaaatcgagctcgtatttgaaggcctcattgtttggcttatgcttattcctataaaccaaaatttaaaatttagaacttaatttgaattcaaatttttggcttttttatcgtacttttttttacatcatttgcttttgagtcgctaagaacatatgtataaaagatttgcacacaaataaaatagtctttaaacgaaacaatgggctgtgattatttatccacacgtatgtacaaattaaattggctctacccgttgcaacgcataggggtatttttttctagtatattattaagaatataattatgattagtttgaaaagagtactcaaattcactctctaggcatagaccgtaagcactggatgaacatcagctgttgcagccacagtcccagccttatgaacactcgtatagaaattattaccagatcgaccggccggataaatcgaaaggcacatgttgcagaaatgtttatatttagacaaaatttaaatcctataaatcatttatattctggagcagagggagagggcgtagttgtttatactccatccgtttcaaaatgtttgacactgttgattttttatacgtgtttgaccattcgtcttatttaaaaaatttaagtaattatttattcttttcatatcatttgattcattgttaaatatacttttatatacacatatagttttacatattttacaaatttttttaataagacgaacggtcaaacatgtgctaaaaagtcaattgtgtcgaatattttgaaacggagggagtattagttagctcatgcgcattgcatacctacatgcgggtatgagttctttgggcactccaataataatctcctattttaaaagccccaaagaccaaatgaaggttgccccatttaatttcctgagaacctaaaagctctaaaccgcactccaaaccacttactccctccggttttattttaattgacattttggacaatgacaccgtctacaaaatataccttgaccttattttctattataatatatacaataaataaatacatgtttacttttattatagtgttttgaaagacaaatatatatatgttgttctagtttctttaaactaaatatttttaaagttattgatggttaaagttataaaagtttgaccttaaccttgttcaaaacgttaattattatagaaccggagggagtaggatgcaaaataagctggtcttgatagttgagagatattttatatttggtttaacggttgagagatgcttatcaatttgggcaatatatgaggggtcacaaaaagacttttgaaaggcttttatgggccaatgcaggtgcggaatccgtcttgggcagagtatgtgtcatgggccgtgcaatggctcaccgcttattgggctttttcgcgcagcgtgtgagaggccggaatggggggaatgggatggaaaaggtacaccgaaggtccctcaacttgtcatcggaatataaaaacaatctcgaaccgcaaaaccagatatttgggatcccttaactatataagaccggtcacccgaggttcttcggtggttttgacccggttctagtctacgtggcagctaaatcagcgtgggacccatgtgagacccacgtgtcagtgtgccacgtcaacagcctttatttcccatcttctctccccccctctctctctcaatcttgtctctgcagggcgccggcgggtggggaggaggccggcggggagctcctcctgcgtggccgcgagctccgcgtcaaagggtggtgggtgctgccggtcaaggcgcaccacgccgcggggcggctgacgggcgccgcgtccgccatgcttgccatcgcagccgtaagacatccctcctcggcgagacttcccctgtgttcatgttcgctgctgcttcttgattcgtcaggtcccgcgatgaacttgctcttcctgatttaatttgtccggtgcagtgcgggaagcctctgcagcatggcgccgttgcgcggggccaagcgccggagaagaaggctacaatggcggcggccgctgcggcgggtggcgtgcccagagcagattgcgaggcggatcgacgccgacggcgcgccgggggagagcacagcgctgcgggcgcgctcctacggctgcatccgggtgttcctcgtcctatccctgctgctgctcgccgtcgaggtcgccgcctacctctaggggccttgctccccccgccgccgcctacctcggccaggaggacgggggagctccgttttcgtacccagccaccgcgaccccatcttgaatattgatacatactctgaattttgagagcttttggtgtgtgttcttgtttcatggttgccctctcgatcttcatggtcatgggacgacgttgtccttctccagcggaatcgatcgatccacccgtccgtggccatagccgccgtcgccggtcaatacatcatccacgcaattgtgctgctcctctcccaagaaaaccacgcaagcgagctccgcggaaaccgatctccgctgccgacgacaaaataggcgatttagatgcaagattggggaacggcggggaggattcctgctccatgttgatcctccgcagcagccgtgaccgcgtccatgtccccatcagccgccatcccgccatccggcggggacgagtgtcgccctcctcctcccaccaccgcgctcgcctcccgccccgtgccgcgccgcgccgttcctcatcgtcgacagcctctcccgcaatcacgacggcgcgccgcggcgtcgtcggggcagacgagcagttgggcctccccatgcttcgcctccccccgtgctcccgccgccgtcgccatcggctgccgcacctcctttcctgcctcgccccgccggcctcctccccacctgtcgccgccctgcccgaatgagatgaagagtgagagagaggaggaggtgagaaaacagtgaaaagagattggtgatgacgtggacagtctgacagatgggtcccacgtaggtctcacgctgactcagccgccacgtccaacaaaaccagagacaaaaccaccaaaggactgttttgtaagttgagggatgttctatatctgttttgcggttggaagatgattttaaaattcgatgacaagttgagggatgtttggtgtacttttctccgaatgggattgcggagtatatatgggccgtatcttttgtgaaactttttgggccgacgcggtgaggaatttgacatggtctattgggcttcttccatttcccttctagtccgtgtaattaagtatagtcaattcgccatcgtcaacttactcctcatataggagtatatactatctgatcatgaaacatctatctcacctacttcctccgtttcacaatataaatcattttaacattttttatattcatattgatgttaatgaatctagatattttgtctagatttattaacatcaatataaatatagaaaatgctagaatgacttagattgtgaaacagatggagtaattagctacgaacttacttaaatttgtcctgacccgacctggattgatatgatcagtatcttgttggtttatatattatctggtagtacttgtacttaccactaaatatatgcttaattagatatgccatgccggatatatgcatgtacaacgaactaataataactccttaataactgaaaaaataactaataactcttcaactgaaccaagggttaagcagctcgatcgatcgatcatcctctctttatagttattatatatgccatcataatcattaagtatactcaactagtgtactgcacgctagctatttccatcttaattggcacgtcgtggcatagccaactagcatcaataattaacttccatcacgcactttttgtggccaaaggtattacttattcatcaagccaacaactgcatgcagctcatgtaagaactaattcacatcgaactttttttttcttaaaagaagagattaaaatccggtctctcatatatttcataatgttgaatgactttgcaaagtgagtggataggtttcttgtggtgaaatctatctatcctgttcaagttctaaatttgacacatgcgcttttatttatgactaattattcttttaatgatagacgatacatatacccctcacagcgagacactcctagtgatttcttcaatcttaagacatgtcaatctaatctttcaaaaatgtttatagggtagtttgtgtgtttgtaaatcccaagacatatcaactcagttttttaaaagtgtttattgtatttttaaaaaagaaacaataccgttgtgtgtcttatgacataagccggagatgtaatccatttccattatcttaaaaaaaaaagaaacaataccgaatcattcgtgttttttggggtaagtgtgaaatcgtgtttcaaaaaaaaattgttgaacgacttttgacttaatattttttaggtgtgccttttctcatgatcaatagataatagatgaatagtttgtgataattatttatggtataaatgaatgacttaataattataaaattttaaaaaatggatttaaaagtattataagaagttcataatatataaaaagttttagcaaatattgtaccgtttaggatcgagtggcctaacacaactaagtaggagtttaactgaagcaagttaccaagttagccagctaggaataactgatcttgtctcttgggggagacgagtgggtcacaaacaacaagtggcaaagcaacatcttctccattaatcaaatacaactagggcaagtgcgccctaatctcctggtcaggaaacttgggagctattaactgtttgcgattaaactatacaaaatgttttgattaaagggagctacggcaacaaccagctttgaatccttctgaccaagcagaaacaggggtgacataaaccacctttccgacgctgacatcacaaccttcaagcttaattggatatgtataacctgttatacccatcagattcctacaagaagaggaacactattaacttaatcctaatcagggccaacaggatgaggacaaggtcaccatgacatggcacattgccaatttgccttttcttttcttttcttttcttttcttttctttttttttttggttttccttttggtcctccaattatgcacttaaacaatgggatcatttttttgtttcccacaggacaataaaaaggcttaattggactgatcaactattgctgcttgcaaagcttgctcacctggcaaaggcattagtttaagcttggtcgacatgaccagctggttgagcatgaagtgtactagatttgtttgattcagctggttccgagctaagccagataactacttgccaaatagagtatatataactatctgattgatactctcaatgcctgtataaacatgagtatttaatttggtcattagcatccagctttgcttgcatctactctaagactttgcaaccgatatatgcgacaaaattatcagttgaccgacttaatctcttcagctcatttatttatttatttctcctactctgcagcataatcggagttgattatctaattgggtagctgctgggcattcatagtatgattagctcaagtacatcactacatctgcaaatggtaattgtctaagcaatagtgcccatggcatcattgcattacaataataaccagtttgatttgttcaagcaagaagaaattggtgtgtgtaagcatgtgaatttgcattacccatggtttaattcgatttatatttacctcctgcagcaggaccgacgaccggccggttcttaaccttttctgaagaagaacagttctgttaacgtcaacagattcagcaactctgtagatgaaatggtaaaggtgattacaagtgctttaattaattaattaattttttttactggcgtcaagtttcgagtggactgtatctcactctttttcttacctgctcgatcgtagttatttaattagtcactcatggggcctcatggtttcacattaatctgatcctcaactgtaatataccaatatatactacacttatcaaaggagtgatcaaagcatgacacagtgagcaaaaaaaaaaagcatgacacagtgatcagacataaaccttggatcagcatgcgcaactaagctactggttcaaagatcaatacacggtggattgaagaatcattctttcaacctctctcacttgtaattattttggatatgtaaagttaatgtacatggattattagtatctaaagctgtgaaatagttgtacgtacgtacgtacgtacgtgcagtaacagaatttagactgatgcaattgatttcacaaaccatgggagatggtgacgtgcacgacagcttgatttcttgatctgattatataattagggtagtctaatcacgctcccacatgtatctaatctatactacgtagtactatctaacacgcggagactaaggaacatttcctccccgttgaccacaaacgaacacaagatccatgcatccgggccgttggatcgtatgaatcaacggctaagattatccacgcgccaagcacgaaaagtcagcgcatgtacgacgggcaatgagaaaagtcataggccgttgatccctgatcggacggtccaggatcaacctggaaagatcccacgcctagtcaccatctatatatacgtggagactggagagagattagctttgtgattagtaagcaacttaacacaagatagtcctagttctagctagataggtttgaagagctagccatggccaccattgttgcatgggagagtagaaacctgcagctgcaaggaggaggaggtggccatggcggtggcggcggcggtggcggcggcgagcggcgggagtacatgttcgagaaggtggtgacgccgagcgacgtggggaagctgaacaggctggtggtgccgaagcactacgccgagaagtacttcccgctggggccggcggcgaggaccagcccggcgggcaccgtgctgtgcttcgaggacgcgcggggcggcgacagcacgtggcgcttccgctactcctactggagcagcagccagagctacgtcatcaccaagggatggagccgctacgtccgcgacaagcgcctcgccgccggcgacaccgtctccttctgccgcgccggtgcccgcctcttcatcgactgccggaagcgcgccgcctccgtgtcgtcctcgtcgctggtgccaccggccttgatcaaggtgcagctgccgccgtcgcggcctgtcgtcgacgaggaggaggctgcgtgtggccggcggtgcctccggctgttcggcgtggacctccagctccgcgccgatgcctcgccggcgctggatttgcagctttgatctagctgaggcatctcatcagttttgtactaattctccaactgattagtattcattttccctcaaaaaaattagtattattcatacacgaacatgcatgctgctctcctgtcgaataaaatgaggtcgtcgaagacgaagttgtacattagattagcacaagattaattaggaggggtgaatttaattaattagacatggatcgattgatatatatgcactgaagatgattaattggacgatggaagcaagcaacaacacaaggctaaggtacctagctagctttgctttcatttttccaaattaaatttcatgtttcttgtcagatcgatgaatagaatttgtttttgcgggttgattgtgaatttcggttctcctgttcttaatttcgccctcttcacacgcgtcgccatacgacattaacacgatcgccctcttaacatattctaattcaactagctagccacctacaccatgatcagaacaagaaagcctatcactatatatctaactaagctctagctagctccaaatatatatatatatatatatatatatatatatatatatatatatatatatatatatatcccggccacttgatatattacatacatcaggtcaattaaacttactcatcttgttcataaacaatctgcagcttgactgcatttatatgcagtcatagcagctagcgtgtaagttcacttggtgcaaatcagggaaaaatcaagttggtaccaagaaagaggaaggcccatgtacactgatgtcttcaataaacttaattaggcccaccgcattcatgcttcagtgcccatgcggcccagcccatcccttcaattgggctcactgtggcctagagcctactccagtagtttatctttggcacagacatctctgccccaggacaattatcaacttctttacacattaacccttctaatcccaccgtcaaatatttattcccccaattccaattcctggtgcctagtttcatccattacgctgtttttttttgtcaaatggtactaagcacatggaaaacaaatacaataattaatctctactattataaaaattaaagatgtttttgtcggtactttagtacgtcattcgtgtttgagtcggtttttaaattcattcactttaaaaatacatatttgggtttgactcactttctaacgtcattatcttttagaaatttagaaggagtcgcataagaaatcttttaaaaa

SEQ ID NO: 76603 - DNA, 4554 bp, Oryza sativa
ggagaaggaggagatgagggggaggggggagaagaacgcgagggaaacctcaccggagacggcggcggcggcggcggcgaggagggcggcgcggcggtggccgcgggtcgtcgtcgagaagacggcgagcggaggaaggaggaggaggattggaagcgctatgaccttaatccagccattggttgcttcttcaacggctggatggtgatgactgcgctgctttgacttgcagtcaaggctgtaacttcagcctatatctgcacccacttgtcatggactcaatgggttccatataacattgtcacagggtgatagtaacaaactaaagagtacaaaaagagtaatcagcagaattcagaaacgaacttaaaaacagtgcaggattcaggttttggtcctaattactccataggattcaggttttggtcctaaatactccatagattatttacttcaaatataaattactccttccatcccaaaatatacgtttgctagtagtatgttttttccaaagaacttttatctattagattgcttacaccacttataacatatttgttaattttttaaaaaatatttaacccataatcgagaggataatccattgcaataatctggtaaataaatcgtttgaaatagagcctataacccacaaccaaacaaacttaaaaatgataataattcaacaaatcaatactggtgataagtgataactcagcataacaaactcaaaaatatttggcagctgaacaacgaatactggttttgagttgtcatgaattttcatcataataataccacacttccgagggggaaaaaaagcccaaaaacgacacaaaaaacatggctggaactctgaaagtatattatgtacagaactggtgatcatcgcagcttgtgatgaaatttgcagcgccacaccgaagaactactagtttactactacttgaagaagaacttccagatctccctctctgggggctcagagacgaggtgcgcgccaaatgcgccttcttcatccaccagggatcggagctgccgcaccgcgctgctcgagccgatgtaattcttccttgcagcaaggtacatcaccccatatggcggccttaggcactgcaagaaccaagaacagaagttttagtgcggagtacatgttaaggctatgaagcaggttctgttccagagcagacggcaaattcggacaatgcatttgatattatctggataaacgagaaggatgagatgaagacagtcccagaaacaaggggaaaagagccttgcagcgaagctaagccaattcctaagtctaatgccaaaaaaaaaaaaaactcagttcttggtctgctgtaaagtctgatataaggaaattcgtctacccatactaatctcctgcatatcaatgcagagtgacctcagggaggagctctacactcattctgcgcttatcgctatcatattatgctagtcataagtcataacaatgcagtgattgtctgtatgctgtctatatatgatgtctcatggcgagaatttcctgaagaaaaaatgtatggagaacaaaccttttttacgagcaaatagaggttttgaagagagcttgcagaataagggatctcattgactaacagtatatcatatccaccatctcctgtggtagtctcattccccctctcccatgcacggcttcctgatagttttcttgatcgccttgaagaggtttcatggcaaatattgcttgcatcttggctactgcaaccatccagaaagtcatcttcacagaactctagtgctacacctgatgatgtgtccacctcatcctcctgaatcactgacagaacagtgtgaagctcctcccattccccggcatagaaatggatatcttgaggcaattgctgccgagatggagtaagggggcttccttgttgttgaccatgtttgtcttgagcatgctcaagatttgcaagcacattgggtattgttttgcaccttattatttcagcactcggatcctgaaaatgcactgttgaagctccctaagaacgtttgagaagaaaatgtcagttatcacagtagccaaacacagagcagaacacagctaatatataactcattgtgcacggatgcaacaactatgcaacagtaatactagatacatggattcatgctagtcaagatttaaggctacggtaaatctaagattaggctagcaataacacattctataaaagtaacgaagagatgccatggataactacagtaccttcaggcaagcaaatatcccaggaagcccatatccacagccaagctgcattttgggaaaaaaaaaaaggactgttacagtttgcccaagtaccataaactaatcaaaccaagctatgagtttggcatctgagggaccaaagaaataaataagaccaagaagtaagttataagtcaagaaccttttcctggaacataaagataacaattccatgtccaagggattaaggagtgcaagttggaatttatacaagttgaatcagaacataacattatctgaatacagatcataattcaccagaaccatggactaagccatatccttccattttcttttacatatgcgcacaccctttagagttttgtgtaccaagataacttaaataaatgacatatttaacaaataaacaaacagtcaatgacagagatggaagtcaaggaatgcatagcttcactagtactccctccattcagttttgatcatcatataacaactgtgcagcgagatcaaggagcaatcaaaacatggtagatgaagcaggcgacacatggactcctacatgatgaatggacttaattatgatttctaagctacgaacggatgcacacatggtgaacgacgtatgcatgcagcttgaataatgtgcatattgatgagaagccaagaaatcaacaatcacaccattagttactcatcaatactgattttttttttgttttgcatatgcgctcatcaatcacgaacgaagtgagtagtactgaacacataaaagcgttgtacctctaaaacctgtttgcttctgaatgtcaatagtccatcacggatctcattcttaagaacattcactaggtcaattgaactctcacagcacttcagaggccctataataaaaaccgttacttttagattctcagtgttttaggtagtcagtacaaaatgattatcattaggggtatgacacttaccttcaccttttggagttataacctctgatccagatagaccaacaatatcgacaacactgacctttccctgaaacaaggttaaaacacagaacaattaattccaaaagccacaaaagattaggatgctatatagcttatatagaggaaaataataatgtttaccatgacttgcctaccatataaatggccactatgaataaaaactcaactctgtaatactaattccatggttctatgaagtaatctagtaaaatgaaaaaaaaaagtagggagttaagaaagaattatcaccttaaatatattcatgccatgcatttcaatattctcgcctgcatacttgtatggatgaacattctacagtacaatgtaaagaatgggagattagtcagtagataacagtcctttccatcagtatatctatgcacaaagagccaaccatggccacacaactttgcaatgaacaagaaagtgtagacaaaagttccacctttgacgggacaatctcgactgctggtgacggagggtgtgactctctctcgggcacgacattaacgcagtgggctgcagctttttcatgcgacaggaagccggccaggcactgtgagagaattgaaggtgaccgcattgcctgaaacgaccaaatcataatgacggtgaaaagaaatgtaatgcagtagcactgtaatgatggtgaaaataaaatgtaacaattcttcgtaatgtcaatacaatcaaagtgacgacaaataaagtgtcaaattatcaaaatcttgggcatgtaaaatttctttctactgggataactcttcttgaacccttctcacttccaaaggacacagaaaatcaacaactggggcacaataggacacccattcctaccggatgagatttcatagccggaaaacttacagctacatcacacatcaagagtacccaaagtagaggggaaatcgcaatgagctaaacccccattgaaatgccaaatgccacaagaaacggcccaaagacctgttgtcaacagctaaaactatagagccaagaaacatcacatccaagttccaacatcacaaattcaagagaagatcaagacatctcgaaaagagggagagaagatgaaggaagaaacacttacttgtacgaacccccaagatctgtccccaagaatcacagacaggttccaaagaaaagtcgggacaaaaacgcaaaattaatcaatcaagattacgaacaggaggggggacagatgatatgagatgagcagaagaaagatagagaaaagctaatcaaaacaggatgcggaagagtggtggcgagtttggcgactgg

SEQ ID NO: 76604 - DNA, 592 bp, Oryza sativa
ccaaaagagttcattactgacaacggcaagcagtttgactctgataagttcagagaaatgtgcgaagggcttaacctaaaaatcaaggttcgcgtcggtcgcgcacccgcagtcaaatggggcggccgaacgtgcaaatggcaagatcctagaagcactaaagaaaagactcgaggaggcagcgaaaggcaaaatggccagaagaattgctatcggttctctgggccctccgacgaccccacaagaccaaccaagtttagcccgtttatgcttctttatggcgatgaggcaatgaccccagcagagctaggggctaacttaccaagggttatgttctctgggggcgaagaggggcgcgaagtatcgctcgaactcttggaaggggtaagggtcgaagcgctcgagcacatgcacaagtacgtcacaagcacttcggcaacttacaacaaaaaaagtttgacccacggagctgatgcctggtcatcttgtcctaagaaagaagacgaacccagtagcggttggtaagcttgaatcaaaatgggaacgaccgtaccttatcaaacacaagtccaggacgggatcttttcgccta

SEQ ID NO: 76605 - DNA, 2380 bp, Oryza sativa
cgacggcgacgacgaggagaggctgcagctcgcgaaattcgctgatcacgtcgacgacgacgacgacgacgactgaacatagttgatcatacgacattgttgcagcgcgttcttgcatgcatcctgtcactgtcaggggaggatgcagctatagtagctctgatcaatcgatcagatagattcgttgattccttcatggcgaacgcatgcatgtctctgatgagacgttgcccagtgacagaaatggcatctctctctgtacgggcaacccggagtggaaagatgagctgggatgtacggattctgttttctgttcatttggttagcataggaggattctacagagaaaaaaaaaaaagggagaatttgaaccatgccacacaaattttacaaaatttgtgatatgccaccctgacccacatgttattgactcatgtgggtcttatatgtcattgagatacgggtggtatatctcaaatttataaatatagggtggcatggttccaacaaacccaaaaaaaaaaatgaagtgatactaaactctggatttgttttagaaaagatgctgaactttgggttctatctcaggttgcagtacatctctactttataagtaagttataacaactgggaatatatatagtagactatatacacagatttgttattcattgatcgtctgatttcttgctcatccttacttgatatcctcatcatggaatgctttctaaggttcgtgctctgttggctttctaggtttctccggcaacggtggcaatggtggccatctcctgtttgaaagtgatgattggctgatgaaatgaaatgggacgactcacttaattaacgtgatacattaatattttaaaagataattaattaataactaggaacaagcggatggaaaataagtagaaaaacatattttataggcatgaagtaaataatccataaataatacgagccaataatctgccgaaaaaaagttccgaactagccatatataggcatctactccatctgtcccaaaataaaacaatctcgctaagatgtgatacatcctagtatatgtccagattcattgtacttggatgtgtcacatcttagtacaaggttagcttattttacagaaaaactaatacacggaatcccgtcgggggcatagggacacgtgataaaacaggggtaagcattatatatttcctagatccgtttctcccgaatcaagtttcccccaccgatttatttttctcccctaccgaggagtagcacttcgtcttcctcctccctccatccactcctctgccccagtggccatcctccttctccctgtcctcgattccttgaccatcgtcttcaacgccgatgatatcccctatcctcttttccccctttctacaccgaatctggagcatgtgagagtgtggaggttgtcgagggcatgggggttatagccaaggacgaagccaactatgactatgaggttgggggttgccatgtgcgagcagaaggaaagagaggcggctaggccgagggggacgagctcctgggcaccaacatgaaggtggaggcgtccagtctcgacgaagatgatgaccttggtgttgatgaagtggatcgatgagaggtcgtcgggtttcttcatgctccttgctagcctatcacttctactcgctaatgttgtgtacaggtatgtcacagctgataccttaggtattagagggttgataccaaggtttgataccttggggtatcatgtctggtacccaagtactagggtctggtaccttggggtatcatgcctggtacccaagtactagggtctggtacctcgggtattgtgcctaatacctaggtaccaggatctggtaccttggggtatcatgcctggtatcttaggtaccagccggtacccataggtactaggtgcatgttatcaagtaggagtattaggtatcgggtctggtacatatggtatcaggtgccaggtcaagacatgaggaaagatagtgcattgtcatcgtttggttgaccaacaagtcactatcattgtctcatcttctcttctcccttcctctcatcgacgcctccctccttcttttgttgttgttgtgattagtgagggcaaggagctaggggtgccactgtttcatttatttacaacatgggtgctcgaacatggggaagacaggtggtgggggattagattcataaagtatcccgttggaatggaatcccgtgctgtagcaatcctcttattttaggatagatggagtagacagcaatacaatgtttgttgtgagatagtggtaacgacactaaacctacccttgatataggagtttatggttgattaggacgaaggatttgcaattgagtc

SEQ ID NO: 76606 - DNA, 1560 bp, Oryza sativa
atatgtattcagcccgtcaatctgtataaaagagctttatggctgaacgcctctttagttgacatgtgctacctaaattatttacaaattttggatagggctgttgaaaagaatttctccaagaaagctatttgtttcttccgtttcttcttgagattgtacctccaatctaacaaattgatgttaaccaagtcccgcagcaatgcgcggggcatcctctagttgtaaagagggctgaggccaaaatttatgctagaacaatactccctcattcccaaattgatcatataagagaattcaacattcaccccgttcctattttaacactttaatagcacccaaagttcaccttgttcccatttttaacacttccgtcaattctcggttatttttcgtccgccttaatcgctattgacccagccacgtacactatatgatgtttctacccctcacaagtacaagtaggatgcatgataatgaggggtagaaacgtcatattatgtgcgtggctgggtaaatagcgatcaaggtgtacggaaaagatcgagaattaacggaagtgttaaaaatgggaatgtggtgaattttgggtaatattaaagtgaaccggtatctttcggtgctataaaacaaaaaaaatgtgaacttttgatactatataaccaattttgcctaaatattagtggtaggggtggtgcggcatattggataccaccaccactaagactgagttctttccccaactttcgcaactcacctcttttgttttctgtgaacacgcttttcaaactgctaaatggtgtgtttttttaaaaaagtttctatatgttagttgctttagaaaaatcatattaatctattttttaaaaaataataagtacttaattaatcataagaaaatgcattgctccattttacttgcacaggagatgagttctcaacatcacctcccgaacacagcctaacattttaaatatgtagtgaagtctttaaaaatatctaggttaaaaaatggtcatatgatatttatctccgtcatcagagtaaaacttttatactcatatagttgaatatgaatttgggagtaaaaagttattcacggtgactttataggcgtttaataaatattgtctgcaatatatttgttctagaataagtttatttttaaagtaatcattgcattagagtttgtgaaagtagaagaaattgtgttggacaaagataaagtgagaaataattatattgtgattcgataaggtatgagtgttttttttattgggacgtgtgggatgtgtgaaaaacgaaaattttttgggacagatgtaatactactagtgggttgttcaattcgttgaaatgacgaaacttgaatgctttacactagctcgtcgatgaaacggctgtacgctaaaatcacggcaaataagatttggaaacgagtttggatgggaagagagacatatggcatggctttcttccccaatccaaaaaaagttccaaactcaacaaaccgggaaacaaaacgaaacaaaaggggtacagtacaccctgctgcccacg

SEQ ID NO: 76607 - DNA, 8971 bp, Oryza sativa
agggctctgagtgagaattgtcaccaccggttgagcctagtgatgaattggtgcaaggagcaatgctgtcatctcccttattttgtatgtccacagtaatattcccagatgaagaaatggagttgttgctgtcatcttttgtcgtcaggctactgataaaatgagagaaatttccaggttcagaacgacaggtacttgaggggatgaacacttccttcttcaagctatcaagtaacattgatggagtggaattcagatcaacaacaagatcaagtccctcatctgacatgacaaaaaattcaaacgaagactttgcattttctgagatcttatgagatgagccactaccaatatctgtaactgtttcaacaacattaggtgcctggtagcttgtttccggagaaatttcatcatctaccttagcagttgaatcaagatgaattggatgctcttgagttcccaagttctttccaataccatcagcactttgtgaatgtacattagaagcaatcacttgacgaggaggtgagtggctaaagcagtctacttttccattgttgattgaaactggtgtagaactcactctggttccagagtcctgcttcaagatacatcaatagaattaggaaatgcatttgcattatatacagacctaaaagcaccaagggctccatgcatatgaggaatgctgccgtgaatgccagaggaaaataaactagagtaatttttttatataaatactagaatggaaaactgacccctgtaggatttctaaccaagcaacccgactacagcagtatatttgtcatggagagcgtaaaagagaggattttgagtggcaccatttgatcaggtgaaatacaacatgtcatgaatgtggcaatttatacaaattaagaataccatcgccagctggtctatactgaaggaattccttatattattaaaaactaaagagcttatatccagcagcctggaattagagaaatactagggaaaaatcacagattcttacattttttttcaatgtttcatctgttggtgtttgaggtcctttgtgatgttttacatgcagaagaggtctatcaccatcatctctttcactttgcggacctcttttatggctaccttggcaacctgcagttgtttcggtttcattagatacacacaccatatattcatgtcacgtctctgtgagagccataaaccattgagtaaaaattggcaatcttagaaactatgccaatatcagaaagttcctatacatacgggtggatacttctttggcatttgataacaaggagggcaaggcaacaagggatgctgctgctttcttttcaggcgatggatttattcttcccttctgagaaacaaagatggtacagattattaatttatcctctgaagagaaatgtaatgatacactcttccgaccaaattagatgcagataccaaacttaaaacagacaatatagcttacctcaagaaacaaggcaagcgagcttgctagctgagagtgactcttgtttgcaggaagattatactgtttgcacaaagattggagctcatggtaattaaggccaaggagatgcttttggctttcctccaaccccatcagattgactgtggaagcacatcaaagacaacaacaacattagtccctcgtcagccatagacaagaaggaagtgaacacgccatatatatgtatatatcataaacgaagcgaggcaggcctatcgaaacatgacaatcagaggaagctgagctcaccgcataactcaaactaaaataaagggaaagcactagtcactactactactcgctagtacacatgcgaacgaaaatggcatccgccatttgtccaccggtatctgctcatcgcgtccgctagcgcacaaacaagcctgggcccatatgccaccccctcgtcgaacatggagggaatccacgatttcgaaattcccccaacggatccgaacgaaaaccgagggaaaccagatctaacccagacggcgaacccccggcggcggcggcgattagcagatcaatcctactcctactcctaccctaccctaccctaccccccgccgccggaacgccgcaaccaacaggagaaaccactcgaaacataccgaaacgccaccagccagctcacgccgaccgccccagcgaacaaacacgcgcgcgacgcggacgccccgacctcgccgcgcgtggcggcgccgaaatcgaaaaacgagcgagcacggagagagagagagagagagagagagagagagagagagaggagcgcgcgagctttgcttaccagcgtcggcggaagcggaagcaggagaaggagaggtcggcggcgggcggcgggcggcgggcggcggaggtggaggcggattcgccggcgcctcgcgtgattttggggaggcggcggatttgggggggaatgagacacagcacgcgcggcggcgcccgggggcaaagctgatgatttccttctagaggatttttgctttgccgccttgggggcttggggcttttgtctactctgcaccgtcaccgcgcggcgggaggccacctcaccttcacctcacctgtcaggtcacgcgcgcaacgctacccacgctgctgcttttgccgggaccgcggggggtggggggtgatggacccacctgacagtgtcacgtgtcaggtaggggctagccatccgccccgtcgctttcggttctccgctcgctggcgggtgggcccgcgtggcgtggcgtgtgggccccgccgcaccggacggctcgggtcgggacgggggtggggggatcagcgcgtggacttctggcgataggtctgtggatggatgatgatgacgtaagttcgaatttgaatttttggctcgctacctgtcaaaatttgcgtgtcaaattttcgtcatttggctggttgcaatctcaaagggagttttcgggaggacggttgggaaatgggaacctctcctctttggcgagcaaaacgaatcatgcattagtgtagtcttaattaagtattagctattttctttttaaaaaaatatgatttttaaaaaaattatagaatttaaaaaaacacaaacaccgtttagcaaattacaaagtatgcacggaaaacgataaagttaaagttagaaacattgacttgtgatgtgttcggaaggaggggttgagaacccctcactccggcacgctaaaagaagcatatattagcatatgattaattaagtattagttgaataatttttaaaaatatattaatatgattttagaaagcaactttcctatagataaattttgcaaaaaaaaatcatttaggctgagttctttccctaggttcccaactctcctctctcgtttttcgcgcgcacgtttttcaaactgctaaactgtacgttttttgcaaaaaaaaaatctatacgaaagttactttaaaaaatcaaattaatccatttttgaaaaaaaaatactaatacttaaataatcatgcgctaatggatcgctccgtttttcgtgcatgggacatgggtttccaaccggaactagcgaacacagccttagtcatttggaagacatgcgcgcacaaaacgaaagaggcaaggatggaaactcagggtatcaaacataacattatctatcttcaacttcccttcccttatatttattcttttcattagactttgtcacttttgcttattggtttattggtgatagaagaagcgcccgttacactttaatagaggaatttgttgtgaatgggaggttatgatgattgtgttggtgtttgttagatgggagttcatggaatgtggcctctaggctctagggattgtgtttctcttaatttcttttcagtttccaatcaacaaaacataagatcataaattactatcccaaactagtgtgaatcccctaaaatttcgaacatgtatttttctatgaaacaacttatagtgtatatttataagagtttgtgtctcattgatctaaaattacccctcttattcctatcgttgtcaagttgccataggaagcaattttttagaccacttaatcaagttgtactttgtatttgtttctcacatttacatgaagtagcatgtttggtttattgaccaaactaccataaaataaccaaatccaaacattgagcctaacttgctagtattttggtttgttatgttgtggaaccaagccatctgtcatcaaaccgtcctccctaaccacaccatacaactctttcttgtgactatatatggggagagaggctattattagccaaactccaacctcataatcaatatttacctagctttaggaacacttatgaagctaaggtcctaagtctagcctcagggattcgtcaccattgttcatgttcaccattaggttccaagagctcgataatctcatttcacactaactataagtctagaacaaggggattacaggaacgagaagagaaatcaagttgtatcaaaccttatattgagaactgaaaaggtagggggtatcatcgatcaagaccttctagatgagagagacgacatttatgacaagggaaagagaggcgatacttctctgcagtacctccacaccgccatgaggagcgtgcctccgttttgcacagtcatgcatgtctttacagttttgtgcatgctattttgtgatttgatagaatacgtgaactgaattgagtggagcatgtccatcttttgcacatgtttgtgaacattggaaggtcttacacgtgacaacaaaggaatatggagaacaaacgaatatctagcgtgtctcgtaaatagggaatatcttgatagaacatataaagatagtatgcccactgatagatgaattacaggcgtgctaatcgtgaatgggaatggtggtgcctatgatgggtaagtatagtagtgatgtggttccaaaaatcacaatagcgtgacaccccacatctcacatagaagggagcataatagaaaaatggtccaaccatccaagactaccgtggcagcttctcagcccaaggctagccaacactgaagtgaagcattggtagccaccggatcatgtcacggcctcataagcatatatacactagagaacgactactctagttacagtaatatttaccaaaccaatacaatctgtacaatcttaacttatgaaaatgttactcgtacaaaaattctctaagatttaacatccaaaaccatactccctccgttttacaatgtaagtcattttatcatttctcatattcatatgataactagattcattagcatcaatatgaatgtggaaaatgatagaatgacttacattgtgaaacggagggagttgtcacttaactactctctccgtccgatagaactcaactggacacacagtcacagacagtgggccctgcataagtttcgtacgcaatcaggtagggcccactcatcagcgacagaggtgcacttcccccttcaccctccaccatctctccctctctctctccattccccctctcctcctcagatctcccacctcgaaccctagccatggcgatcgcggcgcgcgccctgcgccgcatccccctccacctcgccccctccctctcgcgggccttctgcgcgctctcgccggccgcccccgccccggccgctgcctccgccaaggtcgccgaccgcatcgtgcgcctcctcgccatcgacccggacggcgcgcgccgcgaggtggtcggcctgtccggccagaccgtcctccgcgcgctcgccaacgcgggcctcatcgagccggagtcccaccgcctcgaggagatcgacgcctgctccgccgagtgcgaggtccacatcgcgcaggagtggctcgacaagctcccccctccttcctacgaggagcgctacgtcctcacccgcgcgtcccggaaccgggagctcaacaagcacgcgcggctcgggtgccaggtcgtgctcacaccggagctccaggggatggtcgtcgccgttccggagcccaagccatgggacatcccgtaattgcgagccgccgctgcgatggtgatgtgagacttcctttcccccaccgtctccctcggcgggtgcgttcgtgccgcgccaacgctttttttatgttatggattcgatgaaagaataatgatttgatgggcaaaactttagtgctgatgtttaaacttttgtttactttgaatgtggtaacatgtggatgatgtaatgtggaatcccttgaaattgcctcggttcagttcaattgatgaatggtgttggagccagagttaagattcatcctgtgcatttccatttgatttttactgctagtatatgactgcatgttgttactgattataatcaacttgctagaagggtaatcatgtctttaatttagttacttgtaatgtgaagaatgccttttggctgttgcaactcaatgctaactactccctccgtttcacaatgtaagtcatgtttagcatttcccacattcatattgatgctaatgtatagctagattcattagcatcaatatgaatgtgggaaatgctaaaatgacttacattgtgaaacggaggaagtaagtagtagatggagagtttgacacagtggcagagcgccttgttttttttgtttaattttggatttgggaggatggagtatataaggtgaatgggttgtttctgtttcatctaggatttgggaggatggagtatataggtgaatggattataggagtgctgatgttttgaggtatcaaatcataggaaaaagaagaagcttgctggcgcatcaactggtactgaagtaacataagcatgctatcgtgaataattatttcactgttggtatgctcccatgtttcttatgttcatgaattggttgtttatttgcaaaattagaatataacctagaagaaggctagctgtaatggtcagaattctgtcactgaccttggtgctgtactgctgttgcatttgtgatgataatgctactggtatacttgatgggaacacgagtaaagaagtttgagaaagagttgatcttccgttgagtgactcagaaatcaaaattttgcagcaactgaggtagaatcgttcctattgagtattaacaacaatcatggagtattaacaacaatcatggatcacacgttgggcactttccagaatttatcgtagcagctaatcccagatgatccacatttgcctgacaatatttataccagcctccttagacttgtttatttttcacgtggtttggccaggttattgcttgcctgggggaagcataagcagttcactcatatactgaaaattcggagttagtgctacacagtatttttcatacttcagaactttcagatatctgaaatggaatttggaattgctgcacaatactgatcagacttttagaacttcaaatagttggaatgctacaagcttatgtaacttttcaggctcagaactacagatgaacatgttgcagtttgtcttgctctggtgcaaaacagtcgtattatcgtttttcacacggcactgttgactgtctgaaaggtgaagaaggcataggaaatgtggcagttagtgtcagatttacaagatgacaagagatggtttacgttaatgctttatgtgcgctggttccttgatcatttttcacgtaatgcaacctaaggtctggtttactcttggcacattaacgtccagattcttcatggttgatagtccaaacaatgccaatcactgctaaagacgtttgcaactaagcgccacactaccaaaatcaatgcagaagatagaacaaagcagctctaccaaaatcaatagttcaatacatgcttctggaacaaagcaacagagcaactccaccgaaatcaagtactactacaaaagatgggaacaaggcaaatctaccgaaaccaatgtcaataatagagaagagaagatggaacaggaaaaccacaaaaagaaggggtcaacacagaggatggaaccataatcaaacaggtgatggaacaacacagctctaccaaaatcaatacagaagatgaagcaggaaaaccaaaccaaaagaaagatcagtacagaagatggaaaaagaaagccaaaaggtggaacaggaaaaccgaaagaagcaagctgagccaggaccaggagggtcaatagctcaaggtggataaccaaacaaaacttccaaataacactatagattggatatttaacgaaaaacatgacaccaataacaaaactagataactgcggacaaagcctacagcaaaaccatgaggcagaaacagacatgttcaccaagatctattgtttaaaatgactacaaaattcacactgcacctgcagcgtcacataatttgcgaccgaagaattattaaaaaagcaacagctacagtttgaatgacaagagtaaccaatgtaaggtaaaatgtctaaatgaaggtgatgtctttcagaaagttcagtgctgagttgcagctttgcagctacctgccgtctaccaattttcaggtgtttacttcagtaatcttgcgtcaggtgtgctccctgttggcatcggccttcttaagaagctcagccagcaggttggcagctgcagactcccgtgcatcacgagggtttgtctttggatcgccaaatgtcatttggctgaactccaggcatgcaatatgtacattggccacgtacatgcctgacaagataggaaaaccttgtaaaagaagtgcttgacatgatgtgcaatgcaacggcttaagaacaataaagatagggagggagagagaggttgacagttgggcaaacagccatttctgatcatcgctaactggagactagaaaattattaccaagtgattgcaaggctaaataactgatctacaatacggatcacgacatcaacagaatgtgcaatatcgtaacaaatgcaaggaaaaagttcagtttttgggttga

SEQ ID NO: 76608 - DNA, 1665 bp, Oryza sativa
gtgacactatagaatagttaatctcttcattcttcctagacattttgactctccccttgatcccctagtacttacgtctataaaataagttaatgatagtaaaaaaaaacattttatgtgtacagagaaaaaatgtcaaagttatacctgataaatgttgaactccatctttattgtttatgcatgtttttggtgtgtgcatgtaactctccccctgcgtcacctgcatgctgctatgttcaatgtccatgatgtttgtgcctgatgttgtttgggacaagaagtgcccaaggctggcacttttgtttgtttttgatttatcatcaaaatgatgtaagcattcaaatttgggttgctgtgtgtgagttacatgagaagaaatgagaaagttacaaatcgggacagatcaaaaatataaattacatttttttctacattaaaagtgcaacacagatataaaaaaaagttagtttatcagtcaatcaatgctgcaaaaattgagaggattaaaatcaaaacaataaaacaaatcagtacatggtactagtagaaaaattgtgacaaaccatgtggagtttagattttgttcttgacgtgtataagtaaagatggcactgtaaattaaagatgacccaaaaaataaaagtgatttagaaaacacctctatgctctagtttcatctgttttctaaaatttgaattctacataggcacggcagtctatcgttttgtgtatagaggtgttttctaaaaaaatgtctatctgcttctaaaaaatcatccacacatatataatatgtacaaaaaaaaattatggaccagtgtacaatgcaaacaaacattatataaaaaatagaggtgtataatacacaaaaataagagaaaatgaaaaaaaaagcggtttgttgctcacaaaacaaacactaaaaaaatactagtgctttaaaatgcatgatatatgtttgatacatttgtgctcttgtttggaatgttgtctgattcatcttgtgtaggatcttggctattatgttcttctgaagagtttgaataattcacaagaatgaacttcgtcttatcctaaaaatattaaaaaagcataatcaaaaaagatataaattgattaaaatcattggaaaaaaaatggaacaaaaaattatttttttaaaaaaagtacattatgtagtcaaaaaaaatctttttctattaccgttgtgtgacctgttatgtcttcagcatcatatggaccctctatatcaataacaaactctgtagagctgctttcaagattcttggtgggctgcaccttttttacaaaaaaaaaagacatgtagtgaaaagccagggggaaaaatataatggtttgaaattttgactcttgcctaattttgaactttacctcctcctttttggctggtatagtacatataggttccacgaaaagagcatccttgtttgattcttccctgtctggttgagtattgataggttctgttgctttcaagggctgaaaaaaatgaacatatattatgcaaactttttttaattttttaatccatgaataatgtattgtatataatgatatgacataaaaaaagtaatagtgtttttacctgtttccttcctgctttgcgaatcttttggtcagaagaatattttttcgatgggg

SEQ ID NO: 76609 - DNA, 6670 bp, Oryza sativa
attacgtagatcctcacaccagcgtaccccaataccctctatatccggtctacgggtatcccccgtcgacataatgaaagtgatgtcttatctggcgaaggcatgacagtagtaacaacaacgatgatagctaggttagtgtttagagtttcggggtaaggattgggggtagggctaaggttagaggttagtgtaaggggaagaaaagggtttcctgtgttagatggtggaccgacagggacagtagacatgtgttagtagtgagacaacagagccatcaacaaagcatgagtttgaaggaggacaatgagcgaggtcgatgatagagaagttaggaggtaatggtatctctggcagccttaaccaccaaagatgggggaagaatatggcagggcagagaggggaggcacctcaccgttgtttgacttagtaaggagagggtaagaggaggggggaggtcgaccttgtaggactcgtgggtacctcaccgttgtgcacgaagcatgttaggcgttggtggggagaaacacctgaggggagaagataaggttggaatcattgtagcaacatggatcttgttgcaatctagaccctctaaatatgagtgaaatttatagtaactggaaattagatagtcaacttagacaattacgatggtgaaagaaacaaagtggttaataagtggtgaccatgaatatgaatccatggtagtgggtgatccctggttaacttatcattgtgaaaattggtggaatatcatagtgtgacttggcccaagttagccttgattttggcatgttgcttcttcactataagaaattcaaacaaccaaacgtcatgtaccagttgttcagctcccagcttataaaatggcaaaggctaatacaccaaaatgttttcaattgatttccatgcacaagtagaacccatgttaaaaaaacacaactttcctatctcctcttatactgaggcaagaggtgtaccttgcgcaaaatttggtttatcgtctcgctttgccatactcttttaggtatgtgcttgtttcattgcaaagttggtgcatgtcatagatatttaatttttagaccccacgtgctatacatttactatgttttagtcaaatcttatcttagatgcgaccataagtttgttagttgtcttcaatatttgtctcacctaaattatctttagggtgtaattcactagaccttttaacaatagtacattatcattttcttctcgttttaaccatcaaaccaacaatattcccttattcccttatcatcctcgtttgttttctccccccccccctcgttttttctatgagagcctcattggtcgcccatatttcctaataagaaaaacggtttattagaggaaaaaaataatttataagtaaaacttttatgtatttgttcgtagtaacttaaatgccaacattaaaaggaaattacgttgagaatatcttataatcaacttcaaaattaagttcaaaaattcaaattttggttttttttctttggttcattaggtcaaccgatgggactatgaaatgataatcctctactaattctctttaacttagcttaaaataatatatacttttaatagatgaagagagtaactttcgccaagtttaagagtgaaccaaacatgacctataaaccctggagtgagccctaaacatggtaaaggctgtgtttagttccaccggtaaaaagaatttattgggtcatatcagatatatggataccacatttgaagtatgaaacgtagactaataacaaaacaaattacataatacgcatgtaaactacgagacgaatttattaagcctaattaatctatcattagcaaatatttattgtagcaccacatcatcagattatggcgcaattaggctgtcgacgggggatacccgtagactagatatagagggtattagggtacgctggtacgaggatctacgtaatacgacatcaagcaacaaaaaacagggattatactggttcaggccccttaataggtaatagccctaatccagttgatatgggattatatgacggaaatcacaaattacaaagggaatagtggaactcgatgataccgacgagatcgtagttgagttggttcgactagatcacccggcgacttggctcctgtaggttctggctttgtaggctgtagtggatgtgttggcgataagattcgatgccttaggtcctcccggggggtctctttataccgcaggtcagttggtctccaagtaggactcggagacatcggaccctacacgatacagtgacgacccagttctatccgagtaggaatctttccatctgtggactccgtgatgaatttccttaacgtgtacagagaacgtccgtatacgcgcagatataccatatcgatgtatgacgtatatccaagggtagagggtataccttatccgtaaccctgacataggcttaaaagattcgtctcgcaatttatatacaaactgtgtaattagtttttttaatatttaatactctatggtcatgttcttttctctaacaaaagttggattaagattaagatttttgtggcacgcttttcaaactgctaaacgatgtgtttcgtgcgaaaactttctatatgaaagttgctctaaaatatcatattaatctattttttaagtttgtgtaaaactcaatcaattataagttaataccatcttattttacgtaaaaaacttaatcttcatctttatttttaagagattcaaacaccacctatccaacgtttgatgtgatgaagaaaaaaaatttgccggtggatctagacacccccgaagaatcaatgtgccatgagtcatcagtcatgactcatgacacgatgggcacacggtcacgcaccacatggcgccggcgccgtgccacgctgacccttcttctcttcccccgttgcggctgacaaactattaatgcccccctcacgccccgtgttcaattcgccccccaaaaaccaaacctcccttctctctctctcctccttatctccagttctccacccacccaccctcagtgccactaaaataaaggccaccggtgtcagcgcgtggggcccacctaccggcccccaccaccctgtcagacacgatcagagacaccccaacccaacccaacccaacccaagccccgcggcgacacccgagagagctcagctcagctcagctcggcgacgacgacgagcgcgcgcgcgtctgccgctgctgcggctgccgagcaagaggacatgcatgtgaagtccccccgctactactcaataattcctccgcttccttcctctcggctctcaccccacccaggccgcagcgaccaccaccaccgcgccgcggggcccacccacccctcgcgtcctccagccgccagccaagccagctcctgcgcctttgttcccatgcgcccgcaagaaaccccacccccaccaccacccaagaatctctctcacacacttcactcggtcttcctcttcttcttctttccatctctctctctctctctctggtctcagtgaggtgaggtgaggtgaaggtcagtgatggcgtggggggcttgcgctctgctcctcctcctcctggtacttggtgcgggaggaggaggaggggtgcattgcctggaggtgacgaggagcaggagagccttgcagaggaggcaccacctgaggtcaagtgagttctctttgcattgatcccttctttgctcatcgccttcttcttcttcttctctccttctttcttgatgctcttcgatggcatgggattgggtagctagctagctagaacggattccatgcttttcattgcttggtgttcaggcttcagacaccatagttttctctgaacatgcataggtgttgacgtgttgttgtaacacgataatctgcaatgtgttggtttgatggtgcttgcgttcttgattagttaatgattactgctcccagttttacatcgtagtgttgccaatggggggaaaaatgacccgttttggcaagaaaagtggaggcgcgtgaattgccaagatgtgagtgtgactgcgccatgaatgtgatgagctccttctatatctatggtgttcgttggtcagcggctcacccggggcgtttgccaaaagtagcacgcctccaatgtagccttcgaccatgggaagaattgcataaacaatgatgggaatagtagctagtgagctggtagattgatttccatgtggttggtgaatggtggtgactcggactgatcgatgatgctttgaggtttttcaggagcagagagtggcgccaccatactggagctcaggcaccatggcggcggcggcggcggcggctcggggaagagcggcgggaggagcagggaggaggagctcggcggcctcttctcctccgacgccgcgcgcgtctcgtcgctgcagcgtcgcgcaggcggcgggtcttgggcggaggacgaggcggcggcggcggcggcgaccgggcgggtgcccgtcacgtccggggcgaggctacggacgctgaactacgtggccaccgtggggcttggcggcggcgaggcgacggtgatcgtggacacggcgagcgagctcacctgggtgcagtgcgcgccgtgcgcgtcgtgccacgaccagcagggcccgctgttcgacccggcgtcgtcgccgtcctacgccgtgctgccgtgcaactcctcctcctgcgacgcgctgcaggtggccaccggctcggcggccggggcgtgcggcggcggcgagcagccttcctgcagctacaccctcagctaccgtgacggctcctactcccagggcgtcctggcgcacgacaagctgagcctcgccggcgaggtcatcgacggcttcgtgttcggctgcggcaccagcaaccaggggccattcggcggcacctccggtctgatgggtctaggccggagccagctctcgctgatatcacaaaccatggatcaattcggtggtgtcttctcatactgcctacctctcaaggagtcagaatcatcagggtctctcgtcctcggcgacgacacctcggtgtaccggaattcaaccccaattgtgtacacaaccatggtttccgacccggtgcaagggcccttctactttgttaacctgaccgggatcaccattggcggccaggaggtagaatcttcagctggcaaggttatcgtcgactcgggaacgatcatcacgagcctcgtgccttcggtgtacaatgcggtcaaggcagagttcttgagccagttcgcggagtatccgcaagcgccggggttctcgattcttgacacttgcttcaacttgacagggttcagagagtgcagattcctagcctgaagtttgtgtttgaaggcaatgtggaggtggaggttgattccagtggagtgctctactttgtcagcagtgattcttctcaggtttgcttggctctggcctccctgaaatctgagtatgaaacttcaatcattggtaattaccagcagaagaatctgagggtcatatttgacactctaggatctcaaattggatttgcacaagagacttgtgattatatttaacatgatttgatttggagggggaagggggccatgagctatgtgaatatccctatacctggagatctgttttgagattacttctggtaattggcaaatggtagtacagtattagttattgtcaaatgtacaagcatctataattgcttcattctgttttttttttttactgccgtttctttgtgcttcagttcatcctagattaatatcgtttcaagaaacaagtggattttttttgtttgtcttcttgtttcattagatcctacaacttccttgtaatttcagatcctactgtagatcatccagtgcatattgacaacaagaagcacaataccaacttgtaaatttagaggggaaggcagtagtggttatgttttttttttaatgaaagaaattaggcataagtgagcatgtacagcaactgcgcaatcacttgagagaatgccgaataagaaaatttatgtaaaaagaaagcagatcaggacatgccgatcctatagcgatcagatctgacacatgaggtcggcactacctttccaaatgaagacatctgcaagaaacagcagacagagaatatacactatgcagaaatgtgcttttacaggatacagatcaaatcatacgccagagttactgatagtataaattaaaaatgaaagaagaataaaaggctagaatcgcattctcagttctcacatcacccaattgggaatgcgagctccagtggtttcaggtattctatctcatgaaaactgaaaaaataactggcaaatgatagttgtaacttatgaacaaaatatatttgcctataacccagtacatgtctcctgaagtttcacatttttcatgcattttttttcaaccattcactttgttctggctagaatggaagaaaaaactaccaaacaaacaagcagtcttagccactgagctaccaatactgcaatacatactgctgcaccattatgtacttacatgaatactcggagggaattttttttaatagaatacaaaaactgaagtagtagtacaatcacggattcagaatctaaagcaaggtacagtctcgcgctaagcact

SEQ ID NO: 76610 - DNA, 652 bp, Oryza sativa
cttattaaaaaaatttgtgcaaatataaaaaacgaaaaattgtgcttaaaatactttggataataaagtaagtaaaaaaataaataataattccaaaattttttgaataaaacgtgtggtcaaacagtgcaaataaaaactcaaaatcctttgtattatgggacggagggagtaccatagatccgaaataagccaaataacacgatggacagaagtttggatgaagtaaaaagaaaagaaaaagatttattggcagcatgccttacatagatatgttggaggggactacggatcggtcgcccgatccaaatgtgcaaaaatcggcgccacgcatgtgtgcaaaactactttaaaatagattttctcttaaattatttatccaaatcatgatccgattgcacaattaaatttgttgtaattaaatcttcaaaacaagaccacacatgtttatattttgacggaatttttttaccctattattgaattatttttaaatattgcacgatgttccaccaagtatattagaattgtttcactaagtagatcgaaaatgtttcaatcgtttaaatcggatgttatttcaccttatgtaaaaacaatgtttcagtaaatagcggaagcatgtttcagttcactgcaacattagatctat

SEQ ID NO: 76611 - DNA, 54508 bp, Oryza sativa
ggaaatgtgtttggcgaggattcaaaggaagggattgactttcggatttagatttcggagacttgaattgggagaggagatttgaggcggaggattttgatttcgatgagagggaacaacgggatttgaattgagatcttggcacaacttagactcgcacacaaagaacgaaaattttcgcaattaggattttgccgaaatagtttttaacaactcacgaaaagcggagcgttacaagtagctttttaaaatacgtgttaatagaaatatagaagtagctagggccctgtttagttccaaagttttttttctaaacttccaactttccatcacatcaaaccttttatacacacaacttttcagtcacatagtttcaatttcaaccaaactttcaaacttcagtgtgaactaaacacggcctaagttcaattacctcttattagaacgcgaccttagaatagcaaaaggtgtatgttttggatcataatatcctataattaataaactcgcatcagcaaccgatcaggggatgtagctcaaatggtagagcgctcgctttgcatgcgagaggcacggggttcgatcccccgcatctccatttttttttattttttttacttccctattccaagcactatcttcccaactgttctgaatgttcaagaccgtttatctcaactttctgaatattttccttattctagtaacttgtaaaacgagatggagagcaatgagattattatcagtcccaccatgattatacatatagtcggatcaattaactgcgcacattctctgaactttcagaatattttgtttaccctgttctaagacgagaggagaacaatgagattatctgagtctcaccacaccatctgcatcttttgcatacatacgggtgtgtttagttcacgtcaaaattacaagtgatgtgatagaaaagttgaaaatttatgtgtgtaggaaagatttggctgtgtttagttcaatgtgatagaaaagttgaaaatttatgtgtgtaggaaagatttggctgtgtttagttcctgaaattgagaagaagtttgggaaaagttggtagtttgaaaaaaaaaagttgagagtttatgtgaaatgtgatagaaaagttgaaaatttatgtgtgtaggaaagttttggctgtgtttagtttctgaaattgagaagaagtttgggaaaagttggtagtttgaaaaaaaaaagttgagagtttatgtgagtaggaaagttttggatgtgatgtgatgaaaagttgggagtttggggaaagtttggtgtgaactaaacagagcctttaatgtgatggaaaagttaaaagtttgaagaaaaagtttaaaactaaacaaggctgtaatagatcaattaactgaacacgctactagtctcaagtgcaaatcagacgtatgtacacatgtgtggagattatgggtaccccatacccacacggcatggttatctgactagttataggggataacttatatgtatgtaatatgtaacagatcataacttgggtgttacgtttccttgtatattacggaacggcctaaagtcctggttggctaatattgtaaagtagatttaggaaaccgataccgtattggttaaggtttctatctcgtaatcctgccccccatcctatataaggtgggcaggaggccctctagggggcagatgagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtaggggtaaacgtcgagtttcctgacgacgagtgcgatggaatcaactttatgagtcgccggcttcgtcttcgctttgggagctccttgattcctcgccgccgacgacttcaacaagacgaatcgtcgctgctattctctgcctgatcttgttcgcatcagcacgacggcaacgacggggcaacgacagttcgacggatttgatggtcgtcctcgtccaccaccaagcctactggtccaatctacccaacgaggatgccatggtgttgcaagatggatctacaaacacgaagcatgccaaaaccgatctaatcggatgcataggagacggctgcagccacgccgatgcctccctgccgtcctgcgtcgtgctgatggacaccaacgccgcccgcgactgcgacctccgcctcctccgctccgtctcggagtcagtcgaagagatcaatctcggcgagttttttccttttaatctccgacttcgccgggttttttccttttcaacttattgttgtttattagattgatctctaaatgtcagattaatctctcttggtattttctgctgtttgcatgtaacgccgcggcactactcttgccgactggtgcttccgtctgcatggctggcctattaagccgccgctgttgggcgtctacgacttcaccgtcggcctgcctccgtcgccgccgattggtgcctccgcctacacggctggtctattatgccgccgctgttgggcgtctacgacttcaccgccggcctgcctccgtcgccgccgattggtgcctccgcctacacggctggcctattatgccgccgctgttgggcgtctacgacttcatcgccggcttgcctccgtcgccgccgattggtgcctccgcctacagggctggcctattatgccgccattagtgggcatcttcgctttcaccgtcgacagccttcgtcgccgccgactggtgtcttcattgttattaatggacgactttgttcctacattggccacctctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacctaagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttatcaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaaccggccgcctcgtctgccgccgactggtgcttccgcctgcacggctgacttattatgccgccgttgttgggcgtctacgtcttcaccgaccggcttgccttcgccgccgccaactggtgtttccgcctgcacggctggcctttaatgccgccgttgttgggcgtctacgtcttcaccgaccggcttgccttcgccgccgccgactggtgtttccgcctgcacggctggcctttatgccgccgttgttgggcgtctacgtctttaccgaccggcttgccttcgccgctgccgactggtgtttccgcctgcacggctggcctttatgccgccgttgttgggcgtctacgtcttcaccgaccggccgcctcgtccgccgccgactggtgcttctgcctgcacggctggcctattatgctgccgttgttgggcgtctacgtcttcaccgaccggccgcctcgtccgccgccgactggtgcttccgcctgcacggctggcctttatgccgccgctgttgggcgtctacgtcttcaccgaccggccgcctcgaccgccgccgactggtgtttccgcctgcacggctggcctattatgctgccgttgttgggcgtctacatcttcaccgaccggccgccgcatccgccgctgactggtgtcaccgcctgcacggctggcctgttatgacgccaattgatgctatcttcttcacggctggctacatcaccgtcaccgctaataggcatcatcatcttcaacacaagctgtctacgtctgctgctgactagtgccctcacctctacgtctggtttagacagctaccactactgatgaacatcatcgtcttccgtcgccgactggttatgctgccgccgactagtgcttttatcttcacaactgcgcgtcttcactaccagtttgcttctgtcacttcatcacggcaatgcaactttgtcatcatggatttctacttggacatcttcaacatttatcttcaatcaagcaatgactactcgacgataagaagctataattctcgactctatgttcagttgtttcccaactaaacaaagagtcgggggctacacaaatacatggctcaaaattcgacaagctttatgtcaaagatggagcaatcaattaatcagccaacgagtcaactccaggagtcattatcttcatctttgcttcggagcagatattctacttcaacaacttcaaatatttcggtttagacgagttgggcaacaacatcaactctcctccaattatttgtcttcacggttggcctactacgcaactgccgatagaggatctcatcgttatcatcggctgctacatcgttattgactggatcactgacatcgtcatcttcatcaacatcttgtcaagcctcatcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacgtcttcatccttgtcgtttccgtcgttgcgaaggttcgcgagtgcgccggaagtattcaagaagattaattgaagaccgattattgcaagttgaagacaagttgcaaaggagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacattttgtcaccaccgactgttctttcgttgttgttgggcgcctacatcttcactgctagctgacctgactgttgccgactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgatagaaggacaagctatatgctcaggggctcatcaactcaagcgtgaggattatatctccaatttggacttgttccggatacattccacatggattcatagttatgagtctattttctatgctcaacgactggaccaattattattccccgtaagggctatcaaccgaatacttgcgccattcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttataagtcaaggtgctgtttgggtttttaagcaattgattggatacaatattattgctttttgccacgtaagtgtgcatttttattgaccaatattatggcttaggctgattatatattgtgatcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccagtactttgaaaatttctttattcacaacatacaagcttctttatagctattttgctatgtgaattttcaatgatgtagccaactttaggttacactcatcatattttacaaagcagtcggtatatcacttggatcatattattcagggattcacaccgcatctgctacatattaatattaagtcgcttggttgactacaattatcgaaaccactcggtgcatctagtcgatgcacctgactttattttttcagccctccacagtcttctgatttagaaaaagtactcgggagatcatggcgaagatgattgaagcactcggctttggagtaatctagttcgagagaagattatctttctgactgtgaaggtctcaggggctactgtggagattatgggtaccccatacccacacggcatggttatctgactagttataggggataacttatatgtatgtaatatgtaacagatcataacttgggtgttacgtttccttgtatattacggaacggcctaaagtcctggttggctaatattgtaaagtagatttaggaaaccgataccgtattggttaaggtttctatctcgtaatcctgccccccatcctatataaggtgggcaggaggccctctagggggcagatgagacaacctgatcgtcagatcaatacacactcggcggattcaaatccccaaacaggagtagggtattacctctcattgagagggcctgaacctgtctaaatcctttgtctccacatccatccacttttaagtctcgtgcgctaccccgttttattattgccgaattcatgtttcgacaacatgacgtctcaagtgaacagcggcacgcaattcaacagcataggaaagttgagatcatacatggttgcagcgtatgaacggcggaaggaggtaggccgccggatcaggcggtcatggcacggcacaagagccacccaactcggtaggctgctatgcagagctaattcgtgagacaagttatttaggcctaattaatttataattagcatattttttactacagtattatataggataatcatagattaattatactctatagatttatctcataaattagtccagagttatgaaatgggttttatcattagtctacgtttaatactctaagttagtgtccaaacatccgatgtgacacggactaaattttagtccttctaaattagtgtctaaacatccgatatgacatggaacaccactaaataccactaaataatgaggtagtcatattgtacaatagtaatctgaatgtgacacaacatggccatacatacatcatagaccaagaatgaactctttatactacatactagtctgatcacgcgcttgtttggtcagaaacacaagagttgcgttgaattgactgaaccaacgccaacgccaacggccggccaacatatttgactcccctccaaacatacacacagtattattcctcaccgccctaccttttcagttagcttcagcctcagcttctgcagacagtgcagagtacgccattgttcatccactcccattttgcaagtcagtgctaaccaaaaaatccaaaataaaacacccatcgtttcattcgcaagtactgctgctgtaatcagcatgcaagaatcaatgttaacaggctactgattgagttgattagcagctcgaacccttatccctttactggagaatggaagaagaggaatgaatttccatgcattcattcatatagaaccagcaggtagattaacgagatgttggcagaagagaaagaagtaacaggacacgattaagagtctcctcaagttagacatgctacagttttattcattactaatgcagaccaatatatgttcagtgttcatcataagcacaaagccacaaacactctgacagcgagtgtgttcgttgcttgctcaggcagctagaaaatcagtaaagtgttggtgcttcttcgatctacaattgttattattgcaattacaggaagaacaactagtggtactaacctgactgtactgctatcctgtatgaaattatacatttgtataggctactgaacacgaacaatcaagccatgcatcaccatcttacacttgattacactaacttgtcccgatcgatcgatattgaacagcaaaactaaactaattttttttccctttgcgccggcgagctatgtagcttaggccatggcagccgtggcgggcggttcagatgagggcgccgtgggcggcgtcgagggaggcggccatgggcatggggaagccgaaccatggcgcgtacagctgggcctcgtcgacggcggggcgcacgggcacgggctgcgccggcgccacgggctgccttggcggcggcggcgcgggggcgcccgtgagcctctgcacgaggtccctgaactccctgggctcgacgcggtacaccttgggcggcgcggggcctggcgccgccgacggagaggctcgccacggcttggccggcggcttctgcaccgccctgagcgccgcctcgtgcgccggccgcctcgcgtcggcagcgtgcatatccattgaattgaagaagaagaagaagctaagataagcagagtgagagagaggaggaagaagaagagagggcagagcagaggagcgatgggaggaggaggaggagatatatagagtggtgggttgggcgagggcgtgtggagggggttggattctagaagaagaagatgaagaggagaggtggcgggagaggaagcggagtggcgggagtggcggcgagcggggggcaacacgtggaggcgggcggtcaatggtggcaggcaggcaatggcgatggcattcgctaatcgcgcgtgttgcacttgcattgctgctgcattcctaaccatgcacggctctctctctatatcaaatgaaatctagtatccatctccatctcattggcattggatgcaccgcggcgatggcgtagcatagcagaagcaaaataagtgatgtgaatgatgaggcagttgagttggggcggccacctcgctcttaccgatcaacaagggcaagggcaaggccttgttgatggctacgctctgcctgccttatatcatcctcttatgtaggagtataacatttctttttcattatctacttacaaactacctgaggatgtagtggctggtttaattcattatttaaatatctaaatatttttaaaaataagcgtagtacaattcgttacttctagcaacctaaaagatataaaaaaagagcagccaaaaagtgttccaacacatatactgtagctctcaactctatcctaatatataaaatgggcgcacctaagcgtcgattcgttcagaaaaaagtattgtagttacagagtaacgttcaaaaatcacacgataacgcactattttcgcgaagtgaaggtggcgggaccaaatcccctcacctatgcgtgtggccataatttttttttcttactagtttgcatgatttgtgaagcaaatctaacattcgaaattatatgaaagttatattatagttacataccagttacaaatgcaattacggtataattatattgtatttatatttgatatttacttggacaaaatttattaacaaatattgttgtcaaaatgacaagagcttcacgtcgaaggacgtggttccctcggtggagtgatttgaacaataaataacatattaatttatgaaattttttagggatcccccttacacaaccctagggggatatttatagtcttagtacatgcctatacccactagggttcaatatgtacagagaaatttacattatacccttatgataaggatattagagggacatgtagtgtccatcccaactatattccccttgaaaggcccctggcctggcccataataggcgaatggcaccatgggccgtgctgcttggcgggctccctggcgaagccggtcttccatggggcgaacctttcgtgctccgccttgaggcttcgcccagaggataaacttggtggcgaacccccttgacttcgtcttttggcttcgcctgatgcagtggcttgttgatttaatggttttagcaggttcggccgaaggctctcgtggcatgccttaacaaatatatagcaaaattatccactagatggattttaagtcctacctagatagccgccaggtcactgaatagtcaggtacgtgcagtagaaactctttttttccttagtcatgtataaaagggcctccttttactttgtgactaaagaacatatatattcatgtgaaaccggtgacaaagaagtatatttttaatttctttttctttcccactgttcctactgttctacatttccctcgtgctagcatacgtacaatcatgaaatagaagcacgcatattagtttcattcattcatgcatgcattcaaatatctcatacgcaacctactatttctgcagctagcgagcaaggttttctcgcagcctaaccaccgtaccacaagactattctctctactgttagcttgtctgaatgtctgaagaagaataactaacaatcaggttcaggttgagtacttgagcacgcacgagcggccggcccagtcaacgatggcacacgcacagctatggacattccatttctctctgtacgtctcgttatcattctgaaacgaaggaatttcatatgagatttgcagggcctttaatttgataattaattgaccggttgactatatttcagttgattggcgaattaaccacggacgtacagttaatagtaatactccctccatactcacaaagaaagtcatttagaacatcgatacggtctccaaaatacaactttaacttcttttttctataaaaatattcattgaaaagtgatatatgtatacttttatgaaagtatttttcaagacaaatctattcaaataatttttatattttcaatctcaacaacttaagagttattcatgatttatattcccaaggtttgacttaaacattgtcctaaacgacttcctttacgagtatggagggagtacaagttagtactccctccgtttcgaaatgtttgacgccgttgactttctagcacatgtttgaccgttcgtcttattcaaaaaatttaagtaattattaattctttttctatcatttgattcattgttaaatatatttttatgtaggcatataattttatatatttcacaaaagtttttaataagacgaacggttaaacatgtgctaaaaggtcaacggtgtcaaacatttcgaaacggagggagtataactcaacacgttcagttcaatccggcacgtacgcggatattcggtcaaatttgatcaattttttttctgtaatttcttgtctgcaggctagaatggtgagatgatccaagtccgtcgtcctgctctgaatatgtcaaaacttgcgcttggcctggactttccagaattccagtcgtctctcgtctcttcccaaaaaaaaatctctctttttagcttactttcctttgggtgcattttgtttatcacctgattgttcttcacagtccaagaaaaattctatttttttccagtttagtttcctttggctgcatttttttatcaccagattatcttcacagtcctaaaagaatatctcacaaaaatctcatttttgggcttactttcctttgactgcattttttttggtttatcagaagattactcttcccagtccaaattttttctctctttttttttcagcttcatttcatttagctgcacttttgcttatcagcatgttattcttcagtccaaaatattctccctttttcacctcgatttccttacacatacgactagtaattattcctaatgcactgtacagtttaatcttttgatacctttctctaatcactcccacaagatgtatgtacagttcctggatgtctcctggaaggaggagatcaggagatgaatcccaatcagtctctatctcccttcagggacagagtaatctactactagtatagtctacggttagtggggcccacctcaaacaacgacatgcaagaacaggaggagcccacaaactgataactgaaatcatggtcttcttctcaatatcacccccacctccccttcaattatatacaagtcaccctttattctttttttcctctcttcttaggctgtgtttagttcagcgcaaagtttagattttggttgaaattagagatgatgtgactgaaaagttatatgtgtattacaggttgatgtgatggaaaaggactgaagtttggatccaaactttagatctaaacacagccttatactagtgtatccttttggatggcaaagtaaaagcagaggttgacaagcacatagccatgtacatcaagtcacatgtgggtgtgcactttgcacttcttttctatttggcaggtcataagagctttgtcaaattcgagagctctttggtgaatatatagctgcaactcttgtagaaaattaagaaatagttagttcaagtactatccgtgctactaataaagtatgttttcttcgcactatctacgatgaaacgaactctaaaaacagtagaaagttacataacatatacgtgcatatggtgcacaaacaaatcatctaccaaagcaacaaagtcaaggccaaatggatagccaaaaaatactgcaagtgaaacacatcgtagttcactcgaaattgacgcttcagaaaccaactggacagccaaaatattgcaagtgaaacacatcttagttcactcgaaattgacgttttcagaaaacaaagaaagggaaattttttagtcctagaaaaagcatcatcgaaaaggaatccggtggaatttgcgaatgtcttgagggggagcactgaaaaagttgtccccaagtaggcgtaggcaacaacaattcaaccatggccgtgctgaaaagccaaatcttccctctctaatctccttctttcctctgctttcctctaaatgtccagatggtaccaccacccaagtactccgattttttcagctcggcgattgaggaagatcttctcatcatcaccaccaccgtgctaccctagcctaacctagaggccttcaacctctgctcgatcgatctgctgctgcttctccaaggcgagcttcgtgatcaaaggtccttattctctcatcagctctgctctgcttggttttggttttggttcattcagtttgattcatttgatggatagattggcaaggagtatgagtatcttcttgtttccctttttgcggcgatttgctgctcttgttcgctttcagttcgtctctcatctttatgcgtttcttggctcccggtgaaggaatcacgattcaggaatctcggactccgtgattttcaccagagaaattcttttttttttaacccactcatcaccgtgtaatttttttaatttcttctctgcttcgatttcaccgaagggcagaaaccgctcttccttggacgtaaccgcttctcggatccacacatacattaattttttttgcatttttgtttaggataggattggagccaataatattgtttactagtaggatttttcatttttcaataagatgtcttgttcttggatgttgccatggacagcatgcaaggaggggtagcgatggtggtgacagtgaacggcggcaatggcaaggacagcttcggcaacatggcgaggccgccgtcgaggagcctcctccccctcaagctcctcaagccgttcctcatcttcgccgtgctcgccaccggcttcctcgccgccgccgcagccgccctcctcctcctcggcggcggcgctggcgcctcctacgtccccaacgtcctctcggcaacggcgtggcagcagcagccgcggtgcgcgcagcagcaggaggacggcgggcgggcggcgctggagcggtggacgcggctaccggcggcgagcgcctggcacaacatgagcgacgaggagctgctctgggcggcgtcgatggagccgcgggtgcggcggtatccgtaccggcgggtgcccaaggtggcgttcatgttcctcacgcgtgggccgctgccattggcgccgctctgggagaggttcttcaatggcagcggcggccgggagctcttctccatctatgtccactccacgcccggatacaaccccgacttcccgacaacctccgtcttctaccgccgccaggtgcccagccaggtactacaaactcaaatctcatatcaaatttgattagtttccgtttcaaatgcgagatgatttttttcatttctcaattaaattaaaagattggggggaatttggagagcgttgagtcgggttcgtgtccagatgaatgttcagcttccgtggcatcttggcaagtgcagtgcgccacgaatgcaagggtgaaaatgacatggtgtaaaagtctccctccttaataatcccaaaaaaaaataagaatattcaatcacacttgtacaggctacatacaattagctagaaacaaatttcatctcgttttctcatccatcgtcagcatctctgaaacaataattccagaagcaaacctgaagagtgtatgaaatggattggaaattgaaatgggtgtgcaggtggcgcaatgggggcagacgaacatgttcgacgcggagcggcggctgctggcgaacgcgctgctggacggcggcaacgagcgcttcgtgctcgtctccgagtcgtgcgtgccgctgcacggcttcccggcggtgtacggctacctgaccgcctcccgccacagcttcgtcggcgccttcgacgacccgggcccgcacggccgcggccgctacagggcggggctggcgccggaggtgtcgccggagcagtggcgcaagggcgcgcagtggttcgaggtggaccggtcgctggccgtgttcgtcgtcggcgacgagcggtactacccgaggttccgggagctgtgccggccgccgtgctacgtggacgagcactacctgccgacggtgctgtccatcgaggcggcggggcggatcgcgaaccggagcgtgacgtgggtggactggtcgcgcggcggcgcgcacccggcgacgttcggcggcgcggacgtcggcgaggcgtgggtgaggaaggcggcggcggggcagaggtgcctgtacaacggccagccgtcggaggtgtgcttcctcttcgcgaggaagttggcgccaagcgcgctgcagccgctgctcgcgctcccgccaacgctgctcggctactagaatttttttctactactactctcatcagttacgtatagatgtacgtactgtacgtctctcactcaaatgtctacattatatatacgatgtatactcacatcacagaaattttttgagcggtaatatataaaattttttatactccatccactgttgcggttaatcggttatggatgaaaatggtatggactttcccaaccgtatcgactatcgtttccgtcttgtaccagccgttttatttcgatcatgtgtttgaaaagttactacctactgctttgaatcttcactataataggaacatatgatgttaatatataccgcctccaattcaaaatgtacgatgccattaacttttaacataacgtttgaccatttattttattcaaaacagttacataaatattatttagggcttgttcggttcatagagttttcaaatgaaaggaatagtaaaagcaaagaatcaggatgtcacatgcactccattccttaggaatttttctaaaaggtctcacatcatgcaaagaatcctataaaataatttttgccgtttctcatgtgctatgtagacaaagaacctgacaagcttcatattacacagtgcaagtacttagtagtgggtcccacatgtacatcttttcacttttcatctcccaatctctttctcctccccaaccgaggttgcaagctccacaagaccacaacgcagcgcccagccgttctccctgcgttgcgctccctcgaccgtcacggagaacgcgtgccctcttgtggctccgcctccgcgaactcgcccaggcaacgcactttggcgacgtggtgtcaatttttccgttggcactgaccgggctgaacgacacgtaggcccattgtaaatgccctaaggctacaatccttatgaatttgataggatccattcctatgaaatgaatgatgcatataggaaaagaatcataaggtttgaattcctacaataatcctatgaaaatcctctaagccaaatgagtccttatttttttctaacttgttttatgatcaaataaaatataatcttaaattatacttttacatatttatactaaatttttgaaaaaaaagatcaaactttgtgcgaaaagtaaacggcgtcatacattttgaaaagagctactatataaagtaaacattgtcgtgacttgctttcccttgtgacacattgttttcaaggctctattccggtaattttatctccggtgatttcattttttcgttatcattaatcatttttggctctttcgcttcgattccttttttaagaaaagaaaaacaatacggaaatggtttaaacattttctgacagtttttggccattttcatctatagacggatctagggggtggcccagtgatccagtgacaaaaaaaaatcctagcccaatacatatatatacatatgcgaaaagaaattttaaaaaaagaaaaaaaaagctcctttattaatatattataacgcacatttgattaatttatacttatagcttggttatatttagagtatttaaaaattttatatgaattgaaccacccatataaaattaactagataggccaactgttttcatccctagcttcaatgcttgaatgcccttttcttcttttttttttgaaggaaatgaatgcccttttctagtcaaagctgcaaggctgcaatgtgaagattctatggttgttcacatgctgagcatgagcagagaggcccaaaccacccaaccaaagaaaaaggcagccgccaccacagatacaattggagtggtcgcacttgacatcgccggcgtgtgagctacggccggccggagccctccacccttgacgtcgtcaccggcacagccacggcacaacgactgctactaggagcaatatatgacaggttgacagactggttgttggtctcaacaaaaacacccaccactagcaaaatccttactactgtattattgttgacaaagcaaccactcaatttgctactgttctgttgttgatccatcaacatgtctaagtaagtattccaattgtactgttgcttgcagaaattatcatacaactctccacttccctaccaacttttactgtgaactagtagacccacaaactgaaactgacaggaggagatcaaaacatcggagtacaaccaaccaataattcaaacataaagtactccactccgtaagtactagcgattaagacagctcctcagctggttgctgcagctcaattcatggtgtttaatcaatgaaggcatgaagcaacagttgggagtgatgggagtcccagttctctcacaatgctcagatactaccaagcagatgaacaggttgcaggacatggacttgcttgcagcctcctagcctgcatttgatgatggctcccaatttgtgcactgcagaagtgcagagtgcaggctgcagatcgactgcctgatctgctcccctctgttgagccacacatgtaacatgctgccctgctgcttgtagccgagctgatcagctagctcatacatatgtatgtatgcccacctgttgccacgatctctcttgtgcaaatgccacgcgagcagtgaagcgcaggggatggaacaaggattcgttctctcattgattagcaggactgcagtgccactagttctaaattctagtagcatatgcatgtcatgtgagtatgtgactatatgtgagtagttgatggcttgattctggtgaaaagcttggcaggatcctttcttggtcactgcagcttataatttgcttagactgaaaccgaggcgaaggcacagattcctcactttagtctgtttatgtttattttcctttctgtttatccctgagagagttgtcatgtacaagtatcctcgtatcttcaatattcacggcttctttggtttagcatcctactaaaacgttgatggtgctaaaacctggacaagtttcacccttgccaacttgtttatatgataaagttgtgtttgcttttatgccaatgaaaagccaaaactgttgactaaaatctagaaagtggcaaattagacatttgcaatgccaatgagttggcttcaaactagaaccaccatatccactatttaagctaccaaaatatcagtagggcaagttttggctccaattcaaaacgaccctcagttttcactgaagaattttgcagaagaagatgaggactactgctgtgggtgtaaactagctgcaagaccattggttgtgatctcactatgctagggatgtgattgaagaagagagacaattagtaagaaattcagagctaattgtaaactactagcaagaaaagaaaaggaatgaggttgaagaagagagacatcgttttttttgttctgtctgcacctgtaactgagcaagacaaggcaggtgatggcactgaacaatatattagtactagaaattcaggacttgttcaatagatgcatgcataccaatgtagtatagattatatgaccacatgttgggtaagtcaattcaagtttgttcatcagttgatgtcaaaaaaaatcactggattaatatattttaataagcttgcctatgcgcaggaccaaactgaaaaggtcctagcagttttgcccataataaaggccagatatttttcttaacaagcagaaaccgtgtataggttgagaaatctcctcggatcatcacccagaatcaccaggatttgcaaaatttcttcttttactgacatgaacaacacaataacaacatagcactaagaagtagaagtaagcagggattggatcatcgaattgctcctacaccaatcccatctttgtttgttgattttttttttgtgtcatgttaatctcttcgatccccgtttggacgccacacctatttacaatctaagtagtagagtagtgaggaacatgttacaaggatgcatggtgggtggtggttcacctcataggtccttgtcgtggcgcgcgctggcggcggtggcgccgccgtcgtcgtcgcagacgccgcgcttgccgtagcaatgcaagaagacccagaggagcgcggcgttgaggagggtgttgaagacccaggcgccgatgccgctgcacccgccgccggcgacgccgccgaagtgcatccacacgacgccgacgtggcagaggaggttgcacccgaggagcgcgcactggcaggcgagcgcgacgggggcgccacgggcggcggggaggccggcgccgacccagaagcggaacccgaaggcgacggcgtgggcgagcgtggaggcgaggatggcgagcacctggaacgactgcgagaactcgagccagaggaaggccatggcgacggatgccgcgtgcgcgaacaccctcgccgcggcgccgcgacggcgttgcagcacggcgaagagcccccgcgcggcgtggaggtagcgggagaggtagtatgcgtaggaccagaagaagacgcggccggaggagcgcgtccccggcgggaagcagaggagccagcggaacggggtggtgcggctccgtccgcgccacgaccaccgcgtgtcgcgtatctcggcgagcgcggagagcagcgtgccggcgaagatggcggcggagacggcggccatcaggagcgcgtgggccgcgggcaagggccccagcgggagcggcctccggcggcgcaaaagggcggcgaggatggcgtcgagggcgaggcagagcgcgacgtaggaggcgaggaagccgaggaggaaggcccaggtggagaaccacagccccgtggggctccacctgaaggacacgattgccgggtgctcggcgagccagtaggcggcggtggaggtggcggcggccatggtcgtcggcgtcggcgtcggcgtgtggtcgggtggatggaaagggattcgtccgtgtgtgtatatatatagcctcgagtttatttattggattcggatgaatttgtcggtcagctcaagctctcgtttctgatttttgattttctttgacgaatttattgatttataattagagttctagatggccttttgcataaaaaaagggtgagtttgacaggagactctctctaaattttcatccttttctttaaaaaaacgtcaggagaagggaccggagcggctaaaattaggctcgctgttttgggtttctagaggcacgattcgcgtgctcttttgctcctccttccttacgtgtttggttgttgccaggaccaaacactcttagttgtacatttaggatagctaaaattaatgaataatcttaatttcttttagtactccttttaatctgataactaaaattgagtaatataatctgaattcttatgttaacaaagttgttttaaatagtattctaataaaatttttagaattttttttttacacaaacataccgtttagaaaaacttgcaaagcgtgtaaacaaaaatccagaatacataataagaaaagaacaaggtcttcatgtaattcggattgcttacaactctgaaagtacatatacttcaaagagaaaaagaaattaatttggtacttgcaattgagaaaaaggggcaggatgattcacttacaaattaaaatgaaaagaaagatagaagggttttttttgaaatgctagcgagcactccacctccgccgccgtcggcgccccagccggtggcgcccatgctcctccgtcgcccgcagatcccgacgcccctctcggcggcctcctggccgtcggccgccccagcactgtcctccggttcgccaagaccgagcgccggcatgttctgggaaatctcgccgccaccgcctcctccaccagcgtccggtgtccgcctggctcaagacagcactacccacgtctccgagtccacagtgcccccacgctccttcgtcgatgcggtacgcaggtctccgggagccagctccagtcggcttgctccccaaccaccgccgcgtcccacattaaagtccgtctttactgtgccttcgccgcgacgcgacgcctaccgccgcgcctacgagctggctccgagagagaggagggacatcctccctcataggcgtacgacgccacgccccgcattcacgccggccgagccaggatggacagaggtcaaacctcggcgctggtggagagagaaagggcattcaatccatggccaacggcccgattcaaggcgagaagacggcgctggaaggagagccgccctctccttggaggagttcaaggctagaaccaggggacgttgcttcgtctgtctagcccgcgaccaccgggcatcggcgtgccgcgaccccccgcgctgtttcacctgttttcgcaccgggcaccgagcgcgccactgcaattcatcccatctcacctaccgcccgctgcgtctggacgcaaaagcttctcatgctttcccaagaacaccaagagcagacagatctcgctccccgcgtcccacacaccgctcgcggcgcctgcccagagctacttgcgcctcgccaagaacaagcagatcccgtttcccatccccccgccgccgacatgctttgagtgaccgccgccggaatcctcctccaccacgcaagaaatgccagggagcgcctgacaagcgcgcccccatgccgcccctccccctgctccacagttgccgagaagcagagcttctgccaccgccgccgccacccactggtgttatggcgcaattgggtgacccggagacgcgccccctcgaggatgtcgtctttatcccgacgtcgcatgccatcgatgcatagctgtgcgagtgggagagcacggccacggtcacttgggcgatgccccccccccccccccccgcgtctgccactgccaaagacgtcgagcgcgtcattgccgacgagttcggcctacgcgcaggagagcttgctgtgtcactccactatccggaggccttcctcctcaagttcaagcaccgccggcattgcgaggaggtggtaaagcagggcttcgccaagggccgaggtattgaggtctacttcatccaatggcgcagccgaacatgcacctaagaatcggtggaaaccgacctcgtccaccctgttgacgccggcgacacgagggtgatctcgctctgggcatggactccaaacccgagccgcatccacaagcgcgtgtgggtgacaatcacgcgccaaacccgtgatccactcctcgagtcgatcacgatctcggagacgctgccggagcattggcaacaagaggtcaagcacccggttctcttccatattgaggagatccacgactacaccgcggcggctgtcgacctccgcaacccgaagtcctgcaggccggcgacgcgcaccctgccgccgtggcacctaggggttcttgacggcgagcgagccccgccgcgcctcttcgagaacttcccctaccacccgcatccgccgcggaccttcaccttccgccaaggtcgcgcggagggcgtggagaacaacaccgccgccttccagagggaggttcgcgaccaaggtagcagaacggtgagggacgccattggccgagacggcggaagaaggcaagagaaggggcaccgcgacaggcgccgggatgaccgcgatgaccgtcgcgggcgcaacaggaggtataacagcgaccacccagatgacctccgacgtggaggacggcgcgacgacgacaatgatgatcgcgacaacgggggacgtgatgtcgcgcacggaaggggcggcgttcgcggcccagacgtcaacttcaggcgggaacgcacgcactcgccgcgtgcccgcgatcgcggcgacacgggaagacgcgacgggcaacgccatcaagcaaactgcggcggcaaggacgacggggccaacgaccgcgacatgggcaacccacccccagcggtcctcaaccctgtcatgatggcaccggcgcgggtcatccagccgagtttgcccccacgcaacaaggggcctctcctcccgctgcgacgccctcgcgtcgaaaaggggaatgaagcccggtccgccgcgacgatcccggcggcgcgggtcttcacccgcatcaacgaggagatcactgccgcctcggtggagggggcattgcggcaaatactcgtggcggccggcgtggcggtggcgctcgacaaactaaccgcaccgccctccgcaactccttcactgctggaagatcaagtgcggcccatgactccgacggcatcgctgacggcaaatgacgcgcccacaaagaagcagctgccagccctgagcgcagagtacaacgctgtgacgtccctgttcgaggcgatgtcggtgaacaagccattgtcgccggaaccgctgcatcaggcaacgccgacgccgctcactcccacgacgatggatggagatgatgaagtaatcttcgaatccgcccaggtaacgccgaccccaccatgtgccctgttcaaagagctcccccctgcaatcctctccacgcctgcaatcctctccacgccgcaggtgctgatcgaccacgccggcgagctgcagatgccgaactcgctcgctgaccgcgccggcgaccttcagatgccgaccgtggctgctgctacgttgggagaagggcggaggaggagccctaggctggcgcagtagccgctggctggactgccgatgtcactgtgggcgcagatcaacctctgccaacgcatgggactggcaccgccagagggggccctcactgagaaggcgatcgccgacttcaaggcgatgtttaacatgcctctgccgcaagacgccattgatgccctcgcgcagctgttcggcctcgacaaggaagacatgaaggcagcggactcagccctggcaatgtacctgggtccctccgacatcggctgccaggaggagatagccgcggcgtgatagagctctgtcccgcgccccggcgactggagtagaccatctccacgtatccattttactttcctcgttcgcatcagcgtgagacctggacgcgcgccattggcatgatcatgagcagcgacattaccttccaaggccggactatctattcgcagcaatttcgcgaaccgacctctcccctctcggtgccgcaattccgcaccataacgatgtcagtgttagcacaaggccgccacgacgacgatgatagcgaagctcgctggccggcttgccccaccggcatcgaacgcgagagacaagagcgacgcaaacaagaccagccgcccgaacccgaacacgcactccctgggcaggaacgacccttccttggctcagaacgtgacggcgaactccaacgcctccccgaccgccatgatctccagccagctcggccgcacagccaccgactcgccgtggggctcggcgacgatcaccatgtacgccgccgacgcggcgccgacgttcctcaccctcttcgtcatggtgtgcacaccgccagacggcgacatgaacccaagccctcccaggccagttttggtcgacaacgcaacatctaaaaggcaacgcgatgggcgccgtggcgggcgcggcgaccggcgacgcacgacaccgcaacatcatccaccgtcgaattgttggcccaacgacaagttgctctggcccatctccatgtgaccatcctgcttgggccgacccagtgcaccagcaaggcccaacaacaaactgcttgctgcccccatctggaccgccacttcttgggccacccagcgacgccaaggctgataacccgggtgaaaacgccacaaaacaactcaatgggctgtatacagccaaagcagaggcctgtaaagatgtctccctacaatctcaacctagttttatgcactgtgcacaactccccccttgagaaagattgtttctcatgacatatccggtcatcgacatcctctcttggaacgtctgcggtttgaatagaccagccagaagagcgacggtaaaagagaccctccaagatgctaaaccccacatcgtctgtctccaagaaactaaaatgagcaatatagatgctagaatggcaagctccctcggtgggggacgcatacgctccttccagttcaagccggcaacaagaccgctaggaacaagaggtggcatcctgatcctttggaatgatgattttgtcgacctcaaagatttcgcgcaacgaaccttctcactctcggccacagtcttcttaaaagcttgccaaacatccttccttctcacggttgtctacgggccaaccagagatagtgcaaagcaagccttcctgagacaactacgcgacaccaagccagccgacaattcaaaatggcaagtgctcggagattttaatataatctacaaggctttagacaaaaacaacatcaacctcaaccgcaggcagatgcgaattttcaaagataccctcaacgcttgcgaactcaaggagatcgcacttcagaatagacgctacacctggagcaacgaacaagataacccgaccctggtcaagctggatcgtttcttttgcaatgcaagctggaacacaacctttgagagacacctactgcatgccctctctacctcactctctgaccattgccctttgatgctaacggggcaaggagagactccacgaacgagaacattccgtttcgagaatttctggattcagctcccaggcttccaagaggtcgtagcagaagcctgatcagccccacaatcccaccatgaagcacaccatagactctttcacaagctgggacatacgtcaaacagcctaagatcgtggagcaagaagctcatctctcaggggaagctacaattccacatggcgctcgaggttattctacaactcgatatagcccaagagtcaagacaaatgagccaagccgaactcacactaagaaggggcctcaaagatagagtactggggattgcagttgtggaaagagcccgtaaaaaacaagctgcacgaatcacctatcttaaagagggggatgcaaacacgaaatttttccacttgaggatgaatgcgaggaaaaggaaaattttcatccaaaggctacgagtggggaacatgtggaaattaaaccatgaggaaaaagctaccgctatcaaagaacacttccaaaacttcatggcacgcccaagcccacgcttaaaagaccttgactgggatgtcctacgattgccgccgccgactgttccgcaattaatggccccattaccgaagaggaggttcacgcgcgctaaagcagtctcccagcgacaaagccccgggcccggatggcttcacaggagctttctacaaagcctgctgggaaacgataaaagatgacatcatggtggtcattcactccttcaaccatttgcgaagcaatagcctctcgattctcaattcggcaaatgtagtgcttataccaaaaaaagatggggcagaatgcgtgggggactacaagccaattagtctcattcatggaatcaggaagcttatttcaaaagtgctcgccctacgtttacaaccgcatatgggctccctgatcagtcatgcccagagtgccttcatcaagagaagatgcatacacgacaactttatgtatgtgagaaacttgacgaggaaattccaccaaacaagaacgccgactctcctcctaaagctggacataaccaaagcttttgactcggtgagatgggattaccttatcgatctcctccagagaaaaggcttcacatctaggtggaccaattgggtctccaacattcttgcatcttcaacaacaaggatcctgctcaatgggtgcctaggaacgcctataaagcatggaagaggccgcagacaggaagaccccctctcgccgcttctattcatcctcgccattgacccactccaccacctcctagagagagcaatggagttagggcatctatccccacttagggggagagcccccaggttcagaacctccctctacgcggatgacgcggcaatctttgtgaatccaagcgttcaagacatgacaaatctgactggcatcctaagcgactttgggcaggtgaccggcttctgaacgaacatgagcaaaagccaaattgccccaatccgatgtgacaatattgatctgtccagcattaccggcatcttcccagcaggcctaacaaactttccaatgaagtaccttggcctaccccttgtggtaggtaggctaaagaaagtccacattcagcctttgatggataagtgtcgatcgtgcctcgccccttggcaagggaaattaatgttgaccgccaccagaatctgcttgacaaattcggtcctcactgcacagcccatctaccacctaacatctctaaagctgccagatggaaccatagaagaacttgacaaaatgaggaggaagtttctttgggcggggggcgaaaacatctctggcggaaaatgcaaagtaaattggaaaagagtctgcaggcccaaagacctgggtggtcttggagtcatggatctacaacaattcgcatcagcactgcgactcagatggctttggaatgaatgggtggcaccagaaaaaccctaggtggggacggcgctaccgtgcaacaagttagatagagatctcttcacggccgcaataacaataacggtgggcaatggcaaaactgcacgattttggagctcgaaatggctggatgatcaaactccgaaacagatcgccccggatattttttttggcttctagaagaaagaacagaacagtgaacgatgccatatcagaaaacaactggatccgagacatcgaaatatctcgtatcaccgaggcaagccacctccaacagtatgtccgcctctggatagtgattagaaacatgaggccgctaaacgaaaatcaagacaacattcgatggaacctcacagcaaacgagcagtactctacaaaatcggcctatagactccaattccttggggctgcgcgatccatcttcaaccaatcaatctggaaggcctgggcgccgccaaagtgcaaattcttctcctgattggtcactcaaaacagggtttggacggcagacagactggagaaaagaggatggcaaaaccaaaagatctgcccactctgctgcatggtggatgaatcggccctacacctcctggccaaatgtaggctaacaaagagaatatggacataaatccagagatggacaggcactgaccttcagatgggtagctgggaaacttgtcactctgttaggcagtggtggactctcgtagcggagtccccaaataccccccgcaagcctctaaagactatgattatcctagtatcgtgggaaatctggtgcgaacgcaatgcaagaatttttcgaaactctgcgtcatcaccgtcctcaatcctagcaaagatcaaggaggaaggaagagcatgggtcaaagcaggggcaacaaccctacaggagtttggaatcctgggaaatatcacttagctctttttcttttttgcgggctagtctttttcctcggctaaccctgtatatacccttgtttatttttctcctgctctattaatatacacaagacaaagcttttgcctttcttcaaaaaaaaaacttgcaaattaaaaagatgttgagaaaaagggtagagcagttaggattgcaactgaagaatggtcctagctagcctaggagtatattgtttaacgtttccacacgaggatggtcttcgatgaggtcgtcagtcggcaccgtttctttcatttgattatctcgtgtcctcgatttaacaagcacacacttaatttaatccattgcatcatttcctctgtcttttcatggacaccctcttgcgatctgtatgtgcttacaaaacagctgatgtactcatcagaaggatatgtaggccatggcttaattaagtagcagattatgcaattaatctggttccaacaaactagcagatatatgtcaaagcatgagcttggaatatagcatgcatcatcatcaaccgacctagagcctgagaggaaaaggacacaagacatctggctttcaacaagtgctggcttgatgatcatttcttatttgtctcttctccttttgccttttggtgtttctcatcagagtttgagagcacaaaacctgtgtgccaactgcctgaattcattcagtcagtcagtcagtcacgatttgcattacaagaaattattactaccagaagatcagagggcaacgattttctagatgcatgacatgaggtggttacgttgtttcatgatcatccaacgtcgtcgttctagaacgtggatagagttaagtggaatactagaatcaactcaatcaaggaattttctttttcctcatcgtccagagaggcggttgctttttttttccaggtttcaattgtcaattcgtcgttagctgcttgtttttcacttgtttcacctccatatatctctttcatgtatcaaatattgtatatttcatggattttgctttggggttgcaatctattatatctaagctttacccctttttccatcaaatttattctatttacatcaggctagatatttcctttggagctaagggctcctttcaaaggcactattaacaaaatggaggaatataaaaaaaacacattattttgataggattgtaaatatagggctggaactcatattaaaattcctctaaaacttgtacatatattgagacattttcatatgattcaatactgtcctatcctttatttaaaaaaaactgcatatgaaaaataaaatcttatggaattgaaattctataaaactcctattacttccatctcatattataagggatagtcgatttatttgtattgccaaatcccttatattttggcaaatcaaatggggcctaaaaatagacctaagaggagaagtcatgttgtcactgatttaaggtgcttggagtctgaaaagagttttgtgatctgttgcggcagaagcataataccgcaaaaagagaagaggagattcttgatgcctgggcagcatccatgatatgaaagaaggttatattatactccgtattattctttccaaaaacaagcagtggattgttcttttcagaaatgagaggattgtgcttccctaccaacctttcgcttttgagaattaaaggaatccatactgactaaataattaattagcccaaagaaaaagagtacagaagactcctgagaagctcagtttttattggtaatcataaagcaatggggagaaaaaacaatcaatcagtggagcacataagtgtggagttcatcttgacaagaagcataaggcagcaatccacgtactttttctctacctttgttcgcaaacaaaattaacaaccaaaatcacctcagaaacgaacacagtgacggtgctgtagaaagaaattaagaagaatgtcgccttcaaagcatgcacaccacctttttttttctgaagaaaaatgaacctgcagtagtagactagtcaagccatcgttttctgcatgaagaaattagtaagaaaaaccatgtacacagtgagtgagctactctacacaatgagtggcacacacacagcatctctgaattgtgcaatgtcagttgcgccgtcgatggagacggataggatcggagctacctactgtatatactagcaactgcaactttcagatttcagattacgaaaaaagcaagcaagcaggggacggcagacaacatgcggtagcccagacatggaccgatcggagagggagaaaagcggaggtcaggttgggccggcgtgacgacgacgacgacgacggcgaccaagcgctggccggctgactagtaatgaagatttcttcaggcttagccagctaccttaataattaattaggatgccaattaattaagctacatatatatatatatgggattgtctatatatcctgtgattgaaaatcccgttccatatcatttgaattttggactattagatatgctttcgagatttgtgcataacaatgatcttattattttcctccccgtccccttctccctcccaccgcacgcccccggatccgtcacgttttgttcccgccgctgatgctagcccaccgtactgccctcctccacctcgcgcgacattggcggtgccacccatcggagtccatcgcccaccactagttctccgccatccacggtcatccctctaaagtcggtaaactctcccctttcccccctctgctcaccctcttgccatcttaatccggcacctcttgttctttgagtcagggttgttgctgccattcgctaaagattaacgtggttgttagagttgaaagagaaacttactagagcaaatcgtgaaacagatataatgttataaatctgtaagattttaccttaatttttcaatcaagagtgattccgtatatataaatatggcacgtacagtgagtgcaggatcgaccagttatattgacgatgaagttaagctgcactgttaatgtgtgtggctgcaggtcgggttgcatgtccacacgtggaacacacacctggccccgccagctttctatcacgccttcatgagccttccgatgtctcattctgatagttaattacttagcttcttgttaattactatctctgtttcgaaatatttgataccgttgacttttaacataaattttactgttcgtcttattaaaaaaattataaaatatgtaaaactatatatatacatgaaagtatatctaccaatgaatcaaatgatagaaaaataattaataattatataatttttttaaataatacgaatggtcaaacatattttaaaaagttaacagcgtaaaatatttaaaaacagaggctgtactagagtatacataagagtaaaaagaatatgtgagcacagagttaattaaggaggagtattaggtagtagctatagacggttggctggctatagtatgatgaggcgacatcgatctcaacttgatatcgacacgcacgtgttcgtcgttgcgttcttcagcgtctgatgcatgatacactccgatcaattagattaatcttttataaaactgggaaaaattactaatatggacccaaacgcacgcacgttttgatttaattactggttttgaatagggaatgggtccgaacgatgtatttatatatgttaatttcatttatcttggtttctggacatggattcttaataagctctagaaagaaagaaaggaaaaaccatagattctagaagcaggctacgtaggtacgtatggcagcaaactaagacgcatggcatgaggaactttgaattgacccccggctctctaaaacatttgaagcaaggattaatttggaattggatgaggacgagttgattttttttttgttttgtggttttaaggaaggaaaccacgatcgattagttgacacagaaaaactttctactacagtagaatgaacgcaatccgcgtatatagatcgaccaatgatacacacacagcatatgaatcctttccaaaatgaaaaaaaagagagaaagaaatactaagtccagaagaagaatacggtacgatgggcctaatggaagcccattgagaacacacacaacatctgttgggccttcacaagatagattgtcggcccaatacttttgcaaacaaaagcaggtggccgcataattaatttttttactattaggagtactatagtagttacggtaaaattaaaagagttatataaaattagtgagaaaaaaagaaaaagattagagggggacccacccacccatgcgggacccgatcccctcgcccgcctcgaaccttctccgccttcctcttcctcttcgtcttcctctgcggcgcacgcaggcggcgaatcctcctccgtcgacgcgactcctcctccgccgcccgccggtgagtcatccgcctctatcctctctacctcctcgcgagcttgatttgctcggcctcacgtacgtaccctctgcgcgattaagattcttcctactttccagattagattagattagagcagctagatcggatcgcccgcagcggatctccccctccatggatttctcttcttccactcttactgctgccctggttggctgctgcacttcaactgctgtgctgctgctgctgcccatcaccgatccctttaacctagtttgtttctgcccatgcgtgcgggggttactgttcatcgattcgagttgcttgcttctgccgcttcatattcagatcgatctctataggaaacgatgtctagaactaagccccggttcatgtttgcatttatcaggaaccagcagccagtttacatcattttctcttcttcttgtcgtactagagacatgcttcaatcttctcagctagactagattagacttggtctgaatcccaatacctgcattccataccacacacaacggccaaaatgtaaaccgcttctcaacttccaaatcatccatcatagtcagcggttttaatatttcgacacgccgaacctcttcctgcatatccacaccttaaatatagaaaattgtcacaaccaactttcatgtccatatcatagaaatgatattccagataaacgctaggaagttcagtcacagctacataatactaactcaagagaacaaatgacgaatacttcagtttctttgcaaagcagacatgttaaatcctcaagttgctgaactacggtttttttttttatttttgctctaattcttttccattttctttccctgttttagcacacaaaagtggtgcccctgccctagattataataattttgcactccaaaagagttggaactacaattgtacgttccatcatgccaactctgtgttgctgacgagcgtaccaatttcctccattgcagctcatctcatcccactatggcagccaatgttggggaatccacaagtggcagcagcagcggcggtgccgattctgggggaagcttcgagtgcaacatatgctttgagcttccgcaggagcctattgtcacgctctgtggccacctcttctgctggccatgcctctacaagtggctgcacatccactcgcattcacctgagtgcccggtctgcaaggctgttgtcgaggaggataggcttgtccccctctatggccgtggtaaggaccgtgttgacccaaggtcaaagaacgtccctggggctgacattcctaatcgcccagctggacagaggcctgccacggctccgcaggccaatcctaacacccacttccccaatgccaaccccaacccttggttcatgggtggaggcatcccactagccaatgcacggtgggggaattacaccttctcggcggcatttgggggtttgttccccctgctcagcttccaagtccatgggttcccagatgcaaccgcctatgggcagcctgctggttttccctacggatatggacacggccacggtcacggtcatgggcacgcgttccacggcggacatgcccatgctgctgctgctccccgccatggaccgcctgggcaacaacagcaggcggatgtgtacctgaaggcgcttctcatcctggttggttttcttgtgattgcaagcctcatcacattctaggattgtgccatcatattgctgtgcttgtaataagaggaatgatttcccgagttgctttctgatgttgtgcattaccttgcctccacacacgacccagtctgaatcaagtggttcttttgcgcaaagtgttgatagaattcttgtatatacgaaatagatgtggtcgtgtggagcatatgtgtactgtggttcatgaataacatggaagctctgtctgaatgaactagagcaatgatacttatattgtgtttttgatatgatgatgctcagaatgagcaggctatgcaattgtttggagcacaaatgtattcctctatggcttgtactaaagactatcgcactgatatcatatctgtgttttgtggtgtctttctgtcaacttatctctactagctttcagaatgtgttttaactgtccattgtacctttggttaaataatgaatacgagtgtgttagttgtatactgcatttctttttccaagaagttttttccgaagactcaaaaaactgtttaatgccaagtagctgtgggaaatggtggctgagtttgtgttcactatctgtaatagtagaatctatttgatgagactttctgaatcctgaatttctgatacattgagatttgaacagggttttgacttgtttgaccggagtagtatgaaattacaatacaacggcatttttactaaatgtatttctttagtaatgaggtgaggtagcaaaattcgaattcaaaattcataactccgtatccgtatggtaggtagcgtaactcgaaagctactgatgaaacgaaaagccgaggcgagactgaaggagtgtcagagcggaggggcacgtgtcgagcacccattgggtccctcgcctgcgcccctctgctctctttcccgccctttttattccccatctcctctctctcttctcctcctcggtttcgtttccttccttcttctcctcctcctccttctcccaatcgatcgcattcgaagcttcctccggtagctccggtgagggtgatggacgacctggacatggcgctgcctcaggccttcgagctcctcctcggcagaggtgatccatccatccattccctcatcctccctccctaaaccctagcgatcgatcgtttgtttcagtttgttcttaataatctcatcttttccattgctccatccgtgcagatcgagacgcctggccgcgcggggccgcgttcctcgtcgccgcccactacggggacgtccgcgaaatgaagagtaagccacatccaagaacccattttctttcccccctttgggttctgcttctgcatcgcatttggtacgaatttcttgctgaacatggctgcggggttttcatgtgtgggtgcttgcgctggattcttctggtatgatgttgatctgtttgtgccacggattcttggggggtgggggtgggggggtgctcttctctaattttggactaaaatctgggtacaaaaccacccaaagattgcaacttcgtgtatatacagctcgaaagtttcgttatgttcctaaaatgtctcccttttcttcttggtttgtgaagggattgcaaaggagctggacgaggacggcaaagggatcgaggcgactgtggctaacacaagcttcctcggcatgaacgcccttcacgcactgggttggctcggcaaggtgccggcctaccggtatctggtagaggaggtcaaaatggacgtcaacaaggccgacactgctcagggtaataatctactccagttcgcttgcatcttgaaaacatgttcttggatatgctttgcttggctcgacgatttgttcttccatcttcaactgtgtgtgcttgttgttaggattcacacccctggagcatgccgtctaccatggtcgcctgcctgccaccagatacctccttgatcatggcgctgatgtgcatcaaattcgctctacgggaaatgtctctcttcttcactcagctgcagtaaaaggtatcaacatagcttggcctctgatatgcccttaggattatcctttttcctgtcttagttagttgtctgccagcccatcctgctagaacatccatgttttcactgtaagaaactctgccattcccttgatttattcttttgcgatggatccaatttgtagtattgaacattaagccggagatccttatgttgaaatcagggagaactgtaaataataatagaaaaatgttttagtctgatagctattcaagcctaattgggaatactaatattgcgattagcttgtgatcgctagatgcaaatgtttactggtgcttttattttcttttgtaaccataaattgcacaaggatggtctactctgatgtgcttctcatatccatcaatgtcatgtagtcttttgaaaattttaagatgctttccaggttaaataaaatcctctggcctaagtttcataaaatttcctgtgtcattaaattgctataagtttttggaagcaattgtatttacactatcacttgtgggatcatcttttgcatgtgttttttcacgcattgcttcactatagccattaaaattagtttgcccccaaatgatcctttgcttagtatgataaccactggtgtttcattatgccaattggaaaattgctgtttatatttagatgctgaagcttgattcctctataacagtttgcccatatatttttatgacctttggttttccacctatttattcagggttctctgaagtagcaaaatttctgctttctagaggagttaatgttgatgcagaatcagaaatggggacaccactggctcttgctgctttcagaggatatgatagcactgtcaaggtccttttggagcacaatgctgatgtacgattgctttcatttctctgttggctttcagcatgaatctgttctcctttgcccctaagccgtggccttcgttattttcttcccacttgtacacagcatctcacagttaatgtgtgagctaacccaggcgtgggagaaggggcccacacaacagaaactctgataaagcaataggacaagcatataaaatacactttacagaataagcttcagcacattttttccttcagaattcttctttcttttggactgtcattactttgcatgacaattgatattctttgttttttccagcccaacaaggttacaaacaaggcacttggtgcacctttagacttggcattaaccagctcttctgtgtcctgtgtgaagctgttggttcaggtatagctctccctgctttatatggccgtaggtttctctaaagtggtgggtgtagtttacctctgtataaaagcatcaattataaggagaaaccatatgtttgtttatgctgtacacttgaatttaataggctggagctgaagtgaaagttgaggggccaaataatcatttggtaagagctgctgagaaaggcttaactgaagctattaaatgcatgttggaagctggtgcaaacccaaatgttcctgacagggtaagccttctcctttgtcacaccggtgatatctgcttcagtagtaaacggtttgatactaatttatgaacaaatgccacagtatgttcatgcataagttttttactgtttcctttttatttccttttgccatgtttttattaatttggttaggtatgcctagatatttgtctcatactagcaccaccttggtctgttctaaaggaaatggattaataagtttgctgtttacatgattgtccaggagaggtaccatttcattaaaatggaactaggctactctttcattaatctatattatcactatgaagagcatatatcctgaacatcaagaagagctttttgctacttgttttatttcaaattttcaatatttctatttcattcttcatttgttggacagctcgggagaatgccaatagagctggctgctgagtatggcacacgggaagatgttgagattctctttcctttcagctctgctattccaactgtggcaaattggagtgttgatggaataattaatcatgtacagtcagaaatcaagcaactagaggtatgtaccaattttcttgtgcatcttgcaacaatcctggtcttctgtgcaatgtcggcagccactcagtgtaaaccaatatgttttatggattaacactattactttaaaagcaagattcctgaagcattgcacatttctctgtgcaacttgcaagtgagtaccaggaatctgaaacaatgcattgattggatctgtttttttagccctttcacttcaccttaacttcttgttgtaatatgtttcttcactgctagcatcagatctttgaatatatgtctaattttagatattatttactcaggacgataattttatcaaaaagagaaggtctgacatgaaacaacaaggggatgctgcatttaagaagcaggattatctaaatgcatcagtgttctacactcaggtacattcttcggaaccattcccatggtacatcattggaccatattcctcattgtatatgccgttacttgtgtatcttcatctggcggacacaatatgttattgctactgtgtttctgactccagaagacacagggaaaaaaaactctattggaagattcttttatgatatttgggatttaactgaagattggaggtgtttacactacacaataagaaactagtattgaattaaaacccacctatcgatttgcccaaacaggccttacatggttcaccttgtttctttttctccatgaagttgatcttgttgttcatttacttttccagtgcacaaaatttggttggttatctcattatactatcacacatctccttgcatattagagcataagctgaacagtgtggactggaaacttttgtagcctgaagctagcagtagcagcacccaccaccaccaccacacacacgcatgctctacacacaaagcagtccactgatatctgtcttccattaatccctttagtttaattgggaggagttggtgggaattgcccttttaccgagaacttcaattttacctggttagggtgttggtccaagtcgatcagtgctgagaactggtatagcaataacagcaataaatctggcactgtttggttctttgcaggcactgaaggttgatccgtttgatggcacgttgttctcaaacaggagtctttgctggctccgcatgggtgatggagaaagggctttggatgatgccaatgcatgcgaaaagctacggccaaagtgggcaaagtcctactatcggcaaggagcagctctaatgtttctgaaggtgaactagacaagatatgcgttttgacaattcacttgttccttgtatatcttctactcctgtttgatttggctttgcacttgtgttccttaggagtatgagagggctcatagggcacttggtcgagctttagagttggaccctgaaagtgaagagatcgagaatttgtattggtaagatatctttttctatcaacaaaatctggctgttgttttgttccatgttgtaattggttgctgatccttacagggagtcgatggaactgtgcggttgatccctgaaatgccagctacagatagaagaagcacacgcagaactggaagctcttttgtgttatgaaagatggaacgacgcaaacgctcagtgatttgctgctttttgtgtacatatacttaggctgtcaaaacagaaacaaatgtctggtcttttatgtcgtgtttcgtcgtgacatcttcctggagtggctgttagactaaactagcattatcacattctatctgttgctagtatgggcagaggatgatcaactgtctaagcaagctggaatgatatgaattctctgaaatgttatgcataatataattgtgataacagcatttgcatggctgctaaaccctaactagaaggaagcaggtgttgccatcctcaacatgaggggcctgagaaacaaggcaactgacatgaacatgaactcaagtttattttcacccagctgagctgtagtgctccacaacaaaaacaacagaacttaacgcaaatctgcataacttgctggacacagcaagttttcagctccacttacacgtgtaaaagaatgacagaaaagctctaatagtagtgtgagagtgtataattggacagccctaagtaaccattactttacaatatggtgctcaaatcacaagcttttacacgtatatatatatagtaatgatggattttatctttacatatgattctttaccctatcacccccaccatctaaccttatattacatttcctgctatacctcctcttctgtattaaatggcaactacaaagctacaaatcccatgccctttcaggcatgttattctcccactaggtgttacaaatgctgccccccaattctctctcttaatgtccatggtcctgattgtttctctgctgtcttcaggccacaaaatcatgcagaagaggtgaatgctcaaaccgttgccgttgatccatctgattcatcgaatcatagtccgaagatgcgacggtgacaccaagaggagcagtagcattgtagatgtcatcctcattaacaccagggaaacctggctgagcattaggaacgaggttgctgctggagtgctgcaagcccagtgtcagcgacacattgccattgccgtatctcccaagctctgccaagtgataggccatgaaccgggcgttctcgtctgagtgctgcgcgacagtgttgtggagaaggaggccgccatccacttcgttcgatcgctggtccttcagcatcaggttcatgaaactgtcatcaggattgggctcattctggaagccaacaggcgctccgccaacattcattgctccaatgctggttctcgactcgctcaattggcttgtttcgcaaatccgtgccctggagtttttgagatcctccttgtcttctgaagatgccattttatccttacttcttggtgcattgtcagaggaagagttggagtcttgctctaaatcaccaatctcttctttgtacatgtcttcaatcattggtttccaaaggcggacacgggcatttatgaaccaattcgaaatctggagaacaggagaagcatgaagcagtcaacatgttgaactcttgaagaaacacaaaatgcttctaggataagaagttaaaacatcaaatgtggatcaatggtccagtgcacaaaaaagataaacaatatttacctgactcctagtcaggccagtctgcctagcaagcattaacttctcggaatcttttgggtacctgcaaaattgttgtggaggatgataagagaaaagaaaagagggaatgctggaaagaacagcataaaggatgaaacttacggatggaggaagtgttcaaacagccaagcgcgaagaattgtaacagagttttcaggcagtcccctctgtggtctccaggcgttttgtggaatcataccgtactgttggaaagcacgttgttgccttagctgctgatcaatgtaccggaggcgggttaattttccctccttgccagatgagttctcttcctcgccaagctttttcctgataacattgatctgatcattgatagcatccttcaggcaccgaaagtgccgtgagattgtctgaagagcaactgctgtgtaaggcttcgcagatcctggtccagctaccacatcaaacgatgaaaccacggtttgcatttggtggtaataatgcttgtatttccggtccacctgaaatatatatttttttgagttaaaatgatttgccaatcaattaactaagattactgtgctataagtaaactgtatatctactcttgtatacatataccaaggatcagtcctataaaactattgatactgtaatctcaactcaaagaaattggggttgcacttctgtttaaaaagaaagagaagtacaaaacaatagactcctagagtactcacctcatccaacattgccatcagttttgccattttgttctgaagctcttgcttctcagcagtggaaagctcaggtgctgcattagcgccagattcttgtggattagaagatacaccctcactttttggccctccatcagtctctttgccatctgcttttcctgattcaaccttctctttctgagccttttgttttatgctcttccaaacactcacgacctcatcaagcagttcttgtgctgccttgagataccttgagttccggattgcgcgtgaagcttcggactgcaaattcttcatccgcatgtcttcccctctaaggttgtcatggtaagactgcggcgttaacatgtctggctttatagaccagtacggtaaggaaggcgccatgatttgtgtgttcaagctcagagatagcccttggctttgcattgatggaacacttgatgagttgtgattattcagaacaccaaactcaagctgtgaaccagtgtgggcatcatcatggatgagctcagagccactaccttgtgctccatccatcatatgcatcaacatctcatttttcatatctttgacatggctgaaagagcgttgaccctggtgcgaagaaagcatgtcggactcccttgaagaggggtcttgtgacattgctgacgcatgcccagggccaggcatctccatgcaattctgctgaggctgcagaatgccgctgaactccgtataaggtccagaagatggattgttcagatagagcaagttccctagagctgatgacataggataggatgcactgcctgggtctcttgagtacatggtctgcgagtctctttcgctaccagggcttgaatagtaagtagccatctcgcaattataactacttattgctcgagattactgcaaaagcatatatgtatatgaagaaccagctttgacgttgacttgattgatgattccagcaggacatcaatattttgttatccagactaaacttgatcccgttcaacttccctgcaattgagtacatgaaatggactgataagacacccccaaggaagttcaaatattgaataaggagttctctcctctgagattgtaaaataacagcacaccaatgccaacaaaaataactgcaggcaagtgcttgtaaagcagttcaatggaaaacttcaaaacactttgcacaaacaaagacaagaaagtttaattgagcaaactgttaatatagatacagcagaagcacacaaagaatgccagtcataagtgagtaatcagaattggggctcaggctaagttttggcaggattctatctgatagaaatgcagtcacctgcaaaactttgctcgagaagtgcgataatatatgaactgacaatgtgacatgccgatttgcaggctaaagccacaagtggtcctccatttttaagattggatcaaaaaagttttggactttgtggtcctcctttgctaacaagatgttataagaatatctacttgtgaattcctcttgttatataccaagataaacaaccggacaacaccataaaccaaaatcaaatgactgcccagtgttttcttttcttttcataaaagcaacatggggaaaccacagtagtatcatgaaaaggagaattgcattggatagataaggtttgaacatatgactcttgagtgagtaatgatcatttatcatgatgagtaccttgttgaactaatagactgcaacttctcaaagattctctgccaggctgttattgctacgaacacagctaccaatcaaaatctgcaagagatgaacttacttagcagcctgtttgtcagtctaaacaaattctttttcatagctagatttttagagagtagagccaaagagaaaactccaaggcacatgtataacctacatacagaacaaagaagcacaagattttgatgaaaaacaagcaagatttccttagcataaagtgtctggagtgcagtaactcaacagaagaactactgcaaaaaggtaaaagtaacaggaaatttggcttttgagagcccagcttccatgaaaacattttttgaagactgcttccatgtaaacgtcgaggaagaaagggaaaaaaaagaaagaaagctaggacaatttagtcggcaatcgcaaagcctgttcgtacataagctcaaattatgggcaaagccacaaaaaagtgggttgctttacaatccgagaagaaaacaagaactcataattcggagaaaactaagcatatgagttttgaacacaagaatttctccacaagaatctatacaccaaagaaaggcaagaactttgttgaggttgagggcatggaacctcaaggtcagtcaaaagaaacaatctttgcacctgagctttcggttcatcgagaaaaaccagcagcaagcaaaaaaaaatccccaaacatcaaaagaagctgaaaaattcagatggaagggaagagcagtaccctagctctctaacccaacaaggcaagaagagctcagaaacccaagagagccagcgttaagcaccaaccacaagagcaagaaacacaccataattcagtgaaattccaccatcatcgaactgaagccaagaaccaagaacagaggtcatgcatgcaatccgttgctgatgatgctgcaataaggaggaggaggaggagcagatggtacaagagaaggcaataagaaaatggaggagagacctgagggtgtgctcctgatggggcgcagggcaaaggcaacaggaactgcagcagcgattgacaccaaagcagccagctgatcttcttcaagacagatagataggggagaggggatgagaggagaggagaggaggggagaaagataatcgatcctcccaatatggggacaaaatcagatcccaggattaaaataagtaacaatcccaaaaggaaaagtgagcagcagccagcagcagcagcaagagagagcacagagctcagagctcctctctctcctcttcttctcctccttcttctctcctctctctagcaagcagcagttgtgctagcttgctccttgttgcctaaataaaaaaagctcagaccacccactaacagcagcaccaaatatggaataatgtttgcctcctaaagaaatagttttgcttgttcctttattagttgctgtcgagaaggattatactgacgagctagctaacctcctcctcctcctcctctcaactgttgctgctgctgctgatgctgctgcttggagttatttgctggtgtaaccaccacaagtttcggctacttgtcgatcccagttgtttctttacgataaagcctatgcctccatgctcctcctgctatatttaattaatttattatatctgcatataaaattcagtttttttcttcagaaaaatggaattatattagcatgtactgtcctgcactgctctttatactagatcatgttaccttgtcttcagagatggctataggtagcaaaataattaaaaagaagattattttttttcttggcgaaattaaaagggtactactactatatatataagaaacaggagggtgattgaggctaataagctaccagtataattcagacactgtacaatagcaatgtaatggtgctgcttagtgcatgcatttcggagtggtgacagctaatgggcgagatatgcagaatcatgaaatcattagaggacaaagagatggaggcaaagagatttatcacgtgtgacatcaacgcccccaatgaacttaaaaaacaaacaattagtggtgggccccatccccaattcctctctctctctctatgcattggccattggccattgggtggttcgcgtggtccacgagcttacgccatggcacgggtccaccgcccccaactccctcctcctcctcctctctttctacaccaaattgaattcaattcttgcaattggattgatgaattcaattcaagctacaactcacctgaccaatgacaacaccccagcaacagatttgtcttttggcaggtacagacaatgtggatgtatactatatttaggctaaatttgcatggccaaattaaaggggtttgaaaaattttcttcccaacatatataaatcattggtctaaaaaaaacatatataaatcatgcaaaatgttctagttaacatggctacatgagtggaattatgtgtaagttcatatttttcagtgaacaactagtaatgttatcatacaaattaaaagagctaatctttttatataataaaagactgaaattattgtcccaacctctatatcatactagatgcacatttgtaaacaaaaagagatgatctttatacctgttcacctcaaaggtaataagaaagttcagttgcagtcgttcctttctttttttttctactgtgaccacaatatcactgtacccaccacttatattatactatgatcttagaacacgtgatccgtaatttagacataacccacatgcatcatccagtgaattaggaaagggataacaacactaattaattaagtatgcttgctaacgatggttagtaacctctcttcaaatcaaaggcatgaaatatatgcagcaggggtgcagagaaatgggcttgctgtgcacacattgaggttgggagtgggtgttgtggttagggatatgaagatgatggatggatgccctccatctcctaacaaccagtgggtggacctaaatcaaaaccaaccttgtcttagactttaaattataaatccatccctacctgctttgatcttcctttttatcctacttctactactactagctacttctactgcctaccatatttaaaagaaataaacttgtcctttttactttcttgtaaccacccactaatctgtgtttcaccttttaactgttgtgatcaccagggtagcatatacatattaactgtggaaaacaattaatggcatacacagtatacttaattaaggacgggtcaggtagaaacttttgtagggaattatatattttccataagatattatatgattacatatgtttatggttatttgcagtacatcaggacacaataaataaacaagaaaacaacaaataagtaaatgattgagtagtatacaatctggatgacaaatcttgtggtaccttgttatacaagatagataatcatattggtcgtcttgttatccaggacttaatataagagaggttttcttgcaagttgtagccagttctagaaagcatccattgttgatatcatattaaaatgagtgagcttaagataaaataattggcatgattagttcgtttgatcagtaagttgtttggccgccttggtaagatctccttcctttggtggccgtttatggtttcctttcgtatatgctaagccaagaacatataatccatgaagctgacatccaactccctgacaacacagtaaattaattactataaccagaagtaattagtcatacataggacatggcgataggaactagttcccaattgaggaatagtaattaactcctatatatactaatggctatatattccaattgattgttacaagcataatcttgcaattaggctaactctagctaccagatgatctgaaagtgcaattcagagggcagctgccactatatatgcaatatatgcaaatgctgtttaactagctaattaagatgttgttgctgatgtaggagtgacgtgggggtgattaatcaatattagccacacaaattaggagtacgtagcagggtagcattcagtcgctgtcatggtccttgaatttagtgttgggagctgttagtttctgcttgcttactcagccttccttcctaaactaattagtgtgctgttttctttccatctcttttcagatgcatttgtcgccattataggcctgattgctctcaattacagaggcttctctttgaattaggtgcccctaatgcgccacgtggccgccgcttattggacttgttgatcttagtctgtcaattttgtgttcatatactagtagattactagtgctagtcttgttccatttctcagagacagatcagatctctgcagaacaaaatcacacacacacgcctatggatatatgtagtggtttcaattctgtagcttatgttatcttatccaagctgatttagcctacactttagtttaactttatttacatgtgtgatgctataatgtaatgacttgttcaagctatgagaaaattaatcaaggaataaaattataagcagaaaaggaattaagtactgatggagataagccattgctatcagtatcaactgggaagataataaaggttaattattctctcattttcacagattacacaaagtgcgtgaaaagaataattaacatatatgtgtgtgcgtggatcgtttgtttgatgccgtgtcagtttgtaaatgactccagcgatgagtagtccacggtatagacaatgggcattaaaaatcttgcgataaaatccaaaaagtcgacgtatgattaacttaaattgacttaaccaactagatcacaatcaatgtactagtatagattattgttgtctctaccatgtcatcatccagaccaccaaatagttatatattcagattaaaatataattgctgagcctagaggattagaaacgtctaaacaatacactgattgtgccattattttagatagggcctggacaaacaagtcttgtcaaatgttgactaaacaaatacttgagtgtttgtgccacacaagcaagatccaattttccatttgcttaagcttaattattagtttgttgtgagagaaatttcagaagaaattgctattcaggttgttaatttaattcagcttggcagctctatgcgaaggtatagccatctttgaatatgcagagagctatttgggatcttagaccctgtcaaattaacaccacaaagcccgtgtccaaatcacaccgtgtgtaatcgattaaaagaagaaagcttagacatcaatttgcaatttgctcttgagcttttcaccatgaagatgatgcctgcccatctcaacgtatttctatatattccaccatccttccacagtttatctacctattgatgaacagttcatcaataaagcttccattgtcttaaaaaacagttttttgaagcatatttccttcaatgtttaaactgaattcagatggtagtttgattagggtccaaattcttatacaaggcatcattaattgcacccaacttccagttagcctataaatgatctgcaggtagcatgctaattaaacatttgataaaacactgcaccgtttagcgctgccaaaaggccaatataattatgtaattagaaattttatcacaacctactatcttgaccccctcaaaatgtttctgcaaattaaagagaagcagagaattggcatgcatgaagccagctagctgggacacatgtccttcaattaatctgatgacttacagaggatcatgggctcccataagttagttaattttcagatatttaaacacagctagtaagtacatatcatagtgcgtgtacgtgtgaatcataaacgaaaccgacctaacaaaattcgatcggcgtctctgtcgattgttttcagattttcagagaaaaaaaagaagaagaaactcagttggaaagttgtctctggaaagagaccaacatgacgagcttcggcaactcctaggcctatattgacaacatttcgttgcatcgacggtgatagatgcacgtaaactcacacaactgaaacatcatcttcatccagatgatgatgagatgatgaactagggcatgcagctgtccctgttcagatatatgcatatatataaatatatatttatcagtcatgcgtgcaaccaagagaaagaatgagcttagctagccatacatatgaccaagttttctgaccgatcgagacatctttctctatctccctttcctaccttttggagcaaacacatcgctttaatatttatggacatatatatatgttcacttcatgccactattgtattgcagttccacatatagtttataatagaagagtttcacaatcacaaataaggtttgaatagctgttctatgagcatatatgtcaatgtgactcctctccattcattgaaagaaacatctaaacacctccatggtgtatgtgttctccaagtcaaatgagtcactagggcatgcatttcaactgtgtacttgatacataaatcacatagtaatgagtacccagcatgcatatatagtacatgtgtactagtaatctagaaggagtattaagtacaactactgtctacactttactatactccatgtcaaggacaaggaggagaagatatagctaggatgctactcctatttgcacatttccagtgggtcaaagctttcctctttgttcagtgctaggaagaaccctactactggagatctttggcttttccagtggcaaaagtactacactacagtgaacacacacatgcatgcatatgatacaccaagaaggagaggatgacactgttgttctgccctgtcaacatttacttgtcaacaaatttgctcattaggctgctcctctatctgtgccctatagagctatgcatagccttttggttttggagcatttctgttgtctgttattgttgcacatttggcatctagcacagagcacaccactgaaaggaagttgattttgatatgtgtgttcggttttaagctctgaattagtagctcctgcaagcgtaagacattgacaatgacatttaacaatacatgtagctttccctaaaaaagcagcaagattagtgcaccgaaactcagcttgttgatccactacgcatttaaacgctactgtttcagctgatcaaggtctagttttcatgaaaggctgaaaccatattgttcatctttatttataacagcaacctgattattgtgcagttaacttatgcatgccccaatttctcattgcaacaaaaattaaaaaaaaagaaaatcagggttacagaaaaaacctgggacattatttatggtgtgtggtgagtgcagagcttttgcaggtccatcagaggttcagatatgatcagacggtgcaggtgcacttcaaatatgttgcagctttgccctgttcatcgcaacattctgttaagaaggcagcaagataggagttgcagctatcaattgcaaaactgagcaccattataacatgtgcctccaaaacctggtactgatggtctgatactggaagcaatgcaggaaaaaaaagcttttgctgatacagagatgctgactggttcactgcagggcccattgacacaacatcatcaatgggttcagttcagattagtctgagcatgcacccagctacagggctactaccggccatgtagataggcaggcatatgtatctgcaacaacaccaggcgccatggatggaccgagttcagtgcatcaacagtgcactcttggtactctagctagctacagtactcctgtagggagaaagactgagacatagaggggtgcatgcaattggacagggcgttgttctatatgggctgtacagtgctctctccatttcacagtgattgccattttagttttgtcgtaagtcaaacatttttatcttttatcaagtttttaaatatttatgtggtttggcaacataggaattatatattacgaaagtatttctcatggtgaatctaaagacataaaccttatgatattaaactatatgaatttctataaatttatgatcaatgatacagatgtttagcttgggagaaaggtagaagaacaagtaaatttaaaacagagggaatagctcaattgtaaatgagcacatgtataagtacaaccatcagatcaaataataattagcagatgagaactaataagagtagttgataaatttctgtggcatctaattggaggctgtaagagtactgaactggtccatcttccaaaacactcaaactagcatgctgatatcatgcaacattacaacatacatactaccatggaactgtacaacagccgatcggcaacatataaatatgtgccctcttgtactttgcaagtagtgttatctgttaagcatgctcatatcattatcatgctgttctcctctcaattgtttggatgctaatatgctatcttggctaggatgtggtgctgtatagagtccatttgtctaagataggtgcaaggttctttttctaatatttttttagtatctagtatatgcaatacagcagggtttttgttttgaacttttgatgttgccaaaagcatgtgaatgacagactgagtttggctgaaaaaaaaaaacctactggtctttgccgacagcatttctggtgctcaattagcatgtaaaaaacatgtttttgcaaaagaggcctgctagctaggcagagtccttactgactctaatgcatgcaacaaccaacagtagacagagtccttacaacctctagtagtaatataaagttatagccttttgattactgtcatgagtttgcaggtgtatggtgtatcacagagagggaaagttcattagcacaaaaaaatttccatctttttagtaccttacttgtgtagatgaatagtttctggatatataaccagctaactgaaacaagttagttttattttcaggataggcagctgcttaattagttggcgtcagcctctgtggatacacaagaatatagttagcagacgctagtagcagcgtgaactgaaggatagtgacctctcacctgtaccggtagcattttaatttcagcatgcatgaccaaatggcatcagtgtgctcaggtagttagaggttggaacgctggaacaataaccacctcacaattcccctctcaaaacaaaaaaaaacgtgttacatgcatcattacatatcttatacagacataatttgtatcgccttaatgtaattggctaaattcaatgaaactttccaatatctgaaaaccacatgtgctacaatacttctattgatcgagttatatattcgttcaagaact

SEQ ID NO: 76612 - DNA, 698 bp, Oryza sativa
tgagggtgtatcaaagtaccagtgtattaaaatgtcaattcctttagtagtaaaaatgcaagtttacattctaaatgtcaaacagttcaacacggtaaaatatataaatataccatggtgaacttgggtagttaaaaagtcaccccctcaattgttttttcactaggaaaacaaagaatgtccaacatcgaaagttcgaaacattgtagcttcccacgtgatggtttctcacgcatgtatagtaattggtcatgacttgtgactatatgatttagggtgaaaattcttccatttgatttactcatgttataagaagacttttcacaatggagggcaaaaggaatagactgaagacttacattttcattcacaccggtgtcaatgtttctttctttcttcagaagtcgttctgattcttcaaaagtctccctgctgcacaaactttctagtgtcagtagtaaatcagctagccgaacatttgagcctacggcatattaaacaacagatggcgatgtatttgttttcttttttcgaggtaacggaagggagctcctacattacactatagaagaagagagttgatccagtttataagggaaaaccggaccctaaaaccttacaacggcacggttaattatggaaaaccagcgaaaaccccggccttggacatactgaccccaagaccctaataacagcag

SEQ ID NO: 76613 - DNA, 623 bp, Oryza sativa
atgatattggttgtactgggctgttttggtttgatgacaaaatttgccctacaaagcactttaaatagtacattgtagatatttggattgatgccaaaatttaccaaaggtaatacaactcctataaactaactctattaaaatattagtagtgctaaattttagcaataatttaacactaccagtaatttgctaggacaccaaaccaaatgatcccactctttctaatgtttactagtagtaccacttgtttaatgttttttttaacggggacgatatggattgatcttgtgagtagagaagcagcagcagcagcagatctttggtgaagcaggatttgccgtgacacaatgaccgatcgatcctccgttatacacacggtacacacaagcagtccagattccagtctccagtccatatacacacggcacactggctggagtagacaactgcgactcgtgtatccatggagtatgcatgacaaacaacaaatttcagcgaccccgattagacgtaacccctctccgctatactagcctgtgcagcggcagtagtccagcctacagaggtaatatgatgtgtcctgtactctgctgtgtgcagctagttacagctacagccag

SEQ ID NO: 76614 - DNA, 3991 bp, Oryza sativa
tatctctaatctgattcctacgttttttctgtagtccaatcaaacggttattgctgtgtttttttctgtgttttacaatacttagatttgaacatgtattatatcacctatgtatttcctattcctcggtcttttttcattcccgctattcaaggaaccctaaagttgctgtcagcccgtgacatccctgtgatttccaggatgtgcatttttccgatgcaaataactcgtctttgatagttagcttgatagattatcatccacacatccaaaacttaaattcccagacgttactttattttagagagttatttttggtgtttactcattgtatgttattttctggattgacttttaaatcactactgatattaagttttctggtaacttttctggattgacttttaaatcattactgatattaaatttttagaaaaaaatatttatttataagtgtttaggtggtatggatggaaggaacgagaccctaaccaaatgcaatactgtacagtttgttgttgggagatcctcgtgagttctaggatccacttttccgtcgtatttttcttcttcctgacgcgaattataacaacacgagagtacagtcgcccatattcatcccatcgctaccgtccgagagctttctcgctcggctgacggcgaccgccggcgccggtgtcgccacgcgccggcgcctccgcccgcttgctcgcacgcgggccggtcaagaggcccacgccgcgtaggcctagctagctagctgtatcccgccgccagcgcgcgcgcgagagagagaatagctaatacctcgctccccaatactattttgatcaacgatatctataaaactaagatgttttaaataaaaaagagctatatattatgatatattatttaataataaatctggtagcattaattttatattattgatctttttattttcttatgctattaatagtcaaagttacaaatatttgacttgacactatactaaaaatatatattttttttggacggaggggtagtaattaagaacatactccctccatcatataaaaaacgaatctagaaccgaatgtgacgtattctttagtatgtctagattcgtagtatatgtcaaatctaacagtgaagcaagcaaaaaaaaatgtgtataaacatgacctgtgttacaactagagaaacaaaaattaaatgaaaatcatgcagcacctgtgcagtgaaaaaaattgttatttttttcttcataaatagattgaatttagacttatatacaacacacacacatactcgccatagatatacaaaatactttccgggttggaaaacactcccctagaccacggaagcttcaaccccacccccacctcgcgcgagacgtcagcgacgacgtccgccgcgcgccgctaccgctacgtcctagcgctagcgcggcagctcgtgtcgcggtggaaaacgcccacttcgccaccgctcgcgcgcgcacgcccacgccgctcctcccctcccctcccccgcctccgtataaagccgcgcccgcgccgcgcacgccggccggccaccgaggacgagctagagcgcgcgcgccgccgcgaaacattagctatagctagctagatatagccggccggcgatcgaggagatcgatcgatcgaacgccgccgcgcgcgcgcggtcatgacgccggcgagggtggtgttcatctgctgcgttgttctgctcgccgccgccgccgcggcggcgtcgtcgtcgacggcggcggggatcaccagggccgacttcccgccggagttcatcttcggcgccggctcctccgcttatcaggtagacacgttttttttcccttttttagcgcgaactcaaccaccaagcaaacctgatcactgccgatgcatgcacagtgcacacacatctatctcttgctctacaaatcatgcaaaaaagaaggaaaaaacaaaactgtaactagatacaaatcggatggagttgaatctgttgcacaaattaattcgaaacattaattatatttctcgcatcatcgatttgctcgttagaatatcagagagtacaaaattttactgtcaacgcctgtccaagactgcaacctgttcgtcggtatgtccaaccgccacactatctcgttcgctattcctgtccatgtgttccccctgactaacacgaaccatacaaaataacaatataaaattcgtcgattcaacgagcacattcgttgtgccctttgttcaattcttggataaaaacagacggatgaaattcagagtgacttttttgttaacctctcgctttcctactgaactttaatcacagaagtaggctttgcttctttcttcgtttaacctttgtgctaaccagtgtcactctctttatgacttgttgtttcacgttagtactctggtaatatgcaatatatgtcggtatgcaagaaattcattgcatcgacgcaacatttcagtacttgttccgtctgtggttaactgttcagctgttctttagctttgttttgtacttaagagagtacaaattgtgaactggtgatacactgatactaaaactcctaaaagtcccggttttgcttgcttatgtcatggctagtccaaattcagccatcataataaccttttgcacaaagcaagggcataactccacaagagtcagtgtgcctgacgagccgattaattatacctggtacaatttatattcaagtattgttcgataggaaatatgtacttattaggcactgcaaattggtaggagaattattgaaagctgtaagatattgtcttctacaccaacttggctccgagaaacataagaaaagccggcgctgcataagtcaatttccccaagtactagtccatgcatctggcttagtttaatctgctagccgacaccttgttcttattgtttttctcgaaaaaagaattgctagctcttctggaatcggtgccctattttccatttttactgatttcatgttgcgaattgtgatgattccttggtcctttggtcaccgctaacctgcaagcagaaacaatcaaacaacgctcaccgaatacgactctcggcgattggtggcctctagtgcacaatcttgctttgtttctgacgaagatgtgtttgtttccatcgtcttccactaggaacaaaaaaccatacatgtcgttttctttccggtgtcacttgaatggtcttttctgcatcttccgtttggcatcttgcctttagagagagtgcataagtgtatcttgctaagtacaagtcgcagtggaggcctgacatttggcagattcagagaaatgcatggcctgaaacctatgttgttagaacagggaaaagttgtggtgaggtgagatcagtagatgttactatcgttgctttcagctgagttggtggtaaggaattggggaaaatgcattttgccaaataagtcagatgtgtactttgatttgattctctgagggaaaattagtaatcgcactgcattagtagtcatgcagcaatttcagtatattggttacaggtagaaaataattagcatcatagtaccctcattgataaggttgtgaacggttcaaaatggtgcatcataagaagttatgctactcgacatgttgatcaagatttggagtgttgtatagcatattgtactgacctgaacattcacaaaattgcttaggttgaaggtgcatttgcagaggatggaagaaagcctagtatctgggacacgttttcgcactcaggttagtttggtctaagatttacttgtgaaaattgagtctgtgtctacgataaatttcaaattcttaaaattaacgagaactttctaattctattttccacaggctattctgttgatggagcaaccggtgatgtaactgcagatcagtatcataagtacaaggcaagttcttgggacagttctggttaaggttttttttttcagattacgagcatgtcaatttctgaa

SEQ ID NO: 76615 - DNA, 3725 bp, Oryza sativa
gatgtgattagaagcaagggttcagtgacatgtagtgattgtgggtcccatgaccataacattcggacttgtcccaaaaaaaagagaagtcaaatgcaacagaactgatgaaggagaggaaatatagagaactttagggacataaaactctttgggtagcaaaaaaatgactagcctatgtcttatgagtagaaacatcaagaaaaatggcattccacagtatgtctttaccccctttttgtttgcgtgttttttggatggtgcaaatacagttacatggttggctttgcaggcataactgattgttaaaaaagaaagaattgcttgtgtgaaaaatggcataccgtagtttgtcttcactcccttctattgtatttaatgtatatctgtcctcccctcactccctacccccccacccccaaaaaaacaattgaacctgcacacagttaaaaagagaaaaagtatctctcatcagatatctctcatcagtgagacgatcagtatcatgtaaaacacataaagaaatcctaaaaaaatacatgtccttttttaatatttgggtgttatgatattggatttaccatatctagtacaggaattaagctccacatagaaaacacatagcacaaaattttgctaacacatgtcctagagtttacaactcagctgtagcacataaaacacaagcaaagcacaaagtgtttgtatatataagtgtatcttgcatttgtgcaccaaaacaaaactgaaactgtatgttactagataatattttttttcaacaagttgaggactgacataaacccaaactgcatgggcttgaaaaaacaagaaaatatgacatctctctctctatctctctctctcttactaccaggtagtgtgtggccccatctcatgagcttgacagaaaaaacaggattgtgtaatctgttggtacacaaacaaaaacaggagtttatttcactgttgccttgcgtattttccatgctttgttggattgaagcttctagctagcatttttgcttcttcttgtgaactgtgttctgagaacaataggtcatttgcaatttgcttcctcatgtttgggatatattctggtttgatcatatatttcaagtgcatccttgggttccaccattccatacacttcatagcgtagattccgcaatcatggcttgatgagacaaaaacaaaaaaaatcatttaagaaaaacaaaaatcatggaaaaaagggaggagttttggacaaaaaaagaaaatgatatgtaatttggggatgtttgttggggttgataggcagttacccattgttttggcgagtaattggtgggtattggatatcaaatttactaaaatttttctccacatatgagaattcttcccacattgcaatgaatcctggtatctgtgtataacaagaggagcatgaaaaaaaaataccagaaaaaaaaaatcagtggatgcatctataaaaaaattgtatggaaaaaaaaagaacaaaatttgtatagctcaccagtagcccttgaattttcttatgatatttgttgttttcatcataaatggagtccaggaagacaaagtgatgccccttgatgtccacagtaaacacaaaccaatgattgtcatacaggcatgggaaaataagctacataacataaaaaccaaaggggcatcactttatgttaatcacacacacaaaaaagccgatcaattttatgtttgaaaaagaaaaatgtacaaaccaagtcatagtagtgcagaggtttcttgttcctagcaaatgtaaaggcttgtcttgcacaattttcagtcttcctcttttccagtaccttcccaattcttcaagaaataaacctgtggaaaaaaaaggtagagaattttgaagtgctacaactggagatgagaaaaaatgtatgtggtagaaagtatgaaaaaatcacatacactagttctgtggaagaagtaaaaattcctgtattcattttctttgttattctggtcgttggcaatcttcttggcatatgcattgaggacatatgtatccaccactccccttggtgatagagatttagacaatgatgaccatgtgacttttacattgtccattagaactgcaaatttgatgtaccagaaataaagaagataaatgcttttagtaatgcttagtactcttaaggcagaaagagtacaaaacaaaaaagtttagattacttaaattcagaaaattgaaatagtcagcacatgctctttgttatgcatattatgaaaaaatgcaaaaataatttgtaatgtcatagatttttcaccttctttgcatgccttgttgtgttaaacaaatagtgataaactttcatttggttgttaatacaaaattcagctgcgcctaccacttcaggattatcatacaaaatataaaatctaaatcaaaagtggaaaattagtgcgacatgtatcacttcagcggtgcatgttctactctatgttatgaacaacatttgtaaaaaactacagaaaacaccccacctcccatttctttttaaataaaaaaagcttgaaatgatcacaaaatctaaaaaaaggaaatgtaaaaaagcaaccattataatgctgttttgtgacacttactatttatattgttgcgtctcaccaatgctgagtatgttgttgtagtgattgagttcagctgccgagatggtttggtgccgtgtgtagttgtcatatggtgagctcttgtacttacttggatggacaattcttttagggcgataaagattgtgtctggtaccagagcagttggcagaagcatttagtgagtcgatgattcttatcattgaatattgtctttcttctgcttgagcatgttgatttggttccctcatttgtgctattcttggagaattcatacctatatcaggtgatgattgtgaactctgcattaaaaaataaaacaagtgaaaaatggggaaaaaaagaatttattgtaataatgtataaagagtataagacatagttttatgtcgtgctgattgaaaaaaattaagcaaaaaattgataggaaagtacttacaatttgtattacttgttttgtagcaggtgtccttgcagaagcaatgtttatgtgcagtggtgtttgagggctactttgctcattgtttatttgttgttgttgcaacgatgaaaaataaaagtaaaagaaaaaggatatgaacttcaaaggatgtgtttgttgttgtgaactcgaaaggaagtggtgaactcaaagaggtagtggctctgaactgagaagatgatgctctgatcaaaattgcaattgtggactgaccttccaaaaaccaacaaaccttttaggttgtgctgttatattaaaagtttaggatcccaagatagtattatatttttcaagtgccagcttttgctactagtttattcctccaatatatacttctatactactacctccatctcataaatataaaaggaattattccttttttgcataagaattattctcaaaaatactataataccagtgttaaaatatcagaagtttagaaattgtccagtaaggagcataccccaaaaagggttgatgtttgaaaaaaaaaagacaagtaaaaaaaatcagaggttattatcgcatgttgttcaaccatatcggtactcgttttcatcacagtgctgtccctaaagcctcctattccccatgtttgcaatgaagt

SEQ ID NO: 76616 - DNA, 10377 bp, Oryza sativa
cctgtgcaggcagtcaaacagaatatccttatatgggagtatgtgatagctctcagcaacaactgttgttgtagggtatggatgtttttcaactacaggaccaatcatcctgttaaacaggaaatgaaataggaaaaaaaaatgaaaacgttagaaactgttatactgagaacagtagaagctaccagcaattgaaagacagctacataaattaggctgtattcggaaggtggagttgggaactccacctccccgcatggaatagcgagtgagtgatcaatagattttttaaagcaactttcgtttagattttctttgggggggggggcgcaaaaaacacactatttagcagtttgaaatgcgtgcgtgtggaaaacgaggggagtgagttgggaactcacacaaatgaactcggccttaggaagtacaattagccaatattttcatgattagtataataataacaaaagaacatcaagcatgcatgtaatgaagtttagtcaaaagctcaaacgagaataaaaagaagagctttagcacctagcaagcacagcattcaatacaatagaaatgtttctaaacaaactatggactataaaggatataaatttacatcaatacagtaatacacagtgagcagattttgtttaataaataaaaccattgttgatcagagagcaaattcgcaagtgtgtaaacagcaaacctcttgatcaattcttcaataggcatttccgcgaagttgccttttgcagtttgctcgtactgtaagatgaacagctttgtagttgtcccttttttagtcaatgagtatgctaaatgctcatcaagaagacgcaagcttgaccgcttaatctctattaagaaaatcacagaaatgaaatacattaatttcagttatatgattcataaatgaaaaataaagcagataaaataatatagtcgaacagagaattggttgatatcagcccatatcatttacaagggaaattaaacactacaatgttcctagttatttattgatgtatcagcaatgctataaattcatgtttcgggaccaatagcttttctggttggtaattttcaactaaccaaagttttcaagctacataggcatggtccgaagctaattgaatagttcaaatcgaatgaaactaacatactgggggtgcaaaagtctcaacggatgaagcacactgataatgaaaaaaagagggcaaaatttgtttagttaagaaaatagccacacatggaaaacaaaatagagcaaaatggtatagtaacaacctgttctacgctccacctctgaaaatgctaacttttggaggacatatggtccagtctcttcattttctaaatcttgtccttctggcttgttgctgccatgctcactagtgctagatgtgtcaatctctttctccaaaagggagcgaacatttttaccgacagaaccactctccagcagacatcttttcctagttgaatcaagaagaagcacagcgacctttgaaattggccacatggccatgtctggagagtcttggtttgcgtcgagggcttcagcaattccacacgcatccacgactgctttgtcagtcacagagagattcacaccctccccaggacttccagaactcttctcatgttggtggaccatattggagtacgcgagcaaactgtcaccaagagtaagagatgcacatttgaagaacctcattgcatcagcaaaagcaagctgtgggaactgcttccggtggtaatagttatacagaatgactgccatatgaacctgcaaaaacaaggtggcacaacgaggaagtattcagccgtgtattacaagttgcctaaagagaatgcaatgtatgatgcatagggatacagtacagaatgtaagagataaaaaatcaggtaacatggcactcaattttgccatatttgcacacagctacattacagaatataagagataaagttaggtaacatgctactctataatgctatctttgtacacaactataatacagaatataggagatgttgtcacgcctcccacgatcctgcaaatttttttaatcaatgagcgcacccccccccaccccacaaaaaaaaaccaaaaaatttccatatattagaactcccgagatttcctagaggtttaatggaaacatctgaattccctttcctcttgaaatttgaaaaatcccaatccctcctcggaatggaaaaaaaaaacacaattgccagaagagggaaagccttcccgatctggaacgtcccagttagtttacgtcttccctcttttgaaatccgcctccgtctattcgttggcacctacgcccgcagccgccttctccgctactctcgggcttgtcggaactcggaagcccatgccaaccatcacacgctcacggcgcgccgccgccacaccatcccgctggcgcgtcgcggcccaagccatggcgctcgctccgcacgccgcgccgcgccgtcgcagcccgcggcgcggcgcccccacaaaaacaagctaacaaacccgcgccacacgccctgatcgcgtcgccgacggcgaccaccacccgaaacccccccaaacctcccatagaccccgggacccgaaaccccaccaccaaagtccatccattctcgcatcgcaggctcacctggcgcgcgacgtcggcctggttctccggcgtcatcctgctccccttccgcagcgccggccgcaccaggtagtccaccagtatccccaccgcgtcctccatctccaccaccccgttcacctccccaccaccacgacgctccacctccatcacccacccacgacggattaaaatacaaacaagagggaaaccaaaccgccgccgccgccgtcgccgtcgccgcctcgggatccgcctccgcgacggcgaggcctccttttatagagagagaaggcgaggcgagctgtgtcggataggcgcgaagggacgcgaggggggtaggggggtgtcgaggcggaaatgggaaacggtgggaggggggtggagtggggcccacgcgcgatgatctgggccgtccgattgtcgcctgggcggatctgggccgtccgttggcgccgtcacgagaggagcgtgcagtgcagtgcagcccagcgaggcgagaggggagaaaatgatgagcgggttgaaggctgggttgggttgggtgcgcatcggttacggcttacgaggcctttggagctgggagacgacgggacgggacgtgtcacctttggccctgttcagttctcacttaaaaaattttcaccctatcacatcaaatgcttggacatatacataggttattaaatatagaaaaaactaattataccgattgcgtgtaaattacgagacgaatattttaagcctaattgcttcatgctttgagaatgtggtgttacagtaaacatttgctaatgatggattaattaggtttaataaatttgtctcgtggtttatatgcggaatttataatttgttttgttatttaatctaccgatgtgacacgctaaaaattttcaacgtggatatatattgtgaatggatgttgtgtgatgggatgcgatggacgggagatgctgaattgctgatgaatggggccggtaagcaggggtttcttttcctcgtttatttcatttgtatttttttttaaaaaattactactttcttcgtttcaaaaaccttgtctaaattcatagcgaaaagttactatattttattttagaatgtaagcatgtttttttcttgtttatttcatttgtaatttttttaaaaagaaattactactctttctgttctaaaatacaagcatttgtccaaattcgtaacaaaaagttattatattttgggttagaggtagtactatattctctctgtctgtccaactgaacccttagatgctacataacgtaaccattacattgttgctcacatgggtgacatgaatgttactctctccgtccctactagaaaatatttccgatcctatgttcttgtattttatgataaaaaaagtagatgaatagatggatgggtcatgaactggtatcgagggttccatttgaacgtagtaccacaagtttaacatgatttattttttaaaaaatagtttaattttattttgaaataattagaaatttcttcgttttttaaagaggcattttttttcctgttcttgatgtggacacttacacatctctttgtgttaatgtagtttgcactctttttttgatggtttgctgctgagttggattctttgctggctaggctagaatttatgataaataaaattattttataatttacaattatgtttgaaatgggtgtaattaattgtgggaatatttcaatattggatcctaaagagagggttggataggcactggtgtgaacaagttcatatgaatttctattcttatgtttttaggaaatggttgattacttgaatactccaggctgtgttttgcacatgaacatttcgtacgaacctattgttcacaccagtacgtgtcaacccctctatttaaaaacacagcctagcatattcacgtaacataattagtctttcctttaaaacataaaaatattgtttttatttgaacctattcatacccagggatatccagccctcttttaaaacaaatcctaaaagattcacacaattaattatacccattgaaacatagttgtaaattataaaatacttctattccttcctttaaatctttcacgggaacatgttcacaccatacatgccaacctctttctttaaaaacacaacttagaatatccatgtaattagtccttacttaaaaacatataaatagaaatttcataggaagttgctccagggtttacaaaaccggctgcaaacatggtaaccggcttacctccatggtatagtaacagttaaactacggtaaccccactaaattcaaataaaaattaaaataatttaattttttgataaaattttgtacggtttctcatggcaattactgtgcggtaaccatgcaaaccgccaaagtgtggtaaccctgccctggacagtaagggaaaccttgacgtgttcatagtagagcatatttggcctctttacaaacaaatattaaaagatcacacaattaattatagccgttaaaacatacctgtaaattatagtatttaataatttacatctatgttttaaacgatataattaattgtgtgatctttcgagatttgtttcttaaagactagcgcaaatccgacccctttggaaaaaaaatctcgaaagatcaagtaattaataaagctgtaaatactataatttacagctacaccctccaatcccgaaagagtcaacttatagtgatgaatctggacaagcatttgacaagattcatctctaaaagattttttttaaatgaatggagtatgctttaatgggtataattaaccgtattcgagatttgtttcctaaaggacaacacatatctggccagccctctttagaaacaagtctcaaaagatcacacaattaatatagccattaaaacatagctgatcttttgggatttgttttaatggctatattaattatgtgattttttgggatttgtttctaaaggggtggatgtgtgcgggtataaagaggtatatatgaaatttttatttttatgtttttaagatagggtaattacatggatattctttgaagagaagggttggcatgtattggtgtgaacaggttcctatgaaagatctaggagtataaatattttaataatttacatagctatgctttaatgggtattggtgtgaatcttcctatatttatatctaaacatatggctaaatatgcactagcatgaacatgttcttatggaatttctatctttgtgtttccgatgaagggttgatacgtggatattccaggatgtattctaggctgtgtttttaaagagagggttggcatgtccaggctgtatttcgggttgtgtttttaaagagagggttagcatgttcaggctgtattccaggttatgttttcaaagaaagggttggcatgtgctggcgtgaacaacaaaacaagttcctatggtaaatttaaagtaagtgttcaattatgtagatattctaggattgtgtttctaaagagaggtgttgaatgcattttaataaaacaacaaaacgataaaaagaaattcaatcatttaccttaggattctaacttgttcagttgttcccatcttcattgttagggaagttgattctaactattgtttaaagaaatggttctaacaatcgaatagaataatgtaaaatagctaaataaatctacaagtcaacacatgtacttaatttactaacctcaagtgaataaaatttcttgatctaacctgtgagatggatgaaacacaacttgccgatatgccaccacaactaatttaaccgatgctggtgtttgacgcctagctttactttggcgttgaagatctgccactggtagctagtttcttccttatctcttagatctagatgacacaaaaagattgagctagtcatatcatcataagcactaaatcaaatacaaggaaaagaacattaacaacgaatccctctccttacccataggtttcaggatgcatgccatctacgccgatcttgttgcgttaggaagtggtttggtgggaagggaaataacagggagacaatggaaagacgagagggcaagatgtcattttatagtgaattattgggtctcgtagccatatcgtgaggttaagcatagcgaagtacagtggacccatcacctcatagccatatcatgaggttaaacatttcttagtacggtggacccaccaccagtctctcacgaggttaagcatatcgaagaacggtggacccatcacctcatagccaccagtctctccgatgttccgttaaaagaatttcatcgaaaatgcccactttagttagaattgactaagcttaaaaaaaaaattggctcgacaagtagagtcaagagctaaaattaaaataaagcgcttgtttggcactctaccgcttctagagttggagtccaaccaaacaatttcagcttcaccaaaaacagaagccaagcaaactaaagtgctctcataaaataaactagcaaggtggagcaagatctagactgctctacaacttaactctaaatccaactcctttgagataaatttaagagttagagctatcaaataggcttgatgtgacttgtataacaggtggtgctcacatgctaatgcaacgtgtgtaacacatttgaccgtttcaacaatatttctctaaagtgagacacgcatttcatcatttgtaccaaatacgtatcaagaaaattaaactatgttcacctctacctgaaactctccatcgctttctcttctgtgtacatgaggttaggttagcagtttagcacaccttcaccttcaccgttgcccctatccccttccattgacacggccacaccgcggtggcaacttgtgaagcagtgtaattgatacatatacggtacttcctccgtttcacaatgtaagtcattctagtattttctatattcatattgatgttaatgaatctagataaatatatatgtctagattcaataacaacaatataaatgtggaaaatgctaaaatgacttacattgtgaaacggagggagtacatcacaaggaattgcaacccaatataatatctggaataacatacgatgcacaagaacacaatattggagtaatatcagtgatcagttatgcccaaggaaagttcataacaaatgtagctaggcacctcaacgcccagaatcacacgaagatagaagatatctccattatgacctcatggaggccactgcatgcttcaggtttgagaagaaatagtggtcctgtaccaggaccagtaatttatccgcaggggatcacatctctgcaatattgagcagattgcagtcgcaagatcagcatctactgcttcatctgcttcaggatcagagttctttattgcttcgatagttcctttgagttcatctgaaggttgtaaaccaatttgaagaagatcgagcagcaagctcaaagcaaatacgcaggtcgaatcatgtttcaggaccttgagacaaacatcagagatgcgctcatcagccatcagcaagttattttcacccttgtacaggcctttgaggtatctccaggggctttcattctgagggttagccagaatagccccaactgtgtaatccacttccgagtcacgcattgctgcaaggcctccaagaagtggtgaacttgttattacaaggtatctctgttgcaaaacaaacataacatacttcagtgtaatcatttgatcttagttaatcagccaaaaaaagtcagaaaggagacagtagtaggacaaaataccacgtaaagcaagaagagaaagaatcaatgaatttagttaataaatcatgaaccggcatatggattttcagactactattcaagatgggacgaattaaaagtgaaattgtataataaactagaaattttaaagccaaacaagcatatcaactgacctgattccaagctgaattattgaagacgtcttcctcaagcagctggttgcaatactgtagttcagtctcccatccacccagtgcttgaagaacccactgcagcagtaatgatacataaattatattattagaactcagctttccctcaaaggtttgctcagtgcagcactcaaatatagataaatgaactcaaacgagtatcaacagcctaattttagcgcacatcgagaggaaacattatatacctgcctatgagaccaagcatggtaatttttagcatccatagaaagtatcttccttgtaaattcgtgctctttatttgcaatatctggtcctaatttctccgcaagccatctcttgtgatgcctgagaaaatatatatagtactgggacgttaatcaagatttcccaacaaaaaagcagaagaatgaagttttaattacagaacgctcagaattaatgatagcaagtataaacttcatgaaaaactccacagctaccaaatatgggtataaacttaatgtcactcaccagatttgataattttttgggttacattcagcaattcggtccacaaaatccatttcctcacgcagatcagcatccagtgcctctagaacaagacgcctaaaatgccacacctatcaagcaaaaaaagatcattaagttcaaaactggcatccaaatgaaatgcatgacgctaaacacataacaaggaaagacaattttacatgccaccatgttttgttgcttgttaaactcagaactgggagaaatttgcacattctgcatgcaaaatgccaatgaggcaacaacagatggctgagtacaaatttggagggagcaaacaaagtaaaagtcctattatggatatggactaaaagccccaaacataatttggtacagtactacagtatattttaattatatttatctttctgatcatgaaaagtacagcggaaaaactgaaaatttgataagtctgaaagagacaccaccacagtatgcagattaaaatcaaacactaactgttttctcctgctctaccataaatctagacattctcaatgcgtccacaagaaaaaaaaattaatcaattttcctaaatttgtcttgccgcgttgtgtctccaaaacaacattatatatgctagtcaagcttgccatcacagttatacttttataatcaaattccgaaatagataaatccgccaagataccactagctaagccggaatttgccaatatcccaacatgctactcttactataacaagtgaaggctagttctacatgtacataggccttgtttggatgctccgagctattaaatagccctccggaatcttgctatttagaagtattaaacatagattaccgataaaaccgattccataacccctaagctattttgcgagacgaatctaatgatgtatattaatccacgattagcggctgattactgtagcatcactgtagcaaatcatggattaatatacctaaacagggccatagttctaaatgagcaaatctcctgcactgcaaattcaatttccaacatgaaaaaaaagggggaataacacgagcaatctcaccgtgtagttgccgggattaaggtcgatgacctcggcggtgaggtggagggcgcggacgctgcgctcgccggcgaagtagagggcgcggaagtagtccatgacctcgcggaactcgtcccggtaggcgatggccaccacggggtggggcccgtcgtcctgcgtcacggggaccacgtccgccagctccggccgc

SEQ ID NO: 76617 - DNA, 656 bp, Oryza sativa
ctagtatgaagcgcgcgaaattaccgaagcagcaggtgatggcgttgggcttgtgggtttgaagcttccggcaatacaatgatctgcagaactagcttctgactgggcatctgtaactggcagtttagttactgtttgtctggctagttgacaagacattgacagcctgtcatgacaacctctatcttcatccactggcactgcttccactggttcattttccaatataacttcatgggtattaccgttgggggtaagctgcgctccaggaacatttaacgtttcatgtttttcttcagaagttgggcagaagttttcattggaggcacttctaaccacaccccctgaggagaatgctccagctctatcagtatcagcaacaacattttgagtgcaaccgattttgacaggattgactgtgtctttgttaccagttggatgtgtggaatcataagcaaggggagcatggtttctttccggacactttgagagcacaacagattcttgaggaagcacttcattattcaaagcattagcagtcatagaggttaagcatgaagaagatacgactggaactccctcctgtgatccagaaatttctagtgaagtaccaggtaatgtggatgcaaatgacatagagtttacagcagttgcat

SEQ ID NO: 76618 - DNA, 6327 bp, Oryza sativa
gaccttttcaagaaaaccggtcttcgggtatctaggcatggtttatgccatgataagtataggtgttcttggatttctagtttgggctcatcatatgtttactgtgggcttagacgttgatacgcgtgcctacttcaccgcagctaccatgatcatagctgtgcccactggaataaaaatctttagttggattgctaccatgtggggaggttcgatacaatacaaaacacccatgttatttgttgtagggttcatctttttgttcaccataggagggctcactggaattgttctagcaaactctgggctagacattactctacatgatacttattatgtggttgcacatttccattatgtactttctatgggagccgtttttgctttatttgctggattttactattgggtgggtaaaatctttggtcggacatatcctgaaactttaggccaaatccatttttggattacttttttcggggttaatctgaccttctttcccatgcatttcttagggctttcgggcatgccacgtcgcattccagattatccagatgcttacgccggatggaatgctctgagcagtttcggttcttatatatccgtagttgggattcgtcgtttcttcgtagttgtcgcaatcacttcaagcagtggaaagaacaaaagatgtgcggaaagtccttgggctgttgaacagaatccaaccacactagaatggttggtacaaaaccctccagcctttcatacttttggagaacttccagctatcaaaaagacaaaaagctaggcgcacctctcctaactattgcccataaaaaataatatatttaatattattatatattatatatatttgcccttataaaataatatatttaatatatattaattcaattttctattgtgtgaagtaaaagaagaaaaggtctaggctccgtcatgacggaatctaagataagaacctaacagaacgtaaaaaatgaaaaaagattctagactgttaatgtcttggctctggaaggagatcgcgtgcaagtaaactaacgtcgttcgttcggcgaccccgcctcacttcacttaacagaaagggggccctattgagaattacgagcatcgcataacagaaaatctatttacaagctattgattctccgactaccaattctcaggtctgtgcttcggttggagtcttggtccgcgggtggaggttcgcgagggggatattctgaaccagccgctatggcatattgccagccgatacaacttaaaagcgagaccaaatactctatactattactctaaacatcgaatgcaatgagaaattcttcgacagacggacttagctgattgatgtcataagcaatcttccacgtatagcgaaatcgagagttcacgctcagcgtgaaggaaagcacttctactttctcagagctccccatacagtggcacatcaccagccttgccttagttctcttctcgttcaatgctgtcttttcagcgctgatggaagcatgccaaggtgaagttgacgatctctttagcctttctccttctcttcatcttgccctatgagctcatgcagtgagtgccgcaggatgatttagttctgagcgagggcttgacccattgaggagggcatattcttctgcatctctcttgtcggatcgcctccccgtgtccacgtcgtcgaagagatagtctttggaccccaatttcccgtcgtagggagcactcttctgagcccctagattcgccgaaggatgagatcttgcctatgcagtaggatgaacaggaaagttctcctccattgagacccgtggaagactactactttttcttattgaaaaaaagagctttgttatcttacttgctggctagtaaacgctacccctacccttgaaaacttgtttacttttaagggccggagtttacttaaattcaagagggacttaaaggatttctaacttaactgtcctgcttactcattggatgaattgacagagtctcttgccctttaccttggatatacacaagattgctcattcgctgtaaccactagttctagaactgaataggaaaagctatatggcactcaaacagaatggatagcaactgaaactccaagaggtagtatactaatatacttttttccctaaaaaccggctttcctaagatgccttttggtctaagctttatatctatcctatcgctctcttgcttaaattaacttccttccttaactcagatctaaatggcttcctttggatcgacattaacttaggcgtaggtcaaagcacgggcatggaaaagggattatatggcgtgctgggctggatgaaagaagcaactacgcctacaatgagaatagcgggactcccactagctgacagagaactcccagccaaaatgaaactggacttccagcaatagcagcaatgtcactagaacctttcctactggagaataactagaagtttctggggcccttaaggtggaaaaaaatgattaaaaatcaaccatgcttactaaacaactcaatcatgcactcgttatgctccattcgaggtgtaatacctgaatcttcactcatcgagaacaagtatctttgacccagattaacatatccttcacaaatacaagctagcaagggataactgacaagataagtttatgcgtgccacctatcatttgatactgcctgatcaagtctttggatcaagtatgtttaaaaaaaggagtatgcacaggaaatcaagcaagaaaataaatagttgattgaagccatatcttctgtgcgcgttgtagtatgggtgactcttaggaaatcaaacaagtgagcgaagccctcatacccactcttctctcccctccccatacccatcaactactaggttgtggagagggcctcggtgtctctatttgctatgagaaacctacaaaaccatcttaagaaatttagtattcccctaccccttccttcctcaattcaaagtaaatgagcttggcttgattatcttcatccaatttagccattagaagactatcaagttctaagcgagccaaatctgaattaggtatggtattcactctctcatttaagaatttagaaaaatatggacttcgattcctgtcccgttagcatctccgatccgagagttgggatgactctgttagtttcggtcggaagccggacggtaatggacctacaacccttgcttgtggactagctgcagagctaacctttgttctattggtttggtggtgctaccaaaacaatttctttatgcccatcaaagaacctcgagatgctaatccacgaaaaacgatacgagaaatgcgaaagaactcaactacagaacgagggcgacccgtgaaaatacctcgatttctgactcgtggcattgaactctttcttggcaacttggacaacttacaacgatcccgcggaagatcgggttaaaaaattctaaagctttcgtctcaattcatatttagccgcgagcaatctacgtttgtgatctcgtatatgtcgcttctccgacatcttacttagtttccccctcatcttttagcaaaaagccgctccacagtagtaaagtctcatcttttgtattggccgaagtgacaatagtcacattgaaccctcgaatatgctcgaagatctcgaaatgatcttccagttccggggagaattcgcaaaactccgtttccataaagaatttgatggagttttcccatatttcgaccggagaatctaacatagacattactgtcaagattctgaccaaaaaatggtacattccatgccctcggagaacgctttgtcgtgcaaagtcactgacatatccagtgtctttttcggaccccaagaatggattggatcgaaacgactttcctgctttaaaataagggcccctttgtgtctgtatgaatctctgaccgcacaaaatctccataaccaattttccaaattggatttttaaatcagaggcagcttttggtactaatctgatttcaaacaatccaggaacttccataacattggcgtgattcagtttgagcaacagatcctgacgtaatacatcttcgtaatgaaaatggagtggaaacatcatggcttttccgctttttttttgagaatgagcactgtgaactatccgcttcaaaaaggatagttgatcgaaccgaaaccaacgtcaactacgagttattaagcgccgaatccaaataagtgtacttcctttacgcttgatgcaggatttacctattaatatgaagttcactcttctgctgacttgagcccagaagggaagcgactgatttccaattcttctttgctagtgcttgactcctgtggaattccattaacaagctttaaaagtaaagccttttatttggatttttgagatactagttatttataggttaagttcgatatttcactccgtgggccggctaattaatgaaagtaattcctggaggggaatcaatcgaagagattgcctgcccatgctacaattacttactctttaggactagagtgctaagctgcctccccggcaccaccactataatgaatggctcaaacaaataggagatgagaaagtcgagtagcagcactgatgggaacattttttgaaactagaatggttgatagtcaaataggagactcgcgttgtaggtaaggcttttcaaaaccctcgacttggctaacgccctttggttttgaggatcaatttgcccgtgcttgctggtgtcagggttgcagataagttgtttcggtgccatttcctttgttatgaatgaaaggcattttggagatttgctcagttgataccgaatttgaagataagcccttccctctcgtgaacaccttcgtttagtagatcggtacggttccattcagaagaaactattatacggtgtcccgtggagtacgaataaggcttgaaagttttccttcatattgtttgctagcttccttctccttgtttcctgcctttcattctttatgaaattcttattgattttctttgctgactgatgttacaccaagaatttatttaatagcgtatatatagcctgggcatcgataccagccttccgttcgcatgatattaagaaagtgcctactactcaatttcgcattggcaaatccttccacttgctatctaatgtagtatataaagcctttcttttctatttcttctattggctggtctgggggaagcggatcacgcgaagatctatagtgtttaagtccatctttctcttcctgcaagctactgagatatgcctcagctgcaggtgctttgtatctatctctggtcaagagttggcaagggataccaatgttgtcgaccacctacctttgagcatagcttttaccatattcctccctcgattcgccattcattccttcacagctgagtcaatagctgtgtcaactgaatgtagttctttttttaaagaacgaggccgctaaggtcaagggacctgatccagaacattgaatccaaccatcagcattcgcaagaaagagaaagaactcggttcaaagaatcgcttcggtctaaaaacgagtcttccaagatcatgtctatgtgaagagcttgaaccaagcgttcacacgcatacgccctctgaagattggaaagaatccatcagcgagaaaatcaaatcgtattctatagaatatggtagtggtaattatataactgctttgaggaggaagagggaaattgtcaataactgtttgcaagatccacgtatattaaaagaatatataaataaatatgtgcaaacgcactatgaaatccgttatagatattatagtcctaattggaataatatgtgcttattccacaataatatcgaattcaatcaaccaattgtgaggtttcattataattatataagggatatgctttctttaaggagtctctctcctatgaaatttggtgaactctctatgcaaagcagattatggacatctttacaaagattaacagaatcttcaaattatacattgaccgctaaatacacacacaatgtttagtgaatcttatgacaatccaatccaaggatggaacatcgtttgtatgtgggaatttctatgctcttgtcaaatttgggttttataccgttgtatggttcaggtatataccagttagcggtatagaagcgttacccgttgatctgtttccaaaaaattatcatgtctttctcaatgagagggcaaatgtgactgattatagtaaggtagttttcgtggaaacaaaggatcttactccagtagtgctgtctgcctttcaaaatgattat

SEQ ID NO: 76619 - DNA, 520 bp, Oryza sativa
aatcgacttcccgggcggtttcggaggcggtttttgtcccacgtggcatctttgaccccgttgaatggctgagtcatcaggtgggacccacatgtcagccagccggctgctggtgctgcgtggcgacagggtggccttttcctcctcgtcatcgtcgttctcgcccgacgccgaactcgagctggcggcggcgggctggcggccacgttccgcatcccgccgcagctagagtgcacgcaacaggctgggagggggctagcggcggcgttctgcatctggtcctcttcgtcgctgtcctttcccgcctccccaatcaacgccgcctggtccgcacggtggcgagcaacgatgacggcaggaaccccatgggtgtcaacacggggtcctcgatggtctagcgatcgtcgtggaggcagtgtgcggaggcgatgatgtacgtgccggagatggagaactgtgccaccttgacgctgagcggcctggcgacgtcgacggtccacgctgtgccaccttgacgccc

SEQ ID NO: 76620 - DNA, 69533 bp, Oryza sativa
gcatgtcattcaggtccagattatcttgacagtgtcatgcatgtcccaaagtgcaaagtttcatttctatttattttgagaagaaccacaagagttgactgggaaaaaaatcaataaatatacaaattcaaccttgaagttttctctccatttctcccgtatgttgtcaatatggcgacaggcacaccctcattaagcgcatcatcaatgaacctttgaatggtttaatacacaagatcagacacaatgtaacttccaaagttcaagatagtagtaattcataaagcaagctcatggcatagaaaagaaaaaaaggaacaaaagatcaaaacaacgacagaacagaaagatattgcttacaaatgctcatgcattgatggaaataaagcaagatgcatgggtataaaaaaaacacactggatcttttgaattatggtaccatgtctgccatactttgcagaatgcaaattctcacataaatttctggtaaagcccctcaaaagaactaccttgcataccactatggttatcatatcttagaagtatgatttataatgatcctaaaagtgatatatcaatcaacaataacccaaatgatcctggaattatttcactagagagatacttcatagaaaattagataaactgggaacggtagacttactgttcaactccaggccgcagtggtaagctatcagaagctgagaacacttccaaagctttcagctatgagaagaagcacatgtaaacaagtcagtagaaggatattttttggtctataggaaagaagacgaaaaaacacccatcaaccattttgatctggactcccgatagaagaaaactcataagttgattgaaatcaaatgcaaaatacaaatagaaattaacagaaccaatcataaaagtcagtgcattggatggttaatatgcaatcctgttctcagggtatacccaaatgcaaatggttttctgactgctaaaccctgcaaaagcctaagttccaaaattcaaattgccatttatcttccattagcagaacaatgcatggtccatcatgagaaatattttgagactatacagccatgagaattgagattcttaactaaatacaatcaaccctaattcaagatagtctgcctatgggtaatcataatagaaagttcatttttttttagtgccagtatggtggttttttcttgttaagtacctgcatagcgtaaagtatgtatctaccttttcacgaagaacacttttcataaatgattctttctcgttagttggcaaagaagtaggccacccaatctgtgcaagtcagaggacaggatagtaataagtaatgcatgcatatctcaatcaatcaacaaatgaaattattcagctctgcaatagtactgtggtacacaatgaatgatttaaggagaacagaaacaatagtattattggatcaaatatgacagctaggagaagagctaggcgtactctgttgaagaataataacaacatcctttcctcgtcgccactagctttcctaaaaaactacatagcttcagacaaataaaaaaacaaaaagagaatgatagattttcatgcagtaaagtccaaaatatattctttgtaaagagaactatatagaaaataatagagactggaaatagcaggggaaaacattcattgatgccaatagtaaatccagtgcaattcaaaagagcgcatgtcccagttttgatgaagctaaagagtatagtatgcacctcactaaatcagcatatattggctctgtccaatttgcacaatccagcccaagattttgaaatgctgatgaaaaaatatgttagaaattgtgctagaagcattaagacagacaacaaaattacttatctgcagcactatatgttacacttcttctgttaaaaccaaacaagttttattctgtagaaaacacatgttggttattacacaggccaatggtgtcaatataattcaatgctttgcacttgtatattggcatcgcatagaccagataaatgatcacagatatggaatggaattgcattaagcaaagaagcatatttacattgttcgcacctacattgaaagcttggcgattgccgaagcgatacacatctgcaagaactctggagaaacagaggaaattctatcacacaatcatgaagagtcctcagagaaaaaaaaatcagaaagaacaagccacaaaaatagaacaaagtcccaagcaactactacctccgtttcaggttataagactttatagcattacccacattcatatagttgttaatgaatctaggcacacatatatgtctagattcattaacatatatatgaatgtgggcaatgctagaaagtcttataatatgaaatggaggaagtagtaactagtagtagtacatcacaaggcaatcgcatttatcctgagttcctgacaaagttacaagactaatcgaaggcggtattagaattccacagacagtgtagccgtcttgaattgctgaactataccaggagcgcatcaccaactgaattgaaccaagctcatgaaaacaacattgagacttctctcaagaacacaagtacagaacatgaagcatttcgaaattgataagagagcaatagccaattacaactaccctgtgcatctctataccgtggtttaattttctgtaaccagatgaatataataagacaaatagtagctctatctacatcaattgaagctagaaaatggaatatataaaaaaattaaagggcactctcttggtcgcaaggccaagaatcaagaagaccaggtggtctctgaggcgctcacccttccacttcgaggagcacggcgatatccggcgacgcggagccctgcgacgacgaggaggaggaggcgcaccggagcggcgggatacggcggccggagctcgggggaacggcggcgcggagagggagagaggcggccgcggtggtggtggaggaagaggaggaggaggaggaggaggaggcagggatggaggaggagaaggccttggcgacctccggcggcgaggcccggagcgggaggcagcgagcggcggccatggcggagaggagaaggtgcgcgtgagcttcacgaataatagctcagattattatttattttatttatttttccactatataaatatataaataaagtgctacacgtacacagcaagaggcatccagcagtgtatagctaatgtccaatggttgttttgttctacactcttcttagtctgtgttcttttggtgttggtcgggaattaatccccgttcacggaaaacggagtgatcaattagcgtacgattattaagtattagctaaaaatatttagaatggattaatataaattttaaagtaacttttctatagactttttttaaaaaaaacgtaccatttagcaatctaggaagcctgcagacgaaaaatgagggaagtgaagtatgggaatcatcacaaacgaaataagcttgttactccatcttttttaaaatactagtaagtgtgcacgtggaatccacgttgctaataaaataaataaaacacataatataattgttcaagtgctaaataattttcagatttcattttttgtttcaagatcgattaacgatcagtgaggcggtcagaccctagcttcatataatcacacagaaccaaaatttgagggagtcccatctaccttttgttacagtaataacgttttcaaagagtaccacaccaaggaaattatttaacttgttgacgtagtgcctgtcttgcaagacacggattgttcctgtcaaaggaaataaaaaacattctcgagccaatccaccaattatattcatcatctcgaaaaacataaatatcacaatcatttacaagagagaatttttttgaaaacagcttttggtgagcttccatgcattttacaagaaggtggttgagagcatatgcattacacggtgtgaattattatcatttaggccccgtttgatttagattattaagctaattattattatggattatctactataaattaaatattttgagaataaacttaaaaaatagcttaaaataaatggactaaacaaaaatcaatttctagagctatccatattccacagtatgaactaaattctagatcactcaattcaatcagaagatacagtgacaaggtaatgacgtaatgttccaaaatagaactcatatgccatttgcaaacatctcgaccttctacatacaaatctaaagatccacttgtactaattcaagttcatttatcaagcatattaaacggatagcaaacgccaagctgcagtatgaaaatagcccgaattttaaatgatttcataagtaattaccaggggccactcaaagtctagttcgtcaccttgcaatattttaccaaccaaaaagcaaatttcaggaaatatttcacttgatgtagattatggtaagtaggagcaagaaaaactcaaaccgtgtaataggatcatgcccagcaaatccatcttcactgtttatagagccagtacacgcggattaaaaattaaagttcaacaaagttcaatggatttactctaggtctctagcaaacccctcttgatcatagccatgtgctggtgaggtgcttgtatgatgttcttgatgtcccacatggccatccagttggtgtttatcatttctagcacaaacttgatgtcctctattgaaacaaagtctaagttgataaaacaaaggacataaatctgtggatttctgatgggtattaagttggtaccctacttatagctttcagctctcataagagtgtgaaggtgaagaaatcaaaatagctacatagaacggactgaaatcactgtattttacatgggtgtaaagttggtacccttttgttgctttcagatctcataagctgatgttttactgtagaaaggaaccaaacaaaattttgtcagacatcagcgtaagaaattaagaagtaggtggcactaatagaaattaagagggctagctgtgcaaactatatcttactattatgccttgatttgacaatcctaattgattttactactatattccaaatggaattttttctaagaaaacacacatatatatcttgagagaaaagattttacttctcaagagaaacctgtactaatttactaaactcgaaattacttgtgctcttggatacattttcatgcaaaaatttacaggcacaatgtatgcaaaatagataaaatccctataatactaacctggatttgaagaatgctatgacactgataaaaggaaaataaaaacattgttgctccatgaatagaaatctccaacattcacaaaaatagcatgaaaaaaaattgagtgcaagaaaccgacttgcctgtaccttgacctggacagcatgtgcctcactcgcacgcatcaatgaaaccagatgagacaagtcttcagcaactgggttggaggggactgctacctcatgcgtgacctggttgtatcattgacgaccagctaagagacgggacatccaatggagatcactgccaacacaaactacagttcattatgtccttccataagcatggaaaatatgatccaaaatgatggcagaacatgcaaactggaattgcgggagcctcaatggatgaccatatgttcaaaagctttgcaaactggaattgcgggagcctcaatggatgaccatatgttcaaaagctttgcttaaatcgacgaagttcagtagaaatcttgttttctaccttcagaattacagtactacaaatgcaaaggttaagtagaatacactaagaaccattgaattgttaatttgaaagcagcaaacaatcaaccagaaatttggtcagtatgacatctataaattgtcaaattgtaaacaggagatgatgctagtgctagctaagcatttcatcaaacacattgcaagcatgaatatagaacatcaacctcacctgttgctggtgttgctggtgtccttatttgctagcatgaatgatgtccaacggccctagtcctgtgccctcgttccagcgcatccctgataacaacaacaatgaaaaattatacaggatgttgatgatgacagcagtggtggcacaggtagcggtcctaggggtcgtcggctctacctccagtcggcaccctctcctacgaccgcgccggcggcctgctcctccccggcacctctgttggcgctcgcctcttgcccagccaacctcgccgatgctgacgggccatgcgcagcgacctccagccctcctccaatggccccctctcctcctagcaagactctccgccacctcatatcccctttccggcgggcggcacccggatgtccggcccgcgcgccggcgcgcgcgaggagtcagcggggtagggggagcagaagtgcagaacccgcctctctttcctctccatcgcggcgcggcgcggcgcgagcagggaagcaggcagcggcgggtagggtgaggcggctccggcgggtgcgcgcgaggaggaggcgagcagctccggcgggaggcggcggcagcgggctggcgcgctctaggaggagtcgagcggctccggcgggagaaggcggcggcgcgctggagcacaaaagggagcgttccctttcttttttctttgaccgatccctaaccgctgtttagaccctcgcaaaaaaaaaaaccgctgtttagaagtgggagatcgctaattgtttctttttttcccctaaccgctgtttaccacgtgggaatcgctaattgcaggggttgatccaacttttgatataaaccgttagatgaacagatctaagggtcaggagagagaggtgttagatgaactggtgctttttatttttaaaatatatatataattccaaggacatccacaatgtgtcataagaatgaaccataagaccttatgactagccatatacattgtggatactagccataagacattaaatgctaaaaatagccataagcttatggttcaaccttaagaaataaaataatgagataaagcacacgtgcacactaaagagtatgataatagattatggtatggtgggacctactttaaagtagaatttgtttacatagatgtgggacccatcttaacatctattcttgctttaaacattgtggctatggacatagggtatggtgggacctaccttattttcaccaacaccttaagcattgctgatgctctaaggatgtaccatgatgtccagacatatctttaggactagattttctttgtagggctgtgatttgtggagaaggtgaattagggattttactgttgattcattggtcaatccgaaaggtatatttgagtataattcattggtcaatccgaaaggcatatttgagtataatgaagatagaagttactaatatacctctaaatacatagaactagccaaccatcttatattgttttatgagtggagactggccagccttgttttggaaaagttattactacactgtcttgctttatactgtcttgcttagggtatacaaaaccacatagtcatcacacggttaccggttatcacgcgcggtaaccttcccagtttttgaaaccaagataattctcacagtaaccacatggttatcgtgataaacgtcttatcgtagggtaacggtaactccacctaaaatggtttggtaaaccctggtcttgctagtactgcttgaacgatctatacatacacaccaaaacaacatgttgctagttgccaccactaaatttaatgaagtggaatttactgtttttccactttctacacctttaccatgttaaatatgggtgaaaaagaaaattctcgaaactcatggcttatagtcttagatcgaatcatatcgaacttggcttggttagctaaaacatgtacttataatgagctgaaccgattgagttaggttcatggttcaccaaaccattttgggtggggttatcatctcccctcggtaaggcggttaccacggttaccatgaaaaccgtacagttaccgtgagtattaccttggtttcaaaagtaagaagattaccgtacataataaccatgtgatgaccatgcgattttatgaaccctcgttaggcttttagctcgttgcctagcgagccaaaactcgtgtttagcttattcatgtagaatgtcattatatcattatatatatttagtgtttcttagctagctagtagttactaagataccttacaacaatttgtgtttgtaattagtgagtactattttactagttattatttattattatgttagcatatgatacatcggcaaatattgcaactatgtggcataagaacaattttcccatatactccctctatattttaatatatgacgccgttgactttttaataaacgtttgacctttcgtcttattcaaaagatttatgtaattataatttattttattatgacttgatttatcatcaaatgttctttaagcatgatataagtatttttatatttgcataaaaattttgaataagacgagtggtcaaacgttggttaaaaagtcaacggcgtcatacattaaaatacggagggagtactaatgtacaatctagctaagaagcatacaaactttcaaagcctgaatgtagatgcaaatcatgcaatgctgctaactttttctcatgcatatatataattaacatgtaatacacacagttaattacatatgtacatactgagccgagactagcaaagttacatacgtataagtagcatactaatggagcaattttacagttcttgagaagggtaacataaggtattactttttctactgtaaaattggtatctcttgatattagataccaagagatactaaatttacattaaatgtttggttactcatactaatatcaaagtaatgcaagctatagctaacatatagttgttcgatctgcgtcaattaattaatttattacaagtagtaattattattagcagaattggtagagatatccatgatcctccccagctcgtcccagctactgccgctgctgctcccgccatccctactgaagctcatcacctcgctccaccccgccgccgtcgacgacgacgacgacgccgtcccagcatggaagtcgagcatgaacggcgactgacgatgacgaatgtcagcgacgaggtgagactgagagtgagagtgagacctcgtcgtcgtctcggcgtccgacgagtgatcgatgacgtcgacgatgttggccgccgccgctgccatggaagcgctgccggcgtagtgctgcaggtggcgacgatggtggtggccatggccgtcatggactacctcgtggtagtagaattgctgctgctgatgatgatgaatgtgctgaagctcatggctaattcgcttgttcatggatgctgctgccgccgccgccctgcccttggtgtaggtcatgctcctcttgaagatccggcaaatcgtccatgtctcctgcatgccattgatcgagatgatgcatgaccagtactatccatgaattcaattcagaacaaattaaaggtgtatatatatataagagatcattctgacgatcgatgtagctaattaagctagctagctagtgacgcaatgatgtgcctgtctagccgattgcgttgtgtatcaaaaatcttttccttctaatatattgacgtgcaatcttttgcgtgttcacgaaaaaaacctgacatactgatgcgtcttggaggtgatcggagtcggagatggaggaggggagtcggaactcgtgcatcatccaatctgtcttggtgcctttaccggcgctgccgcggtagtagacgagagacttcttgaggccaatgcagtcgccggcaccggcggcggcggcggcggcggcgagtgaggaagagtagattggcttgtcgatgccggtggccttccagaagccggagccggtgacgcggttggggcggatgctgttcctgtacttcctccctcgaaggcagaagaaatagccgcactccttctccgccgccgccgccgtcgacaacgacgacgacgacgacgagccctgcagcgccaccgcgccatggctcacctctgcattcacaagcacaacattagaatttggttgatatgcatgcatgcatggctcgttgttcatcatttttatctgactttgctgatatatatcaattattctctcaaatctctgattgtgtgttaattgttcagtgtttaatttttattcacgatcgatcgatcagagaggattattcagagatacaaattgtaactgatagctagtatatactaccacttatgactgaatttccttttttttttcagttacagaaccaactaaatttaaatgacacataggcatgattttatgaatgtttcaattgcaggagataattagtcatgcatgacgattcgcctatactagtcatattattaaccttcaccaccaagtgtgacaaaaatttaacctctggtatcacaattaatatatcttgcatcatattcttataatcttcttgaaagtaagatgaactaattgatatgcacaaaggaagaacatgagatcagaaaagtaatacggtttcatgccctgaatcctgattttatcccctcttacttttcagtgcacatataatgatgcgtatacatgtgtggatatgttcaaatcaattaagaacataacttgcacgtacaccagtttttttcttaaaattaagaacaaaattgaagtaacctacttggaagatcccagggatcatgcttgtagatatcgatctccttgatgatgtcaatactgaaaggcttcttctccaccttccttgtcagataaaaccccacgagctcttgatccgtcggatgaaatcgaaaccctggaaacaccagatcatcatcttctgctaataaagctgctcctcctcctgggctaattggactgtcaatctccttaataatcctttccaacctcttctcctcctccatggcttaatcttgtagtagctagctagctagcttaattggacagagctataataacttgtttgatcctatatacagctagttatatatagtgtatgaggtttagtgttagctatacatagttgcttacatatggtgatggagaagtatggccatggctgctgtattaataaattaatgtgctatatttgaccatattagaacacatttgatgattaattatactagacaaagctatagcctgggataataataagatgctggaaatttttgtctgagcaagctgagtctaagtcaatcgagttgaaccctctctctccctatgggtctctgcagataaatcgtcgtacctctgatgacttgctcaactcaattatatgtcgaatcaggagatttttcttcagtgacgacgatactttatttcgatctcgccacagcaaattaaatacaggaaggattaatttatttcgaagtaaaattatcacattgttatatatactagtggtaggcctgaatatatatgtagcacgtggttttcagagttgtgggaggccgttgaacaccttaattagagtctcagtttattcagaggcaatgcacatatatgggaaattgacattctaccaagtcaaaggcagataatattgattgacttggtagaggtgtgctactcatttcttccaactgagacatgcaacccaaattactcccttagtgcaacttataagatgtcaatgcattttaagattcaactctcataatatttgaaaaacaattagtcaaatataaatttaatttatttgataaataaaaacaatgttattggattgatatttgaatgtactagctttttatagttatgatttaatttgttgctacgaacattatattatgtgagaaactgaaagtcaaatagtagttttgaagacatcatgtcaagtttaactatgtcttatattttagaatggatggagtacattttagcaaataaaagaataatttcttgatgtatgaagtgtttacaaaattattgattcaaataactctcaattcaatctgctaaagacaactcgaatttctcgcgttgtggaaattagcactaaaatttcgacacctcgtgatcctttatcaaatactgcaacaatgcatatcaaaataaaaacttaaattaaatgggcataagtgcttattataatcgaagaagcttctgattaggttggacagttaccatctttttgtagctagttgcacgactaactactagtaactacttagctagagccaagaatctcataccgttcataccaagcaactgtacagccataggatttagtcacagtgtagacagtgatgctgtggattaattagcaattcgaggatttataatacggagaacgaatcaatctttcaagatgtactaatgaaaaaggaatgacgaactttgaacatttccagcttttgaaaagtacttgagagtcgggttcatcatattcggcctgaagaaaggataaattcgagaaatatatttcagtcaacagctgtagatttgtaagacgaactgatgaaaagaatttttcaagggtgctcacaaaaggccactttaattaaagagttcgttcaaaaggaggatttgagggtttttcttggtggctgttggtgccttggtggagttaattttggttaaaatcatgtgtatggggccacaaattgaccctttcatgactctctaacctccagagaaaaaaatttacatggtaaatattttctctaaactgtttttttacagcttattcgttttatattttttttcataaactcctctatctaaaattaattatactgcatgtttttgtcctatgtaagtccaactttcaaatacaaatactctgtttctatgagccgtcaagcaatgggtaacctaacaaagaaatgaagaatcctagtcattttcatctgtcagattggacgaaatgttgctatcacaagctttgaacaatgggtaaactacagattttacagtaattttttctaggatcatgcaagaactttgtcaaaagccttgacgtaacggtacatgcgcggtagattcggcttgatatttttacctgtcactcagtaatttactggaaagcaaagccaatattttcatctttgttgggttctcatcctggaaggtgaaatcctgaccactggaccttttcttcttcctgtgatcaccaaagtcagcatgctctgctccttgccaaaacaaaaatggaaaagattcaaagcaaagagaagaagagttccaatcttctagacccagttgctagcaacagatccattgtagtaattttttaaaaaagtatttaaatattgggtttagaagactattgatgttcagagtttttacagtcaatggcaccggttggcttgccagggaagaaactcaattagcatatgattagttaagctttaactattatatacttcaaattttgatttatttgattttctttaaaaaaaaccttatatgtagaaagttttttttaaaaaaagatcacatcgtttattagtatgagaagcgtgtccgtgataatgtaagcctaaaacgacaaatttagaagactgaaagaaaatgatagttgagtgttgacctgccagattagtgggagtactgtagactgaaactttctcctggatgttttgtcagagaacttcagcattatcctcatagtttacttagaggcatcaaagaagtacaagtaaaaccacttggtgtgaaactgtccgatgcttccaaaaacacatttttgcaaattgcatcatccaccatgcttgctatcctccatgtagtaaaaaaaaaaacatgcatgtatgtagttttctgtcctgtagaagagtctaaggggatggccatgtattctctcatgaccccatcagctcggttgacatgtttgatatttccttggacacttgattatacattggtcagcaatcttccaccagattgacttaaggtacagtttgtcaaaactatgtttgtttacgggtgtaatttagtcaggcatgaaacaaggaatcccattgtttcatactaagagaaagtagacattgaaaccactgaaaaatgagatgattactgaatccaactctttagaaaaaaaaacctgcttaattagtactcccttcttcctaaaatactagtttaggaagtcacacattcacgtgactataaccattctattgttaatggtattctattattaatggtatagatgaaaccttatctatgatgttcagcaattgaagaatttgagtattagtatttgtgaaaaatagaaacgctaatcaataacagaaaattttaaacacggtattgtaagatgtacttgcaaggatgattttgtagacgatgatatagtagaaccctttgtgtcattgaaatgagggtatgcatgtgttatcttgggcaaaggcatggtttaatactgtcattgtcgttgttctttcttttctttttagttcctacaaatatgcatgagtgtacagtgtactgccctctggaaattctgcaacccaaaagtcacaaccatatcaaatactccctccgttagtacggctcactcagacgatttgttaatccttgatcttcatgataacaactgaagttaatttatttttaatgatgtaatttgtcgatgtatataatactgtacgacttagtattataaattgcattttaacttatcttttgttaaataaaacacattatataaaattaccttcttgatgagtgcttttttttttcttaaagcagctgatcactcctcctcttactgtcttacagcatatttctatctataagttacagctagaagatggttagcgatgacaatgtctacggatacacaggcgagcaggtgacgatcaggcagtagccaacgacggaagaatgaagcaactaccaggtggtgctgaggctttgaagaatgaagcctacaaatctccaaagtccaaacggccagactaaaatggatttacatctcgatgaggtctacgaatccagagtctccaatcgtccatccgagctatggttcaaaaagtcaacttttcagtctctattcaaagcgcccagtcgatgccaagcacatatgtattactcccttcgtcccagaatataagaagttttagggttggacatggttattaagaaaatatatagaagtgagtggtggagggttgtgattagttggaaagataatgttgatgtagaagttgttatattttaggataaatcgtgagggttaaaagttgttatattttaagacggatgaagtaacatatactaggccctagttcagcaagcctgagccatggtgtttatacaataggccatacaggcctaatggttgcatcaaaatagtacaagtacaacagaccaattacaattgagactcgagagagtatgcccaaagttaatggctctttgcaagaccttgttaccaactccctactttcgttttccgcaccacgtttttcaaacagctaaacggtgcgttttttaaaaaagtttctatacgaaagttgcttaaaaaatcatattgatccattttttaaaaaaaattacaaatacttaattaatcacgtgttaatgtatcgctccgttttccgtgttcactctttgggttgggaacatgttcctacgaacacaactagcaaagttaactatatgtgtattttttgttttgtgggcttattctcctatactggctatgttattttctttgtacatgagcacattttggttctttttgtctatatggattgtatctagttgatgtgtacaaatctagatcagaaaaagaatgtggctagctagttgtcctggatttatatgttcgttaatttgtacaacttgatgaagttctttacattaatacaaaagaatctgaacattgaagttatttagtttatattatgaaattttgtttaggtttctgcattaacatgatgccttgaggctgctcagctaaggcttgctcgtcggattgccaaacaatgcaagcacctaacatgtatatatatataggttgcaaaaatattttctagataaactcaattaacatccatatgatcaatctaagtaagttttcacacaggtagctaacagctgtatatccaatgagccaactaatccaaataagaaatttttagttccatcactatctatattcaagtaggattgatgtattattagtttataaaggtccaagccaatactgggtatatgccgctaccttatacatcaaatgaatgaaaaatgagtgaaatgataataatggtggagattgtgctaatggtacagtagcagacgctgacatgtaagcccgaatccacgtatcagccattgctactgtgtcaacagtagcagagaatgcactagaggcaggccggcagatgattttccttgatggattggaattcagaaaataatcctttcacgggcatcgtcgtgtgggtgcaactcttccagtaggaaccagcgttcgacagataggccttttgcacaggctaatccgtctaggtctttatgttcataactgttccaagtgtgcaccgaattcgcagtactggacttgaaagtctcgaagcggcgagccatctcagcatggtcacgcttcaacttgtacgatacagcttcgtctgactcgacgtacgtcctcggcagtcacgcacttaccatcatctatatatcacaattcacagacaaatcaatcagttttacacttgcatacaaacaaatcaattagaagtattaaactttgagtaattttacggtccttgaggaggtaccattttttctattataaatttgatacctcttggtacctaggtactatgagatatcaaattttacactaaatttttggtacctcatagtatctcctcaaggaccgtagaattgctcattaaactttagttcctcagggtcgatcagggactaaaacatatcggatgtttggacactagttacaagtattaaatgtagactaatgataaaactcatttcatgaccctagactaattcgtaagatgaatctatttagtctaattaatccatgattagcctatatatgcgatgctatagtaaacatatgttaattatagattaattaggtttaaaaattttgtctcgcgaattagctcttatttatgcaattagttttgtaattagtctatgtttaatactctaaattagcgtcgaaatatgcaatgtgacagggactaattaaagtgatccaaacaccaccaatctatccgtatgctaaattgcatgtacagctgcatctttgattgtacgattggttattatggggtttaatataatgggattacctgggggctcgctgctgtagcggatggagaggcggtcggagacgtcagccgccgcagctaaacgggcggcgcggcatgcggccgcctcggctaagcgggcggcgcgagatgcggccgccgcgtcatggcgcgccaccgcggctcgggcggcgcgacatgcggcggccgacgccactagacacgacgccattgttaattagggcttactgtattttgtttctaccacatatgcatatatgtcgtcaaataagatcgatcgatcgatcgatggatgagagataggaaacaagtcaatacgactaatataaattatagagtaaaatacacggtcggtccttaaagttgagcgcgggtgtcacttagattcataatcttgtaaattacacatctagatccaccatcttgtttaagtgactcattgaggtccaaaagacctctgaccgggttgactggcttacgtggcggtccagcgtggcaacatatttgcattttgcccccctttttgattccccgtgtccgatccaatcccttctttgcgtggcgcacgcaggaacgcgtcgacggcaacgtgcgctagcacgcacacctgcggcacccacctgtctcaaccacgctgcgcccgctgacgtgcctcgtacccctctggcagccgctcgccggtgttgcgcagcgcccagagaaaccgcacaccgtcgtcgacgggaaggagaaagagcaggggaaggggaaggcccccgctctagccagccgtgggtgcacgcgacaagtggctgcggcagctgctcaagtcaagcttgccctgccgccccgctgccgccatggagctcgcacccgcccagctcgcgccgaactcgccgacgcctcccccacacacgcggccgcggtaggcgacccctccccccgggcgtggccggcgacacctcccccgcgcgcgccaagctcaccgacgcctctagcaccaacgaccagcgggaagggagaccgatggatctggccgtcagtgaggcgtgagcgccaccggcacgctagctacgaagacagtgacggcgctccgcaaactctcctctagttccctccgccgcctgccaactgctgccacattcgcccgtcgccgctccgctgctgctccgctcgcaccccgctgccgcgcttgccctccaccgttccgcccgccgcccattcgtcaagaaggatttgaggtccacgacggcacggcgtcctgatcttcgagctcgtccgccgctcgcttcgtcccctctaatactgtgtcgttggcaatcatgcgtcgcttcgtcgaggtccacgatagcggcgacggaggacactgatgttggcgaggcgaggccggagaacgtgacaagcgaggcggtgcagctgtgctgtgcgactaggcgccgcaacagctcagccatcggtatgacatggccggcgaaggggctgacgatgaggatgacgtgcggcggcggtgggcgatgtgacgacggaggcagctgagggatttgggggttctttttggtgcccagggctctactaaatgcaatgtagatggtcagcttcggtcaaaccgggtttggaccttaatgagtcacttaaacaagatggtgaacctagatgtgcaatttacaagattatggacctaagtgacacccgcgcacaattttaaggaccggccgtgtattttactctaaattatatctctatctctcccaacttctcttctactccctccaactaaaagtttaagccatagttcttatatcattgagaccactcaccacaggcggacaattttttttaattagatactaagtaaaatttggtacataaaggttctatgaaaaatttagtgtgcttcaaggtaatttcttaaatactgtaaaattcttaacatactttgcagtgatttcaggcctgttattactatctgcaaagtacgttgattactgaatccacttcttccatcttttcactagttgtaattggaaatcagcaatatgaagaacattgtttgtgtgcgctggtgcgtatgtacatgtgtgattgtgtggcgtagaccaaataatggtgaaataataaaaccagcttaagcagataatcacaggtaattaagacatgttcttcgtagttctgtcagcctttaaaaaggcaagcctgaagatcctttccttatgacactagctatcaggtgttatttatgaaagagatgattgactttcagagacatatattaaaaggagaagctgatgaaaaatgcaaagactaagtacataaatacatatattcctcgctttgaactggctcgtcaggcaaatatttgtgttttcatcaaatctaaggcaaggtcaaactccaaagtccctgcaaaaaaaaaaaaaaagctcaaactccaaagtgggacaaagttgctccatctctagcttcttttagaatggtcgtcaccataaaatcaagaacacccccagcagctggttcagagtcagttgctaagaaaaaaattcagattagtgtactacgtcaaagctactggagccagaatctgtatgaaggtccccgtttctcttgcaaatcaagaatccattgtcgtctagtccggttaggatatctggctttcacccagacgacccgggttcaaatcccggcaatggaacattaatttttgtacattttttctttgtctgctagttttgtttgtgagcagctcacaaaactaacttcaagatttaatttatggcttgttcactttgttgcttaccagattttcacaataccaatttttaataagctttggttttactaaaaaattttaacttggtgtgtttagtttgacatctttctaaatcttggtagtgctttttatcaggggtgaagctagcatcaaaataagggggtgtactaccattaaaaatctagaaattttcagtacaaaactgtgtattttagtgtttttaagtgagaattgaggaattctggggttaatgtgcaccccatacacaatatagcttcgccactgctttttataataagaaagttccaaaaccaccaaataatgttaaggttaaaatcagaataaagtgaacaagttctcatcagctgtgtttgttatgttgagttgggaactcattcccttcgcacgaaaaacggagcgatattttttttatgattaattaagtatttattattatttttaaatagattaatatgatttttaaagcaactttcatatagaatttttttaaaaaaacgcaccatttagcagtttaaaaacgtgcgctcggaacacgagagagaggagttgggaatccaggcggccaaacatatatagccgtgtaattaatttcctacgtaccactaaacagcttttttgaggtgaaatttatcgtcatttcatctactacatgtagaattttgcattgcttggagccttagcctagttaacttctcagcgaaaacgagaaagctctattagagcatgatcaattaagtattacagaagaaaactattattcaattaagcttgcatatgggctgcctccaggcccataggcccatgatctgtaactgggccgtaacttgcaaacctgcactagaatgggctttaattcttggttgtcaattaattcagtagttttgatattattaatttttattatttactagaaaaaatgcatgtgcgttgtaacgggtgaaggatattttattattgttacacagtttagttaagatgaaactcactatagaaatttgcttggatatatatttttctacaaaatcatgagctgcaattaagaatccgatcatttcaagttagcatgcgagttttttaaagagatatcttatacatatttctaaaagcgaacgaatttaaaacctgacttaaatacggatctatattttcaaaatcgaatgaatttaaaagccaactcatatacagatgatatataaaagtatcggtaaaaacatcttcaatttttataatggaagagatatacatctaaacgactgaatcttctcttgcctaagttgccttcgtgaaatttcttcaaactcgctttgaatcacgcctatatgcaccaattaacgccttgtaatcagtggatatttgcattgtgtccaatatatcaatcagtacgcgtatggcttgtggccgagtattgaacgctggctgaacgacttgactcttgtgctggactttgatctgttcgactcttttagtagcttaattattactagccctcaaaatattgtcttttgttcctagctcaaaaggcaaattaattaagtcgatctagatgtttgtgctgctatacacgagaatagatattgttgtttcactgcaagatgaacataacatttgcagatatttttatcctttccaactagatgtacacaattagtattaaaatttcacctgttattttcgcatagagagattaatggaaacgctatgcgttgtcggaaacgacgatcgagttaataagctgtggcttgtgttaggaacatgtcgcatctatgcttccaagaagcctctcatggctagttaaatagttagttaattactatcttaattaatttgatcatgtgcctctccattcatcggttcttacaaagtagtagtatatactactcctaaatccactcccaaaaaattccttcatcagcttctagtatactggacaactacttctctgaatacttgcagatgcagagagtctctgtctgcagctgttctatactccactgagctagtaacaactacttttgatctgttcaccaactagtagcattagtacagtttcttattcggatgctctctaatctctgcataataagtagcatattatactgcgagcatctaatcctaatcaccgtatttgttactcaacttccaccgtctttgtccaaaaaataggccacaaaaagagccaagcaaaagttcaggttttcaggagttctttgctgtaagctaatgagtgagttgggatgtcatgacagtgatcttgagcaagcacacacaactgaaattaaaaagaaagaaaagaataatctaatagtatgagattatacttgcattcacacaacatcctttttctttcagttccaagatgcatatgattatctgcaagggattaagtgcagatctgataatcaagtgctttgctaatacggcaagctaatcacatcttatctccgacaaagagacaggttaatgctagatcccaccgtggcaaaaattgtcagcttgtggtatgaatgaaatgatgattaaaaacaaagttgtgaggcagctgggagcattctagaaagagccagcaaatgccaatttgacccaccaccttctgaaagctacacaccaaattgcaaagtgcagaaaaagaaaattttgaacatttcttctcatggtcctcttcaacaccaacaggaagagatggaattcatctttgtctccatggccatggcgtgtcagggcacattatgaaattacacccctacctttcagcaaaatttcatccaacagagttgctgttgaccgttgacctttttgtgggtcaactcaatcaagaccagtcaaactaagcagaaagattcatagatcagtgaatgtagtgtatgaagttatagtggaaacttgaaagtatgcaatccaaatttgtcaaaagagcattgctactcatactatttttctttctttttttcgcatagctcttaccaacaaatctctcaaccgtttgatttaataattatatgggagttcaaagtaattctatatttactcacatcataccacatcaatgtttgtaatagatttataataaatcttttaggacctttgtagtaaaaaaaacaagtctaaaatcaagaaccaatacttttgggcttttggcgagtacaaaagtggaggtcttaatcaatcctcttaacaataataattaaatataaatatagggggtagagtgcaaaaaggactcaccttattagtcatcttccttagccttaagcgtaaagcaactcgtctcatcttcagagaagcaaacccaacaaaaaaaaaaaaagaattttcaggttttcttctcgctttcaccggagaaggagaaggagaggaaggtgttgatcgaatcctcctccaatcgcgcgcgattcgatccccgttgctggccgctcgctcgctcgatccctcatccgatctgaatcccccgatctgatggcggccaaccccggcaacaagatccgcaacgccaagctggtgaggaatcaaacgtctccctcaatttggtttcttgatttgtttttgtttccccctggatttagggctgatgatatttccccctaagatccctccttgttggtcgcgattagattgatgaactgattcccccttattatgatcgtaaaacaagaactcaatctttacttattggcatcatgtgctcatgttgttcatgtatcacgaattccgggtcttgggagtatgttggtatgcgtttactaacagtgttgattaaccaggttcttcttggagatgtgggcacgggcaagtcgagcctcgttctccggtttgtgaagggccagtttgttgagttccaggtgaatttcttttacacgtgaactactatgacctaagattgagcaggtttggtgtgttgggataggcttgattttgttggttcattcggatgcaggagtccaccatcggcgcggccttcttctcgcaaaccttggcggttaacgatgagacggtgaagttcgaaatctgggatactgcagggcaggagaggtatcatagcttggctccgatgtactatcggggtgcggctgccgcgatagttgtctacgacatcacaaatgcggttagtacaagactaagtgacttgcttgaattttaattaagttgtacatcttgatgatagtttctcaaagttttgatttaatgcaatcatgcctgcatatcactgaaaattataagtacggcaccacagccgcgattggtagaaattactaacagtctaataatataatttacgccattgaaaccagaattacgattagtaagtattggtaaaatcaccccttctctgtgattaacatatcgaaccaagtattcatgataatcgtacaccaactttgacattttaatccatcatcttttattgtcacagaagattcgaacttcctacatatagttttaggttatattgctcttctggtcttggttcaagtgtggccatgttttcccagatgatagactgatgagttggttctgccattaccaattagcaactcccatgtcctggcgttatggcacactgatagtagatcaactagttatcttcactgtttttgcaccttgtttgcatcttatgagcaagccctattcggagaagatactgtatctattgtgtgcccttacttgaacggaggaacccttcaattcacggtcttgcgatcttatgtattagcatattagcaacgcatctctttatatttttcttgcttcacatgcagcttttagtgtgtgttcttggtaaacatgatttcgatctgcattacaagtttttgggaagaaataaatatatcatagttgatagtttacaccgtgcacaaatttaagtctaacttcattcatactgttttatctgagtatgctcactgctcattttgtaaaagtggtgctaatagtggttctcatcattattttctgccttttaggcctctttcacacgtgcaaaaaaatgggttcaagaacttcaagcgcaaggtaatccatttctctttttgtaattttcacgtatgattagaacatctgtaaataagcagctatattgattttgtacaactgctggaccacctgtactgtacagttctcttataagtgaacttgcaatttcatagcactataagacatcgtgtctgtttttttaatagtccagctaatacaagttaacttctttttatacaggaaacccaaacacgataatggctcttgctggtaacaaggctgatatggtagaggcgaggcaggtgccagcagaagtatgtaattttgcttctcaaatccctttttttgtgattatatgtcaaagcactagtgcatttctgcatgaaactatcatgtcactgtgatttgatatttgtcactagcatctcataatggtgcttattttcctcattgcttcgagcaaaagtataatttggccttaccagcttcaaattactgtatttttctcctgtcacatttgacgatgaattatcagtatgttgtgatagtgaatagcacagaataactatgtctactttttgttgctcctgcttcattgaaaaaataactctgaattgaagtatttaacaaaaaaatatataataaaaagttgtgaaggcaagaaggttttctgttctgtggtggtcttttttgtttgctcattgcaacactgatctattaaataatagataccatcttttgtgtttgtggcactatcctgttcttgaaatgaatttcttttccattatgacagcctctgcggcttgctttgttgatgcttatcaaaagctctaatttgtatggtgcaggaggcaaagacctacgcacaagagaatggccttttcttcatggaaacatctgcgaaaacggcgatcaatgtgaacgatgtattccacgagatcggtgagtttagatcacaaatcatttccgcagtggatttctgtacgccgacagagctggttggttatttggtgtacaaaaatgtacacagcctgcttctgctaatttctaagcgaatttgcattcttaatctgatttcagcaaagagattgcttcaaggacagcaggctcaagacacaccggctggaatggttctcaaccagagaccagctgagaggatggtgagcagttcttcatgctgctcataattcaagtgtggagtatgtgacaactacataatgccatggcctgaaatccaggagaagtgtgtatgcatcagagatgcacacaaagcttgtaaagtggctgctgccatcccagctgctgtttcttattttgtcatgttcgttctgtaaatgtgaatactagggtgtcgctgcagaaattcagatgtattactacagtgtatgctcttgcttaagtatttctcgacactgaaacagagtaaagcaaagtctagtcagattcgttttgtttgcttcaattcagatcatgcagtgagcttgctttttacattctaattgtgctagtatgtgcaattcagaccacattcacccatttgtaccttttcgtcagaaaaatggaaaaatatgatcagattttgtagttacccttttacacaaggaatgtggtaaagatacacgcatcaactgaacaattgctgatgtagcttatccaattcaacatcaagaagttctgaaaccatcccaagcatgtgtggctcacaagaaaaacaagcatatacacgcttagggaattaacaaaaaataaataaaatcagtgatggcaactccttttgcttatgcaccaaaccaggaaaaaagggagtacaagaggaaaagctcatgaaggtatagaaccatctcacttttcctgtattgattttcaagaggggcatggaaacatattattccaaatgaaattcatcagtatgtgccattcttttttttcttaatgctatctatgttgttttcactggatgtaatcttcattgtagctgtcactgatcaccgaaacgaaccgctcgagccatggcagctggtgaaggtccttcatggtgtcaatgatatatgaatcggcgcagcggggcggcgactggcttggaggctcacccaggttgaaaccccctgagaggaacctctgaatgagagccagctgagctctctcctgctccgagtacccttcgatggcggttggcatgcagtcgaacgtgtcccatgcccatatctcggatgcttgggtggaatgcgctgccgaggcagcctcgatgctctcttcgtcccagaaaacacattggcatgtctgtataccattggtgtactcggcgccacaggagtagcagaactcgtgcccgcaccttcagaagtgacaaaccaacatttagcatatcgataagaatcaaaaggtgcattcatgaattagtaatccttgatgggagcgagcatttgcaatgcaatagctatctaggtgggcgagcaacacagagcacatctagttggatctgaatctacctagtgtgaaattactatgaagagtatgcccatataaacaaaaccctaatgcggactgtagaagaaaattctcttattgacaccagtaatgcaccttaggccccaactaagaattatatgaagttatctcttgtatgatatgataaattaaataactaatttgggaatccgggattctgaggccataataaggaacaccttggaatttgtactgaaaactaccaagttctttaattcagagtgtggtcagagacagagtgggccaacataatatagctagcttacagtctacaacatttctatctgtttggtaactttcaaatattacagattgtgggagaggcagaaatcagcgcactacttaaaagttgcactaagaaagcttcatcaaacataataaacattcgttcataacctgtgaaaatgtgaaatgattcttctctctcatttagaaattttaactactagcatgacaacagatctttactcttataataaacagtgtttaatgctttcaagtttcagttgaagcccaatgaaaccggccaaaaagagtgcttctctatgtagaattataaagcttagttctgtgtgtacttgtttatttttttaaaaaagaaattcctctttttagtctacgagattccataccagcaagtgtgccaaactgaaaaaaggaacataccagcaattcatatggaagcagccttgtgtgagttcaatcattcgtcggcatctctgacaacgcctccacctattgttttgtgctagccgatgcaaagacaggtctcctgcatctctttcatcaacaggcaagctctggtactcatcacagcccatcatgacatgccatggcactccacagttgatacagatatctctatggcattctgggcactcaacacaattgagatctgactgacttgatgtacttgctctagagaagtgctgactaagatctagtagaactgaacagtttggaaagggacaataaaatctttccatgtctgaggtgccagcttctgcaaaagctctctccagagaatcgtagcagctaactggaaggaatgacttacactcactagcagaaatatgatatttacaccttaactgtgggcatcttataggaaccttgttggtttgcagcttctcttgagtatatgaagtcaagcagctatagcaaaatgtatgagcacaacccactttgatcatctgagcgcctcgtttttcctcacagcaaattgaacaggtgccaacctcgtatggagatagatacatgatgcctatggcttctttggccaactgcagtggcctctcaagctcaaagctaggaagcaatattatatcaaagtcttccagcttttccaccagttcaagaattctgtgtcctaaagctaccaagagctggtcttctagaatttcagcttctgcgatctgtcagtgcaaaagaacaagaaatgacacatcatgtctaagtatgatataatacaggaaggcagtaagataactctattgaaataggtaattatgtaagaattctacagctttcggacaacataaattgaacaaactactgcatagaactgcaagtgatgaatacgatctatatactgcagctgcactgcagtagcagaatttggaatgtgcagctgtcataactgcacattccctaccttttcatcctttcgttcctctcagtttagttctgtttacaacagtcagctattaataggtagctgttaaaatctcaaataggaaagacggtttcttcattgactgattgttgaattgattagttcgactaacttggaaccaagcaagatggcatgaagtcaagtatagttatcgtggtgcggtccatttttttgtcattcggattaccagccaaacatgtggtatcctcaaaacatgaattacattattttggtagcgtatatcacaatgccaaactgcaacatacagtttagttaactaaaccttaagcgcccattaggtgatgcccaatagcagaaatatcagggtgattgaaagcgatactagcgattctgtgtaacattcataagggcaaaccatatattagagaaaatcggaaactcttgcctgaaagtacagcttctccgaattggtgaaagcaaagatcttccgtatcccattctgcaacgccaccaacaggccatccatcagcgccaagtgatcggccactagctcatccacatagaagtccagtttcttctgcacctgaagcataggcaccccaggtgacctctccatcaccaccccaatcccggacagcttcttcccctccgcctcggggctcgacacgcccttgaagaacagcctcaccgagctctcatcaagctctcccttggcgacgccggccgtgaatgactcctcggtgtcctcccactcatcctcatccccacagcagctcctgaagtcatcctcccctctcgaattgcaggcgaaactgccctccacgtcggctaacctctcctccattgctgaaatcccaatccaattggtgaaatccaatcaaatcaaatcaaatcaagacgacactctctgactcagttagaaagctgagcaatccccaatttgagcaatctccattcagctagatgggtcagcaagaagctgagcacactgacaggcaaccaaaaccaaaaaggtttccaccaaacgagcccttttgagctcgagactgcacctaatcccaactccaagaaggtgccttgttcctttttgccacaaccactatggtggtggtggtgatggtgccagtgacctatcgctccgacgaccccacagattcgtgggggggcctcggaatcgcacgagatttggctcagaaattggcggagaggatggccatgaagcaccagaaggagctccacatcgcgaattccagggccgcgagggcgaaattgaacggggcagcgaccaaattcacccaaatgttggagctttcgtcgattctcgaattattcctcatgcgagagagacgctcagtagtaattagcaattcagaccccgaggacagtgcaaatcaccgccgcgacgtgagctccaatcacctgcctgcaaggtgagaatttaccaacaattcagatcaaaatcagcaattgcgagaacgaaacgactgctcctgaaattgacaaaagaaaaaaaaatctagctcaaatgttggaaaggcccaagaaaaaaaaggaagaaaataccgaggcaacctgcctcgcaatcgaatctaacagcaaattctgcagaaaactcgtagaaacagatctagagaaggcgagcatttaggcccaaaagtagatattccagctcaagaaaaattactagaaaacagcaagagaaaactccgcccaacaagcacaaaaagaacccaacaaaattcgcagaaaaaaaaaaagatgaagaacaagaacacactccacacagaccgagatgcgcccaatcgaagcaagagcgagtgtgggtcagaaagagagaaaagcgggagcacctgggagtcacacgcatcacatcgaggagagatgaaaccgggcctccggggacaagaacccagagggaggaaagaaggaaggaattgagggcaagcaacaaatggagacaaagatgggagctttccggcacaccccggtgacggtgaggcgcctttccttgcggcagtggagagagaatttattctgaggaagaagaagaagaaaaagagagaggagtggcgttaaagcaaagacagaggagccctaattattccttctcgaccacgaggagcaggagcagcactgcaattgcaaactctcctcttctccttcttcttcctctccagatttgcactgctgtccctcaacaagcacaaatattgcacctttcaaacttagcactactacctctcttctaaaatgttcagttattttatcatggaacgtgttttaaaatgaagggtgtgtttagttcacgtcaagggcccctttgatttgaagaaaaaatataggaattttggaggatttcaatcctatagaaaaaattcctatgaagccctttgaaacaaaggattaaatcatatccaatcctttgaaattcctatggaatgcacaattctatagatattttggaggaaatttagcaagagctccaacctcttagaaaatttcctttgagtctatctctctcatccgtttcctgcgtttttcctgcgctccaatcaaacgaccattcctgtgttttgcgatcctatgttttacacttacattcctatcataatcatgtgtttttcctattcctatattttctcagccctgcgattcaaaggagccctaaaattgaaagtttggttgaaattggaacgatgtgatggaaaagttggaagtttgaagaaatagtttggaactaaacacggccgaagttcttttcatctacattatcttcttagccaatcataaccattctctatttaatttctttatatattttcttttatcaacaatgacaacttttttaatgatttttgtatattttattaatatttgctttgatcttaaaaacaagatagtggagaactaaggcatgtttgatttagattattagatggattatttagggataaattacttttaaagtaggcttaaaagatactactagcttagaccaaacggtcaatacagtgaaaataatttaaattattgaatggattatcgatttagttgtagaaataaaattatatatattgagaaataaacttgacaaataacttgaaacaagcaaaaatgcataaattattttagaaaaatgtagttttagaagtgtgaaacaaataatttattttatatttcgatgaataagaaaaaaaaatatggcaccatcaatccttaaacaagtcattattactcgttcataacgtgtccaattgcctacgtttgcttgtgccatatcataagacgactccgcattttataaacgagtcaatgacatcgatgttgcgagtgtttataatgggttttattgctccttgaaaccatcaaggataagttaaccaaaaaaactttaaagttttattgttaggtgtatgtttgtttatactttaccctcgtcaaagaaacaaacatgtatctaccgtagagaacaaatcaatcaatgcattctagtagtgctaggtggtacttggattcagggactaaacctgtcatatcggatgaatttggagtattaaacatgaactatttactaattacataaataagagctaattcgcgtcacaattttttaagcctaattaatccatataattagcatatgtttactgtagcatcacataggctaatcatggattaattaggctcaatagatttgtctcgcaaattagtccagggttataaaatgagttttattaatagtctacgtttaatatttataattagtgtccaaacatccgatgtgatggagacttaaaaagttttaatcccttttaaacggggtcttaatcaagcatgtatttattactactccctaaagtagtggaaaattaatataccctccttttctaaatacagtaactaatcttaaattctgctctttggaattatgaccacaatctactcttaaatgttaggtaaagtgaacgaaatttcgttcttacatttactccatccattcctaattaattttttcctaatcatctttcacaatcaattttcagcatcatgagattaatgttttaaaattcattgtgtaatatttatataatgtactccctccatctacttttgatagtcatattccatcttggcacacagaccaaggataagtaattctacttatcatctatttaaacatgctaccaaggataatatgataggttgttgaattgaaatatgcctatcaaagataaatttttcagatttagaaatatgactatcaaaagtagatggagggagtatatttcacatgatattgaactataggaatttctaaaattttattattgttaaagatagatatgttaacttacgataaagctaaatcaacaagtaatatgaaatgggaagtatatgacatattacacttaaataacatataacattttttatggtttgtaaatacttaaaagaacaaatgatcaaaattttaaaggtggatagtgtgcctaacgttggttattttgtaaaaaggtgacgaacacactgacagccgccaagaagtaattcatccggttttataattttaaagttttgaataataacacgatctacaaaacgcatctttaactatgattttctcttgtaatgcatataataaataaatatttaattttgttacagtatttttaataataatctatttatattttttaagtgcattcaaacttgtaaatattttagaagatactaattgttaaagaaattttaatagtttgactccagctgaattaaggaatcggatggagtaattagcagaagagaggaggtgcggattgcaaaagaggcatggaagtggttggtcgattgattgatgtcgagtttaatggcggtcggggcccacactcacactcttcctgcatctgcatgcgaacggaacggaagaagaaatcctccgttccgtttggactcgccaagttggggcggtggagtgggcccacgctgtcggcgagagcagccaactcggaccagcgacgtggcaaccaccaccgtccagtgtcagcgtcagcaactgagcatattctaccaaaatcatcttcctcctctcatcaattattattatgcttattaaggatcaggaacgactacgtgcacaggattctaatctcctaatccgattgaaaacatgcagagattcttccctgcattctgaatttctgatgagagaatcaaggatatgagcatgaacgtgcggataacaaaaaaacaataacaatttttagaaacattaattctctctaatactccctctggttctatattaattgacgttttgggcaagcttgaggttaaacttttataactttgaccatcaataactttaaaaatatttagtttaaagaaactaaaaaaacatatatagatttgtcttttaaaacactataataaaagtaaacatgcattcatttattgtatatattataacagaaaaataaggtcaaaggtatatcttgtagagcgtgtcattatccaaagcgtcaattaaaatgaaaccggagggagtaactaatgtatgcatgtgtgtttccttgcaatcgtatctttttctccttttatttttccttttcctttttactgacgacagcacctgattcaagattctaatgctcgcatcttcaggcttttactaatttttttttcttttcatcagtcttttttgaactcgattcttttctcttttcttcaagagcaaaactcagctttaatctactttctgcctgggccgggattcacacactgattaggcaaggagggtaggcgatagattatactactgtatactgttgctgattcagctagttgtgttgtgtcattaataggaaattaaccacagcttgggagagctctagctaaagaactcttgttcatctactctcgcgtcgtcctcccctggggcggcacgggaggcgacgacccagccacccatctccctccccttcttcccctccgcctcgccgccgctcgagcggccaccggcaaagccggccggccgcaaggacggcggcggcggggcccctcaccgacctttcaccgggcaggcaggggagccgccaggcgggacggcggtgaccgccagatccaggccgctccggccggatctggcggcggggaggacggcggccacggcggcggggatggcgacggcgaaggcaggggcgcgcggcgctaggcggcggcggctgaaggcaacgggaatggcgatggcggcggggatggcgatggtagcggggaaggaaccggccgcgggcgcgaagatggtggtggtggtcccgtgtgagcttgtggtggcaacggcgcggtgctcctcggcggcggcggcggcagtgtcccccagatccgcgcctctcggccggatctggagggtggccggcggcaactggcggcggctgtgcggcgacgacggcggcggtgcggcgacggcagcggcggcggtgcggcgacggcagcagcggcggtgtggcgacggcagttggcgacggcgacggcggtcgcggtagttggcagttgcggtgttggctggcgatggcggcagtggcgcacatggcatggggcggcagccagccgcatgctggtgaagggtgacggcacagcggcaggttgcggatgcgggggctggagtcggtggcagcggcgacggcggccgtttgtggaggcggtggtgacatcagcggcgaggcgaggatggcgacggcgaggaagctgggcgttaggcagcagcggctgcggtggtggtgaccgtgtctgcggtcactggaggcatggcggcctcaaacggctagctgagggcgtgggaggcgactacatctggccggcgcggcatcgtttggtggaggggtcggagaccggcttggcgcagagaagcgcagccgatgacagcggaggccggctcggcgcgagaggcgcgagcgacggagatggaggccggcttggcgcgggaggcgcggccgatggagggagaccggattggcgcgaggcgcgtccggtggaggaggccggcttggcgcagagtggcgcggccggcggtggaggaggcgacctaggggtgagggagagctgccggtgggtgtagcgcggtcttcagcgctcgaagactggccggcgggggacgccggtgcaggggtcccacatgtcggcaaagcttgtgtggtggtggagcatcggtgcgtcaggcgtggtttcgcaagtggcgagcggtgggtgaaaacccagtccggccttggtcggaccgacaacgatggttatcccccctcctgagagcgttgtcgtgctgtctcacccctctggtgaccttgtctgtgtccctttgttagcctagtggcggtcggtcacgcttagcggcggccggtccggtgttagccttctcctgggcttgtgtgatggcgttgtcgccgtgtgggtggtggtttattttttcctttttcctggttacgaccctccagggttgtaaccttgtaattttttcctactctatcaatagaacttcgcaccgtctcgtgcgagtcgttcagaaaaaaaaaaaaaccacagcttgatacaataatccagggtaataattgcctgaactgacagttcattcatagagcgactaaaatacttgcatatatatatatatatggtatccccatattgatcctttgcaatcagctggctttcatgtgcctaggcacattggtttaaagaaaaaacatataaagaataactgagacgataagataatgcaacaggtggctaaggttagataatgcagcacgttctgcaagaattagcaacagtaatcttgcctgcctgccatctttcggcgtttagcccagtaatcagttttaggttttgagggtgtactcttctgcttggaccagtcagctagcagtgctgacctactactaataataagatacttgtactaattattaaaagatacagtacttactactaattggagtactggtagtatggaatatgtttagcacctgttcattacaacaagtactactgtactaatagctgttctgtcgtctaatggtaactgtacctatcatatagcaggtggcttggagcttagcaagggaacagtactagtgttagctgtattaatactacgactatcttacactggagagagaacagctagtgacacactaaccaatcaagctgtagtagttcagtagtactagtagcttggatcattttgccatgaagttagctagatgccaatcggctcagccattcattatatactcctacatctactaaaagattaattagagtggaacagataatctcagcattcttcaaggttagtatagtattaacagtgtcagagatatggcactgattagatcatactgtcgagatgattcaataatactgacctatagctctttgacactgtatacatgcatgttatgatcaatgtgtatgcagtaggttttgcaaaaccatacgattatcatgcgtttattattagtctccttagtttttaaaaccacaataaatcttacgataattatacgattaccccgataaccgtaacccattcaaaaactatttgatgaacgcacacgatgctttacgagagaaccttttcagatacagatccctgcttccactgcattgcattgttctgatgatcggtcagaaattcagaatgaatgactctgaagcagcattgcagttgagttgatggaactttacatggcagagcagggcagctaatgacaaggcatgtgaacggcactttgcagctttctgtctcccccttgattagcacagagatcagcaacctttggattttttttccctattaatttattgatatactcgagcctgacagccgggacattagtattagtaggagtatataatgagtatttaatctactcaaagcagggcatgtatatataagtagtaaaagaaaaagaaaagtgtactatatataggcaacagtaattacagtatgaaatttggagtaatacactaatactccctctaacccataatataagacgtgatcaaagttggcacggtctccaaaacaaatctttagcttacaatttctcatatactataaaatttgtagcaacaaaattatagccatatgaaagtaaatttaaatctccatctaatgatataatttttactcctttcattccaaaatataaggcacaaccacccttaacccaaaaaccaagaaataattattatcatcttgtagtttgaatcatcctaataaatataatgcatgcatccaataggattagataacatgagagtagaggatttaaaaaagtaataatttaatggagaagatgccatagttaattgcatgcttgcatgcatgccttatattatggaacatctaagaaaaatggttgtgtcttatattatggaatggagggagtaacaaataaaatttattttatattatactaagtgttggtcaaatgtttttgttttaaaggttgaatcttgaaatacgtgcacgccttatattatggaatagagggggtactcattaattacattacatggtgaaattggtttatcttcttgcatgtactccatacaacaatgaccaagagtattaattagtacaaccttgaaattaaactcgaacaagaccataaaaaggcccaggtttgactgcttggccctttcggatcacacaaggaggcccaccacgatctggcccatgtatattacgggctgcacgtaggtgacaatccccaagggcccctatttaacacgatttccgtttcatgggcctcacgacaggctgagactgcacagagaagcccactctcgcgtgcgcatttctcacgggcagcaccctttgggcctttggcatcccctgtgagcaagggtctattttaatgtaaaattattcccctcaatcccctccaatactttttaatccattctaaatcgaacaagacctaaatgtttcggcttcgttggttgggagctccggatttatggtctatgcttttcgactccaaatgatcgcatgtatttctcgtagtcttagaggatgtttggatgggactaaaaatttttagtctctttcacatcgtatgtttgacactaattagaagtattaaacgtaaactattgataaaatccatttcataaccatagactaattcgcgagatgatctattgagcctaatcaatccatgattagcctatgtgatgctatagtaaacatgtgctaattatagattaattaggcttaaaaaatttatcacgcgaattagctctcatttatgtaattaattttgtaagtagttttatgaatatatataatgatattagtgtcataaaatatgttgttttactcgggagggtatgtttcgggttttcattggtttttatcctgagttgaacatggaggagggcctgtaggaggcaagagcttgggccaaagaccggggaagctaaggagagatagggaaacccaactgctgccggtcggaacggacaagaaagaggtggggataagctatataagagataaggccgattcaattggaaaaacaatatactcacaatccaatctagccaattgaatcgttttttcaatattgctcatagttctagcctagttcatccatctttgtcgatttgcattgtaaatcgtctgccttcgccgcaagagtgcgaaatccatctatcccgtaaacctttcgttcacccacaagacgggtgtttatcgcttgttctatctaaatcagctccactagctggtttaatctatcaaaacctattttgatttagcttttgctagattggggtggttggcgactctataccaccataagacgtttagagtgtgctgattgtgattgtcttctcgccgaaaaagttaccaacatgatctaatctaaataatctgtaaatttaaaataatatttgtgttaaatctacaaaatatgataacactggatatcttattatatatcgtggtataactatatatctcttgatcacgtaatttattctatctgatctgtaactagctctggacaataacaacaaccagaattaattagcaatctcgaaagctactaattaaccttgactacatgcttcacctgcaaggtacagttatacctacattttacatgagcaaagagatgcacgcatattgcttgtttttgaaaattttaaaaatcttatagtattaatttgtatttattgtcttttgcaagtaagcaaagtgtttggccgagctataaatcttaaattgagatggaccaaacattaaaatatatggagaaaattaagtagagtggagctaaaaacaattacagaagcatagcggtgacaccctgcttcgtaactctgctctacatttattttacgaaaaattaagatctacttcctccgtttcacaatgtaaatcattctaacattttccacatttatattgatctatatctagattcattgacatcagtatgaatatgtgaaatgctagaatgacttatattgtgaaatgaaggaagtagaaaagttcttccggcatatatagatccaaatccgcagtggagaaaatggatcactcactgagacatatctgaaatgcattttccctccatttgcatcactaatttttaaagttgtttcataatataaggcttgcatgcaaacatgtcattaactagcacatctttttcattgaaatattattatttaaatcctccatcattaagatctctaattttattaggtgcatgtattctattaaaatattattatttaaatctttcatcataaagatctctaattttattgggtgcatgcattctatttatcagggcaatctaaactatgagaagataataattattttttggtctttgagttaatgatggatgtgccttatattattttggaatggagggagtaattcattagcagtattactaggagcactgctacacgtattatatttcttttacaaaactcttacaaacaattatttcaaccatttgatttaaatagatggaagttatagaaaatttagatgtcctcaccgcgtgacacatagtgttagtaagagtttagtgtgacaaaatttagtatgtatagacttttcttattagtagcttccccgtcatatacagccacatgccgtcggtccatttccaccaattaatggacgagtctgcgggtcgggcgcccgatcggtgtggagaaaaatcgggcgctgacgttagcatgacgtcaacacccgatttacttgcaaaactactttaaaatgattttttttctcaaattaattatccaaattataatccgattgcaccattaaattcgttgcaattaaatcttcaaaacaagaccacacatatatatatatatatatatatatatatatttcgatgaaaatttttttagcttattattgaattatttttaaatgttgcacgatgttccaccgggtatatcggaattgtttcactaagtagatcgaaaatgtttcactcgtttaaatcgtgttttgtttcaccttatataaaaacaatgtttcagcaaatagcgaaagaatgtttcagaatgtttcactcgtttaaatcgggtgttgtttcattaagtagatcgaaaatgtttcactcgtttaaatcgggtgttgtttcaccttatataaaaacaatgtttcagcaaataacgaaagaatgtttcagttcactgcaatatttgatccatacatagtaaaacattataagaacgctaggtgaaacatttttcagtggaacaaaaaataaaacgaattcccttaatatgggtttctaaaatatgtgggttttttgttgcaatggaatatttcagttcactgcaacgttagatctatacatagtgaaacattatgagtacactaggtaaaacattgttggtggaaaaaaaaaccaaattcccttaactaaaggtttctaaaatatacgagtgatttgttgcaatggagttgtgtgtgtggataagtggcaggtggacagggaacatgtggtgggggccaggtacgcacgtgatgggaggagggggaagctatcgactttttcccctccccgcgcgaccgagaaggagcattctcggcaatcaatccccaatttaatttgtgttgttgaacatttcctcctcgatatcctgtggacctgtactctcgtatcggaaccaaaacaattatggagtgataacacgcacgtgattgaattatttgcagtccgttaatgcgtgtttatccgaagaaaataagacatacagaaattttttaaaaaaagaagaaaatactatattgaaaccaagttaattaattaatcaattaatccgaatagctaaaaatatatcgggaataataattaattaactaatttacagaaacaagcgggacactcacgctctatatataccaagcccacgcgcgcggccgccacgtgccacggtaaaagctgagccgaccgccgccgccgccgccgccgccgccgccatcgacgacgacgacgcaagcttcccacagtggtagtgtactccggccacgtacgccatggccgtccccaggagatcagagatggtggccggcgataaaggcgccgtcgaaagctgcaggaaccaccaccacggagaatgcgccgtcgacctcgcctcgtcctgctgcacgtgtgcgccgcccgccacgacggcggcttcgtcgaggaagaagagaccgcgcgtcgtcgtcgccgatgagacgacgacgacgaacaccgtcgtcgacgacgacgatgaggatgacgacccgtcggccttgctgcggcggcgggcgaggtggaagcaggggctggaggcggtgaagacggccgtggcgtggcgtctggcggcgaaggacgacgagatcaggcgggcgcgccgggagatggcggagcgcctccggtgcgcgtgggcggtgtcgcgggcgtggcagagcatcgccgtggcgcgggagggggagaaggccgcgttgcagggcgagaacgccgcgctgcgcgtcgagctcgaccatgtgctccgggcgaagccgcggtggcaccacgacgacgacgacgccgagtcctgctgctacggtgacaacttcaccgacgacaccggcggcaaggaggaggacgagggcggcggcgacgcgagcacggcggcgaggtgcttcgggtgcggcgagagagcgtgctgctggcagtggcacctgtgcgccgcgtgcgcggcggtggcggcggcgtgggcgtgcccggcgtgcggctactccaacatggacatggacgacacatgcatggtgtaggaggagaattgaaggagatcgcatcacatatcatatacatagctagcttcaattcttcttcagttgtagtgctagatttggttattcaatttgtgaacacaaatcttgtcattcgtaatagtttggagtattgatggatttattcttaatttgttaatcgcaaccccttggatagtgatacatgtccctcttaattaatactccgtttcatattataaagagtaaatttcagaaaactactactatagtgataaaactatcagtttgctgcaacattagcgatctatttcagtttgctacaacaacagcgtgggaaattattacaaaactgcaacttttacgtgatatgctgctacagttgtaagctacagttttgtgataatttccaacgctattgtcacctacatatactgtagcagcatataacataaaagtttgcagttttgtgataatttcccactctattattccagcaaacgactaaaatagatcgctaatgtggcagcaaactgatagttttgtcactataattgtagttttctaaaatttactctattataaatgtttgggtagtgatatgcttgccacttaattaatacctcctatgtttcatattaatatttcctccgtttcatattataaatgttttggtagtgaaatacttgccacttaattaatacctccattgtttcatattataagttgttttaattattttatagtcaatcttatttaggtttaacgtaagtttataaaaatatttaacaacattgtcgacgggtgatacccgtagaccggatatagagggtattggggtacgttggtataaggatctacgtaatacgacatcaagcaaacaaaagacgaagattatactggttcaggccccttgacaggtaatagtcctaatccagttgatatgggattatatggtggaaaacacaggttacaaaggggacaatggaacttgtagtcgagtcggatccggcgagatcgtagtcgagttggttcgactagatcccgatgacttggctccttgcaggctccggcttcgtaggctgtatgagttgtgttggctctgagagtcgatgccttaggccctccctgaggggtcccttttatatcgcagatctggaggtttacaagtagaactcggagatatcagaccctgtacgatacattaacgactcaatcttgtccgagtaggattcttcccatccatagattctgtgagggatttccttagagtacgcaggaagtatccgtatgcgcgtgggtataccataccgatatgtaacgtatatcgaagggtaaagggtatgcctaacccgtaaccctgacaaacatctgttatcaaatgcttcgtttgtatgaaaaagtttattttatcctcctcaactatgagacatgcggacgcatctttaaaatacagatgggacgaagaacaaaaatgttcactcgataaaagcaatcaaacataacatatatcgtatttatagttcaatcatataactgcctcaatcattgattatggcataactaatctgttggacgttcccacctacctaagtgacattaaaaaaataatataaaatataagtggaagccacatataagccccacaaacacgaaaatcaaccagctagcccctctctcttcctcgatggccacctactagaaacaaagtaatactgttttcagtcttgtgttacataacacatgcagttgaccatccaaatatttagtcaagcgacttaattaaatgaaattcacatgctctgtatgcgtacgtacacacaactgatcatccacatcaaccacacatgatcaatcaattaatccatgaatccatggatatactacctccgatctcttggagttaattaattaattaatggacctgattattgagtgagtggagtaaactaattatgctccttagctaaccgtagtttggtcgttattatctttcaattaattgccacatgccgatggacacggtccacacggataatgctacgtatatatatggttaagatatgcgtgaccaggccaatgtttgtccttggaatatactcccgtatgtcgtcgttgactttttttaacaagtttgactattcgttttattcaaattttttgtgtaaatataaaaatatttatgtcatacttaaagaacatttgatgataaatcaagtcacaataaaataaataataattacataaattttctaaataaaacaaatagtcaaacgttggacaaaaagtcaacggcgtcatacattaaaatggaggtagtataatttaattgtactatgacattttaatatagtttaataactatagttgcttcaattcctgatcgaagtgaaaagtcaaaaaggaaacttgacaaagtggactgcaagtctgcaagtgtcaccgcgtaccattagacgtactcactgctacgtgtttcttgacggacccgtaacaaatgaaccattaaacaaactaaaactgtcaattgaaatataaaaacaaattaaggggaaaacgtgtttctatcgacagggagcactcgatctcgtcatttgaccaaaagttagatcggcgcggttaaaaaaatgctaatgaggtcgaattattttaatctaagataaaatttactccctccgtcccataatataagggattttgagtttttcttgcaacgtttgaccactcgtcttattcaaaattttttgaaattattatttattttatttgtgacttactttattatctaccgtactttaagtataacttttcgttttttatatttgcaaaaataattggaataaaatgagtggtcaaacgttacaaacagaaactcaaaatcccttatattgtgggacggagggagtaccaattaacgttaattgataagaaaattaattttgtcctaataatattgtggttcagtttaatttcacatcgtatgaccacagtgataaaatctactagtgtcttaatagagtagagtagtacatatttatctattgcaatatatgcttattggtggacttggaccatcgctctaataatttaaactagtgatagagcttagcctgatcatacaaccacacctcaaacttcaccaccaccggcgtgtgggagtctcttttagcgtgtgaatggcttttgttgagtgttgagctcggtcgtcctgttcttgacttctcgtctacttacttggtagcttagattagttggtggaatgtatgagtatgatagttgtgtggtttttaccccgttttcgctaattaattctgtatttatggcatgatcatgttatctccttaaaatggaacactcgttctttatataaaatgtcagcaacagtctgaccgttcggaaaaaaaaaacaccaccacgtactggtgatatagttagcgctatatttttattatgaaatagtattgcccgtaatcaataaaaacacttgttaattttgtaggctcgaaaatactatttttatgggcttgatgatgacactggctctgcaacaaaagtaacactgcgactagtgttatccatgtcgtcaaaagctagctggtgcaggatgcctcgtgtgatcttctcccataccttgccagtgagcaaagatggcttccctgcagtgttttttgtttttatttttacgcgtgctcgcaaacaaaaagaagattccgtgaaatctatcgcaattttccctcccctttcattcaccgtactaactttatcttctctacagaaatttaaaagaaaagtatttcttttctacatacaaatcaatatttcttcgtcgagcgtgtcaggaaggaaggaatgttccgtgctgcctaaggaaccgctcccacctttcccactgacgcgcggggcccgcatcgccatcgccgcgtggtggcgcaccattcgcgtcaccacaactaacctcctcccctctcccctcgccgcgccgccgccgcctcggctcgatccgcccatatatttcccacgcattcatcgcgtcgtcttcccatctctcccagatcgcaacgaatccaatcgaatccaatccgaattcccccccatctctcctctcctcctccaaaaccctaacccccactccccatcggagagagatcgagaggtggttgtcatggcggagtgctcctcctccgacgactgggtcatgctcgactccgacaaccccgccgactcctcctccgacgacgactacgtcctcgcgctctcttcctcctgcaacactcccgcctgctccgacgaagaggaggaggacgacgaggtggggagcgacgctgacggcgacgacctctacggcggagaactcgaggaggaggactcgccgcgcccgccgccgccgaggccgctctcgggcctcttctaccacaccgcctccgacaaccagcccgggtacctcgccttcgacgccatccgcagcgccaagcacctcatccccgacccgcgcttctccgccttaccggagcacgtcgccgtcctcgcctccacccgcggcctcgtctgcctccgcggcgagaccaccggctcctactacgtcgccaacccggccaccttcaggcgggtgcgcctccctcgccacacccgcgaccacgtcgaccccgccgtcgtcatcaccttcgaggagcccaccgcctccgcctcctgcttcggcggcatcggcgtcgagcactaccacgtcgtcgtcgccttcaacctcgggggcggcgtctggtccttcgagtccttctcctccaggacatggaagtggcgtgtctcccccgggatctccatcgtcgagcaggtcgagtccttctcaggtgtcggcgcccacggccgcgccttctggcgcacctccatcggcttcgtctactacgacccggagaagggctacccccacgagttcgccgcgccgcccgaggtggaggcccggccgttctgggagatcggcgagatggagggcaacctctgcgtcacctgcatggaccagcgcgtcaccgaggtggcggtgctcaacctcgacatggacgtcctcgccgccgatggggtcgggtcgtggtcgtgggccggccagttcgagggcagcagcctcaggaaccgcgagggcgtcgagctgctccgctcgcagggcatggcggaggtcgtcatgtgggacccctcggaggagcgcgtcgtcgccatggacctcgaaggccgcaccacccgcaacatcggcccgctcacaggcgaggactactcgagaggtttcatcccctacgttgcctcaatcgccgaaatctccaggtacctagctactggctactgcattcgattcgaatttgccgctcctacttgtgaattaattctgtgatgtgttgttaatcttctgcatccgattcgttttgatttgccactcctagctacttgtgaattccgtgatgtgttgttaaacttctgcatccgattctatttagcagcgctactcctgatgtgttagatcgatgcgatcgacgagtcaattggagtttcgtaccaattcgtcaattcgtgtattgctatcgagttggtttggatctgtagcccattcctgattaattggcgattagttaggatttctgtaactgctacgtacgcgtcgtttttagctgagtttttgcagtgccagtacgttttttgagttcgttatagtcagatccagacaatactcgcaggatagcttgtgtatcgaggctgatatcagcctactacattcccaaacgaaacgtgttgttgacgctttaaatcgaattgggatcagttgtctgtaactgctacgcgcgcgtcattggtcagtcgttgtctatgtctagatgatgcttgtggagttgtgatgtactgaaatgtggacatggatgcatgttactgtggagtggagttgagtggagctgatagacaatagataagatctctgtttgaccattccaatggcttagctggtttgattttgtcagtcttcaatagactcccaaagtcggtctccttacccgagtttaattaatcaaccgatgataagatttaatggaatgagacccggcaaaaaagataagatttaatggaatacattgtttatgttacttccatatatgatttgttattaatataagagcacaacacactggaatcatgcattgcaatttagtttagttaatgatccaaattcttactgtattaaattgtccgatgtcttgtttcccatatgtgtatcctgtacatatatatcctggcattaccgcattagactgagaatgagtagagatcgatagctcgtcctgctttgtcatctgcttaggtgtagacattttaccattaattgctgtctgtttcattgattacttgaaaaggtgcacaattttgtgataatagtcatatctatttcgttacattataattaaatttctatacccatttgtatgcaataaatcatgcatgggcaaaatctgtactgtactgaatgacaatggtttgcacttgtgcttttgagttaccagaatttggatagttcaccattgcatagtctgagtaaatattcagagcaacaacttctaatgctgctgcaacagagtaacaagtactctttagctgaacttttctgcatttgtgtgatacatgattagttggtcacggactgtcaagcgcatgcagctttgcattcgttgatgttgatgtgttatccactaacagttgtgtgctctgcttatgtttatgttgtcagcgatcaaataagttcaaagtgctctgctagtgctgctgatgccaacacgcccaatcttggagcagcagatgcgaccacgctcaacaacctcgccgcacctgctgcgcaagttcactgaagcttcaactaatctgtaagtcgtatcgtatctcgtcaattccaattcagacaaataacataacctgattgattgattgataatataatctatctgtgagatatgatgatactctgtttgcattgcaatttatttatcggtggcatgcatggcttggcaggtaccaatagctagcaggcagacaggaagattcgttgacgatgaccaggaataaacgaggctagctttcagattgatttgtccagcataaaaaggaaagcgaaaaggcatccttgattgagtggcaactggactactactgccataagcattctttttgcagctactccgtatcggatatgaacactaagtatctttcttgttaggttttgcgtctgccttgtaaatattagcagtagcaggctcccttttgtgtccgtccgtcgaactatcattgagtccttcttgagttgcattcagtcagtcagtcagtcagtcaggtccaaactagttgatcgagtgggtaaactttgaaactaccaccgtctctggtgttcctgatatgtcattctggctgggctatgcaattatttcttttgcttaacccattcattcatttttagtatttcctttttgttattccggttgtttctttgctgtttggaatcaaccacccagcaatttttgctttcctgggttatgacttcttttcactaggaataggaattaccattttgttgtacagcgctttgttccatcttccatggactgttgtttgctttgttccatgtactgattgctgctatacaggagaatgagcttcatatgcaccctgtaattgactggtgcaaagcttgttgacgctgcaaccccaataattgtttgagatgtgtagatggacaatgctaatatatgtactatgcttggtgcttttgatttggttttaccaatcctaggatgtattgcggacattgcctcctcctgttgttgttgttagttcttagttatataatgtgaagcgagtaaaagtcagtcagtcaatttcaggaaactgaaatcaggagatttagtgaagaaggcctgattctacaaagcactgttgaaatctacaaagctgctttgctcaaatgcaaagcagatttgattgatttgagatattgaggtctacggagtagtggcttgcacttgcagcggaataagctgcctacattctggaatctggagattcagatacctcaggtacatctccaccgcgcagaccacaacgtaccacatgacacagtgccatatcaatcgtgacaacggaaagcccttgcaactatctaaaatatgttgttcgatgatagtttcatcaaaatttacatctatgaaagttattctagcaaattaacatggaattttttttttttgccacagtcaacaatagacataatatcaagcacaataactaaagcttgcgcataagaggctacaacttgaaaagatgatctaaggtacgtttatacctaggtagtgtttagcaaatgggaaagggaaatgatttcccagccatctttaaatcctaacaattcattcttcctcttccatttaatcctaacccttcattcatttcccaatcccaatcccacccccatttcccattatccaaacacacccctacagtatggagaggttgcaataaggttgcggcaatggagacgacgtcttttgtgtgggctcctaaatgagtaggtgccatcagaggtggagcattgccgatgtcacgaggagatgacgacgatggtagtggaccacgagacgatgcagacgataagagaaggctaaatattagtactactataaggaagatgactaataagagggaaggaaagaactaggaagggattacgtcaacgattcaacgcctctacacggtctttttctctttcctctcttttttttaaggcaatgtgcaacttgctagggaatcaaggaatccaagcgcttgcaatggttagagttggctatgagctctataaaagagtaagaaaatatgtcctaccacttcctcaccggaggtgtgttgggaaggaatactatttaatacaagaaaaaccaattcttcgcaactaaaaaatatcccaaatcctccatggtaaggtgtgaactaaaaggagaaaagtgctcctacgtcctctacgttacacacgacatgcagccttacaaggaagagtaatgcactgttcatagaaaaaaaaacaaagcaaagaagcaaaaacttgcactgttgatagaaaaaaacagggagagaaatggacagtaaaaagagcaaagaagagaacttgcattgttcatagtaaaatattcatagcaaaaatatggcaggaagaagagagaaaacttgcagtcttgcactgttgatagaaagaaaaaaaagaaaggaaaggacagtaaaaaaagcacagaagaaaaaacttgcagtgttcatacaaaaacagggcagagaaggaaaatgttcattgcaaaacagggttaaaaaggaaaggaaaatgttcatgcaaaacagggcaaataaaaaaaattactacgcgccaggtaggggtcgaacctacggccttctgcttaggaaacagacgctctatccactgagctacaggcgctgttgtttacttgagagcaaacaattattgtgacaaatactcttttctccaaaagaatcaaaagttatgtaccgagctaaatctcctcgcatattgtatcggttgcttttgcaatggaaaatgtcgtctaaattcgtttttcagatatatggcggcagaaagaaatggcactgtggagattggtcacagatagcactgtgttcttttctatggaaaatgtcgtagacattcattttccagagatatagcggcacaaagaaatggcactgtagagattgatcacaaatattagtatgttattttcagctctttttagctacctcaccatacggatatgcatagaccacttgttccaagatatttgataattgttaaaaaaatatttaatttatcctacaatcaagtagataatccgatgaataatatatttcagacaggctgcaaatagaagagaacaaatgcaaaatatcttcatactgggaaatagggtcaggtggcaaagaatgttcccctctctaaactagaaagtcggccaattaattcagaaaatgtgcctctcctcaagaaatgtttgtccatttccttaatatgtgagctcacatggcacaggtgtttatacctgatgtctgatgaggtgcttttcattctgatggaattcggttgcttttgcagtgcagtgcttgaacgagacccagcctggtgtcaatcaccgtttccatgtttcctcgggtcaccatctattttgtcctgagatcttccaaaacaacggaggcagcgttacggcccggagcgcccattaccccacctcctgggtgtgcaccactgccacagaggtacaatcccttcactggagttctgtaatctgacctgaagaagtggtgacgacatgttcacggtcatgacagatgaaccttgacaggcctaagattcgccgagtagaagggtgaaggaatatgcatgttagaggtatagacataccatcccttggcaggcctcatgaggaaaagtgaatccaagcccattgcgccatgaaagatgttaccacctgtgaaaatgtgaatcaaatgctcgtttaacaaggttttcggatgaaaacagcaacggtcagcactccgcaagaagggaggtacactatgtataccacgcaaacagattacctgttaggccaaactccctttcaagatcaggtggagtcagcatatcatagcctaccactgatgagctaaaacccggtgcatattcatcaatcaaggaaaagcatctttcagcaaaggatttctgaaaattggtttcaattaaaatgtcaggggtgcctctctgtggatagtaactggtgacaaacaataatgcataagggcatcatcatcatccactctgttcgattaaggagaaaggcatatgtgggaaaacatacacagcaaaatctgtgcagccatgaaagcataaattaaacgaagtgcatcatgacatcaaacttcaagaaggaactacttactctaacattagaatcctgccagctgccttctgaaagtttgtatggtgtgtactgaacaaaaaggttaataacatgctggcctatcaaaggataaagcaaaggatgaacattgattcagattatataaagcataagaagaaggtgaggtttcacagccacatatccaaattaaacttggattttttggggggtgaggaaaattaatcttggatatatgaactgtagggcacaattatagcttatacaaatcagacaccacacttttatgcaactgcaatgctgggaacaagaaattggcatacctggtggggagatggtcttatccaacacagaaggaatcgtcatttctataacaggtcttgtggatgagacgccatttgcagcttccctgtacgctagatcgatttcctccatgctggagttccagtaaagttcaatatgaaaagataaggataaagttcaataacatgaaaatataaggatttgcatagagaatccaacaaaacgctacatcatccagtagtttccaatcaccaaaataatgagaaactagcagtaggctgcatgatcccagtcaaatgtatttgacgttgggagaactgagattagtttttccaatgtcaaatgtttttgactagatgtagtagtatattaccgttaacatgttcagattacactcagtactgtcctaaggtactaatggagacatgatatttctatatacacgtgcaggtcatcgatttggtacatagaattgagacaccaagtgtatagtatttccaaagtagaagaatatgttaacggaaagatgacatcatggaattaagagattatttcacttgcctactcattactcatgttggcaaccaatctatactacacaggaacgggaggcaatataaaagctggtgtctcaaagattttcaattgtgtacagctacaacagaacaaagattaacacaactgaatgcaataacatgccgcagatcatcatagttgaagtagaaaaggttccataacttcagtaacctacctttcagatccaatgtgtatggtgcccatgtgttctggaccgccttcaggattaaagtctttgcaacaggaaaactgtggcagcctgtcaacagccacattaattttcgttgttgcctgctctccacagaatcatattacattgttatcaatcaatattataacacttatttattatgttatgcttcaaagtacgttcttacagagctataatctgcagttttgatagcagagaggaagttgtctggaagaacattggcaggcactaggtcctgaaaaggaaaccagatatcagtgtacaaatatttgtttcattgtgtctacaaaattggaacaggtattatatcttcacgttgttatatattctgagtagctcttaccacaaatgttctatatggagttgcatttgataaaacaactgatgtcagcacctctgttccatcagccaaaactacctacaagttcccataatttcaagaggttcaaagaaatgaaataggagtaccatttatcggttagtcaaagaacttaccccctgtaccttcccagaagtgtgatgaacagatatctgggaaacctatataaaaccactagagtgaggcatgttgcttaaacagaaatctgggtgcaggataataattcaccactaaataaaatttgaccttttcttgtagaaaaagccagcattttacagctgtcaataaatagttactcattttttctattcaaatttgaatgctgctccaccatacgtaatcaaagaggtaatatcatggcataagaagagaaaatgcacctctgcatttgttaaaatttccacacctgcttcaagagctgctttgcttatagctgacgatactgaacccataccaccttcaacatacctgaagcgaatgtttttgttttaccacataagtttttcaacaagcaaaataagaagaatcaggaaaccaactactaatgaaccaacaatgctaaaactagcatatttggctagaaaccatatgaccattatatggcatttgccctgtttgactagacagtggagatatgcgccagcaaaacaattcctgatgctagggccacaaaggcttggacatggtttcaggcctagaacaatgaaggacctattatttttctgcgggaacagaataacagagagaagctcaggttaagagtcatacgcccatactccacgttggccaccagtttcccccataacatgatgcagaagaacataaccagatcctggagtgtggacaccagcctgtagaaagtccatgcagcatcaaatgctaaaccattaccattggccacaacacatttcttggttcatccaaagcacccttaccatagaacctatcacagcatcagtcgcaagagttgccttcaacacatcaccctgcagttaaaaaaaaacacaattgtccatggttacaagaaaaacatgtgaatattgtcaattcaatagtgaaactccacgttgcttcatatgaacaatgtgataagaagtatttcagagaacgggtaaacaagatatcaacctcaaaccagttgttcaagatcttggatgctggtgaaaggagaaggtcaaagaaatccctgtgaataacatatttccaaggaaacagaaaaggaagattaaagttacacatagcactgtcgagtcatggtgttgatggtggcatttgcaaagggtcagtatttatactcacaccatgtccttctgcccctgctgcatcacaatcccaagaagtttgctccagaacacagacttgtcaaccttatccttcatcctgtccaccatggagaggtggtattcatgcctcatctcagggggaggcgagtctatgacaaagtccatgagtttgcagaacttctccagcttctcctcgtacctacatttacatgtacactacccaactaagatcatcataagataaaaaaaaacatgcacggtcatttagtcacatgaccgattctacctaaatttcacaatgaaaacagagttcatataatcaagcactactccaagattttataactgaaaacaagagtcaaaatatcagtgagtctatcacctcgggtatgcaccggcatcattctcggagaacttgctgatctccgagtggttcagctcagcgtcggggccgagaaggagatacctgccgtctaggcatggcgtgaatgacgacgggctccgcggcaagagcttcagcccatgcctctccagctccagctccctatcaagaaaagaacccacatcaaagctagcagcatcagaattcagttagtacagtgcaatattataacccgcatttgcagaatgattacagaaatgcatatgaacacagagctgtgggaattccgattgacaaatagtatttgggtgggtagggggggttttactggatcagggcggggcggaggaggctgaggaggtagctgcagcgggagaagcggaagcccgggacgaggtcggactcggagacggcggcgccgccgatgacgccacggcgctcgagcacggcgacggagcggccggcgcgggcgaggtaggcggcggcggcgagcccgttgtggccgccgccgatcaccaccgcgtcccaccgcttccccttggggaggagctgctgctgcggagtcgacgacggggcctccgtcgagaagcggcggcgttgacggcgggcggccgatagcaggaggctcctcgccgccggcgacattgggtttaggggttcagccgccgccgccgcctgcagccggtggcgaatatttctctttctctccgacggcttgtttcgattacgtctacgctactagggaggcggatttctggattacgtgtctccagtctctgcctctattggctcatagtttgaaaaaggttattccgaccatatcgtttttggctatttatattttttgttttttaatttctttatgtattgtattaatattgacattgaatagtttaaatgataaatatagtcaattaccgaccgatcgagtatcgtttttaaagagatgctactaattccgaccgttttcactcaagtgatgtgctttggtagcaagtacaaggtattatttgtaaaagaggggggggggggtttctcgtcgtttgccctatgacttataaaccgataccaaaatatgcactaaaacataattttgatgttttttcaacgtagttttcttagtttggatttaagtcgctaaaatacatgtgcaaaagttttacctataaatcatttttagtcgctaatcagtcgtaagtaaccaatcgatgtggattgtgatgcgctggttaaagttgatcattcatttgctattgataaagttatggtacacacgacatgattatattcaaagttaattggtgtgattttgcatcaatgggatattcaaacttattacggaaaaattcagccattcttgacctttttgtatttatttatttgtttgtttgttttccaaggctgggaggaaaagaaattgcattgtacaggcatgctatgttgaagaactccaaggacataatgtgcaatcaaacgaggtgaatgagtgtgaaactgtgaatagctttagcttaggattccagtggttgaaaccagggttcaccgtaccgccggtaaccgcgcggttaccgcggttaccgggcttaccacgggggtacggtaatgtaaataccgcggtaacctcattaaattcaaataaatttaaaaaataatttgaatttttgatgaattttgtacggtttttcacggttaccgcggttaccgcgcggtaaccgtgcttaccgttggggcacagtaaccccggccccgacggtttgggaaaccctggttgaaaccaatccacagaattttagtaagacttagcacgggtactcatatttaaaagcaaataaattatacttttaaaaacaaaaacttgacgataatattgtaaacaggtgccgccactgtcatctactactctatcttctagtaatatttaacgttgattagtaagaaagaaaattaaaaacgaaggagcatttttcttttaagaagcaaactaaaccaaaaaaaaacttagagaagtaaccaaccacagcacaatacactcacataaacagccttggtcaagtaaaaatggtcgcttattactgttggtcatttagcagtttttacactaaataaaaaaccatattgccattcttcagaaaaggtcccatggtctagcggttaggacattagaccctgaatctagtaacccgagttcaaatctcggtgggaccttcttttttcccctttttattttttattttttatttttttcccattaaaccttaatgaccttttttactgcaatcattaaccgaggctgttttaatcaacgggcaagattttccaggatctgatcagacgtgacagcaagactttgactgtgcgagtcaacttttgatctgatcggtcggttcaggcagccgcgtcgcgtcggctttgccttcgcgttcgggtcggaccggaggccgacccgtgggtacaaccgtcatttcgcccgtaagatatttttaggacactgtcaggacacgccgacgtcagctgggccccacgtgccgacctatgcacattttttgctccgtgtcccaatatcacccaaatcctggtgctcaatcatcatattgccgaaagcaacctctcctagtgtactatatatatatatatatatatatatatatatatatatatatatatatatatatatatattctcttgtaataaatctatcatttagttattatgcttttaatataaaagttgtttggaaaagaatcttgcaataatgtcactactctagtcatgagttatagaatatatatggatggatatgaatatatattcttctacaaattttagatatgattttgtggatctggtgcgtgcaatgatagatggtgatacaaaattccactttgtttaatctaaaaggaggttccactttattttctataaaagcccctaacaaagaaaacaacaatgattatcttgactgaaatgatatggattaccatgtttaaagtggatcctttttctatacaaagtattattgatatctaaacaagaacatatatacttaaaaactcaaaagctaggctatccacaaatatttttatgagtagagtctatccacatatttttttcgctaaaaggaaatggaaaatgccataacagattttaagaaaactagcaataaaatgtgaatttttcccattaaatagtaaatacaacataaattccatcgctagccaaaacgatacaataagatttgctcatttacttggaaaaaatcctctccaccaaagtgaaaggtgaataaaacctttcaagtatgtggttgtggttagcattgctaaagaaagaaacacatagtcatcaaaattgatcccccatccacataaaaagtgcacaagaaagggatgctcatgagctaaagtgaaaatacacacgagtgcgtgctttacaaagaatatgaacattgcgtgcaagaaacgttacaaatgaaatggtgagacaaaatgtgctccgtgcatacgtggtggtgactcacattcgtatgaatacggacaaacaaattcatgcttcgtgtatatatactagttgcaaacgtatcggcatgtaagtaaattaagtgtacgtgcttagcctaacttagtaagttaaccacactaaaaaaaaatgtatacgctataagcgtgcgtgacacattgctacgcacgcaaaaccaaaagaaaaggaaaaaaaacactactccacgtcatgtagcaaaagggcggaattctttccattatctttagaaaaggaaaatatcatgtacagtatactactagtggtgtagatacttggcgtgagcgtagcaaaaacacaaagacaacttgaccccccgtatattccaaaggcacccacctcatatccttatcctgcgcccctcaccccccaccgtcggatgcgatctggacggccacggattcccctgagccggctataaatcccacctgaggtgcagccttcttccccgtggtctctcagaggtgggttggcttctcctccccctcccggttcggttcggttcgggtccggttcgatttcgtttttttttcttcttcgtggggttggtgggaaagcatggcggcgccggatgttgagtaccgctgcttcgtcggcggcctcgcctgggccaccgacgaccgctccctcgaagccgccttctccaccttcggcgagatcctcgagtccaaggtccgatggattgattccctcttctctgtgtttttttggatgtgatttggtggtggtgttcttcagatctggttgcgtagatctgactatgggggttgtggtatgcggtgcagatcatcaacgatcgggagacggggaggtcgcgcgggttcgggttcgtgacgttctcgagcgagcaggccatgcgcgacgccatcgaggggatgaacggcaaggagctcgacggccgcaacatcaccgtcaacgaggcccagtcgcgccgctccggaggcggaggcggaggcggctacggccagcgcggcggaggcggaggctacggtggcggcggcggctacggtggtggcggcggcggtggctacggccagcgccgtgaaggcggctacggcggtggcggcggctacggtggcggccgtggcggcggcggcggctacggcggtggctacggcagccgcggcggcggcaactccgacgggaactggaggaactgagcggtggggccctcatggccaagttatctatctatctaatcgagctaccatcatcatcatccgatcgttatcatcgttagttttgtgtggaactactatctagtttgtgttactgtgtggttgcccatctgtgtttttgatcgcaagaagaaagctcgtctcgtgtttgctttgatcaaatgaaatgaatgaatgaatcttagtgtgctccgctctcgtcaaatccatcgaattatttaatttgtcatggttgtgaatcatgggggttgatactatttgttgttgatgctagtgcaaatgatcatcatcatcacgatttgatgatttgctaagcataagcagcatcattagctaccactcacactgactgtgatgaagctgtgaactcacactgatgctactactgaagcgtttgtctgatttccttacgattggatttgttgctaaacagcatcgttagctagcagcggtgacagtgatgagcagtgatgctgctggactagagatctgctgatctgtgtacaaatagattggagcaaagcttttgcaatacagatttttcttcagtcgatgagaatgccggcagcgatcgatggcctccagcttgagcacttgcaaacaaaaaccacagctccatctatccagtttccccatatttaacaacacttgaaacagtctttgcaattgctaatcttagaagccatgattgccacaaactatgttttctttgctctaattttagcagagttacagctgaccaggtgacgcttgttgtgcccggtcataatacaattcagagaacatgaccatgagatgtctctgcgacagaagctcggcctagcagtgtgaatgtgtgatggtaagatttgtactgtgttctactcctatgttaatcccggggatgtatcggtacaacgtgtatgtccaaatacaccgccttggcgatttctgccggcttcaatgcaccttgattgtcttgcttattcgccaaaacgaaaaacgatgcgccggccaatctctgacatcaaagctccaaggattactaactttcagaagaaagattcagcaaggggaaaacatgctctgagaattaaaactttgcagtcttcacagtttcctggtgcagaataaacacaaaccatttggaaactgggtgccattaacaattagagttagtggctaaaatcacttgcaactcttctttcaacagactctggagctcagcattcggatatcagaactatcaatcacccaaaccaggcagttagcctgctcaaatacgatcggattgtcttctgtccacccacatcccatatgttcaaagagaacctgccacaatcaccatatgtaaatctgaatttggtgacctgaacatgtcacaatatataaccctgtaacaatcctagatttctagtttcttttctgtgtttgccactcaaaagcattaaaggcaaggtgcactctcatgcttctgaagcaatcatcaaattttgaaagtaggtactgatcagtgtcatgtcttaacataataatagcatgttaactgaataataactagagaacttcgcgaccaccttatgctgtccacccaaaaaaaaaaattgaaagcagtcaagcctactaaagtactatctattttttttcgaaaggtgctaattctacctattatattgccagaccatgtgaggtgaatttcctacaaaaaatgttgatctatgtgaatcactaggcactccatggcataatctcacattggaaaatgtttgttaaaattgatcttatggaactaaataagctagggtgctatgaagataacatattctagagcatgtttgagcatattctggagcatacttcaataccttatacttgtagaggttaagagaagacacttgatatcatcaagcagataaaaaatcaatatagatcagtaaactcacactctattgactaaaatgatgaatccacttccaccattccacatgcttcagtcttatgttacatgcacttaaattgatacgaaaattttcagaacactacagccagtatgctctcggagacttccttttttagataatggtatgatcccggagatactatagcatttaaatgataaatcatatcatcatcctggaatttccttgtgatgccatatttataacttgataattgacagaaggagaggttgcaatgcaatgcatacttgtggtacttgatggtcttgatcctgaagccaaagtgtagggctaatgacgctggtgtcatcaccattttttcttagcacaattgttgtcttaccctagttgtggaggccactgtaaaattcttcacatcagtgatgtctccaagaaaatgaaaggaacaacaagagcaaccaaaccaatggtacaaagtacatataaaccctggtaaatcaagaaacatactacaacccaggaatcaagaaaagcatcagcattggaagctggaagaggaggggaggatcagcttacaccatgagaatcctcatcaccttcttctcctttcgcttgatctttctgattatgctgaggagacccattctagagccggcacattcacacagcagaaatgactctgagccacactctagctggacaaacaaggattagaattcctcctatctgtaaaccaaatcttgcgcgctgcaatcagtagtatctgaactaggaatcctgacaagcgagagatgacagaatcggtgcaggaaacaaagaaacggaggcgaagagggagagggcactgaacctatcggagggaaaggggtcggatcgccggcggcggcggcggcggcggggggagacatgagagatggaggaggaggaaggcgatggatacatgggctgatgttagaggcccggacggttcattgggccgtcggatttagtgggcttaatgggctttgcctgtgcctttaaggctgttttattttgaacaattttccaacttctattctctggttttgacacgtacataactgctaaacggtgtattttttttaaaaaaaatctctataaaaagttattttaaaaaattatgttaacttttttaaaaaaattatatctaatacttaactaatctcgtgctaattcgtcgttccgttttgtatactgagaaggaagtgttcccaacaccaatgaacgaacagaaccttattacttgcatggtaaaattgacttaattattagtcagagcattttaggagcaagaatatatttagtttttcatataatctttgttggtaaatcattggtaacatctaaatactgatattccgattgattctcttcatcgcatttctttatttttatctatggacatacacatacttactggaaaaatgtaagtttatatataaaaaagcctattagcttgacatacaagcgtgtagacatatccatgtactatgggtcttcaaacgtatacaacgattgtaattaagcttgctcaggcttcgtaaaattattgtctctgccactgattcaaatacatgcatatattaataataaggctagggaaaaaaaaaggactgatagatattggggaaagttcttcgcgttctacactacgaggcagttcaaggcgtcgactatcacatcttttggtctccctcatccagaccatgcttctgcatgctgcacaaccatgtgtcagttatttatttttaaaaggaaaaagtcaagtaccccctaaattttagatagaaatccgtgtggagataatggataccccatacccacatggcatgtatatccgactagatatgggggtaccatatatggatacaatatctttagtaaagaactcggttgttttcctaacttgtgtatgaaatatccgaggattctagtcggttacgattgcaatttttatttacttgcatattctgttaggaacatgtgttgtatcttgtaatacggactcctccccctatataaggaggggttcgggtgcctcttggggcataacctttctctcatatcatacgatcaataatacactcggtggatcaatccccgaacagaagtagggtattacttctcattgagagggcctgaacctgtataaaccttttgtctcctaacccatccacttttcctgcttgatagccaccccctttaagtattgccgaaatattgtttcgacagtccatctagcaccctaaattttaaaaccggacgtccaaccccttaaactttgcaaaaccgttcatgttaacccctaagatggttttggatggtggctttgtatattttaaaatcttaaatgaacaactttaaataactaatataacatatttgaatatcatcagttgtaagtcattaatttatacttatacagtgatatcatacgattattatgttggtacttgtttgtaagtaagagctaacaactggtaaaatgaaagatttaagtggagattataataatatatcccctctgtcccaaaaaaaaaaagaccaatcctacctacgaacctagacacatatgtgtgtccaggtttgtagctaggaattcgtttttttttacagagtagtatatgtccaatgtgcatggcacatgatcaaactcatccaatttatacaaattagataaaaaaatcactatacaaaaccatcttatgaggtaatatgaacggttttgtaaagtttagggggttgaatgtccggttttcaagtttagagtgctagatggacttctatctaaagtttaggggaggggggggggtggtatttggactcctttttaaaatgaaagatgttgaggcatagtttgagagcatttctagatcgagataagttttattggtgaccttttgtcatagtgttctcataaaaatatgcttaaatcattttctcacagttgattaccatttttgtaatcttttcttcacttcacatatattttctagatctatgataccgctttattagttattttcataacctcatatttcacttaaatatcattctataaaatcccgcaacattgcacgaggtatcatgtaaataattagcaactcatgactagtcgatggatcggttgggggcgttggttgtggcgtaagcttccgatttatcgcgctagctagctacggggatagtggcttcaaaaagaagtgcatgtgaaggaaatggaaagaaaccgccctatcaatacagtgtatatgtatcacagacccagggttcgacttaccgtcggtaaccgcgcggttaccggccttaccgcggggtacggtaatataaataccgcggtaacctccttaaattcaaataaatttaaaaaataatttgaatttttgataaattttgcacggtttcgtacggtttttcgcggtaaccgtgcttaccgccggggcacggtaaccccacccccgcggtttaggaaaccctgcacagaccaaccaacaaatgctacaactccctctgtctcattttaagtgcagttgtggatttccgtgtccaacgtttgatcgcccgtcttatttgaaaaatttatgaaaaaaattaaaaaaataagttacgcgtcaaatactattaatgttttattatctaataataataaaagtaatgataaaaaaattcaaataagacggacggtcaaatgttggacatggaaatctataactacacttaaattgggagggacggagggagtacaactctatgtgagagtgagatcagaaatatattagtgaaagcaacaataacacatccatgtcaccccttctgaggcatcaaaaggaaaggggaccagttgatgtgtttgaatgtaagcttttgtgaaagagatcattgtgcagcgatacgacaactaatctatgaagaatagtattgacagagaaacaaaatgtacgcattaatcgccttaattttcactcccactattcaggaaatctgaaagatgctttcaggatcaccatttatctgttgttctagtactacaaagtacaaaaccctcagtaacataggcattcagcatgccatttcgatactttttttttccttaagatataatgcaagcttttaatcaagctgatacaaccacacatactgttgttatgtacaacaaattcagcctatgtagaacaacaggtataagaaaaaaaaatcaactaaaagagttaatttagttgtacaaaaagtgtagcagaaaatattagttatacagaaatcaaatattatgtgctcgaatcctaccagtagagagattcttattgttgcctgagtatttactctctttgagacaattttgtaataaatggttatagcttctttgaagcaaagaccgaaatttttattccattatagaaaaaaaaaaaaaaccagcagacatatgagattaagatggatccgcatccgggtggtcctgactcctgaccctgaaagacaaccgctgggacagtgtctgcatcctactccaggatcaagagttgtatacactaattgtacactaatccaaattaggacaatgtgagcatgcagtgggcacacctaactacacatggcattgacttgagttgaagtacttcaaatatttttagtaataaaaagactactcacaacaaaataaatgaaaattacatattttttaaataagatgaatggtcaaacgtgtaaaaaaaaaatcaacggtgtcatctaataaaaaacggaggtagtatgttctaatgttcacaaaatcacagttaaggtaaaaaatatatctagatagaatgtatgaaaagcaagcacatcggtagatttgctttttcataatttttgtttttctcataatatttagataggatatatgaacagcaagcacataggtatatttgagtcgaaataacttttagattatgggtttgacggtcctttattattattattattattattattattattattattattattattattattattattattattattattattattattattattattattattatatgaagggaaaattttcttatttttttaatcaatttataattttataattcccacttatttacccgcaaactctactataataattgactaaagctttgttgaaataaaaaacaaaatttatttatcgaaaaagataatgattggatggatggagatacatgcgtggtcctgcgcagccagcactgtacgtacctactccctccgtttcgaaatg

SEQ ID NO: 76621 - DNA, 1584 bp, Oryza sativa
aaaggcgtgaatgcaaataaaaaacatcccctgggtaagcttcgcagccggggggtcttcttaatagaagggacatttggcgataagcttgtgcttgtttggagagatcatcataaattattaaagtatgccggtacataaaatactcagccagggccgtataaggagcgaggtattgtaatgtagcaggggaatccgccatttcagctactacaatagtgtattccatggccccctctttttcttcttgttcccaactcactactaagcaagttcgaacgaattgcatatatattatctctcatatcagatgtgagtcaccgcctaaactacactgacttatcgaggttcaaactgtctcgcgggtaaagcaataaactctctcttcgagctcagtcacaattcattcaatctgtggcagtagtcgtagatagcgtagcccgggatgttagccatctacctatagtgtgagagtacttttcttcgaaactctataagtgtaagaaaagagtgcatgtacttttagtggacttgactttttctatagtgtgagagtactttctgttcaatctagtcgctccagatctgcccgagacatgcgcctaaggagaaattgtggtacgtaggttatgtgtctgtcttatgtcgtcctagtgatttatcatcggaatagctcagttcgagagagggggtggaatttgaaattcgaattggaaggtttgacagccaaggagcggcaaataagtaaatatcttcgacatagctgaagagaaaaggaataataatatctttcttatttctttcccatgacgactaggaacgggcaaatcaagaatttcacttcgaattccggacctcaacatcctgctgctcatggtgtttcacgatcagtattgaaaatgaaagctgaagaagttatcgaaactcggaaccacatgttcaatctttttttagcggtttccccagagatctttatcattaacgcaaccttcattttgctcattcatggagttgtatttagtacctctaagaaagatgattatccaccattagttagtaatgtgggttggcttggattacttagtgttgcgcgcctaggagggcagcgcgcttggggtgcggaggagctattatcgcctagctccctaacctaatgcggccagaccgcagggaaccttagcatggggggacgtcctaatccttttgccgccgcaaggcaggctaatcgtacgcagcaggagcaagggaactcccctggttcaggaaggcacatgagtccgaacgctattatgaatgtgcgaccgacactacactacgtaggtacctgtgcttgcaggtgaggcatcggtcggtcctaaaaacagcggcagctagctaggagttaacgaccggacgtgctgcaacctagggatcaccaggcagctctttcgctctatagggatatcgggggggcatagcacaattcttcttggacgagggttggtttgcccaggtgactgatcctgccataatatactcccgccaattctattgcaccggcaaccgaagtcaaacatacatacgacgatcttcatgcgtgaaggg

SEQ ID NO: 76622 - DNA, 1271 bp, Oryza sativa
ttttcatttgaatacccttgaattgagttggcccacccctgcccatgaccatgacaaatagagtaaggccctgtttagttcaggggtgaaaagtatttgtgtgttataacggatttacggacacatatttgaagtattaaacgtagactaataacaaaacaaattacagattctgtctgtaaactgcgagaagattttattaagcctaattaatccgtcattcgtaaatgtttactgtagcaccacattatcaaatcatgacgcaatcaggcttaaaagatttgtctcgcaatttacacgtaatctgtgtaattagttttttttttttttgtctatatttaatactccatgcatgtgtccaaatattcaatgtgattggggaagctggagtaggtaaaacagtactcatcatagaattaattaacaatattgctaaagctcactggggctgggtgaaaattttttatttaggaactaaacagggcctaattaagctgtgtatagtaagcacaatttccacgccgacgcactgcaattttcacgcaactttcaccgcctatttccttcttttacccccacaaccacgaccacgacgacgaccagagtaaacaagtcttattataaccacccccctctccttttccatctacctcctccaacgaagccttccttcgcccttgtcgtccaaccctcctctcctcccctcctcgtcgcggggctagggttacgccccctcctcctcctcctcctcctcctcctcgtgtgggggcatggccgggagcgaggcggcggcggcgcaggaggcggagatggacccggacttctcgggcgggggcggtgggggccccagcttcgagttcgccttcaactcggtcaacttctccgaccgggtgctccggatcgaggtcgtcgcgggggacgacgacgacgacgacgaccacgcgcccggctccagccgggacggcggggccggctcgctctcggattgggcgcgccaccgcaagcgccgccgcgaggagctcctcaaggagaaaggtgcgttgttgaaaccgcccaaattaaacgcttgtttcgtcaattttctttttaattttcgaattgtggacgatcgttttacgaaaatttcggtgccttcgatcatatattaggtggtcaatgaaaagcgaccagggtaacggagaatggatgaaaggggattttatttttctccttccaatttttagatgctctcgtgtacttgtaacagataccttttcagaatttgatatttt

SEQ ID NO: 76623 - DNA, 15349 bp, Oryza sativa
  unsure (1)..(15349): unsure at all n locations
actacgcgttatatattttattnttcaaaactgcgccttaattaaagggnggcaccaatacccgccttttttcctccttggttaattggttaaggaaatttaaaaaaaaaaaaaaaattaacccaattttaaccccccaaaatttaaattttaaattttttttttttttttttcccccccccccccttttttttttgggctttgctatttgaatgcttacctcagtgcaagagcagggaagaggtttgattgctaataaaatgagtggaagaaggccgtcatggaagagtttggggtccaaagccacaccttctttctccataggaacagaggtcaggagctgccggcagggcgctgcttttaatctgactgatggctcaagataagttggagacgtacttgagatggataatttatgtatttcgctatttcgaatacctaaactcaagcggtgctaatttgctaatccaagccttatcaataataccaacacgccatctgatccaagattagcaacctctctttctctaatagagggaacctcactgacgcattcagggctctgcagttgaagcgttcctaccatccatatatagggaatccataccgtcggcttgtcgatccgggatcacccaggatcgggtggaaggtcggagaagccagtcttcagtggtgcttccatggcagttggatagtagatcagagaggcaggccagtagaatatggagttgtttttgttctcttgttattcttttatggctataagtctttctgtcttggattcgtaatgtttggccattaggtttgaattgccttctctttctgtcttccatttgaattctgggacttatcctgcaatttggagagtagttgatatggtctttcttggctttggctttcaaagtgcagttcgaaaagagtgagttgctgtcaatggcgggaatgaaatatataaggatagggtggaaaagagtgctccatatccatatatgtgcttggagggaaggccacatctttaattgtattctttttcgaggtcatcctcttcagcctgtgttagtagtgctagttttgagtttctttttagtaccttccctatttaggggttctatagaaaggcttagaggatcctaaagtgtcagtttatgttggaattgctttgctcttttctttctttgatgcttggaaggaaggcctataaccaatcaatagtaaacatccctcacccaactaccagtctgtttagagaaatgaagaagcgacttgggttgatttagacaatgttatgtatcgagaaactcaaggccactcttcctccgggctcgaccaatcaataatagaacaactcaccaacacaagcaagttgaacgagtagatcaatccatctgcctacccgcttaatcagcgtagcaggcatgcccacgggaggcaccctccaaatcactaaaagcagcactataccaccacaagtagagaatcccaatgcgcttttcactaggaagacgaggatgctattctttaaagaaccgagcttgacaagcatttcccatccatctttccccttcttgatgagcgcaccacgactcattcaaaagagagagtaaaaggaaggatttcccatgccaaaggatcggaacagatcgggtctcaatccatccgtacttgcaatttcatcatgatccttatcaacagagctaatcgatacatttataaacaatgataccttgctttgtgtttcccatctgttcaagtggataatcccgattcggttttcgagggttcgctcgtcatttattcgtagtaacgtcgtattgcctatgtagctaaatcgataggaataggatttctcaaaggaaagggcgggtggacatacgttgcgggtgtccagttggcatgggtttgggttccgctcatcaactcgaacggtcaatgctggccagatacctgcatcgttatacgtcacaagttggggtggttgaacaggaaaaacaacaacgctttccttttatggcactgctcaatccgaataccagctactatacccttttcaaaatactagctttttcccttttgcctccccctcacaggtaagatattttttattccctggactagtacgcgtacgctatttatattccttgcgcaagagctattcctatcctttcagccaaagcttcctgtcggaaaacaggtacgattcactagaataccctactcaattaaccaacaaagagagaaaagaaggtatttgtgaaaagagaaaagaagtagttgtgttggcagtagatgggttaatggaacaattcaaacttgaaagagaattctctctagagagggattctgaggtaaagtagctaaaataaggaaagcaaggtgtaaagcggtaaggcattacgctgtggtcaatcttcagatatagagtaggtaccgaaccggagtcagagtgaactgcggtatttcattcagtcagcttggcttttctatagttggcctttttgtctaccttcttgagtcaatgtcacattggtccattccggtcttcagtaagtcagtgttcaccaagcaagctggagcacctttcactctcgggcataaaggcttttatccaattcattcacaggaagggtagaaggagcttcaaagcttttagccgccgttggagctctttcttttggccctacgaatgaaataagcgtgaaatagcagtaagcggtggtggtgaggaagtcagtcaggttagaatagaactagccgacgctttgctttttcaaagataggatccctatgcttttgggaaggtatgccacaccccgtctccacaggcaaaagtaaagccggcaatgggtatttttaggtctctgccgtaaggaattggatgtcaagacgacgatagagatttgagctgtaaacacaagaagtaaatgacaaattgggagttggggttccttaacttaagttgacggtggaacccctttgaacaccccgcctaaatgggaaggaagctctagaaaaggagctcgcagttcctcaataatagactcgcacctgggagaaggggatcaaatatataaggttgaatgaatggaaaaaaaagaagaataagtttgacccgagtgagtatggaccatacgctcatctttcttctcaatctacacctcgttctgtgagagccctgtcgaaacaagatttcggcaatactaaaagggggtggctatcaagctggaaaagtgtctgggtttggagacaaaggatttatacaggttcaggccttcttattcaagaagtaataccctactcctgtccggggatgaatccgccgagtgtattattggatgtataatctccaagaaagttgatgtcccaggaaggactcggacccctccttatataggggaaggagtccgtattacaaggtataactcatatccttatcagaatatgagagtacagataaaatacaatcgtaaccgactaagtctcagggtatttccttgacgtacaagttaagaaacaaacccgagatacaaataaagatattctatctatattcggtatcctatatccagtctaaatataatcgccgtgtagatatggggtatccataatctccacagtagcccccgagacctttgcagtcaacaatcatagctttctcaaaaataataatctgagtgctttaatttcttcctgctaaggcctgccgagtagcgaagacaaagactgtaaagggcgaaaagataaaaaacattgtgcatcgaatagatgcacctaattaggtgtagcccccgactatatgattagttaacaaactaaacatgtagtcgagaacaaaataatagcataatcatgtatcatatgacaaaagcatatgcggcgcccaacaaggcatttagccgactactttccagccatagtaaaaagaatccgagtgaataacactctaaaaagttcacaaatgaacacatttgacaggcatccgagtagaaaactctaaagataatccatcaaatattataaaaattatggtaattaataagtctaatagcctaggctatgactcttcaccataattaaaataggcatataacacgccaagagaatgaccattgtaaaaacaagtcatcccaaattaacccagacagcttttgcagcctaaaaaagctttcaaaaatagtataacacttttctgtcgggtaccttttaatttgcattgcgataattccgaagaattatataaccgcattaaaaaggattttatcagcattgggccacaccattgtgagcataaattgccaaagcaaaaatgcctaagtccctaaggagcacaacgggccacgctgttaataatattgggctgaagtactgttcaggcctaggcccattagcacccccgaaacccttaacagaaaatcccgaagtctaagcggcgcttcgtcttccccgccggaactctcgccattttccccattccttgctatagtacagaactgcgccggcgaaactagggttcaccattccgctccaatccaccttcaaaaagttcaccaaaatcctccccgcgactcaccgcttcaattccacatctctccccagccatccctcgaatcagatcagctcattcggatcaaatcgatggcggaagaaaaagaaagctttgaaggccaatgggcgtcgtccgacgtgacggaggaaaacttgaaggagatggtggcgcacggcgttctcccagccaaggagatcatcggatggtggccagcatgtggtgaagctttcccaacccccgatacacatgaggtcgtgcttttttctcactttttctatggcggatttgctcttccaaccacaaagttcttccgtgggatattgaacttctatggaatcagtttacatcatttgaatccaaactccatagtccatattgcaaatttcgtccatgtctgcgaagcttttttgggcattaggcctcattttgctctgttccgccgaatcttcttccttaagccccaaccaaacaaaaacaaaccatgcgtagttggaggggctggatttcaactgagagggaccttgagccaaaagtatttttctatgcccttcaagacttcaaacaaaggatggcacgccaactggttttatgttcaaaatcccgagcctgctcttcccgagtactcctgtcttcccccagtataccaagatacctggaactctcttcccatgggagatgaagctgcccaagccttagaactgatggaacgcatgttgaagctcaaagagcaaggcttacagggagagcaaatcactcggcatttcattaagtgccgattagctccaatcaaagagagatctcgcacagcattcgagtttgacggcaagcatgatccaaaccgtgaacacccagattctctggattttaagatcatgaaggagaggatgtacaagatattctcaaacgccattgtcgtcagttattcgcatctgctgccagtcgtgccatacaatgcattcaatccacctccgctggtatgtatcagaactcttcaaactgtgatcaaaacataattttgtcttcttgttgaattaactgaccgtggaggcatttcattcaggaatttgctttggtaaagtctgaccccccaatcgctcaacgccgatctcctcgtcatcagaccgttcaggggagtggaggaccaaaaatcaggtcagactcccaatcccaaactcccaatctgactgggcagacaaattctcgcaagagaaagcttatgctgaacgacgacgaaggcgacgacaataataaatttggggataagggatcacccaaaaaattaccaaagcacactgctccgaagaagaaactgtctagccgccccatgccaaagtttacaaaatcctccaggtataaaccatccggtaccgtttcacttcgacatgcttctctcatgaagataatattgaaaactagaaggaaactttgcaggaaaccgtccgacatagatccatccgggaaggattctgatccggctaacacagagacaggttcatctaaagaagctgggccgactactgaggaccagccgactggcgcccagacttcagctgataaggtcaatccatgtgaccagcccccaactggaaaccagtcggcagaagcagaaaccgcaaaaaaccaagagcccccgactggcaatcagtcggaagtaggtccagatcaagaaattcctgaagttgaagttcaggctacaacttcccaaggaccggacgctggtaacgacccaacgcttgggtctccagataaagggcaaggatcacctcacgctcaaccggaaatcacctcaggtaacccatcttctcaagtaatgccaatctgaataactccgattcgcttgtctaatgtctgggaatacatcaggaccactaggcggtgacggagaggaaatccctcgcataaaggcagctgctgactctcgtccccctatcttaatcaaatggtgggacgagaacttgcaacctgcaggcattgtcataaatcgacagaaagaagacgaggaggtgcgccagctgaagaaagcactcggagaagctaccgtattgtaaatgtaagtcttccaggtggctgcccttggtgaccttgttttttctcagcaagactaaaccgtgaatcatcgcgcagagaatccatctccgttatgaggccaaaaccacaactttagaaaagctggttcctcatttagggacccttgaagcagttagggatcagctacacgaagccaaagagcttgccaaaaagacagagcatgatctaagagaccggattacccaactccaggattcgaactttgaactgagtggctcatcaaaaggtaacctcaagatctgccccattaatttgtgctgttataattgtatcctcaaccgtctggaatccaaacagtgcaagctgccaagatagctcaactggagaaacgaattgaggccttagaaaataacaaggcagaattggctgcacaaagggactcggctttgaaggaggttgaaggtattgtcagccaacaacctaagtttctctctttgatgcagcagatcattgacataaatttgtttttgtagaccgcaagatcaagtcccaagcccagttcgacgtcctggttggcaagatcaaaagacttgaaggagccagggatgaggtcgccaatgccgctaccccgcttgtccaggcgatgttctataataacaatggcccgagtagatttcatgcttccgaagtgtttgacaagctgagaatcgctccggacacctatttcaagaacattagagaagccggaagcatgggagcaggtttagcgttagcaatgaccaaatccctgtaccctaagatcgatattgatactgttgatggttttgcggactggacaagcgaagaggctgcccttgatcttatcaacgacgctcaaaaagcagccgacaagattgctggtgacgtcgtagatcggtttcaggataccgaccttcggccgactggtaacaataactctgatgatgagaagactgatactgattaaatgtaaatgtatcgaatgccgaatgatggaggcacaatttgtacaataccggtatatttatgctgtgcttggtgtttctagcttagctgttgatttcttaaaagcctttatcaagctttgttgagcctaaaacccgcaaaagctattaaaaactttcagtcctcgtaaactaagtagaaaaatcaaacaaggcaatgatagaccaagtaagcaaactgaattgataaaaaatcacactccattattattatggtagcccccgactgacaacctcaagaagaaagcttgatgttgacagtcaagatagggagatacatggataaacttaagcgtagaagcgacgaagatgtttgatattccaggaattgtcaacaagtgtaccatcttcacgcttgagtcgataggaacctggccgggtgacttcagagatgataaatggcccttcccatagaggagataacttgtgccgatctcgtgtagtttgaattttcctcaaaaccaggtcgccgactaggaaagcacgggatcgaacattgcgattatgataacgtcgcaacccttgtaaatatcgggccgactgaattaaagctgcgtcgcggacttcttccaatcggtgcagatcatccactcggtcctcttcgtagcgttcttcgcgaaaattgcgaaagcgcaaagattcgaattcaacttcactaggcaacattgcttctgccccgtagacaaggaaaaaaggtgactggcctgtggcccgactgggtgtagtacgcaaagaccaaagtactgatggcagctgttccacccattttcctgcatagggttttagccggtcaaaaactcgcgcttttatcccttgaagtatcatgccgttggctcgttcgacctgtccattgctcatgggatgcgctactgaggcatagcaaattttaattccgaagtcttcgcaaaagtctttaaaaactccgctagtgaattgtgtgccattatcggtgataatccgattaggcactccaaacctatgcacaatgttgatgaagaaatctcgagctttatctgctgtgattgtgacaaccggtttagcttcaatccacttggagaatttgtcaatggccacaaagagatgcgtgtaaccgccgactgcctttttgaacgggccaaccatgtcgagcccccaaaccgcaaacggccaagacagtgggattgtttgcaactcttgagctggtagatggatttgtctggcgaaaaattggcaaccttcgcacgtgcgcacaattttgtcggcgtcggacactgcagtaggccagaaaaaaccctgccggtaagctttgccgacaatggtgcgtgcggcggcatggtttccgcatattccagaatgtatgtctttcaacaattgtctcccttcctctagagatacgcagcgttgcagaattcctgaagggcttttcttgtatagctcggcttcatgaataacataaagtctgcttcgccttgaaatccgctcggcttcatctttatctttggggagttcttgagaagtcaaaaatcatatgaggggctctctccagtcggcttcaatcatagctatgttatgagtgtccgcaacttgagttgtttctttctgaggtacggtcggctcataaaggtgttcgacgaatacatcggagggcgccgcctcgcgcttggatccaaagttggcaagtctgtcggcggcttcattgttgtgtcggagaacgtgactaagctcaagtccatcgaatttgtcttccaatttgcgttcctcttgtcgatatgccgtcatgttgtcgtcaaggcaggaccgctctttcataacttggttgacgaccagctgtgaatcgcctcgaactattagacgctttatccctagggagattgcgatccgtagtccatggaggagcgcctcatactcggcgacgttgtgggatgcggaaaaatgtatccaaagcacataacttaatctttctccagctggggaaattaaaaccacttccgctccagtgcccgaaagcctttttgacccgtcaaaatgcatggtccagtgctccatcttttctgcggggatatcctcctggcactcggtccattcggcgacgaagtcggctaatgcttgggacttgattgaagttcggggcttgaaggatatgtccaaagacatcaactccaaagcccatttagcaatccgtccgtttgcttcgcggttgtgcagtatatcgccgagcggaaacgatgtgaccaccgttaccaagtgaccttggaagtagtgagataatttcctggtagtaatcagaataccatataacagcttctgaacctgaggatatcttgttttggagtcggctagaacctcgctgacaaagtagatcggtcgctggactttctggacgtggctttcttcctcacgctcaacgaccaagactgtgctcacaacctgggaggtggctgatacatatagtaacaacggctcctgcgggtgtggtgaggctaagactggtggctcggtgaggagtttcttgaaatcttagaaggccttctgtgcctcgggtccctactggaaatcgtctgttttctttaatagcttgaagaagggcatcccccgctcgccaagtcgtgaaacgaatcggctgagcgccgccatgcatccagtcagcttctggacgtctttctgggagcttggcggtttcatgttgaggatagcagtaactttctccgggttggcttgtatgcctctatgacacaccataaaaccaagcagcttccctgacggtactccgaaggtgcatttttcagggtttagtttcatcctgaaagcgcggatgcttgcaaaggtttcttctagatctgagattaaatcatccttctgcttagtcttaacgactacatcatccacgtaagcttcgacattgcggccaatttgcatcgagaagcatctctgaatcatacgttgataagttgctcctgcattttttagtccgaatggcatggtgatgtagcaataggccccaaagggcgtgatgaatgaagtcttcaagcagtcggattccttcagtcggatctgatgataccgtgagtagcaatccaaaaaactgagtagctcacagccggcggtcgagtcgactacctggttaatgcgaggcaacccaaaaggatctttagggcaagacttgttgaggtcggtataatcgacacacatgcgccattgcccagttttcttccgaactagaaccgggttagccagccagtcgggatgaaggacttctttgatgaagcctgctgctaacagcttggttaattcctccttgatcgcgtccttcctgtcttgtgcgaagcggcggagtcgttgtttaataggtttagcgtcttctttgacatgtaaggagtgctcaatcacctctctaggaataccaggcatatcagatggtttccacgcaaagatatctttattattttgaagaaaggtgacgagcgcgctttcctatttacaatctaactcggcgcctattacagcagttttagtgggatcagaaggatctaggggaatttttttagtcttggcttcgccttctccgctctttgagaccttggtcgcgggcacttctccttcgcttgccgtggttgcagccagtcggatatcttctcgggcagacgccatctcgcgagtctgggccatctcgcaattttccttgtcgcatgtgacggcttgcttgatgtcgctccgtagagataggactccccggggaccaggcatcttcatcatcatgtaagtgtagtgcgggacggccatgaacttggctaacgccgggcgtccgagtatggcgtggtacgctgtctcgaaatcggcgacttcgaagcagatattctccgtgcggaagttttcccgagtgccaaaggtgaccggaagggtgatctggccgagtggagttgaagataaccctggaatgactccgtgaaaaggcgcattgcttggttttaacttggagcgaggaatctgcatgtcatccaaggttttggcgaagaggatatttagtgcactgccaccgtcgatgagggttctgcgaagcttgacattacggaccactgggtctagtaccagggggtaccgccccgggtggaccactcggtcgggatgatctgagcggtcaaacttgattgctgtctctgaccatcgaagatattggggtgtgtcgggctgaacagcgttaatctcccgttcggtcaacttttgctttcttttagattcataagccaaggggccgccaaagatgtggttaagctccttgcggtggttttgaaaacctgccggggggtcgccatcgtccttcttctttgacgtgctttgttcttcgtcggagttcttccgtgtagtcttggtgtattgttccgcgaactgtttgtagacgaaacaatctttggccgcgtggttggagttaggatgatgcgggcattgggagttcatgatcttgtcgaatgtattgacgcgcgaatgctgtcgagaagagtgagtagcggttgcaacaagttcctcaggcttacgcttgcggtccttatgattgttacttccaccccctcccgtagccggcgtatccttttttggcttccaactggagcccgactgctttgatgcgatgacggcatcttcagccttggcgtactcgttggcttttttaaacataagtttgactgttttgggaggcttacgcccgaacttgccgaccaattcttcgtggcgaattcctttggtgaatgcggcgatggtaacatcgtcggtgatgtcggagatcttattgcgttgtttagaaaatcgccggatgtaatctcaaagagattctccggacttctgtataacgttgtagagatcgaattgtgtgccggggcgctcgaaggtgccttggaagttggcgatgaagtggtcgcgtaattcggcccaagatccgattgtaccacggggcaatccatggagccaggaccgggcggaatctgctaaagccactggtaaatagttcgccatggccttgctatctcctcctgctgcgcggattgcgagatcgtagacggtaagccatgattccgggttggtggtaccgtcatacttctctattccagtcggcttaaagccggctggccaatccactcgacgcaggtcgttggtgaaagtggctactccgtcaaggtcgtcgtcgtggcgatccggcgaatgatgatggcttcgagctgcccggcgatgtatgatcgtctcgcgaagatcgacggggcgacgacgaggtggcgaacgaggtcgttccactcggcgctccctatgatggtcgggaggcgagtggacagatcgctcgtcgtgacccctgctcctgcgattagatcctgcgccagcgatgctgaggcttggctggtggtagtcgtgagatcaaagatgagggactcagctgccgctcggggtgcggacgcttccggagttaactgggaccgaagccgcaatcatggtctttatctggttcaagatgttgacggcgtggtcagattgattgagctcgttttccttgaggagggtgtcgaggagggtgatcgcggcaacagcattctgttgaggggtgcggaaaaccggtgtcccctcaacgtcttgttggccgataagatctcgcgctcggcgccctgcttccaaggctcgtagccgccggtcttcagcctcctttgcagcccgctcacgctcctgttgctcacgccgtagccgttcttattcttgtacttgacgctcctcctccagtcggcgtcgctcggcctcgcgtcgtgcttcagtttcccgggcttggcgttgctcctccgtctcgttatcggccataaagacgccgaaatagagaggggtgtagttgtcttctaggctttcatcgaagtcgtcgagatccgggtcgttgttgcgaaagccgaactcattgtactccacgatctcggtcggacgcgagtcgacgccgggagagctccagtagccatccagctggtccgtcgaaactgagccgagtggctggaggatgacgccgacttccctggagctaggcgagatcggtgttgaagccgatttccgcctaggcctacgggatggggacgctgtggtggtgaagaaggccgccaaatcgtcggggagcttcattaggatcggtgggtaagccccatcatctcgatctgatgacgttggagaagatgcaatctcgcccgagtggtttgaagccgactcgattgagatggacttggagtagatttcagccgcgtttggaactccaaacgggactgagatccggctctctcccgactggtccgattccgagtcgaggagagagatcttgccgaagttattggtgacgaagtcgaggctgccgaaccgaaacgcctgcccgggtgggaagatgaggtcgtcgatgccggagacggaacccattgcactgatcggtgaaaagcttgacgcaacccctacctggcgcgccaactgtcgaaacaagatttcggcaatactaaaagggggtggctatcaagctggaaaagtgtatgggtttggagacaaaggatttatacaggttcaggccttcttattcaagaagtaataccctactcctgtctggggatgaatccgccgagtgtattattggatgtataatctccaagaaagttgatgtcccaggaaggactcggacccctccttatataggggaaggagtccgtattacaaggtataactcatatccttatcagaatatgagagtacagataaaatacaatcgtaaccgactaagtctcagggtatttccttgacgtacaagttaagaaacaaacccgagatacaaataaagatattctatctatattcggtatcctatatccagtctaaatataatcgccgtgtagatatggggtatccataatcttcacaagccctatcctcgtttcgaaataaaggaccgtagtgaggatcgatcccggataagtgagtcagtgtagggacagaggctgatgattctaaaggtgatttaaaactagaagatgactttatttgaaaacggaatccaaatatcaacaaaaagatgaatggaaagtcttgtcgatatgaattgatcttcaacccaatgacaatgcttcgatttcgatcttgacttctttcttcgatgcctgaagtttgtgttcgcatttcatcaaaggaaaagtgggctgtacctacatgaaggtaagagttgctcgtgtaaaagcaatatcttctatttgacttatctagtcgtgtcttgtcttgcacatactcggctcggtgaatggttcatcttcgattggcatggagcaagaaaacagattgaagcagagccagcacacctcagtgaatatcattatttaggacaagcacgaagaggaagagctttgtccttcggccttgaatcagcataaagcccctcgctgagccacttctttgacattacgtcatgatgaatagggttcgactcattcatgtctccacacccaggttatgccgcagccccctagattgaaatatgacaacaaacatttgctatgggcggggggtccgcttcgataaaagctgtccagcctgccacgctttggaagagcttcggaacagtttttccctagttaggtaacccggttttgacaccatggcccctatgaatcatcaagctgcagcttcgctaccaggttatttacaaaatgaaagaagaaaatacgaaagaaaagcgtccattgtctaatggataggacagaggtcttctaaccctttggtataggttcaaatccta

SEQ ID NO: 76624 - DNA, 937 bp, Oryza sativa
agatttcaccagttacaaaattctaaagcctttctttagccattttggggcctggaactgcacgcaaatcaaacccatttccaacaaaactaaggtagtattaagctgactggattatttaccctaaacccccaaatcaactaagccagaaaaagtagaaaaccacacaattttcaactatttccagtaagagaaaactgaaaattaataagcgaccccccccctcccctttttttttcccaaaaactataaatagtttacaaaagaaatgttacattgggcagattcgaagcaaatcagcaacaaattcccatttcacaaaacttgctgaattctaggcatagtctactaaacttagtcttctcttcttttttttagcaaaatatcttggatcctcatccaagtgtacaagaaacccaggaagcaacagtaatttgatggtttcctatccatgtttttttttccagttggggtttacactttacacacatgtatcaatacttcaatagtataactgacatgttgtgcatatattcaacaggatggtcgcattagctatcaggagtttgaatcaatgatgatatctggatcagactggagaaatgcttcccgacgatactcaaaagcaaatttcagctccctcagtcgtaagctgtgcaaaggaaattcatgaaacagaggaggatctgagcaacagttacttactgagtgcatcaagcaatcaactaaaaacaaagcatcagtggacagcctaaaatataaaaccagattactgggtagaggacatcagcagggtgaaaggagattttgtatctcagttgcatagatgacaaggttcatcaagcagcgagccctatagcatcgtcccttgtaatggaatcaagacattccatatctaggatatatattcatgacttagcataggcacatgtaaggg

SEQ ID NO: 76625 - DNA, 738 bp, Oryza sativa
taataatacaaaagatgtaaataggataagcatttaaagttgaacacgaaaactcttggtttcatttacataagacgaatggggtagatgctaaaaaggaagtcgtcttgtaaggacagagtaagtatttagggggatagcaattaagtcggggaggcattttaatccttaaggggatgtcccctagtatatatttttcttccaaattccaaccaaatacttaaaagaaaaccatttaaaaaaaacaatgacgtggatgtataatgggaaagggggtacacgttgggtccatccgtccatggagacgtacgtagggggacgcgaagctagggcatcaccatcactggccagctgccagctgccagtgcatgggcacattctgacccaaaaggcttggccagataaattttccttgggttttccttatgtacccagtgcaatcatagtcatttaaccgtgcaacaggaccttccattaattgggggtctggtaaaaaaacaagggttccaaggcatgcccgattatttccctaaaggtccttttttaaatcaaaaaaaaatgatttattccccccactttaaatccaaatgatgttttaccctcaatttttaaggactggaagtttaccctcaattttgaattttaaccaaccgttcacgcccactgttaataccggttgggtaggtcccacgttttgtgttaaagaattgcaaaggaaataaatgatgaactactgta

SEQ ID NO: 76626 - DNA, 682 bp, Oryza sativa
ttttcctgtcctcctaaactctcagaggagtcaaaaataaaaatcggcacctataccggtttataaaaaaaaccaacacatataatgtaagcgctggttttttaaaagacgacacaaataaaaatactatgagtgttgggttttttatttacccgctccaaatttagagccccacaagcacgcaaaaaaatcagcatggagaaaaaaaaaatcatgtttgacccatgccgtgctaccctgcccattaatctctatcccttatctcctcgttcgccccacccccgccatccctctcttccacgtctctctcgattcctccatctccctcctttccatcgcggcgagaaggaagcgacccacctctcctagccaacccaacgatagcggcgacgaacaagctgtccggtctgactcctgccgcagttgaccatggcctcggctctctttgctagatttgtcggcgacagttgtatatacgccagatcccaattcggtgtgcatcctggtgtacctatatggattgcacatggaagtcttgaaaaatgctggccaactaaaattgatcaaacatagtatatttgacttaggataaaactaaaacaacagaaatatttaatttatgataaaactaaaacgataagaaaaattgaaagcacatttctatcgtttcgcatatgtttat

SEQ ID NO: 76627 - DNA, 8067 bp, Oryza sativa
atcgcgctgagtagcactggtcacccgtccaacgccagacgaggtgatcctcaacacccggcgagagctgggtaggtagcaccgcgtcccagactaacaggaactgagagatgaccgggacagtgagggtgccatgtatgtcaccaacccaggagttgttcgctaacccagcagcaactgtgtgcgatccccggaaacgtggaggcacggcgtggaggaggtcaggagctatagaagctatcgagcgaccatcgatccaccgatcagtcctgaagagcgtggactgaccatctcccaggatgctgcgaatatgttggagacgctccgctcaacaggggccttcagatcagaccagtaggggtgtcccgagcgctgaagccagagccagcgaactctcaaggcaaagccagccaccctgagatccggaatgcccagtccaccgagatccctaggacgacaaaccctcgtccaggacacccgtcactgtcccccattggccgagtccgtacccatccacaagaaggcgcgacgcttcttgtcaatggctttgataacccagcttggcaagccgatcgccatagaaacatggaccggaatggaagagagaaccaactagactagaaccgagcgacccgccagagtggttagacggcccttccaggggggagccgatgggacactttatccacaagcggttgcagggccgcttttggcagcttgcgaactgacagtggaatgccgaggtaggtgcaggggaactccgagatcgagcaaggaaaagaggactgaaccagctccaggtcaagaaccgagcagcggatcggagtaatcaagcacttggtgaagttggtccgaagcccggaagcggcaccgaagacagagaggatgccttggatgaactcaaggtcttgccgaacgggggaaaggaagagaactagatcatcggcgtagagggatgcacgatgttgaatagcacgatcattgaggggaagaaaactacccgagtcagaggctttgcggagcatcgcattgagcacatccatgactagaatgaaaagcatgggggaaagaggatctccttggcgaagacctctccgatgggggaaccgtggacctggcaccccattaaccagcacccgggaagaggaggcactgagaatgagggagatccaatcacgccaacgttgactgaagccaagctgggctagcacctcaagcaagaaaggccagctgaccgtgtcaaaggccttcacgatatccaccttgagaagaagtcggggaacgcgtttggcgtggagcgcccttgccgcaagctggacatagcggaagttgtcatggagagagcggcccttgatgaaagcgttctggttaggcgccacaaactcgtccaggcgaggggagagacgagaggccaagatcttggagaacagcttcccaaagctgtgaataaggctaatcggcctgaaatccttaacgtcaacagcctcgtccttcttcggcaagagggagattagggcgtcgttgagggaagcaaaaccttggccgttggtcaggaacaaggagttaagggccgccagaatttcgaccttgatcactggccagcaagacttgtagaaacggcccgtaaaaccgtcaggaccgggcgccttatcagagggcaaggacttgatcaccgcccagacctcatcctctgtgaagggacagtccagtccctcaagctgcgcagggcggaggccaagagagtggaggtctagggcgagttcacgcttgacgctcgtccccaagatggcgcaaaagtgagaggaggcaagctcttgcagcgcattatgggagatggcaagctggtcaccatcacgaaggcgtgtgatgaagttcttctgcctacgagctctggcgtgcatgtggaagaacttggtattggcatcaccctccttaagccagaccaaacgcgaacgctgacgcgcgatagtacgctcaagcgaggcaagaccaagacacttcaactttaaatctcgccgcagccaggtctccaagggggaaagagaccgactctcctgcgcaacatcaagccggaagacaagttccttcgccatctgaagctgcagacgaacactgccaatgtgacggtcactccagctctgtaagcgcttggctgtggtagagaagcaccaggcaagagcggcaagagggggtaggttggcagggggatgccaggcgtcctgcacgacttgaagaaagccatcgaacttgggccaaaaggcctcaaaacgaaaacgatgcgctttcggggaggtgacgcaggtatgaaggagaagagcacagtgatcagaggcgatagaagaggccgcttggaggaggcaagaggggaaaagctcctcccaatccgcagagaagaggacgcggtcgagcttaacaagcgtgggcgactcgcgctcattgctccaagtgaagcgacgtccgtgaagcggcagctcccggagttccaactcgtcgacgagccgacgaaaacaacccatcatacgacgattgagattaaggttgtttttatcccgagcttcgagaatgaggttgaaatcgcctacgacggcccacggccccgtgcgagaggagtgcagcgaacgaagctcatctaagaaacgaagcttgtcaggctcctcctgtggcccatagacgatggagagccaccagggggcgacatcagaagagtgtcgaaccaacgcggtgagagagaaatccgcaaggtgaacatctgagacagaccagacagtcgtccgccaggcaagcaacacccccccactccgaccgaccgcaggcaagaaggaataatcaaagtcgaggcctagcatttccagaatagtacgagaggggattacatccataatagtctcctgaagacagagaatagagacatgctcatcacggactacatcacgcacagcatcccaacgggcgcgcgagttcagacctcgcacgttccacaccaaaacgttctcgttgcatgatcccattgtgggggaccacaccgagagcagaagagaagaaaccgatcagccgcacacgaccaacgcctctgcagccttggccgggggcaaggagctggagaagagcgaggagagcgtgatgatgtgctcttgggaaagtggcttggagaagagggcgttgtaagccgcgaccgcctcggccgtgaccgggcccctctccggaactaggccgagcttccgcatcaggttgcgctgggcgcgcgacactgcgtggatcgacccctcaagcgcctcaagtgccatcttagcagcgatacgctcactgcgcttcggcacaacctccaccaccttggcggcgagaggcggcagcggcaaaggcggcgggaggagcgcaggagggagaggcctagagcagctggtgaggaaggcgcgaagagcggcgttgtctgccacagaagatggaagcgagtgcgccagcgggcggccatcgaggtcaaggacaaccatcggcacatcgtagaggacgccgtcgggcccatcaaccaccaaagttggagcctgctgaggaagcggcgactcaggcctcaaccactccccaccggtaggctgtgtgcaggcagtccttggcagagaagtgccgcatagggtgttcacatataaagttttagcatgttaaatcgggtattatttagagtgtcgcatagggtgttcgggcactaataaaaaaactaattacaaaatccatcagtaaaccacgagatgaatttattaagcctaattaatccgtcgttagcaaatgtttactgtagcaccacattatcaaatcatggagcaattaggcttaaaagatttatctcgcaaattggttgcaatctgtgcaattagttattttttaagcctatatttaatactttatgtaggtgttcaaacgttcgatatgacatgttgaaaaattttgttgtgggatcttaaacaaggctatgaacaaaaaaaccgatgtgagatagttggctgcatcaaccaaaaggctttctagcttgtgcactctgttcattcgtgtgtgtgtgtgtgatgcaagtgaaaaatacgtgagtgtttgcgataaacaatacacaagagagggagtgattccaacaatcaattctattagcaaatagatatattcatttttagcctttctaattgagatttgaataatggatttgagtatctaaaagtattaaaaaaaagttaactagaaaatcataaatattgtcaagagctacagttttcatataaaccttatcataattcgaatttgtataaaaaagttaagtttatatcccaaaccgacacggatgcttattaagacccgacattgatgactttttccatcaacaggctagtccatcccactctaatcgacttgaaccgacactgatgattaaccgatcaatgtcgggtattcttataaactggtatattggtttgtatgtagaataaccaatattggtttgtatatgacccgacgctgatgtcttcttattagtgttaggtgttacctctgcgtagtgctagagtgttagggcggaaaaccatcattaatgttgggttttattgaaccggcactgataatagtgacaccgatatgctattatatactcccttcgttttaaaatagagcaacttttagctatcaggatttgtcccaaaatatatcaatttctccaccaacattctcttcccaaccaataacaaccctccatcattcactttttccacataactccactactcatccaatcacaactctccaccactaacttctatctacttttttaataaccgtgtctaacactaaaacttcttatattctggacggagggagcagtatttatcaatacgcaggtaagcgcaaaaggtcagacctaatccctaaagaacttaaggttaagtttggttcaaacttttgctagatacgtgatacgtcactcaagtaggtatatactccactaaagaacttcaaacataataattgctctccaaatcacagtcaaactaattatcccacaaaacaaagttaaacctgcgcctaacaagtcgacgtggggcgacacgagtggggccccgggtcatcaaatgcaggcatgcagtagacagacacctacgtgccctgtacacgtccgtacatgaacattttgatggaaagataacgacagcgacagggtaatgcaggtggcacaaaggagtacagcaactcaaattggtcgccaactctcaccattttttctgaattccaggtgtttctgatctcctctgttcgtgattctgtccgatttttccatttacatccatacacattctctggcctccttctagaagacgatgtcgcttttattatttttggctattgcgtggagggttggaaccttccactttcgtatatagtaaaaagaaaaaaaatattaactgcatactttttttaaaaaaaaaacccaacctaaaaatgtgacccctcctagtataattcagaatcgttgtactgggagaggattggcttttttgggacggagagagtagtaagttgctcatcttctagtctacgtctccggattaatatcttcccgattcataatgcgacgaagggtttcaccggccggagctcgccgccgttgaggaagtcggagtaccaccgtgccgagctcctgacgtacctcgtcctcgccggcgcggtgaagtcgacgcagcacaggccaaagcggttgccgtagccggagaggaactcgaacccgtcgagcagtgaccacacgaagtatccccgcgtgttcgatccgttcctgcatcgcgaaccaagaaactaaattaactagagtgtctctctctgaagttccaaagatttctagactggacattaatttgacgttatagaaattagtttatttttcttcaaatttagccatattcgaagaagtttaacttagaataaaaactgaaacaccttacaatatggaatggagagtaacaagcagggagagtgagcacaccgtatggacaggtgcagaacttccaggtagctctgcaagaaatccgatctaaagtcgtcgtcgtagtcgatcttgcccggggtctccggtgaatctgcgtcgcctgagccatcgagagggaaaaaataaaatcatattcacatcacattgatcagatttacattacgtatgttcagaaatagctcgataattcagaccatccattctcgtggatcatgactggggggttgccatacttgagcttcagtgatgtagcatcttgccaagagcccaggatgaagctgatagtgctcctgtaaagggagggagcattcaagcaactgtcaagactgaatttctgatgcattgaaaaattttctgaaacaactctgctccactgcagcatgattatctatatattaccttgtcgaatcctcctccaccattctctgcaccaggtgagcagcaagtcagctcggtttaatctcatatatggaactcaaaaaactaatgcagttgactgtagaaaaacatggcaatgcaagattaatttgcttgggaacatctggcctgtggttgttcagagatccttaccttgaacacctgcatcaacgtagtagtcccttagtttctggtcatgatttgcgtcgctggattgcacaaagataacgaagtaatggttgatgccgatgaagtcgaacgatccccgtattttctccgaatcggacgccgttatggatggcaaccgagcgcctacgcggctcctcattaccggagggtagtctccatgcaccagaggattcataaacctgcattatttcagaggggtacattgtaaattcaggagactgacaaatagccaaactgaatgtattttcgtatgaacatcgttttgagtttgaaaaatctgagtatgaacatcgttttgagtttgagacagtagtattcgactacaatttaagtagttactaccgcaatttaagtactaactaaccatccaatatggaattcattcatcctgattgcagcagctgcatctgccaccgcgtcggtgtagggctcataccaccagcccagcagagtgatccctatctgacctccttgaattgcctgttgccaactttccatgtccaaatccaattttcagggaccattttatcttggcacgtgaaagaaacacaaatgcataatgaaaagtattttgtataatggtgaacagtaggaattagttatggaatttaatatgacctgatacttctgtctgtagatggacactgccgaggcatgagcaagcagcaggtggtgagccacgatgtacggctccgtcgaggagtcgccgccggtgcagttggtgccgaaggggtaggagcaccgccgcggcggctgaacgccggcgtcgtagccgccgatgggctctatgttcggctcattcactgtcacccagtgcttcaccctgtcaccgaagttcttgaagcaaacctcggcataagccgtgtaatcttctctgaaaatatatggtagattacaccatgtcaggctgtcagcatgatcccctcaaagagaaattgcctgaattcttcaccatttcgatcactttgcattgcgaaaagccgaaaatgttcagcttgtcagtttgtcacacaggattttgtggatttctcagggtgcttacatgaatctggggctgagtattccaccgtactcatcctgaagggcctgagggagatcaaagtggtagatggtgacatgaggttgtattcctgccaaaacatggcagaagatgggtcttgattgatcaagattttggtaattaagaatagagctgcatggatcatgtaatgtttaccgtgcattatcaattcgtctatcagattgttgtagtattccaagcccttggggttgatctctcctcttccatctaatccaattgaagctccctgtcagaaatgttctgaagatattcaatactaccttatttatgtgattatgtctacctggaataactacgaggccatacaatggagaatctgtacgcatacaggcccatgtcatacataagctttacatcctactgaaatcattga

SEQ ID NO: 76628 - DNA, 1211 bp, Oryza sativa
atagatctaatccagacgaacgtattttgacacacgggagattaattacaggaaggaattattattttaatagatctaatctaatggcggtaaataatgggtccaccaaatttaataaaaatcaatggtgagatgtttttcttttttctcagaatttatatatttttctatttttattagagtgtcacgtggcagtttgagagcgtttttagagcgccatgtgacggcatgagagcgtttgtagaaagtttaatggactttagtatataatagatggtgggtcaaaagatacaataccaatttatcacttttagatttagcgtttaataatttatcatccatatatctatatttatgacacgtgaattctcatgactatagatccggtgataaattgttaaacactatgtgcatcagagtgttaaatatctccctcccgagtcctatccgacgcttctcttctgtagtccgtggccatgtcgtcctcgagcaggtcgtgtcgctgcacggtggccgttgtggctttgaatccatcggatgagatcccaggcgcagcgcgtggcgaggaagcggggcagttcgggatcggggacgcgatgccgacgcggaactgggtaaagtcccctccgccgaatctcgcaaaattctgcgtgcgaaatgcggctgatggcatgaatcatgcgcggattctgttggtcatctcggtaggttcccggtgtgttcagattcagatcatgcggcagattacccctgttacacttacatcagctgccttgttttccagttcgttgaaacaatttgtggcactaacgttaaaattaaaaatttagttgaaattggaacgatgagacggaaaagttatgtgtaggaaagtttcgatgtgatggaagagttagaagtttgaaaaaaaactttgaatctaaacacggcataactcaacacgtgagcttgttgaacagtattatcaattggaattcggagagttgttgatctctctctctgttcctcgtagctatattcttgctatccacgatggctgattggaattggtttttgatgttaactggacctccgcaaaccctttgtagtactagtttgtaattttctttagtctcaggttgtaaattgggactataaatacatgactgaagatttttatccttagtctcggttaaaatacccagaactaaagatttttttttattttgctt

SEQ ID NO: 76629 - DNA, 90513 bp, Oryza sativa
  unsure (1)..(90513): unsure at all n locations
aacaaggcacaaagtgattgatacgatgtagaagcatagcaatagctgtcaactttatctattttcctaggaataaattttttctttatataatctcatcaatttttttttgaaggaaaagttaaaaaaaaaacagaacaattctgcttaggttacctaaagaagctgagatcagctgagaattcataatatactcgtacggtccaataagaagaccgacatgatctccgcttggaagcaactaggaattaaccaaatgtcacaaaagaatgttgccatcaagctcaccaacctaatgacgatgactaatacgcaatcctttcagagataggcatataaacaaccaatttgcacatgcacatttctatggttgactagtaaccttagctctgtggttcagttctgtaatcaaactccgatttccaagacagaacggcagcaaagccatcctcttggccctgaagctgaaggtagtagacaaatttatccagcaggggagcaaatttccaagctcacaaacccaaccaaatttttacaggacaaaaaaaaagaaatgcagttttgagacctattgcagctcatgtgtttcaaaaacgctctcaggtgtcagccttgaggtagaagtttgcatttaacgaccgtgtcacactacatggtacgatcccgaaccagatccacgggctctcaggtttcgatctggtacaagcaagatccacccgctccgcttggatgactgactcgcgccacgcatatggcgggaggagggaggtggatgtaaatatatatatatatatatagagagagagagagagaggagaagcacacgtactgtcagtttgggagaagacggcaacacggagcgcccagatgttgaagaagccgaaccagacggaggcgaggcggagggagccgaccagcatcagccaccatcccaacaacggcatcctcccgcctccggccatgctcccgctcctctgcggcgacggcgccacctctgctctgctcgcaggatggagatcggcgccggcggcagacgggatggatggaggaggtcgctctgcggccggctgcctatggcctatgggtcatacgcacaggcccatcaggctggaaatatttcttctacgaaaaaagtaaagttcacctaaggtcccttatcttgtcgtcgagttttaaaaccatccctgaaccggaataccagaggtaatggatcattaatctggtataaactgagtcaccttttgatcccaaagcaatattgctctccgattttggtgacatagtggctgagttagtacggccccacatgtcagcccacaatcttctttcacctctctcctttcttcccatctcaacccaaaccttcaagggagctgacaatgggtggggagaaaggcggcggccagcggggacaagctcgacggctgagtagtattaattctatctctttttttatttctctatgtgtgagtggatttttattttaagattttgtgaaacagtagtattttatatgttgtacgaatattgttaattttttaaagattcttttataactatttaaatggtgttttcagctaccctctcaattttaaaactatttccccacatggtagcagcagcttgttcaacttagatacagtacagtactagctcctagatggcaccttgcatggcgggccagatgtgtagtactgcagctggttgctgccactgtaatgaatcgagagaccatagatgagtttacgcacgtcgagacgtgcaaacatatgcaggtgctgcagatagatgatcatataccactccactatagatgtgcaacattatctgaggaggagtaaaaaacaaggagagatcgtcgatgtgtgcgtggagtggaccatgcaaacacctgatctgatctcacttgagtgagagactggcagtaacagtagtcagtcctagcagtatacggacatacaattaaaatattaaacatagactaataataaaacaaattacagattccgtctgtaaactgcgagacaaatctattaagcctaattaatccgttattagcaaatatttactgtagcaccacattgtcaaatcatgatgtaattagactcaaaaaattcatctcgcaatttgcatataaactgtgcaatttgttttttttcatccacatttaatgtttcatgcatgtgttcaaacatttgatgtgacgaaatttttggaagttcgaaggaaaataaacacagccatagtctatttgtttttattttcacagggtgagtagacaacacctgctgcctgctaatagtagagcgcatcgatcgaatggtgaagctagcacatcgatcagtgcaaggagtagtctgtttacaaaatcgtttgatggtactttcaactttcagatgagtcgtcgctgcagtctttagcaatgcaagcggcagccttgatcagcagagcacctacttcctccataaaaaaaaaaccttaaactagaaggagacgtgaccgacgatgaatagtcgagattcgtagttccaggagtgattagtttttttggacggatggataaaaaaacttgttggattgagtagctagctagttgtgcaggcctctcaacattttggcttcagccgcttgtgagcactgaccgcagtccgctgagtaatgcatgaaggctgaaagcttgcaatacgtacgtacactccagtagaagtatatgaaaatccatctcttgcaattcggccttgtttagtttctaatttttttttctgaaaacatcacattatatctttggacacatacatagagcattaaatatagataaaataaaaaactaattgcacagtttgtatggaaatcgtgagataaattatttaagcctaattagtttataattagccctaaagtactattgaccttaactcaaccaaaagaggaaggaaaataaataggagaaggtgcgggagaatgggagatgacgagaatgacggtgaccaatagctagccagtcatttttctgtttataacggaaatctcagagaggtaataaaagtgtaaaatatcaatggagcataagaatcctctcgattatttttctttgtttaattttacagcacattcaggcaacagttacatttgtgcgctgtattacaagatagttatgttgggatacgtataggctacgatagtataaaaattaaaattttctatcacgtaaaccaggaaccatgcaagtattagatcatagattgttaccactcgacacgctgcgcagcggaagaagacgctgagaagtcgaaggaactctcgcgaagtagcgcgcgtcgatgtagaggaagtagtcgatcgcaccggctcgaccttctcctcctcgtgcgttctcctcaccgtactcccacgccgatcagcaccgcaaaccagcggcgcctttaccggtatccgcacgtacgtacagggacagaacgccacgcgcagatgtgctagcacccgcgcgcagctagggttttgctcggggaggaaagtgacggctagggtttctcacgtgatgcaatgctccgccagtcagacccctcacgaatatataggatccatcactcgggccttcaaggcccgtaggactcctattcggatccctatccgaattaagctcatattggatctccattgtcacgcccagaaatttagcccaaatttccagactattttgcgtattaaatccctgtccaggaccagccagggtacacaaaacgacaagtaatatacagttccaaacgtaaatacagcgtaaaatacttacagaagaggcacttagtcctcacaccgaaacagaacgacagcagcggaaaaaggcgatcttagcggggcttcagctccactccacaggcaagactcaactggggtctgagccttggtcttctaacttcgtcttcaactcagaagtattacacttctgaaaagggggaacaatagcaaggctgagtacaaccaccgtactcagcaagccacaccaatgatgcagacgtgcaaggggaacacaaggacggtttgtggctatttgcataaaagcggttgtaaagcattttattaagcaaaacagtaaaacagttgagtaattaaagtaaccttaaatctccactgatcaacgctacaccacgttgaacaggcccaaccaacccacctgaactacagtgcattaggttgatttattaagtgtgagactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacaccttgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaagataaatagaggacttatttaccttaacttaggttatagctcagacagcccgagaatacaaccgacgacacggacgaggcgaacaccaacaacagcagcagcagcggaaccaacggtctaacacccaacaccacaggcgacggctgggaaccaggacgaaaccctaatcttcacttcactttatcttctcttcagggccggggaactatatatatatatatttatatagagcaagggtgagtactttcgtactcagcaagtcacgggaacttaggtgtttaatgcaagcttggaagagaggcaaggttgttttgcaaatcttttatttgaagacattttgaaatcactaagtgatttatttctttctaagtttgggccgaaaagagacttgcgtctcgattcgacattaagagatgtttttcaacagctcatttagtaatgtaccgacctcccgggtcagatcattacttctcggctcccagagccattccacttgattaatcggctcccagagcctttttcattttctcggactcccagagtccagctgcccagcagcacaacaatccgcttccactcgggaagcctagtctatgatgcccgcagacatcccgaatcacacagatttgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttatttcgaacacccgtcggtatcggaggttcgcaacaaagcctttcccaagccgacccagggttacctcatgccacatagaaggatcaaatcctcacataaatataggccatttcagttttcacaaatcaaactccaaccacctcgatcggtaacctggcaagcttcgcattcttgccttaccaggaacccgggttggctccaatcgaccccgccccggcgttccccaactattggcatgcgaggtttccctgaaccgactagttacttagccagggtgtcccattccaccttgtggttgcactttgattatgttcgatgagtttcccataggaatcggtccttatatgcgaatacgggacagtgccacataggcacaacctccgcatcgcgagttttcacaattcattttattttcaaacacaccgacaccacatgtcgggttttgatggcttcacaaacccatttcccaagttttcgacaaacaacggtgtatgtgggatatttggtatacgcgctcagagagcacgaataccgaggtaccacaagggtggagcgacaaggaatcagggtagtatgacctacgaaaattagtgcgactactgggtaggtccgtcgatttggcatgcaaaccgaggccaagcaagttaagtgtgtgattctaataatgcaagttgcaaacgaaataataatgacttttcaattataggagcaattgatcaaagggtgacttgccttgctcaaagtcttcacgaagcttcacgaatcttcgagaaaacccgcgatcgacgaaaatccgataaccgcaactatacgcaaacaatcgaaaacctaaacaaaagaccaaaagaaagatcctatttagactaattattagtgccattaaatagatatcaattttacggaattactggaagtggaacggagtcaatcggatgagcggttgagaagatatgaattttggaagtttaattggagtttctggaataggagaaatggtttatggaattttatagaaataatattctcaagaatattattgacagtcactgaccaaggaaaatgattcatggaattttggaataaggaattgatttatgggacaaaggaaaaaggatttattacatcccgggaaaaagaaaaggatggagggatgtatattagactttttcgggcggcaagggcgcggcccaagggttgaaggaggctcggccaagccatttgggccggcgcggtcgcgggaaaggtggcccattagggcgcgcggaagggggagggagcggtccggtggaccgagcccaccacgcggggtcccgggtggggcccatatgtcggcgagacggtgcacggtggaagcggcgcacgcggggcgggcgctagggttttgggtgcaccggatggatcgaggcgcggcgggcccacgtgcagccgcatggcacaccgtggtccgcgcgcacggagggggaaacggaagggaggggccgaccgggtctgttgactcggtcgtgccgaggtggcgccgacgtggcggcagccacgcgggtcggcggaaggacgaagacgaggccggccgggatggacggcggacggcggcggcgttcgcaggagcaaggcgcgacctcaatggaaaaaggaagcacaccgggggaaggggagagacgagacgaagcgagccgacggctcggattcgccggaggatggccggaatccggcggattgtggcggcggcaatcgccggcgagcaaagaggggaatcacgacgagacgatgagggttcgattcaaagggggtggagcatctccggggttcaaggaatccgtttccggtgtcggatggggcggagaatcactgaggagggctggcgacgagcagcggccttcgggagcggacggcaatggcggcgaggctgtgctgggcggcgacggcgctagggaatggtttggggaggtcctagggagctcaaggacggtggtggcgcgaggtattggcgagagggcccacggcggctcacaggcgggtgcggcggcggcgaagcagagcaacggcggggcggcacgtttaaggggacgagcgagcaaccgaatggctcggggcttatccaagatgatgcagatggcgagaatttgggcgaggagctcaccggcgtgcgggaacggtatcggcggcgatttggggatggaaaggggtggaaggccgatggcggcacgcgaccgagcggcggcgcacggcggatgacgccgaggcggcgcggcgtcgaggcgagtgcgccggggaagaagagagggagaggtggcgcccggagctcctcgtcacgcgttcacgctcgcaccggctcctccggtgctcggcgacggacgacgacgacgagagcgggacaagcggcaacaaggcggcgatggtggttcggtggtaatggcgctacagcggtggagactgaagcggggaaattgagaggagggactcggctttataggcgaggaggagaggttggtttggaggagggaaaccgacattggcagtcaagggatgcaagggcgacgagctggcggtcgtcgacgcgtgcagccaaggtggcggcaggtgatgacgccggcggtgtcgggcaaaaggaaaaagaagggggaaaggggcttggtcccttgccaaaacgagaaaaggaggagggagagtgaggaggaggaggagagggagagcagctgcttctcccactcttggacgggtgcggcgtggagtggcgggggccatggatgacgtcgacgatgacggcggcggtcggtttggcatggagcggggccgggtggctgcgcggcgcaggcgcggcagggctgacggcggcaacgaccggccggtcggccacgcgcgagcgcgggaaaaggcgaaggcggtggcgggttttgggcggcgacggcgggaagcggcgtcggcgcgggagagagacatcgagagagagagagagaaacagcgagagcgagagagacagagagagcgagcgacgactctctctctctcggctcgcatgcgtgcaacgcacgtgcgagggggggatgatgggctgggagggggagatgggccgggggaggagaatcggcccatccaaaatcacagggaggtaaggtagacttttgcagagaaaattgatttggatagaattggagagatttagggtttggattcgaattcaaatttgatattcgaactcgagggtttagggatgtatcaaggggaattcaaggagaagtcatgggaaagattcaaaaggaatacttgggtatttgttctcgggatcatagggtggagtcaaggaaaggattcgaggcgggatttgaataattctggattcgtagaagtatttggcgaggattcaaaggaaggatttgaatttcagaatttgatttcagagactcgaatcggaaaaggaatttggaggtagaggattttggtttcgatgagagggaacaacgggattaaattgagatcattggcacaacttagactcaacactcaaagaacgaaattttcgcaattaggatttttgccgaattagtttttaacgcctcacgaaaagcggagcgttacacacctcaggtttcacccccactcctcgcaaggcagcgggcagtcccctctcgtgcctaggtgaatccggaagccgcataggccgtcgcagggcccatccaaactccatcacgcccacccttgcctggatgcgtcagctagaggaaagctacactacaagcccagccgttgcccacgctggcttgtggtaagcacgataagttcttccagggcatcccgcgaaccggtccttaattgccatgggtgcgactagcaaaaccatgcacccacagcccaccattcagtcgcattttagttggataattacgaccatgaagcatggccagatgtctcgagcacgcagctcattctgatactaaaaaggtctaatactgtaattatcccatcaactgagctagtggtaattaagcatggctaagcatacagttctagctaggtcacataagtaacatgagctagtcgatttattacccaaggttgacaaaggacagatatcaagtaaacatggcacacgcaagcagataggtaatacccgaatcccatgtaattagcaagacatgcatgtttatttgtaaacggtaaaacatttataaattgggatcaacatgttcaaggggaatgtgtgacttgccttgcttcttcaaaaaaatcttccgaactcttttcctcgcgaccgcggacttccgaaacaacggattctacacgctggcacgcaaaacgaggaaaaactctaataaaaaccaagaaaatagtacataaaaagtaaacaaacatgtagagctcaattttagatgaattttgcaagttgaacggcacaattcagagttcgaatgaattagatatgaattttagaagttttgagccatttaaatgaatttctagaattatcatcgaattatgacgcaattattatttatttttccaaaggaaaagagacggctgacgtcatcaagagaaaggggcgcgccgacaggtgggccccgcacgtcagcggcacaggggagggcgcacggtggactcggtccaccgcggcctgggcggcaccatggacccggaccacgggagtggtccacgggcggccaaagcacgggcgcgacgaggagccggctcggccgagccttggagcgacgacgcgcgcggctaccagcgacggctaccggcgggcggcgcggggagcggcgaaggagggagagaaggagggaggagggtgctcaccgagctggcgccgacgaggggcggccgccatggggcatggcgacggccgatggccgtcggcggcgtgctccctgggatggaggcgaggcggcgctccggtgacgggaagtggtggccgaggctctccccgtccttgcgaagccgaaggaggcgacggcgtagcgcgggatggacgggagcggcaacgattggtggctggaggcggcgagtagaggtggtggctcggtttggtggtggaatgggaatttcggtggcggtttggggaggaaaagtggatgcaggggtgcagcacggcgtggtgaaactagtggcggcggcggcgcgtcgcggcagtggctagggaggcggtggtgagcggctggaggcgacggcggagagaggtggtgcacgaggcggcgatgttctggaggtagagaggggaaatggagtaggggccggggtgcagcacggcgccgcgaagccgacggtggtggcggattggtgcgacagtgggtggagcagcgggaaaaggtggccggtgaactccggcgagcggcggcggctcggcttggcgaggggagagcgggcgagagcgcggggagctcgggaaagttggggaaatgggagaggagagcacggggatcgtttttatagcctcgagagtcgacggggaggccggttggcgacggatttgaagggggaaaggggcgccggtgacgtgggtgagtggggcagtttggcgccggttttggaggggagaagtgggggaaatgggcgcggggtgaatgataccggtccacgcgcacacggggtggggtggagagcggaggaagcggcgacgtggggatggaggccggcggccatgggccatggcagttgcgggaggggaggctggaggtaggggacggcgctgacatgtggggcctcgggtcccacatgtcggctggagagagagaggggggagggaaaccggggacgcaaagcagacttttctcaaggcgtgggccggccgagagagggaggaggcgcgcggcccgcgggaggggaaggaggggttgggccgaaaatggcccaagggggatggagggagattttatttgttttctttttattttatttgattatatgaactttgtattgttatagttatttcttgagctccgaaaattcacggaaaattccggagagtacattagggcacaaagaatattacaaaatattcccggccatgatttttaaaggaaattttaaattccctcattatttcactttattaaattgctttaacttttatttaatttctagaaaatgcattattaaatgattttttaatcccgaccgaaaatcggggcgttacctccatccaatcctcttattccggcccattaagcgtgcgaccctgtagtttcatatatactcagctgtaacccgaaaactcattttcggtccacgcgtcaacagcggcccctagcagaacgtattgactcaccgggcatacataaagatcatatcggctgaacctctagtgtatacttgtatgaacccctttgcctcacgatatcgattaagttcaaggctagatatatgccatcctctaatagctcaatcattcactcgaacctgtcgatagattatataacttgtgattgactcctcaatcacctttggcatggccatgcacttccataatctacaacatcgaggggcccagagatatctcttcataggaggggcaaatcccatgttgattattcatatcccactacatgtttcatagcatacccgaaaactacttttataactacccaattacggagtagcgtttagcagtctctaagtaagctactacacatgttgggaatcatgataatctcaagtctaaggattcaacaccaacactaaatgagatcactgatgacacaacatatatggttcttacagtgtctcatgttgggtctatcgaacaatatgttcactaacatgtgcccacattattaatttggtatctctataccatgatccaacatgtgcccacattatcaattaatacatgtgctgatcatctatacatatttgttccacatatgatatttgatcagtgatcctttagaaatagcaacacataacataaagagtcttatgaaagaatcacacattcattaaccaataataagtttatctatttcaaggaacaaagtcggataaatatgtaaacatagtgtgtgatataatcatctctatgatagcctctagggcatatcactaacaagttaagataacattaattaattagttataataattaagaatctgatgcatatatatattattaataagatgagacgacgacgatggtggatgcatggatgacgatcgatcgatgatgggtgagagatggagggcagcagcaggggtggtggatcgatcgatatgatgaagaatgaattagtagggcttgacgccgacgtagttgccgggcggccagtagctgcagaccatgatggtgtcgccggaggtgcagacgacgcggccgcagccgacggcggtggtgttcttccagacgatggcggtgtagtgggtgcacatggcgccggccttgcagctgttggatttgtagtcgtagctcttcttctcgtcgctccactcgtccaccgtcttcttccacgtccactgcttccccgtcccgaacatcatgttctccccgtaggggccatgagagtgctccagctggcaatcccctctcctcaaatccgcgtactcctgcgcgtacttcgccagcgtcgcgttccacctgccattattatatatgccattgtcgatcatcgccattgccattggcattccatcgaacagcttgcgtgcgtgcatgatgcttacactatgggtggcacgtgctccctcgtgcggaacatgttgtgctccctcacgatgtcgctgatcgccttctcgttcagcccgtccttctgctcctccgccgccggagtgttgctggtcgccggggcgtacgggtcattggaaggaggctttggcaccgccgtcgccggggaagaaggctgcaccggcgccggcaccacgcctgctggcgccgccggggaagaaggctgcaccggcgccggcaccacgcctgctggcgccgccggggaagaaggctggttcaccggcaccacgcctggcgccgccggagcatactccttattcgaaggaggagacgtcgacggcgtcgccggaacagctggcttgggcgccgccggcgggacgcaattgtccttttggaccgccgcgaccgtcggcggctcctccggcttcttcggctgggtcgtcgcgtagtaatccacctgcacctccttcgacggcggcgatgatcctgccgcgccagcgccgcccttggccggcaggacctgcgccgccggcagagacttgggaggattcccctcgtcgttgggatccggaatccatggcacgtcctggtagaattgcccggcgtccgccttctccagcaccggcttcatgacggcagtcacccccggcgcggagttcgccgcgccggcggtgaagccggtgaccagagcggccgcggcgtcctcctcctcggcggcgtcctccgcctcggcagccgccgtctccgccgccaaggccttgttgacgtcttcccccgccgccggctgcttcggcgccacggtcgccgttgcgccgccgtaggattgttccggtgcggtggtggccgtgtgggccgcggcgaggaggccgaccacgacggcggcgatcaccgtgcgcatcatcttgtccatctttttttttcccttgtgtgtgtacgtagcattggacaagttttaatttgaagagaggcgacatgctaattttggcgcgaactaacgcacgcatgcatgggttggtttgtggcgccaaagctatttttgacgcgagggtgaggtccactagtaattacttgtaatttcttttttttttgtttggttattttcttactttcacatgatatgcatgaggaattccgtactattatccgtctattaaatagggagtgtgcctatatctatatctattctatacctaattaaaaaatacataaggattccggtaaatgtttggtctgtttcttttttttttatttttttccgttttattttcttttcgctgtccgttcctttttttcccgtttccgtttcctcttttttttttccgtttctcttctttttcgttttttttccgttttattttcttttcgccgtttttctttcttttgtcgtttttttgcagtttttctcgtgccgaaccctgcaccgcggtcacgttgatttgctttcccatgtgttttcttctccaattgattgcaaaaaccgattctctactactctctcatcatttttctctcaacaattttagggatttcgataaaaaaaatggaaaaaggagatcaaggggatcaaaatccctctaaattttggagatcaagaaagattcaggagaggatcggctccatcatcgtacagacactggactatgcgagctcgaccccggattaaattttgaagatcaagaagattcccgactactctctcatcattttcccttaacaattttggagattttgattaaaaaggaatagggagatcgagtggatcaaaatctctcaacaattttggagatcaagaaagattcgaccggatttgtcattttcccttaacaattttggggattttgattaaaaaggaagacggagatcgagtagatcaaaatccctcaacaattttggagattgagaaagattcgaccggatttgatggagaggatcggctccatcattgtatggacactggactatgcaagctcgaccggattaaattttggagatcgagaaagattggaccggatttaatgggaggatcggctccgttatggtacaggcacggtattgttcgagctgggcctacagtttcacttgtgggctgagccgaagagaggtaggctgagcagagggaggtagcggacatggctaggactgaagctggaaaggaaggaatgagcgttcgatccaaaaccaaggaagcattcggtccaaaaccaagggagtaaaatgtataggataaataaaacgtttttacccccgttgaaacgtacgggcattttttctagttctcttaaaaacaaactcaggtaagcttgacagtatccagcccacacagtgtccgacccaaatattctggcccagttattgttatttcggcgaaagcattatcgtcccctaagataattcttactacctcttgctagaaagtcttataacctgaaacagaggaaatatcttttagtatgcaagcatagtatttattagcacttataaaacctatgtgcaaacatgccacatcaacccattaagcacacaaaactcaacatgtaagtatatagtctacaatttattttattctaaaactaaacatacacatgctaaattatcattctcaaatcatttttataatatttcaatctaaatcatttctccaatatctaacttattatatcccgcagcaaaacgtggggcatcatctagtaatttgttatataagcatttatgtgacgcttttactgttttgtcctttcagtacccctcagtaattttttttagataatgggtacccctcagtaatagtggaccctttcttcccactgtttcactttctaaagtgcatttaattatggacattgtcgtaaaaaaaactctttcgatctttaattctttcacttaatctctgcttaaaaaagatatcaatgcttatatttgtagtgtgttgtatgacagctgccaccaatgtatattacacaataatcctagcttaaccggccggtttctgatcttgaggcagttgagtgcctgatcagtgtgtgaggctcaccgaggaaacgtgcggatgtgaaatattcatatcctgattattgaaatgtgtttgaagatcatcatccggtcactactgaagtctccatccatgtagcttccccctaattaacttcaccactactacagtactatttgtagaggatgcgcatgcaggtctattggtctaagctaaacactttgcgatgagtttgatccacataaattattcatttcttcggaaatcgttgcatgcatgcttggccatatactcccaattcgtcgctatttatggatcgatcgagtcaattagctactaggatgtacttaacaactatgatttccgactgatcatcaaacgggcgagattgagttattaccttgaaaccggccgccccattatgtttatagtgatttgattagtccaagcaatgaatcaactaaccatacagacatcctgatttaacttactccctccttattttaatgtatgacgccattaactttttgataaacgtttgaccattcatcttattcaaaaaatttattcaaaaaatttatgtaattataatttattttattgtgatttgatttatcatcaaattttctttaagcatgacataggtatttttacatttgcacaaaaattttgaataagacgagtggtcaaacgttagttaaaaagtcaacggcgtcatagattaaaatacagagggagtatacagtatacctagctattaatgccatcacctcaacaactacgtgcatccatcgagaatgaattgtagcgtccttttgttttaattcatactccctcctttcaatttgtcacgaagactaaatttgtttaactcattccacgtgtaacaaactcatcccatatgcatgcagttaaaaactgtatgcatgcatgcaacgtgtattaaagatggttactcgggttccggtaaacaattcaatcgagcaccacaaaacaaaacgacaatctctttatttaagtgttgaatgtgtgaagaatgtgttaggttcctagctatattttatcaccatttaccaataaatattatcatacttatctaagttgaggcgatgtacatcttcacaagcttaaggaaatcttgctatatatactttttgagtaattttttttttgcagggacacttttttttagtcattgacgtgtgggatctggtttattggaagaaaatcttgtcacatctatagctacaaccaaatggttgtcaaggtgatcaaacttaactaaccttagaagtggcagattgtgaatggcaaccaaacacctctataaatacgatcatctcatttggaaaaatcacaaaataaaatatattaagactttaaaatggagacagtaccgtttaagtaatttcgcagcggtatacttatagacaacacaccacctgttaaaaaaatgaattaaaagtacattttatgaacacaattttgcatcgcgtaaataatattacaacagagtaatggcggttcaaaaccttatattatcctaacagagagaaatagagatagtacataggaagatcacggataggggagaaaactagaatttttttagaaataatattattttaataaaaaaattataaaaataggagctgatcagctaaaatcgcaagtttaatatcctgtcgaacaaccgcagttcgacaggttcgatagggtagttggtccataaaaaaaaagtacatgaacagtgctacgcattgttcggcaggggcatatcgaacttacaaagttcgatatgtcccgcatgaacaatattgcacagtgcttgttctccttttttttaaaaaaatatcacctgttgaacaaccgcagtttgtttgatatgggcccccgttaaactgcggttgttcgacaggatgctaaacttgtgattttcaacttctatttttataatttttcattaaaataatattattgctaaaaaaatcagaaaactaagccacatatgttgtttatagtatataatcaattgagcaggtgggcagaacgagcgattagtcgcatgcatgaaaaccatactcatgcagtccaagcaacgacgaacacacaattaagcagacacgccatcaaattaacaacaactcgatcgatctctagctagcttatttatacctggccactctcgcatctccctttcgatcgagcgagcgagcgatggggaggtcgtcggcgtgctgcgacaaggcggcggtgaagccgaagcgcggggcatggacggcggaggacgacgagcggctgcggtcgtacatccagcagcacggcaccggcggcaactggatggcctccgccgctgcggcaagagctgccgcctccgctggctcaactacctccgccccggcatccgccacggcgccttctccgaccacgacgaccgcctcatcctcgccctccacgccgccgtcggcaccaggccggtcctcctcctcgccgcccaccagctgcacgttgctagcaccagtagcggcggcatgcacgtcggagtcggagaagaaggacgcggctacgacgacgtcttcgccgccggtcattcgttgtagtcgacggcagctacgagcggcggcgcaacggagctcgacgagatcttccgttccaccggcacgagcggcggcgattgttcatcatcagctcagaatcggagcacggacgacgcgctgatgatgatgatgaattggcacaaccaccaaaaccagctacaatatttgcaaggcaaattacaaactggtgtgcagcagcagcaacttgtatttggcatgccttactggtgataattaatgtaatcgtacattgatttacagttgagatgttttgattaagttttctcttgttaattttcttaaaccacctggcatgcatacgcattgtatgttttatgcatatgcactagttaataaactgttaattaatgtaggtgtttaatactacataatacttttatatatgtgtcctatatatagtgatgagatgaaatgaaccccctggaccatgcatgattatactctgctgttctcttttgatggttggttcatttctctgaaatttatttattgggtagttcaggataagggtaactactgaagtaaaggtcattgtcaaagtgtctcgctagctgcggtggttcacttcgttgcaacctcaagtttattcgtacgaacgtacggtatgttgagagatcaaaccatcaatagattagagacccaacagttaactgatcatttcttcgttagactctatgattattgagatcccagattagctctaagaattcatgcaggcaacaagtaaagtacctatctgtgacgaaatatgatactgaagacctggaagctagctgctctgtccagaaattctagtgtacagatcaccgctgacatcaacaagatcagtcatcctttacacttggaaagttgaagtcgatcgatcgattgaaaattggaacagattttgatgactggtcgcagcatcactaatctgctgacgtcaatgactctgcccttgtggttcaaaacttcaaactgtactacacttatgtcaaattcaaacacaaaccagttttccgcaaggttcaaataccgcgggagcagcctggtgagaaaaaccaaagctgcaggctaactgccctgacctgatcatcacaagtaatgtgtggaataatacagtgcccagaccataagttgcagcagcaaaaacaccacccaaactgtgtacaagcactctgaaaatgttctgcttatgttacagatcaactcttaaaagcatatgctttgagggaggcaacaaaaagttcttgcttaatttccctgttcaaagcactggcagcagtcaaaaatcagatttcttttaagagtaaattgcatcgtcggtacacgaacttatcaggtgggtgcaatctagtgcacaaacttgtaaaatattcattttgatgcacgaatttgtgtggtgcgtgcgggagaagtcaaaaaggacatgactaatgttattgacttagaggctgattaggatactatgttaacatatatatgaggaggatgccattagacatacacctattcaataaaatatagaataggatttagtgaatgtagaaaaagattaaaaaaatcgagcactgatataagggttagaaacatatgaaattcatcatttcaatgatgaaggataaagtagagactaaatttataaatattgcatgttttataataatcactgcacgtatgcacgtcacatcctaatcaacatcaactttataaaattaacattgccaaattattttggttctcgttcgcacgaactaggcaagttcatatactgaaacgagcattttataagtttatatactaaattgcacccacctaacaagtttgtgtaccaccaatgcaatttactcttcttttaatcttttcaagaaacagtagagcctaaagagatggagtactccatacaaagaggaaggaaacaccaccaaggacaaaagaaaatattcactgaaatcagcatgcaccagatttgtgatgcacagcacaaaggataatcccctgagctcttttgatgacaaagactgatggtggctgtaaagtttgatggggaatatgcctcccaacagctacagatatgtatagattgcagcccaacgctaaatctcaagaactgccaccaaatacaaaatgatggcacatgctttttgacaaatatggattaaattaaaaaaatgtgcagtccaggacaagctctaagctaacaggcatggaaatttcagttttacattctcagatgagttgaagttagaagaggagggtaattgagttgcagagtagctgaggttaccaaagaaacaagtttaaatttcatgtaacagaatgacctagcactacaacaatatctgcatggcaaaggcttgaatatactgattaactagcatgtcctagagtcactagcttggaaatcaaacggatcaaaacaacaaaattgcttttcaggtatcctgatgctctctcaatgtatgttgtatgatgtatgtggctgtacattttcatcgctgaacaggctgatgaaggggttagtagttagatatcctattctattctgacaaacctcttttctgcaatctgacaaggaaagtaatcgacttcacagcatgccgaagacggctaactgggagtccattcagtgttgggtgagacaactccgctctgggttcctcgaagctttcttttccattcgacttatcagagctacacccttgttcctcatcgctcccgacagtctgaattttctccaagggtatatcttcagtgtcgtggaactgacaataggcagaatgaagccggtggtgaatttcatccattcttcctgaccgttcgtcttccctgtccatgtcaattaaatcctgtacaatcaaaatgcagtagtcaatcacccacgagcaaaaatctctaccagtcaccacaatgatagaatgtggagaccatggggttattttttaatttgttgtccacttaagtccatcactatacactatgatggaactaatacgaacctgtgctggggtagttctgaataatgggagaagtcgatttctgcaatactgattgaataacagagtgaggatgataagaggtatggtgaagcctgcagctactggtgattctttcaggccaaatacaccaaggcagataatctgtgtgagcacgagagagaatatcactgcgttgtgtgcgattggccagtacaaaccccctgtgtcatatcttgtgcggtaaacattgagcaactgaaaacaccacgaatagaatatcattagcatggggaaataatagggttgaagaatgaagctaagaaataagaaatactatttcagtaaacattttttacaagaacatgcaattttctttccaaatttaattgcatgaaacagtgcgagctactcaacaaatataatggtgcagtaaggttcatgtaaaaaatgttcaccaccacggttacaatttgcaacataataaaatattcattgatgaagatattcatatttgagaataaaaatatgttatgaacatataatactccaagtagaaatgaagaggttcctcacctgattgcggtacacgatgtaaccaaggaagaagtacactaacagaaaaggtaagatcaaaggtgccagtacagagcatgtgaagcccagtagtccgaacagcaaaacttttggcacttctgtgtgatatgggaatgagggaacaaactctgtgtcttctggcatacgtagaatatatttcctcacaaagttccatattaaaccaaataattgcataagttcagatgataaactggcccatcctgatgtcagaacataggtgataaagaaggtagcctgaaaatatttacagaatagcagagagaagttaagaaaaaaactaagggacaaaaacagtatctttttggagaaacctttcatcatgtactccaaactattcatatcttctgaagcacaaagacaaaaaggtgtttggacaatatttacctggacaggtatagctctagcaagctggacagggatgtcctttgggcttgataacacattcaattggcttatgacagtaccagatagtacatttccaaagaatatgttccaaacagtgaagtacagcactttacagcaagcactcctcttcctttcactgtgagatataggcccctctaatgtagaaaataatatcattatcggtgcaacggcatataaaaatatttgcagtatgacactgggaaggtacccagttacaagctggctcatgtatttcctgcacacgaaagagtactcagtagatgctgcatagaaatgaatagaagcccgtatttctacattaaatattgcctcagcaacacaagagaaaaggaaacatcaaactgtgttcctttacacatttgaattgactaactgcagaacatgttaaattaattggtctaatcacaagaatagggcctcacttttaaaatatatatatatacatgagatacgattcgcactacaaataagaacaagctttgtaataacaagagattggttccattttaacatgtatacttacttctccagtatccccttcaggaaaggaagcctctgctgcaactgctctagctgagatagtccttgtataaatgtcactggtatcagaaagaataacataaaaacaattgaaccaaggagcgtagctattcggcgaatccaaagctgcttataaggtagccaaagatttgaccaatacacatcatctggttctggagctagatcagtaacccatttcatagggttagatgtttggagtatttctgaggcaacaagagcagcataccgagttctgaaatatacaaaagcagctgcacattcctggtacaattcaacagttaaagttactggttttatactgactaattgacgaactaccagtaaaagagctaatatttgtgagattacaagttcaacctgatcatctagtttcaagctggaatcttgaaggtcagatttcccctgattctgctcaagcccagttgccaacagctggaaagaattagatgaggctccgcacagacagcaccggtatgaaattgctcgacacctctgatcaatagtgctgtctgtaaaatgtttgaatttcctgtatgccttcttagcaccagtctgccagaatatgactagaattgttacacaataagaagaaagtgaaataaaaatatgcaaagccataaattcaattcaaggaaccggagattaatgaacactactctatataaaagcacagagctgagaatcaaattagtgggaagaatgtgataggttttgcttgtttcccccagtgattacccaactacaagatagtagacccaaaattaatatcaaatgacaacaactatcaaggccgtcttttaaaattcccaataaacaatcagcaatattctttattacaatatgttcaaatttatatgcagctcatcccttcgagtgcagattttaccattatcttctgaacttttccaactttgtaaacaacttgatggaacaggtagcttgatccatggtacttggtgaagaaatcatcaatagcattactgcatgattctttggtttcctttggtattccacgaacaaggacagtaaaatggcttggattgggcattgcacaagtaagatgacggagcctcagcctagcaatgtgcttgtactcctaaattatcagacaaataatgttatatcaaatctactcctcaatatgaggaatgagaatgtttcaattactcctaagagaaaaaggccttacaagatataggagaatgcaagctactcctgatattatgtacaaggctacacaatggacccaaagcctgcaatgcaaccggcatataaatcatatctttctcaaaaaaaaaaaaaaaaagaagaaattattgattctatgaaagtacttttgatgacaaatctattttcacatgtctttttttttttgcatttattagtgatttgattgcacacattctaaaatgtcgtctatttgagagcggagggagttctctaaatgccagcactcaagaggcgtaaatgtcatgtagaacattggttaaactaccctgtagtaaaactacaagaagtttctcatctcaccatcttgatctcactttcacattcccaattgtaaagatatccaatgattctgaaggaatccgaacatgatgtatatcttgcccaaagtagttcagtggtagaattccaaacacacacagaatggcagctagagagaagatgcgtaagctgttgaaaaacaaatgtattagcatgtaaatttggatagaggtaaaaaataaggaatataaatctttaaataaaagacaggggatgtgctactgtgcattacaacaagtcaggaacttatgctttatacagctacaaattttcttctccttctgattcatgcccatattgaagtttaaaaactcagcaatcagataccaccttctaataatatataaacaatacagggaagtaaaaatacctgaatactagaattctattgaaaacaacagcatctagcccagcagcagccaagatctcttcctcggtacactgcagggcttttactatccagccagtagatggtacaaatctctccaagataaaagcttctcggagccgattatgctcctcggcaatcctcctcccaaagtagaccctgacattggctggctgcttcctcagaacagaatagagcgatataaacagcacagaaagagcgatattgatgccagcagaggtcagaagtccgctgattttcattccttcctagcaagtgcgtggcgcgcttatgtcatccaaatacaagcacaaatttcatccttggtacccagaggctcagcacctgcaggaagagatcgctaaagcaaatcaaatcaatcctgcaagtacaaatcgctgcaaattctgtaatctccacaaagagaaagagaaaaaagaaagatagcaaaacaacagataacatcatcactgcctatttctacaccatgaataaacaaacgcacattccaaaagtggcaccaaggtaaaatcagatttgagaatgaagccaattcctcggagtgggtgtacggacagtggaaccttggagataataagtagtaattaattggctaaaacaaaaagtagtggtagcatgtagaacactccagatgcaatgtcatgtgcccaaatgacatgagggctgcttatatattattctactaccaagtggagtagttaattaaaaagaagaacacgatgcaagaggcgtcaacatcgttggctgcaaggctgcaaatagaggaatccaagctgtctgaacaggttgggtttagattcgatggttggaaccggtgtttgcgtgtgagcatccgcatcaccacaacaccacgcgacagaaagcggattgcctgcaaactgcaactctacctgaccctgcaggcttagtatagaaaccaagcagaaaattactactacatcgcattaaccgcgactcctcccccattaacagattaaccgcaaccgcagcaagagaaggaacagaatccaactccgaaatcgatggacaaagaacggggattaacaactgaaatttctgtctaaaccaacgcgtagtaaatccgacgaactaaaacgaacaagtagagaagacgaaggaggaggcgagattaacttgcctccaagtcgaccgcccgctcgccggcgcaacacagcaaccgccgccgcctcggtggagccctgcgccgccattaagtgaaaccccaatagaatgagaaggaaatcaaccaacgaagcagcacaaagcagcaaaaaaaaaaaaggcagcaggagagcagattaccacggcgacgaggagtgggagtgggttaaattaagcgcggccgcggcggcggcaatggcggggagatgcggactggattggagcagacgagacgaggcgaggcgagaggaggaagaagaagaaggggatgatgaatccaaactttttcctctctctctctctcgctttttcgatttggtttcgattttggtttggttttgatttgggtttggagagagtacgagacgagagtggaagggaagaagcccccaggagttattgcaaaatcaaatacggagtactacagtgtcctttaagttttctttttcttttttttcctccgaggaataaaggattggtgcattttactactcctatcaattttttttaaaaaaaattaaaattgagatgagaaaaaggagatgccacgtaaggtgggcagtggagaacgtggtgggggtggattggtcccaacagtggggcccacacgcacgccgtgatgacacgtggttctcaccgggccattggaatcagaggccaagcagtgtcttgtcatgcttggttaccaacaagtaaagcacacaattcatcacatcgatcgatcttgacatcaaattaatcaaagagcatgatttgattttttgtttatccagatcgtggccaaaaagtcccttgtaagttactcctatgcaattagcatctttatttgtgtttggatttgagttcggggagccttacggcatgcaccattcatccatttattcgtactaacattataagatttataaaaaaaaaagtcccttgtaagttactcctatgcaattagcatctatattcacaatgataaatactttcataatatataatccaaatattgttaacggtggggtttttttcctaattggaatgtatcatatcattttttttaaagttaccaaagatttgcttggatttattttttttcgccaaactttgataaatacaaaaaaaattctgtcataattttgataatattgtcaacttaccgaaataccaaaatttgtaaggtgtgttttagctacaatcttaacaactccctaagtgttaagttcctgtaaaaagtcaagctaacatccatatatataatatgaaagaggttaatacatagtatagtcacttatttacgtacgtggcagctgtctaaaccttaattaggcatcatcaatggaagggcacaggcaggtgagctaatccaagaccaattgatcaagccgaccaagacaaggacactttgcttttcttttccccatttttatggactttgacgtggctataagagaagaaaaatcagtgggcatgtgtgagattaccatctacgagtagtttccaccagaaattccttccatacatatatatatattatataaaatgcagatcgatcagcgtttcatccaaaaagatataatacatcggtttcttaatatttaacgccgttaacttttaacgtgatatttaactactcatgttattaaaaaaattatataaatattatttgttttattgtgacttttttcatcaaataaacttttacatatttacacaaaatatttgaataacatgaatgataaaacatcgtgcgaaaagtttacgctacgtgtagtataaaaaaaccgaggaaatatagaattgtggtacatattgagaaaattcggcagaagctgtctgtccaataataacaagacagtgatgacacacgacaaagatccaccacacatttcacatgcacgttgcgtacgtaccggccagccagcctaacatgcagcgtcatccacgagaaggagaaattctaaacaacacgtacgccagccaaatatacttgctgatgatctacaaattgcatgtcaatttctctaaaaaaaaaaagaaattgacatcatctgtcatccttccatcgatgatgctttgtgttgtctgagtggctaattgttaggatcagcctaactctttgttctcaaaatctgaatcgtaatagggtcgacgagggtcggtgttttaaactcggaataagatcactttgactccctcaactgaccaccaaatctaaatcgtatccctcaatcgcaataccagaaatcttgacccccgaacttacaaaaccagtgcaatttaactctctcggtggttttagagggtggttttgctgacgtggcgcatatgtggcagtgttgactcggtctttgtgccacgtggcattgacgtggcacttatgtggcactaaaataaaaatatatatgcggggcccatttttcattctcacaaaaaaaaaattcccgccgccaccgccgccgccggggaaggcggaaatggcgggggcggcggagggagggagagcgaaccctaccacgaggcgccaccagaggacggcgatcaacatatctcctcctccacggcatggcgtggtggcgcctcgccggagtgcgcggcggcgcgtaggcgtagcagctcagcttaggcttcgccctaactctcgatcccaatccccatgcggcgtctctacctctaccaatcaggtcaggctccgatccccattcgctcgtgctctcgtcggcgtggaacaacaggtgcaagaagctgggcaggctggccaagatgtccagcgccgacgtggaaggggccgagaaggtggaggaactccatctcgtgatggaagagtagctgcctagctagatgctgcatggctgattggtttcaagtaatttcatgggtcttttgttttttgagacagtccattttgctcagtttgatgtagtgatgttcatgcatggcgtgcaaagtctgaggacttctctcattttgctcagagagaattaatccattttgtgcagagtatgaggacttctcaagcaaatgattttaaccaaacattgcaaatgattttgtgcagagcctgccgccggctcatgtaagggcgggagagagagagaaataagggagagaggaggaagaagaagggtagtgagagagaggatgagatgtgggacctacatgttagtggatcccacaattttttttaatgacaaatgggcccacatattttttttcttttaatgtcacctaagcgccacgtcaatgtcacgtgggataaagaccaggtcaacattgccacgtgcgcggccacgtcagcgaaaccgccctccaaaaccaccaaaggagtcaaattgcaccggttttgtaagtttaggggtcaagatttctggtattgcggttgagggatacgatttagattcggtggtaaattgagggagtcaaagtgatcttattcctttaaactccgaactcctatggctatttcgtgcgctatctgtaggcttagatgggcctgagtgggaatgcgactctctcttctggttgggccagaacagtatcaatgacatacatgcggcccatatttattgggccggaacgggattgctacttcgtgcggtctgtatattatggagtcccccagtttatctcttctctacaattataaaaatcgaagatatttttgccggtactttgatacgttatttgagttggtttttaagttcgtttgcttttagaaatacagaaggagtcaaataagaaatctattttttttaaaaaaaactcgcatgttaatttgagatgaacagcctgctaactgcaacttattatgattttctaaaaatatacatatctaagcgaattcctatagtcaatttcaccttaaataaacataacaataataagattaaaatagttttcacctgttaaaacgcacggatattttttttatataagaagaagaagaattgaagaagaagaacggtgaaattttctttaccgccttcacccacgtgcaagccgaacggtgaaatttcctccgtccatatccgattccgtctccattaatccgtcctaattcatgcaatccatatcctcctcaaatagaatgcatgcagtagctagcgaatctcatattttaactcaattaaatttcccaagccagcaacgcaattaagctaagctagctacgcatggactgctgctcccagctgccgggcgaccttgtcgccgcgacatcctccgccgcctgccgctacgcagcctcgccgccgcgcgcgccgtttgccacgcctggcgtgccatcgtcgacgaacattccctcaccacgcaggcggtcgcgctcctcccaaaccatctccgcggcctcttcgtctgcctcaatgaatcgtgcctccatggcttcttcgcccgtccctcgccgccggccaccatccccggcatcgacctcgactacgacctggacgacgatgccaccatcgaagtccactgcaacggcctcctcttgctcgatcgccacatcgtcaacccggccacacgccagtggatgcgtctacctcctgtccccccgtacgcctcactgcccaacataatgtacggtgatcggggcctcgtcttcgacccagcagcgtcaccacactacgacgtcctctggatgccctacctgattcttcatcgactccctgctgcgtctctgtcggatcagtggccgccgtcgccgttcatcctgcacgtcttctcctccacgacggggcgatgggaggagaagtcgtttctccgggaaggcgacgccaccatgggcaccatggctgatgtatccttggcaagggtaccttaccactgcaagactcactccgtctacctccggggagcgctctacatgcattgccagaatgattgcgtcatcaagatcacacttaacgaccacaagtatcgggtcatcagattgcctggcgactctgcatcaaacagaaagactagggaccctttcctaggaaaatcaaaagacagagtgtgctacgtattggtcaccggtctaagtcgactccaaatttggctcctcaacgaaacttcttcttcttcttcttcttcttcttcatacgacgacaacgagtgggtgctcaagcatggtgttgacctagggccaataatacaaagctacccctgcaaccatggtcgtcagcaatggatatggcataatgctgacactaaacaagacaaaaccagggaattaccagctgtaaatgatatggaggaatttgaatgggctatcgataaggactctgatgacattattagtggtgccaatgaaagcatccaccataatggagaatacatctccgctgtactcggatttcatccttttaaagacatcgtcttcttgcacgatacaaatttaagagttgttgcatatgactacaacaaggcaaaggttcaagacttgggtatgatgttcctataccataatacagatagagtggtaagctcatttccatatacaccttgctggatacgtgatttgcctggaatgcactacggttgattttaatgtatatttatggatatatgcccacgttggacggagcggagtttgattgccctatagctttttcactcgtttatcatttgtaacaaagagtgatttatttgtttgattgtatatccggaagactggtccggtatattttgaaattgacaaagtaacccaatcccttcttcctataaagttatcccccactaagtgcaattaatctcctaaagctcaaacctcaatgttccacgtcatcattaatttacagccgttggatcggtagattacatcccattttagccgtcggatggaaaggctcagggttcacagcacgtgaggcccatgtcaccttcctcctcccatctcattctcatctcaccatcccacgcttttggactcccaaacgacgctgttgcctttcgtcaacccccacttctccttccccgccgccgccgctcgccgcccgcccgcccgcccgccatggatgaggagtacgacgtgatcgtgctggggacgggcctcatggagtgcatcctcagcggcctcctctccgtcgacggcctcaaggtacctctctcctacccaatccgattgatccgccgcctcccgtgctcggatcggtgcttgatccgtagaacggccttccgcccccttcatctcatctgggcttgacgcagccgcactcggatgagctgctgctggttgcttttttttttttacctcgccatttgatcgctgcacagagatcgaagggagggcctgccatggccgctcaacgtactcccgccccctctccgccctccactgccttctacacatcggctcctccctctccactcccccgcttttgcacccaccaccgcatcccccgcccggagaccggcaacgacggagggttagcttcgacgagcgaccgaccacgagatatgatatgagttcatctgcgccttccctcacagcgtccacctgctgatcatcctccaaaacccggcggaatggtaaagccgcctacctcttgcgtccgcctgagggatgcagtcgctgaacatgtgttgctcatgtttgatcattggcatgctttgcgtgaagcttcctgattgtagcaattcgtttaatgcggtttcaaatcgaagtgatttaatatttttttcccatgttaattcgttttagagttcaaaccgaaacatcattttagagagatttttattttgtagtttatagaggattacaatgtttctgcatatataggtaaaacatgaatgcatttaaacaccattgtaaatttcccaatgacgaatggaatcatgagaatatatccaattttttcttctattgctggggcgaaagttaatattatagtaggttctcatgtttgggctgaagaccctgaacttgcctgggtcgatggagaagttgttaagatcaaaggcgaagaggccaagatccaagcaaccaatggaaagaaggtaagctgctaattcgtttttggccttcagtttgatgtactgctacttatgtttgtgctgtcaattcttttagatcattgcagctgctggtggagttgatgatatgacaaagctatcatacctccatgaaccaggagttctgcagaatttggcaaccagatatgaacttaatgaaatatatatatgttattctgcatggccatttactgtaaatatgccattgtttcagtcgtactgtatgacctataactttaacattttgacagacatatacgggaaacattctcattgccgtcaatcctttccaaagattgccatatttgtatgatccacatatgatgcaacagtacaagggagcaccatttggagagttaagtccacatgtttcgctatggcagatgttgcatacaggtaaagtaaatatgataggtggtatttgagtcatcagtgtttctaactttctactcctataaatcgtggatcatcctgctgtctttttacatgaaacagagcaatgattcatgaagggaaaagcaactctattcttgtgagtggtgagagcggcgtgggtaaaacagaaacaacaaaatgcttatgagatatcttgcctatttgggtggccgagctgctaccgagggaagaatagtagagcaacaagttctcgaagtaatgaatcgagttcttatttttggaaggccattgtattattaaattagttatattccaattgaatttttgctacatattctttttatgtctgcagtcaaatccagtccttgaagcccgatccgtagatcggcccctgcccccttcatcttatttgggcttgacgcagccgcactcggcactcggatgagctgctgctggttgcttttttttttttatacctcgccatttgatcgctgctttacttacctattcaagcgtagcgggatggtaaattgttcatacatcgtggctgggtaggtggtgcgccatggttgtggtggttgcttgcgtttggggaggaattgtgagtgcgtgcctgagcttacgacttccctatcccacttaaaagagtagcggcatagtgattttgggggagttcagctaacagaacgatgtatttgtcatgtatttgaaggtgttgcacatggataggaatgactactatgaaagagattccacctcgctcatcgttaaccaggtaagcaattgcaataaacttaatttgagcagtagagagtctctatatctgtgtgctcatatcatgtcaaggaatgcttatgttattacagagtacattatttgctataagatagttcaaacaatcatgtatgtctcaattggcaacctttcattcaacattatattcctcctcatattaagttgcactatactataagtcattatgtgttgcaagcagtaaaacaaagctccacattgttagcttatgagcttgatatcatttcaagtatttcttacttcagtgcctattttacctatcaatttgttttcagattcaaataatacaatctaattgttcattcttacatgcatatttcatcttttctaatgtgcccgccgcaacgcgcggggtttcacctagtttaaaaagatgaggaccggggtttaatatttatgatattttgcgatttaagatataattcgaactcggtatcaagatgagtaacataacatgaacttattcctagatatgttggcataaaataaaaggcccagtgagcccagcccactacgcaagttgaatacaccagtcatgatggcttcttcttcttctctagcgcggtggtagcatcttgtcgaggccgaagcgcttggcgaagaaggcgtcgcgcgcccacagcggcgccgccgccagcgccgcgaacagcaacgtcatgttcccgtacacgatctcccgcggcggccgcgcgctcatcacccgccgagccacgtgcgccgcgaacacgccgccgtccgtcgcgccccccgcctgcgacgcccgcgccctctccgcgatcgccgccgcgaactcccggtacagccgccactccgcctgccctccggcgagctgcgccgtgttggcgtggcccagcccggacctcaccgcgccgggcaccaccttcaccacgtgcacgccgaacggccgcagctccacccgcagcgcgtccgtcgccgcgtgcaccgccgccttcgacgcgcagtaggggccggcccacggcgtcgccgccgtgcccaccacgctgcccacgttcaccacgcgcccggaacgccgcgacgccatgtgcggcgccacggcgcgcaccatccggagctggccgaggaagttgacgtccatggcgcgacgcacggcctcgccgcggagctcggcgagcgggccggtgcacccgatgccggcgttgttcaccagcacgtcgacgcgcccgtgctcggcgaggacgcgcgccacggcgccctcgacgctctcgtcggaggtgacgtcgagcgggaggtggtcggcgtcgaggccggcgaggtcgggcacgcggtcggggacgtcggtggcgacgacgcggcagccgagggaggcgaaggccttgcagtactcgtagccgatgccgccgttggcgcagccggtgatgagcaccaccggcatctcgggcttgtcgtcgtcgccatctccggcgtcattaggcggcgccatggattattagtgcggcaatgcaatgcacgtaattataattgcaacattgtgattggggtttccgtcaccaaggaatatgcaggagggatatgcggctgctcatggcgtcttccgcttggaattaatcgttttcgttgccgttcatgcatgctcgatccatttcgttgtgtgtatatgcttgtttatttaggatttcttttcaccgtctgtgtagcatgatttcgatcgccaaattaagtataaacgctctgcttctcttcactgaaaattcagtttagtctcttgttttactttaggcccattgttttggttttgggctctgctttctgaaacagtgctcttgtgtcttcaagcttcaatccagaattccagagacaaagcccagcatatgctccaagcttatataatactatcatgtagcttcagctaagttttctccattcagatgaagatttttacggtacaatctactggcagtatacaactagttttgttttctgaaggaaaaaaaaaaaacctactcctggaggctggaactatcaagattcagtctatgtctatctgcaggtagctagggttggtaatctgacttaagcgtacccaggttataacagaattcgattgctctgagaatacattagttattacttgcacaattggactgacgaatcttgcttacctgcttaatcagcatgtattaaaacgtctaaacagcggcagaatgggcaaaaaaagattcatgtgttcctttctgctgattagccatttgaaatgcttacaagccagtagcagcaactaaacaaaaagacacacgctagatgcaaccgtaactttgtaagtttctgtagaatgacatatgaatcacattactctgactaattcagagatttagaaacgtagtactaggatagggggcggctgcaaaccaaaaccatctctagaaagatttccggacatgattaactagtatagtcattttctgatggaaaatttgcccttcgatcgtcatcatcattatattatcatcatatcaccccgtttgtcactgtcacgcagtattttgaaaattgcatttgggaagatttctattttttttttggatggatctacttgtacggtattgtgcaagacaaaaatcagcaaggaagcttcattcttgattgagctgcctgttttgttgaacaagaccagtcaatattccgagcacactaaatgataatattagcagagagtgactagaatagaagtcataacaaaagatagagaataagaaaaagaattatatatgattatgcaggccaaatttatgacgatgttggaatagtcatttgcaatcagatgactgatatgcgactaacatacgtagcattaaaacacatatgtacatcatggccagataagtaagttttactagtaatttaaaattaaaaggacaaaaattctctaagatagcgttgtttttgcatgcataatattccaaagcattaaagaactgttggcgagagaactatccaatttctgattagttgctattttgtagttttcccggcaatttggtgctcctccttccgggtgtcagtagtggtcaatgttgatggtttggcatttttttgtggcctaccacggacatgagaaggattttccaactccttgatagctactgcttgcaataatcttttggaatttatcgagaaaattccttatatgatcctcatatataacacctaatcagtctataaactcaaatttggaataacaatttttcatataacacgcagatagctaaaaccatcgacggattaagcaagatgaagtcttcgattttcaaatagtttgttgcaaagttaatgcgtgattgggattcggaaacccacatgccacatgcttgactgttaagtctgtaactgacagacaggtaaacaattggcattctacagcttagatcagatgcctccttatatattttcgtaggttctgaactatgttttctttataatcacaaaattcgtaatcaaattacatgacagtactctgtcctaatatactccttttattattaattataaggtatattttgttttgttacaactaataatctctttactaatatattatttatgtaatgtaaaagtataaccataagtttttttagatgcgaatctaataacattaattttgtaaggaaaaatcctaatagaaagggagggagtagctaaaacttgtttcttcagaagagtaatttgaccctaaacttgtagtatatgggaagtcaagaacttgctttgactgttgtattgtgagctgtaagtctgtagtaactgatcggcacgaggttataggaggtttcatgtgtaaacaaaagcctctgccatttctatgaaaggtcaaatgtagtgccatcaacttggcatagttaattttggtttctactattatttcccccccccccctcaatggattcaagttttggatgtgttattcaaatcgatcacaaaccaaaccttccaaatggatatgttttgctcaaaaagaaaatccaaacaaccaccaaacacgagtatatagaacctaacccaagaatgaagccccatcttctagatgcaatataatgcatgcacgaacgaattaattcatcctgctttgatgatgttacacaatttttatagctagcagtcgtactgacgaacacattgccgccagttttgttgtactggatgacatgcgtgtgtttgtgttgaaaaacaccaaggcaaggaaagaacaaaccaatgacaaaaagaaaaatcagataaggatgcttgtgtatgtatatgatgtcaatctgtcgctgttgaacttgaagctcatctactctttaacgaattcatgctaatgtactgtacatccaccctttgcttgcaatctctgtatttctttgcttgcagcaatacatgatccattttattttatagctacgtacataggcgtatatgaatgaaattcagttagaaaaaccatgggaaattaaaataagtacatcagtgatcaatatcgtcttgcagttgggctgttggctaaaacaaatactactaacaaacaggaaagaaaagaaaaaggagaaaaggagatgaggtcacatgttccaatccgttagccttccgtgttccaagctacactaaactgtaaccgaaacaaattaaagagcataataagctccattttgaagggcacacacactacccacacgattggcatgcatccgtgcatgattcattcatgatccatctccatcaatttctccactgctaaaacccctctcatctcatctcatctcctatccttcttccaaaccaaccaactccctacttcttctactcctcgtcttcgttcgtcttcgtcttcttgtacaattaattcctcctctttctccgcccaagaaacccacaccaaaaacatcttcttcttcttctccgtgtcaaaacaaacactgtttctctctctctctctctctctctctttctctgtgttcagagccaagaagtctctgctctgcatgggtcaggaagaagcagcagccgcgccggccaccgtgatgttctcgtgggagcaggagctgggcgtgcccaagcagaagatggcttctgacgacgacatgcccgagagccccaggaaggcgccgccgccgccggcgcggcggctgtcggtgccgccgcctccggggcggatgctgatggcggggagcaagagcttctccaaggcccgggccgtccggccggaggacgacccgttcttggcggcgtacctggcctgcaccaagagcagcaacggcggcggcggtggcgttgcgcgggagagcaaggggcagaggcggtccagatgggccgggcttgggcttgggcttgggctcgggctctcttgcaagagctcaaatggagttgtggaggacagcatggtgaagatggccaaactgcctgaggttcatcctagggatgcttagtgatgatgatccagttaaatatattctcatcttctaccagtctaaaaaaatcatcttctgtctcaattctcttgtttgttttctttgatttgtttcttgatttggaatttttagtgatggtgatcaagacttgcttgcctgcttggtacttaggaattaattagaggtatagaggaaggcacatgtagatgtgtgcttgtttcatctttctttgcaaaatggagcatatcatttgtgcaggagattatcaagctcatctgtctataagttcaagattgtgtgtgacttgcatgctcttttctctctcgctctctctcttggtgaatggcgtccgtttttgtgtgaatggcaacttagcttgtcaaagacacagtttgaccaaggtttcctagaattaattccattgatgttttaatttgttcatattgaatggctgaatgtttagtgaatagagaattgctatggttgttcaacaaacgcaggttggtgtatgcatgcgccaccctaatacctgtagaaattaagataaaagattgtacttgtgttcccggaaatatatatagatgtcacccaaaagaaaaaaagaatcagatgtcgtcagatcccaagctgattatccgtgatattttgtgaaagcatccttagttcagtttttcttttcattttatttatttttttgagaaagcatcttcatcagtcaagttctctctctatagacgaaggtgccaaatcgcaatggatcgatgtttagtactcaccgagaaagagctgagctgatgaagttgaaatatatataaactcttctttttttatacgttctataattgattgatcaccgctgttaagtccagtccagatgtaaaaaggacattatttttttccaaaattttactccccagtcgctaaatatctgatgctattaactttttaaaatatgttgaccgttcgtcttatacataaacttttgtgaaaaatataaaactatacttacgtatacataaaaagtatatttaacaatgaatcaaatgatagaaaaagaattaataattacttaattttttttataagacgaacggttaaatatattttaaaaagacaaccgtgtcaaatatttaggaacggagggagtcggtactggggttcctagggggcgcgtgcgtgccggctgcttaactggcgcagccgcgcgcgtccccctgacgactagttcacgcgctgccgccggtaattatgataattagtgttaattactgtcattagcattatttttaaaatagtaacaacatacataattcataattcagttaccaatctttttagaaaagtaattgaaagttttaaatttgtagtcaaaagattttgaaatttgagttgaaagttttaaatttttatttcaaattttaaaattttgacatagaagttttcaagttgagttgaaagtttttgaaattgaagttgaaagttttcaaatttgagtcaaaagtttcaaaaattaagttgaaagtttttgaaatttgtcttgaaagtttgtaatttgatttgaaagtttcgaatttttagttgaaagtttttgaattttgagatgaaaattctaaaattgtgagttgaaaactttcaaatttgaatcgaaagttttcaaatgctgagtggaaagttttcaaattctgagttgaaaacttttaaatttgaatcaaaagttttcacatgctgagtggaaagttttcaaattctgagttgaaagttttcaaaattttcaatttaaaaattaaatcttttgttaaaaagtttagttaaatgttctaaccactgtatgcatgtatgtacgtgggttttccaattacaattagcacatactactaccaattgagtgtgttactattgaatcatcgttaatcatcgttgaaaaagtcattaggcccagcaggtgtagcgctcgttccgtcgtggcgcctagcggaaaaactatctcttaaaaaccctaattgcgaaatccgttcccttgcttgttgactagtgtccgtgccatctcagatctcaaatccccgatctgtcgccaagttcaatcccgaatccaaatccttcccaaatcaaatccctccgcaaaagtctatttgcctccctcgggttcgatgggccgaattcctctcggcccatctccccctccctccccggctctctctctctctctctcgcccgctctgccgtgagccgcgccgagccctccctcccgctcttgctgccattcccgccgatgccgccaaatcgccgcgccacccgcgcgcgcgcgccgtggtggccgaccggccagtcgccgccgctgtcagcacctgccgcgcctgccccgcgtctgccgcccgtgtcgccgctccactccaaaccagtccaccgtcatcgccgtcgtcatcgacccggccccgccaccgctaagcgctggcttccaagggacgaaggctgagccccgccccccctctgccgcatcgccccctctccctcctccttttccccgaagtggcaaggaggcaagccccctttctctccccctttttcccttttccctcccgctggcgtcatcctccccccctgtcgccgctttggccgcgaccgcggagcgctggctcgctcccttgaccgcccaaggtcggtttccaaaccaacatcgccgccctataaacccaagcgcctcccttcctctttcctctcccaatcttccccgtttctcgcccgcgccattgccgtccctctcgccaaccgttcgtcgtcgcgcgtgtcggaggagccgccacgagcgaggacgcggaaggggactccgggcgctcgtctccttcctcttccccggcccgaggctagagaaatcactcccgtgccagcggcctctcgtcactgcgccccatcacccctgcacggtagtgtctccctccgttctctctcctcgttccatcttctccccttagactcgggtagtagcacgagtagcctccccgtagctagctggcgccgccccgaccgttgccgccgcccgctgtgtgctcgccgccatcgccgcccgtgctccgtagcacccgctcgtcaccggcctcgctcgacgtagctccgcccaattcgacactagcaacggattcccgtagccgtgtagatgctctcgccgccgggaatcggcccctcatgacctcatcactgtttcccccttctcccaccgccggttgccgccgccgcaatccgccgccgtcgagcatcccccggcgaatccgagctgttggctcgtctcccctcgtcctgtgcgacatcccggtgtgctcgccttcgcctatatcgccatggttcgctccgccgctcgccgctgtcgttcgccgtctgttccggccggcgtcatcgtctacctcccgacggtccgcgtggcagccacgtaggcgccacgtcggcgccacctcggctgcgaccgggtcaagcagaccccggtccgccgcttccctccgccccctcgcgcgcgcggtccaccgcgagccgtgaggctgcgcgtgggcctgccgcaccgcgtcctccgcgaaccgcgcgcatgcgccgcatctcccttcccaaaccctagcacaccccgcgtgcacctcgctcacggtgagccgagtcaccgacaagcgggtcccacccaggaccacgcgggatggacccggcccaccggctctctctctcccctccccgcccgcgcgcgccttgggccgccttcttgggccggccggcccattaagctcggccgagccgcccctttctctcaggccgcgccctagccgcccgagtaaagtctaatttccctccctccttcttttcttttctttttcaaaaaggatttaaataaatccttttcctttagaccaaaaatccaataatcttagaaattcaatatcttcccaaccgtaagcccatttgactccgttcaacttccaaaactcctcaaatcttgagatctatctaatggcacgcctagaggtccataatagggctttattttcgccgtttgttgagttgtcccgtttcgcgtgtagtttcggagcctgaagacccgcagtgcgaggatttcgaggatcaagctcaagatctcgagtaaggcaagccacatttgaacatcttgaacctatatttgaatgtaattatgttacttgaaaaatattatgcattgataggattgcacttaatctgtttgccccgtctgcaaggcagaccggtgggcctacctaacttgttgcatctgatccttccattgttaattgttatatcatgtttccttgtaaccacctggtcacgcctcggtattcgtgcactccgtgcgagtatcgacggtcgcattcaaacttaaaatctgagaaacatcttgggtaaaacttgggttttacaaaagacttggaaaacccgacacctgggtcggtgcttgcgaactaaatgagtttccaaaatcgtggaccggggaacgtaccgggtgtacggtttcccgctcttgcacttaaggaccgtttccttggaatttcatccgaacataagacaagtgcgaccacatgggtggaatgggacacccctggctgagtaactagctaaacgggggagccatgatgccaagagacatgtggatttaacggggtggtgtcggggagaacccccgggtttcctggcacagtatggtctgggacctaatctggtgttggtctgggacccctctcgttggcatatggtgaacctgtgtcggctttcgaaatgccttgtcatgaaagccttaaggtctctagtcgtggccgttctgcacgcgctggatgatccgggttagtaatgtcgtgtgggtaaagtgtaccccctctgcagaggttattaaactgttcgaacagccgtgcccccggtcatgggcggatgtgaggtgattcctagcgtagttttgtttgactactgctttgtgaaatttgctgaggtggtttgggattgatgtttggaaaatctgcggctgatgggatcagccaggcccgggtggccgtttgaaagctgttggccgggtgccaatcttgatcaattcaaaagactgatatattgcacatactccgaccggacgagacgcactatctcatccgtgtcgtttgagaagcactcacttagttgtttcagacaagagtttaaataaaatcaattgcaaaaacaacagcctttccttgaagcctgcattaaacacttatttcccatggcttgctgagtactcctgtactcacccttgctctatataaataatccccccccagttgctgaagaagatgaagcggatcccgctgacgaggagttcttccaggagcaagtcagctacgatgagttttagggttttcggcctagttcccaagtcgcgcctgtgatgtttggtccaagtcttggtttccgcttcccttttgtaatgcagttgtaagctcgggatctgtccgcagcccaacataactatactcctactctataataaagagacctctgttgctgtgatattctgtcttcctgtgataccagcactgtttcctgggactggtatcgattaacaggttaatttggagcgtcacgggctagttccgctcgggactagttcgaggcgtgacagcaggcccatgtcagacacgaagttgaggcattgccgtcgcgaaacgctcgcgacttgctgatctcgcgcgtacgcgcgaattagcaatctcggtaggtactagtctttttttctgccataccctaattaagatggatgattatgagccgtccatcggatcaatcggattcctgtagtacgttgcaattgcaaaaggaataagttcacttcatgacccttaaaagtgatcgaaatctaaaccatgaccctaaactacaaaactggatatctcgacccccaaactcctaaaaccggtgtaatttgactccctgggcggttttgctgacgtggcgccacgtggcgcctacgtggcaatattgaccgagtcgttgttacacgtggcgttgacgtggcacctacgtggcggtagaaataaaaaatatgcgtgggacccgtttgttattcacacagataaaaaatgtggggcccactgacatgtgggccccacatgtcatcctccttccttcttcctcctccctctctcccttctctctctctcccttgttcaccctcggccggcggcggggcatgggctgcggtgtggtggcggccggtgggagctgaagcgccggcggcagcaggagatagctggaacgggttctggagcgccgccggcgtggtggacggaggtggcgcaaggagctcgtccccgggtcaacggcgatggacctcggcgcgacgaagaggcggtcacccccctccgacggtggcggcggtcccccgagtggaggagtcaacgatggcgaggctagcgcttggcgagatggggtcgtcgtcgtggaggaagtcgaccggcggtggttgcccttggcgtcgtcgatggccgaagacggaggcggaggtcgaaggcggcggtccacgcggtcgaagccggcggcgcagccgtgccggggtggaagagcgaggcggccacttggggccgctacgagacgagcaggacggcggcggtggccacaagttccggccctccgagttggagcagggccgagccacccacccgccaccgctgccgctccggccttccaccgcccgctgccgccgctccagcccaccgccgccgccactccagctagctcccgctgccgccgccggccgaagaggatgaaggggagagagagagagagagaagggaaagagggaggaggaagaaggatgacatgtggggtccacatgtcagtgggccccacaattttttttatgtgtgaatgacaaacgggtcccacgcatatttttttatttctaccgccacgtaggtgcgacgtcaacgccacgtgtaacaaagactcggtcaatattgccacgtagatgccacgtggcgccacgtcagcaaaaccgcctctcaaaaccgcccagggagtcaaattgcaccggttttaggagtttgggggtcgagatatccggttttgtagtttagggtcatggtttagatttcgatcacatttgagggtcatgaagtgaacttattccattgcaaaaggagaagggctgggccggcttgttcatgggcctagtacggctgcgaaaaatacagggcggcccagaccatatatgggccaattggaccaatgtgttagctttcctcggatcagccttggactctcgattgaatcaaataatggaagtttttgaaagaacccatcgagctggttttatattatagaagaagtgagagaaactgtacagaagagaaggcaggggaggcgttcccagagaaactcttcctgcctgcactccctaaaaaaacaaaagcctaatctcttaacatatgataatacacttcactcccttgacacctgccatttcccacaaatgaagctcatctatgatcttgctatggaacaaactgatctcaatcgaaattcgatagagctttgtaaacgcgcgtcaacctgttaacagtgaaatttggtaatcggcaaagacgtcatcagcttagaatcattatcggctgcagcatctcggaatcagccgatgggagttatcaagtcgccaatagtcggattcctgctatattcggttaaggaaatcaatctactaaaggaagcttatccctaagtgaccgagtttaaagaggatgcggcatggcagtttatctattaattaggaatagtttgttagtttccttttatctttaggaaggtgtgtttagtgtccgataaggactttatgttttccttttatctttaggttagtttctttcttgtctgacaaggacttgtatcaacccatgggtataaatatgtacacccggggtctatgtaatctatctccacgatcaatacaattcggcgcatcgccaccttttaccttttctactttattttatcgtccggtgggacttggcacttgacgcggggctgcatcggtgttcgatctccggcgaagggataagtccaatgttccgtcggtccaggcaattgtatcgtctacgtcggcgtcgttcaaggctgcatcagtacattcgacctcttggattactctggtttggataatatatttgcctagctatttatcatatgtctatgttaatctagtcctagcatctcaatttagctctatcggttgtctctcgctttagggtttccgccggtatcggctaaatcgccttgctatattagattagcctagacatctaccaccctgaaaatcagtcaacggcttgattgtctagatattgtgtttcttttcatacttagtgctgcatcagttaagtttgatctactaagtcgtgcttagaaccataatctctcgcttgctttttgactgccaataagggtttcatcggggtttcagccgatgagttatctggacgttgcatcggctcataaggattgcatatacatataagttggatttagccgatcgcaacatagatttcactgtttaatctaatcttgtagatttcatgacatcggacctctgtagcgcccgttccgtcgtggtgcctagcgggaaaattatctcttaaaaaccctagttgcgaaatttgtttctttgcttgttgtctagtgtccgtgccatctcaagatctcaatccccgatctatcgtcgagttcaattccgaatccaaatccttccaaatcaaattcctccgcaaaagtctattttgcctcccccggggtcgatgggccgaatttctctcggcccatcttcccctctcccccgacccatctcccccctctctcccgggcgctctctctctctctctctctctgtctctctccctctcaccctccgcctcgccccgcgccgcgcgcgagcgcgagagccgcgccctgcgcccctccgctctgcccgcgcgcgtgcgcgtaagccgcctgcgccgagccaagtcctccctctccgctccctcgctgccgcttcccgcgcgccgtgttcgcgtgcgcgcgcccgcgcggacgccgcccgttgcaagccgcgcgcgcgagccaagtggccgaccgcctggtcgccgccgtcgtcagcgtctgtcgcgtctgccgcccgccgtcatcgccgtcatcatcgcccggcccccgccactccgcgcgctagcctccaaggggcggaggcagcgtccctcctccctctgccgcgtcgcccccgctcccctcctccttttcccgaatcggcaaaggggcaagccccctttctccccctccttttcccctttttcctcctcgccggcgtcatcctcctgtcgccgttttggccgctagccggagcgccagctcgcgccttgaccatccaatgtcggttcccctctcccaaaccgacatttccgcccatttaaacccagcctccccccctttcccttcctctcccattcgcccccgtgccattgctgtcgcccctgttcgccgtcgccgttcgtcgtcgcgtgtgtgccggaggagccggtgcacactaggacgcggaaggggactccgagcgcgccctcttcttcctcttccccggcccgaggccggagagattactcccgcgccgtcggcctctcgtcacagcgccccgtcctgcacggtagtgcctccctccgttcttcctcctcgctccatctccccccttagatttcggtagtagctcgagtagcctccccgtagttagccggcgccgccccgagcgttgccgtcgctcgctgtgtgctcgccgccgtcgccgctcgagctccgtagcacccgcacgtcgccagcctcgctcggcgtagctccgtccaatccgacgctagcgtcgagttcccgaagccgcgtagatgctctcaccgccgggaatcgacccctcgtggcctcgtcgccatttccctcttccctccccgccggttgtcgccgccacgattcgccgccgtcaagctccctccggcgaatccgagccgttggctcgtctcccctcatcacgaacaaaagcccggtgtgctcgcttttgcccgtatcgccgtggttcgctccgtcgctcgccgccgccgcccgccgtccattcgcggccgggtcgtcgtctacctcccgccagcccacgtggcagccacgtaggcgccacgtcggcgccagctcagccgaggtcgggatgggccaaccccggtcagtccctccccgtgcgcgcgttccaccgcgagccgtgaggctgcgcgtgggcccgccgcatccgcgtccaccgcgagccgcgcgcgtgcaccgcgtccttcccccgcccgcgcgcgtgcgccgcgtgctccctccgcacggcgagccaagccactgacaagcgggtcccacccgggaccgcgcgtagtgagcccggtccaccggactctctctccttcctccgcgcgcgcgcgtcttgggccgctctgggctgccttcttgggccggccggcccgttaagatcggccggtccgctccaattcccttgggccgcgccttagccgcccgaggaaaagtctataatcccccccctcttttcttttctttttcttttccaaaaaggatttaattaaatccttttcatttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgtagcgcgaggatttcgaggatcaagctccagatctcgagcaaggcaagccacccgaacatcttgagcctatatttgaaatttaattatattgcttgcaaaatattatgcattgataggatcgcacttaatcttttatcccgtctgcaaggcagattggcggacctacctgacttgttgcatttgatccttccattgttaattgctatactatgtccccttgtaaccacccagttgcgcctcgatattcgtgcactctgtgcgagtatcgacggtcgccttcaaacttaaaaatctgagtaacaacttgggtaaaactggagttttacaaaagacttggaaaacccgacacctgggtcggtgcttgcgaactaaatgaatttccaaaaccacggatcggggaacgtaccgggggtacggttttcccgctcttgcacttaaggaccgtttccttggaatttcatccgaacataagacaagtacgaccacatgggtggaatgggacacccctggctgagtaactagcttatcaggggagccatgatgccgagagacatgtggattcgccggggtggtgtcgaagaggaccccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttatgaaaaaggggttcgatgtttgaaaaatcagcagctgacgggatcagctaggcccgggtggccgtttgtaaagtcgttggcccgggtggccgtttgaaaagctgttggccgggtgccaatcttgtttcaattctaaagactaatacattgcacatactccgaccggacgagatgcactgtctcatccgtgtcgtttgagaagcactcacctagttgtttttagaaaagagttcaaataaaatcaattgcaaaaacagccgcctttccttgaagcctgcattaaacacttatttccctggcttgctgagtactcccgtactcacccttgctctatataaataatcccccccagttgctgaagaagatgaagcggatcctgctgatgaggagttcttccaggagcaagccggctacgatgagttttagggtttcggcctagttcccaagtcgcgcatgtgttgattggtccaaatcctggcttccgtttcccttttgtaatgcagttgtgagctcgggatctgtccgcagcccaacatgactgtacctctactctataataaagagacccctgttgatgtgatattctgtctccctgtgataccagcactgtttcctttgactggtatcgattaacaggttaaattggagcgtcacgggctagttccggtcggtactagttcggggcgtgacaacctccagccgatgtatgctttaaccttcagatcagtgcttattatatattgtttctagccgattggtttctatcggattatattattgttattttattacatcttcatcagccgattgccttcatatcattatctacgttggacatatagccgattgcttaaatcctatcgctatcggctggtattagcatcggctattatcggctatcggctggaactactccatcggcttgtcagccgatcggctgtttggatctactatttgcatatcttgtcagttgcaggatcaaactgtctggcacgctcgcatctaatcaagatttggacctgcacaggagctaaacagatctcccaggccggtgtgttctattttctcgtcaacacagattcttggtcccaccgcggctgcgctcctcccctgcacgctccgcggcatctttgtccagatcggcgtgccaactctcagcggcttcttcgcccgcccctcgccgtcggcagggacgaagacgacgaggccacccatccccggcgccctccacctggactacctcgacaccgacgaaatcgaaaaatcccttctcaccataatcgaccactgcaacggcctcatcctgctcgaccaccacgtcgtcaacccagccacccgccaatggacgcgccttctcccttactcgccgccggagtcgtcgccgccgggcagcgaaatcatcctcgacggctatcacgccctcgtctttgaccctcatcgtgtcgccgccgcactaccagttgttcttgatgccctacgtcctcggacgacgagccacggtgttttctccatgtcttcgccaatttgaaagttttcaaatcttgaattgaaagttttaaaattttgtgttgaaagttttcaaatttaagttgaaagtttttaaattttgagttgaaagttttaaattttgacttgaaagttttcaaatttgagttgaaagctttcaaatctggattgaaaattttaaatttgagttgaaagtttttcaaatttgagatgaaatattgaaagttttcaaattttaacttcaaaaattcaaatttcgagttgaaagttttccattttgtgttaaaagttttcaaatttgagttgaaagttttcaaatctgcgttgaaagttttcaaatatagggtgaaagttaattttcaaaatttgacttgacgtatatatattttttaacctgttacttaaaaagatcgtgaaaaaattcatccgtgcttgattaagagaaaacacgaaaaaactaactcatgcgagtagaaatatactccaatccattcacacggtagcacacatgccggataatcgttggacacaggcctgggcctcacgtgggacgtggcttgccagaaagtgcgcgccgccagcgcgtatgcgcttagttttctcggaattataatggtatattttaaaacatgaaaatttataatggcatggatcaaattaaccccatctttaaacacagagcagagttagttatgtttgccagctctaacattgatttgcatacatttaggttcttcattgatgtttgtctgtctttcagatcaatgattttttttctttttggaagtggaagcttgttttcagatcaatgaattccaggttacttaattttccttccaattaaccaatggagtacttgactaaccaatggagtacttgaacaatattttaatactttttcccaattaactctgtaaccttgctgaatgatgcaactgccagagtcttcggtttcattttgacatggtctcctgctttgcctctaatattgttcatatcatagcacagtccataattaatgccatagtgaagggactttttaatcctggtatttttaatcgacgtagattagcattaataaaattaaaatatattaaaaatcggtccaggagagcaacgagagacggatcggccttagactcgctggctctgcctccctcgtccgacgacatacgtccacgtatgtatatactactcgtactcgtactagtatagcatatatctatgatctctcttattaaatcaatcaatcaagactaacgcgcgtcaaccgtagcggccatgcacctcttacccgacgacgtcctccgccacctgccgcgacgcagcctcgctgcctcacgctgcgtctgtcagtcctggcgcgtcatcatagacgaccgctccctgctcgccacggccgcgctcctcccctgcacgctccgcggcatcttcgtccagatcggcgtgccaactctgagcggcttcttcgcccgcccctcgccggcggggacgaggaggccacccatccccggcgtccttgacctagactacctcgacaccaatcaaatcgaaaaatcccttctcaccatagtcgaccactgcaacggcctcatcctgctcgaccaccatgtcgtcaacccagccacgcgccaatggacgcgccttcccccttacccgccagagtcgccgggcagcgacatcatcctcgacggctaccacgccctcgtctttgaccccgccatgtcgccgcactaccaggtgttcttgatgccctacgtcctccgacgagccacggtttcaggccagtggccgccttcgccattgctcctccatgtcttctcctcgaggacagagccagaggggagtacatggcggtgggaggagagatcattcgtccgggaagggaacgccaccatgggcaccattgatgaggtgtgctcaagctcggggtgggaaccctttgacacctactccgtctacttccggggatcgctctacgtgcattgccaaaacaattgcgtcatcagaatcacaattgcaaatcacaggtataggattatcaaattgcctggcgattttgtgggaaatcaaaatattactgtcgatccttacttaggaaaatcccaagagggagtgtactatgcattggttattggtttatgtcgactccaaatttggttcctcaaggaatatcaatcatcatattcttcttattcgaattcatactgtggtggcatcaatggcgacggcggtggcatggagacgacgacgatggatcatgagcacgagtgggtgctcaagcatgacgcagacctagggccagtgctagcagcaggctacactctcaacgacggtggccagcaatggatatggcataacattgacaccaaaaagaaaaacaaggaatcactagtaaaggaagaggaattcgaatggaacgactctgatgatgaaaatggtagcgccggtgaagataggcagtacaaaggatacatctctcaagtatttggatttcatcctttcaaagagatcgttttcttgtacgacacagacactagagtggtagcctaccattataatagatcaaaggttcaagacttgggcgtactacaagtacgtgaacgagtgtcaaggtcattttcatacactccttgttggatgccggatttacctggaatgcacaattaacattttgatttgaaatacatcgacgctggagattaaacaccagctcgatcgtcggcttatcatttttgtaaacaaaacaacgtgttaacatacgagtggaatcatgctagctttgcagagtttgcaggtgtatggtacaggacgagatcaatcaatcgagcgtccaaggtggcatggggatatttgattacaaagaaaagtgttgctacatggtttgctaactgcatccaaaaactgcagctgattatggtagctgatacttgtagataagttagttaattgcatagcaagtagttctgctctatgtgcacgtgtggtcctatataagtacaatagtaatcgactagttagtcatctattactgcatgtcccactgttaattaccatatctctgattagattgtaaggtcgatactaacaacctgcaaattaaatgactgagcatgcaaagttagatgggtgtagggccatcagcaaatgaagctgcagtaattggtgttaacaaatacagtgactgtcctcatggcaaacatgtcataccagcaatttttttctgagcactattgacaaattgcatttggagtttatgcatgcatgggaaaaaaacagtgtttttcaatgtggcagttcatatacagaccagtgcaaattcagttcaccagcttgctagccacacatgtcaaaggatttcagacttgtagattttgaatatatttcagactcttgtgaaatgtcaatggtaaacagatttatctgatcccaactgcagctgcagatttctgcctgtaatgtagtatacacctcagtacctgcctgatattgtccagctgctccaaatctatactctgatgagatgaatcatgaatcccagttaagtggaccactcctcctccatttccataagaaaaacaggaaatttcagagcaccaatcagatgattcaggcaggaaaagttccagattcagatagagaaagttgcagatggggtcaggttaagtctagagtgttaattaagattgtatgatgttgtcactagctctgagatttcatgatcagatctaatcagagctcaagtattcctcgagcatctgaagaagtgtagctgtcataagaaaggaaacatgcaggagagtggagtatatactatatatgcacatgatacccaacatccaattggttactccagacctcaaatccaattgccatttgtttaacatgccagtatccacatgaaagagattaactactagtagcagcagcagagaccaaacacacaagtgcacatattaataagtaccctgaattaataatgctctatgaatcttgagaggattccatattagtgcacgtattgtacatttgatttgtcatttagcttcttcactttatcagaggcaaacaacataggtctacaacctgatacaataacacttttacacacaaaggagacctgtaattcctaccactgaaaaaaattgcactagaaaaaaaaagaaactacttttgtctgaagaacagaaaagaaaaactcatttgtgttacacatcaaagaaccctatccagttgttttttttcttttcgttttacagttggaatcatcaacaagatgttgtgcccaattggaatttatttacattcaggaggtgtcaaagattcaggcaacaagcatcatgtcacgcacagcctccactctcatctcctcgaagatcatggcctctatgcttgcccctacctgcgatgcttcctcctccctgagccgcctccattgctgcagtgagccggtgaggtcgagctccaccagcgcggggatcctcgagatgtcgccggagatcctctcccaggaggagatgatcatctgctcctccagcttggacctcgtcgtctcgtactcttcttcgtctcctgtctccgctttgcaattcttgccggcctcgtagaaggtgaagcatggagcggcggcggcgtcgagcggattctgctccggtggcggcggcggcgagctcttccctgaagtcgacggcgactcgtcgtccttctcacctgtatggagaaaacagagtcagaattgaattcttgaaatggcgaagcagcagagatcagggcttacggtggccgacgccgagcatggaggacgattcgtcgtcggagttaatatcgaggtcgagtacggacatcgggctgagctgcctcgcacattcctcctcctcgtcgtcgtcgacgtcgcagccagcagcaatgtcgccggcgccggcgtggcgcagccggcggaagctctggcgggcgccgcaggagaagcagccggcgaggagagccctcctgacggcggcgccacagaagacggcggcgcccaagccccccaatgcgcggctcttgttgctgacggcggcgcggcggtggcagaaggcgagcaggcggcgcctgcatgcgtcggcgagggaagctccgccggcgaggaggaagggctcctgctgctcctggagcaggtccgagagcctcctgacgtagcagctctcgcccatgaattctctctctctcactctctcaatctgaagaagaagcagaattatatattctgtgtgaagaagaatcaggaatcaggatgaaaatggtggggtgtggatggcgacgggtgcgtatataaagctaagctcgacatggagacctctcttcgtcttcttgactgtctcgttggaaagcaaaaggaggcagcagcagctacaaacaactgcattaggctgggcctcacaagtgttatgtactcttcactcttcactgtataagtagaagtgttgtttgggcttttggatgaccaggatattaattaaactgttgtagtaggaaattaattagagcaagtttaatagtatagtccactgctaacttcaattcatctatagtcaatctaatagccaattcatataatagttgcttactatatatactatcaatatccggtcccacatgccatacacatattacgtcttagagttcgtgctacagctggctacaaatctgtagcccgctgctcttctctctctttcttttatctctttataatatgtttacagctggcttatagcctgctattgtacctgctcttagggaagcaagaaacacaaagtagatgctgtgtaattaattaagaaggtcccctccccagtaaggtaaggtaaggtagttgctgaatactgtagtgtggaagaagagaaaggtgtgtgtgagtcatgtggtgcttgctactctgcaaatctgcagtgcaatttgccggtgggaaatagatgaagaaaacaacactgctactactgctctactactagtactaaacagcaattaattaattaaaaagatttgattttgattcgtttgtggaggagtatatgaaagtgctagacgccaatggattgtggattcaggcgtggttgagctatcatcaggtggagtacaagaagacatgggaagagacaagcagaaagctccatagttgtagtactcctaaatgaaatgaaaacacatgttgagccgaagtgaggagaagatgtgagagagtgagctgattcactgaaaaaccaaagccagcgtatcatatttgccgtagtggcacgcagaatttgcagatgcagcagagcctgccgaattgtttgttaggccacgcccacgcagctccccttgttgcatccagacataagtatatggatgcatccagcagttctgtactcgtagttaattataattgtaccaccatgcttagcactagcagtgcaggtttgtgtcttgtttcatttgttcgtgtcccatgatattcaaaaccatgtcaaatcaaaattcagagctagtaatactccagtcaatattcagtcactttggtaagatattcattactagccttacaaccaacatcagcagcagctgtagtagttgtagtcgtagtactcgtcatcttttggctgtagggctgagctgagagggggcagcttagcaaaaaggcctgcaagagatgggctccatggcagcttgcatcttgcactgcagcgccaaccttttcccctccctctctctctcccactgatcactcagcaggaccatgcatgcatgatcagcgtcagttcatcgtcaggccattcatgcataattcattgatgcaatgaaaatcatgcaagcaaatgcatcaagaagagcagtggagtgtagtaccagtgcaaatgagtccttgcatgtccttccattgggtacctttctgctgtgcagcacagagttgttcattagctcaagaaaatggccacagcaacaccggttcagttgccaacgagtgtaaaagtggagacgaagttaggtgcatggttaatttacaacagtgtcaatacgcgtttttgataaatgttggcgtttgcagattcaaaatatttgaatttctctggcctgacattccaatcctgtgcaacaactgtatatattgctgttgtatatttcacccaaacaatgaatggatgaaacaaatgcatttgctgctacatcttgctctctattagccgatgacgagatggttcaatgcaaaaaaacgaccaggagtatcttttttatctcttcgatcactagcctcctcgccatcacttcacttctttctttctcgtcactgaatgaaagaaaagagtgttcaagaaagaaaaagaagcgacgaaaggaaggtgagaaagaaaccaaacagacagctttgcttgcttgcctgcacaaaccaaccaaccaaccagccaacaaaaagtctcatcaaaaaaatgaaaacaagcagaaacactgtagacagtaagcttgtgattgtaaccacagctgctgcttttctttcctgccactgccagattgtcaccctgccttgggactgatgccatcttgcctcccttgtccttgttctctttcaacgcacatttcacctgcattttgttttttgttttgtttttctgaaacccagcaaacctgaactttcaaattcagtaattctagtagtatttgcacataaaaacatcatgcggcgtgcacgagatcttctgtcagtcatcaggctcagtaattcagtatgcaagtgtaatcttacaatactgagtagaagtaacattttcactacttcaagtctccaactatagtactgtagtatggcaaccaactagtcatcagcctctctgtaccaacatctttctttttccttttccttttatttgtttctaaaaaaacagagaacttttgagaaagctgctgggcctctcttgtgttggtatagagaggctgatcaaattggcctttatcgaacgggttaatggaccaaaatgcaaagcctctgctactgtaaaatctgcagcccatagctcacaggctaatgggccctgtataaattgtactccctctgagcgaactttctttttttgagaaaccctctgtaactaactgacactgttaacgatggccgcctatcactaattactttcagatggttatattaccataaatgaaagttgtattattatatatttataatgcaacacattacacacgtctttttttaagataatggaatatagcattttggtcttttttttaagataatggaatatagcattttggtcttagtacacacttctataatataagaagaagagaaaaaattatacatgcctacgtacaaaacaaccttgctcgtagctctcctagctcctcatgacaacattctcccaatgtgtttagcgccggccataccacaccaacctaactccttttagatacgattgagcatctggtgctgtcgtctccttttatctaaagattcttccattccttctagattttccaagcgatgagcaataagagagatctaagtcttttttttttgttttattacttctgggtcacttgtttcttatgtccaccaattcaagaggtttctactcttattctatttcaggatgaagtgtccttggcacaaccatgtgagaactccaaaccaaatttgcttcgagcaggcatttgaacgataggttttaagattccggaaacataactataagaaataattatttggccatcccttgatctgtaaccggtcagttgtccacaggtagtcaaagttttaacttaaataataccggtgtcgattattcgagaagcgaaggaataccagttggatatagttcagcggggtaacttagtccattcagtcatacaagttgaagaggacaatgatgcctcctgcaaattttgccaagttatttaagataaatttgtccacttcaggtgtatccatcacaaaaggcagcacagtaggacactgaaagaggatcaacaacgaatcgccatggtgtgatcctctctttttcctgaaggctccatccaaagctgtccaaacatctgttggatgcaaacacatccagctacagcaaagcacagtgattgtttcagattaatgtatctaccagcttgcatctgtagacacatactaccagaatccagaagtaacaactcaacgaacaaacgaaaagaagagaaagcaattagacatgttaattagctagtaggcttaggctcccaggatttctccatggaatcaaataaacaaattaaagtcagggcacgaagtaattaaaagtggcgagagcaacacaagcgccattagcaaacgagacgtaaaacacattgctagctcgaatcgatcgatcgatcgcgtttgtgctttcgacgtggcgatggtgactcgccaccagctcgatcaaattactgaaaaaaaaaatcttgttctaatacttccctctgttttaaaatgtttgacaccgttgactttttagcacatatttgatcgttcgtcttattaaaaattttttaaaatatgtaaaactatatgtgtacatgaaatatatgtgtacataaaagtatatttaacaatgaatcaaatgatatgaaaagaataaataattacttaaattttttaaataatacgaatggtcaaacacgtactaaaaaagtcaacggtgtcaaatattttgaaatggagggagtacatgtataaaagccagccgccattggctcactgtaactaatgttctgttcagcaatgaaaacgacattaattgtatagcatctgaccagctaattaagctttgatcaaccacgggtgattagctcagctcaactgaccgctagcttatgatcttctgctatcgattatactgtaaactctatgattgtgagtgagaagtccgtttctgatggatgcagagaatccgatggatctttgatcaaatggttcatttgtgtatatgcatctcatatatcactttcgcccatgcgatatgaaggaaaaaataatattaattaaccgacaagaatatgtgcaattcaaacatcaactttagtgatcaccaaactcaattccatctctgcttgctcgagagtgacaagtaccaaatacccccacaggatttgacagcacggaacgaaaagtaaaatggctgatttgattgatctcggagaaatttagcccggatagatcgatcaattggtgcactcaagttcatgtcatgacatatcaaatttcatcggcatgatatattgaattcgggacaattcgtcctccaagatcgagaaaaatgagcaactgatggtcgagcgatagtaatagagcgttcgttcatcgttagctttgctcgtccttgccaatttcatctcactgtgattattttttatctcagcaaaatgattgctacttttatctacagccattcgagttcatcagttcatccattcattcgagttggagaattcgtttaaccggcccaggtttgaccaagtcaaaaaagtcggcacgtgcatgcatgcgtccacgtgggatcgatcgcctacgcgatcaacgaggcgagcgcctgcatctcgaagccaccgccggcggcggcggcggagtagagctgccggagagctatgacgcggcgggcggcggcgaggcgaagcgcgagcttgccggcctcgtcgcggagttgcgcgttggtgagcgccacgagcgcggcgcgcgccctggcgccgcggaggcgcgcgacgaggtcgcggctggtggcgcggagcgcggaggccttggcccggagctcgtcgaggtgccgctgcttccgcgcgcgcgaccggcgcgccgactcgcggttcgagatcctccgccggagccgccgccgccgctcctcgtcggcctggtcgtcaccggccatcaccggctcatcagtagccgccgccgccgtcgtgtccggatgcgacggagacggcgccggagcagcttccggacatggtgcgccgaagccaatgtcggcgaggaaggcctcgagggcggtgtcggagtcggaggggaaggggaggccggccatggcagtggaggtgagaggggcagaatggtaattagcaaccaaagagagggggtcgagtggaaggagagggaaaagggagggaacaagtgaaggaagggcccattttatagccgtcgattcgattcaacccagtgggtttgtggggcccactagtggttttctgacgtggcagccaactttgtttgctcttccttccagtcccctctgttgaagctttggaaaaagcttcatttcatatcatagacagacaggtggattgtcgtcgcatataactttgcaagtatactatgtccactcgcattgacgatttgccaaattttgtagaaagtggtaataatcagcgaatatatatatattctgttttccttttcattgccgtggtttttgatccattgcaaagttacaagttactgcttttaattaatccaactaggaaggtagcccgcgcaatacgcgggcatatgtattggcttgttaaaaacaggtatggcaaattaattttaaattagaagtaagatgttttttccatttgcttttttctttcagtgagctgagtcgaatgatttggttcttttttttttcaatttgagtcaaaatcacgcgctctctccctcgtgaacgaaacatatatgcggagtacatgcggctgactcatggatggcatcatcaagcaatggaggatagaatcatcttgaagtttttaagtaggttaagattaatattagatctaatgattgtaaatattaaaaaaaatcaatggttagattattttaaatataattcctgtgattttttataatttattagagggtcgcatgtcatttaggagcagtcacatgtcatttaggagcattggtatgattgccgcgtggcgatttaggagcgtttataggatctaaatttaatatttgtttaatatgttgtttaaaaatttgctcttaaacatttatattagaagtttgagctatgtatatggatctcgaattatgtatttaattatatatagcacaataattcaaaaaatgagaaaaaaattaacttgagatttacgatcatttagaaatccaattattaatttttgatagattgagtcttagctaaaaaatagaagttagcttaagaaatagaaaaggaggggagagttaggagggttatgtgcgcacgcacgtatggatgtggcggtgagggtgcaggtaccagattttcttttcaaatgaagatcgtatggttaaaattaatgggttcatcaacttttataaaattagaatttttatgatttttattaatttgttagctagaagattaaaaaaaggaaggaaggaaagagggagggagggatgtacgtaccgcgagaagaggtggcccaagaggagggggcggtggagatgggttttgggatttttctaataatgtagaatattgggtccaccgtattaagtgaaaatcgagggttagatgttttgcttttttcttgtaatttcttcgatttctctaatttgttagagtgtcatgtggcaacttagaagcgtttgtaggaagtttaatagactttagctagataataggaaggggaagaggagaggagagcactgagcttttcggagagggaagggtccatcgatttaaataaaactcatggtcatatgcttttttttttctcaaaatttttatgttttttttaatttattatatgtgaaatgtgtagacatagagatgttgtaatggacatctaacagatgatgatatgatataggttgtcaatttttatacaacgtttcgttgctgtttagttgtcacggaaaggatataggtttatgcctaacaatatatttatcagatatcaagaaaggcctaaatggatcaaactaaaaatgaatatattaaaaaaatataatcatttagctatctattgtttatatacaatcatttatactatgtaacgatccgccaccaaccatgcatgtaacagaggaactcatatcccatacttatatctcaaacggctaaattttttttacccattagatacccatcacatgtctatttctatataaaaacatagtaaatatagtgaatataggacttagcttgttgattaatttaaataaaaaatacaaccattcaagcgtatatcataaaagtatatatcgtccataaaaaaaattactgcttgcaggttgcacagccagcttgttgctccatgcaagaagggatataaccatttacaataatacgttatggtgtgtatctcgtaataactaccttaattagaaaaaagaaaaaaacgagaaaatgaggggaggatgcgtacgtacagaagtcgggaaagtgcacgtgtgggcccaggagagaagggtgaggagagattttattttgatctgatggttaaaatcactgggtccactgttttaaatgaaaatcgacggtcagatatttttgtttttttcttatagtttccataatttattagagcgccacatggtggcttatgagcgtttgtaggatgccacatggcggcttgagagcgtttgtaggaagtttaatggatttttagtatataatagaagattgcgcatgtcaaaaccatatattctttctagtttctaccctggttttacccttacctgcagtatttggtacaatttgcagatgaaagctacaccagttcagagttgtttcacctttcaccctatgaaagtgcaaaactttaactgcaaagtaaaaaggttgcatgactagctagttcaattgtctacaaattaaattacagatactgcgatgtttaccaactttaacctgacggccgtgtaaccgcacatagatagtacacatccgtgtagcatcatacttagcaatagaatcttgtgaactacaaaagctcaagaactattcacatgtatctagggtggctgtgttctgtgtacaccttatgatgctttgggcatattcttacatggacaagggagaatcctagattatcatctgtgaaaatgaaaggtaggtagcttagctaggttggtagtcttcactctccagagaagaagatataggatcgaatcacaagaactaagccaaccagaggggggtgaatggttggtatacccaaaaaccgaaaacttttagtggaaataaaagttaccctcgaaatcgacgaaagtcggtctgactgaaattgatctgccggtctgaccgagtggatgccgccggtctgaccggtgtagaatctccggtctgaccgccgaagtcgcctgctacgcctgtcgccgctgccggtccgactgccgtgctcccgccggtctgaccgccgcttgccgccggtctgacagccggtagatcgccggttagatcgccgaaacccggtaaacacaaatcaaagaactcttaaagtggataacgactttattgattctctctgtctttacaaagtgtatcaacatcactccttacaaaaatttcgactaaactcgaaaccctaactcaaaactcaattctattgctctctaaagcgataccgggaagcctcacgctccccctctatttatacatgaggtaggcagcctaaagccacgaaccaaactcatactaggagtcctaaacaccttaggaaaccctttagtacaagaaagaaactttacataaccaatcgtatcaaatttggactccttccaaattcgactccgcatcccatacgcacacaataactccatcgtataccatatggaatctccatcaaccacgtgcatcaactctagcctaagtatcccgcatgatctctgaccaccacggacgtcgtcttatccccaagccgactccccgtccatcactgcaaatactctcctgagacatcgagtcacctacacatggaacaaacaaagaaaccatattctgagaccaagctatctctaacttgactcattagcagcaaacaatagtattacatacgtatagtatccatctagaagtcataatcatgaaataaactcggatatccaaataaacaatccgaaaccgaaaccgatacagtgtcggccggtcagaccgcgggttgcgcctgtctgaccgcgcaatacacaccggtctgacggtctgactagtccacataaaatgatagatcctgcgatcacctgtaaatccgatcatctccaaaaccacttcgtgaataaattccaaataacaaaaccaataatctccaatgcccaattgtttatcacagaataataataaaaacacctttaattttacagaggatcgagaagggaagaaaaactagttaaagcccgacctagttactctcattgagaagctctaaaaccttaatcactaaggaaagggagaggtatatagctagctagcaggttcttctaattgttttttgcacgcccacaagatattggatagcaaatcttatattcgatttttttttgctgcctagggccagcaagatctattgatttgcatgctcagctgtcttatatactgataaatgattattctatgactagcaatcgaaaagtttgtttaaacccatccttagtcagtctgacctgaattatttgataagatgttgttgaatttcttgctggattgcaccatcgatctatatatctgaaagcaagcgacagttaaacagtactagtataactaacagaattctatattatattattacatggacacaatgtaatcgtgaaattaaattaatatatgtagcctgatagtagaaattaaaagccattacattatgacattgaaaccatggagcgcacccacaccactacttttgggacaccagcaaacctgcccttgatttttatgcagcaaagctagtgcattcttactgatcatgactgttcgatgataggtcatcgaaagctacatgtaattaactcaaaaggggggcatatatataaacattctggttggccatgctaccttagctctttcatgaaggaatacagatatctggtcgatggagtatatgctcagccactggaatatatagcatcaaagctaatgttacactagtcacccatcatcatctcaaagaataaaacttgtagacaacatatatctatatatgcttccatctatgtggaatattctagtagtattgcatatcatagcaagtaagtaatcttccactgttcctctaaaaaaggtaattgcatctttcctttaatgatcagcacagtgtccacccatgcatcaatatttagtgactgtcagtgctatgtgcaagtaatttgattaggtagagatcatgcatgcaagctgcatggtcgcatgatgcatagcaaagctttcagaaagatgggattaactccaatttgtaagtcatactctagtgcaaatctcaaaggcaacattcacaagttcaaaaaaaaaaacaatgatgcatcattaattatgtttaaatgtatatgcattattatgcataagatctaataagtactaaagctgcctcctttagctagactaataaagcaggcgatgttgaggcacgacctttctgttacagcaagtgggtagcacgagacaacacagagaaggtatggaagatcaaccagacaatggtaagctctagctagctagctcgacagaaagatcaacatacctattgcttagtgaaagggaaaaggagacagtctgagaagagtactgtgagctagggtactaatcaagaagagtcattggagataaaagtatagtttagttagctaacagtacgagtataatcacataatatagtgaaataaaagcagggagttatgttagttaagtgccatggatggacagatggcctccatgcatgtgtagttcctatccatcaaagcctgaattttggtgtctgtacctgaagtctctgaagatgcatgcacgcacgatgagatctagcgactactgcatatatttgcaagtgcaggcacatggtttgcctccaggtttggagaaaagaccgcatctagggaggcttttggaaattcagaaattggaatcttagtttcttgtttggtttgacagggaggatgcactgaggagattgggccaggtgtccggctatatgctagcaacagttctctgcatacacctttatcttatataattagtttttagtagtaattattgtggcttgtcaactttattcagtgtcacttgaaatatgttacttttcgattaaatgactaaatctagtagtaaaagagtaggcaggcatgcatcttttgtagtaaatgtataaatatggtgtatatagttaatttcctactgcctttggattaggaactagaattaagagtcacatattgcacaacatgtgacaggtaggcatagactctcactacaaaaggtctcacaataatgttcttttttcttgttgaagtaaacactcctatgtgagtctgagatcaggagatgatgcatgtagacagtataccattggttgttttcaaagctaaaccaagcagttaaaacagaaaaggcagggcacatgcagttgtcatgctgcctggggccattaggaaatgggcaagtgatgggttaaaggtgttaatcagagttgagagtacacccccgcaggttcagataatcagtggatctccctaataggtaagcaggatcttgagaaaaagaaagcttagttaatgagatgttgatggagaggcactggaaatgtgaattgtgatggacatttgggcatgtgggcttgggccatccagctgctgggctgctgtaaactaggcctactctgtagaagcaacggcttctaatcctagctagctttatgctgatggatggtgcgaatcaggccgtgcagaaaaagagagaaaagaaaaccagtctaaaaagaaagagagaagaaagaacaaacacaaggaacagattcatcatcatttagttaggattaagtgatatgtatgaaaaccgaggtcttttacggtgcttgaaaggtacctcaggtaccttctatcaacagtccagataaagagttttttttaccgtccaacggccggtactgaattcctagacccgatccaacagctggtagagtttggtaccgtgagataccaattctgtccttggtacagtaccgacctaagaactaaggtggaaaggcaaaaatataatttcacgtgcaatagatggatgggagtcaagcggatagtgtgatagggttcccaccaatgccaccgccgctgcctggagtgcgtcgacctcgtccgtgcggcgccgcgaagaactccgcctcgtccgcccctcgccgctaggaagtacgtactcatcctctcggcaccgagaaagaatcctccttctccatccgtcgccgccaggaaggactactcctcctcgggccctcagcgcagggaaagtatcctcaactccgccgcccctgctcacacgccgtcggtgctgaaattgagcgcaccactgctaattttctctcccaatcctatccatcccgaattgaacggtcggatgagttttggcaccgaccggtaccagtaccaggcggtacaacttgctggacagtaaacatgctcccagataaatcccaagcaccgtagaaaatctcatgaaaaccacgtaagttcatccgtgcaatcaagaattgaagatgggggatcagtacgtaactgcacgctaaatattcctacatttcaaccagattaaattaagctggagagcaattgaaccgaagaccattggagtgtgatacacatataggagtatatatgtaggatgattcatccaaaatgaacttatgacatagtacaattcatcagcgagaaactaactaacaattggtttattcatttgcaacatgcatactgcaagaagaagaattgaagactattgattaattagcagtggtggtgttgtcacaacagcgaaagccacccctgctgatcttgcccttcccggccgtcgtagtcgacgtgctcttcttcggcgccgccgtggtggcgcggggcagcagcggcgccgcctcgctgacgacgacgacgtcccggctcctgggagggtggtcgtcgtcgtcgtccgtggggaactcgacgcaggagcagcgctccagcgacgcgaagaaggcggcggcgaggcacccggcagctcggcccagcgggcggccgcagctttggcccaggtgggcgtgggcgcctccgcggttgcaggagaaggacgcgcaccgcggcgaggaggtggcggcgcgcatcggcatatcgatcgatactagtggagtggagtggagtggtgagtcaccttggcttggatcgattcttgcgcgcgaatatatcgatcgatcaaagatagatcatcctaggcctaactattatggtttgacggttttgttgagttgtattccaaattcatttgcacatatataaagaccagcttctgtcagagcgaagcggaagcccattattggaggcttggccggagcgaagcgtagggtatcgttatccttttaagatttcaccttcggtgctgtaatcttatcccaatataataaagatatttttgttgactgatgttcgtgtcttttgtgattgatctatcattgtttatcgtttatttgcctaacgtttcctaacaggttttgcccttgttatcgatcgggtcggatcgccgtcgacgtcaaccagtgagtctcctctccggccgttggccgcactgatcgatccggtaggcgggcggcggacagcgagagcgcagtggagtgacgacggctacccaccaatcgtcatcatcgtttgctcttgctagctccagataaagatgatgacgactggtgggtagtggccgtggccatcggcgagaaggacggcgattccctttccttgtggggaagacggaggatccaacaccaaacacggcatatatgcaaaggaaatacgggaccgctatatgtgctaccattaaccaaaggggttcttttaaaaaattcctagcacaatcaaaatgggcttcacgtatgtcgcattaccatttcggcccaacaaaaacaggcctcttgtaggttagaaacccgtaccggcccaaacatttcgcccgcacgtcgcattaccgacttacagttcaggcccattttatatgggctgcacggatacaaccaacatgggccttcccttccagtgcaacaagaatgggccaaacttgtgacagggcttggaccaagatgggggtttgaaggaccaagaatgggccttttcaatattgatcgatctggttctgtggtgctagaattatagctaaaaaaatctatgtgatttaacgctagtcaataataaatgggagttggggatttgtttcatcaccttatttcttattttgatttatttttatctttaacaaaattttggatgtgtcttatgattgaaggcggagatacaatctattttcattattaaaaaataatacatgtttgacgattgattgatagaaaattttgagatgcagagcttactggtgaaccgctgaagcaaacatctaccagtagcaatttgtgtagaagtcgtcttgtaaaaataaaatgcgtggtagggcataaaagcccaggcatgcatcgcatttgttgatatgcaggaatagggatcgatggatggaaagagagaccgggattcccctgtcggccggcaacaatcctctactattaattctttcgtcaactgaacctgaatggatatctgtatggttgttcaatcccatccatccaagatgcaggccagctctgagctcctctatttcatctagtgcatgcaatgcactggctgcagtacttatatatgcatctgtctgaggttctcttttctcatttggaggggatcaaatcaaaacacaattaaacagaggagtatacagttagaaagagcatgaaaagttggtttacgtctgcaataaaattcaagcagggatcgcaaccactttactttgccaaagaaactactttaatacttctcttcctgtacgtgtgaaagagcagaaactacgttctactactttactactacgaacaaaatcatccagcttcctttccagcatgcacctgacctcgcgatcgaatcaattcgatcggccgacgcatccatcgatcaatccatgtcgctagttcaaaccgtttacaccaacatatactccctccactaatgtatgacgccattgactttttatctaatgtttgaccattcatcttattcaaatgttttgtacaaatataaaaatatttatgtcatgcttaaagaactgaatcaagtcacaataaaataaatgataattacataaattttttgaataagacgaatgatcaaacgttggataaaaaatcaacggcgtcatacattaaaattttaatgaaggtagtattagatggacatgaaatgatgttgagcttactggtagctttagcttattattgttagcaagtgtcgctagctgttgctattgcaaatgtggtggtggtgcgagacagccatctgccggccggccatgacaagagaaagttacgtatggagtatcatggatgcatgctcatgctggggcctttgctaccactgcctcttcttcctctcaaagtcctaggttcccagctttctagttttgagagcctgttccgaaagtttttgatagctgcagcttttcaaattcagaaggttcctcaaataatttagctttccgttcagattctaagaagttgtagttgtagaattcaaaaattaaactaacaatcaaaagccgagtttctcagcttttctagattctcataatctggcgaccaactagttgtttctcagaatcttaaagcttctccaaacatgaccatatactcctcgtcagggatgggctcagagcgcgcgattacatcatcttggtgtaactgactgagggagtgtttgagagaaggagaaaagagaaaatgcataaaacaatgtgaaccactaacgcatgattaattgagtattaattatttttaacttaaaaatagattagtatgatttttaaaagcaacttttctatataaggttgtcatcggttggccaattacggataatacgccaaatgtttggctattgtgaaaaaaaatttgggttaaaacttttatatatgtgttttttttacttcaagctaaaaaaagaaactacgaaaaataaacctcaaaatcaacttttggtattggcatataacttatactaagacaaaaaagatgtgaccctaaattttttacaaacaacacatcttttaatagtttagaaaacgtgcacgtgaaaaaacaaggtgaattttctctcacaatcatctgtggacgaacgtaacccagtcttaatagagcttctattatctaaaattagactcctctcctctccaagccaatttagcttccattgcaccacctccctccctccctccatccatctctcttaccacgtaccaacaatggccaccatggctccaaggctgctcatcgtcgtcgtctccgtcctcttcaccgccggcataatcgcctccgccgccgccgcgcgcgacctcaccgccgacccggccggccaggccccgccggcctacgacttcggcatcccggcaggcttcttcgtccccggcaccaacaacccgtacaacggcgatcctgcagcgtgggcagctgggtacggcagcgccgccgccggcgacgtcggcgggttcgggaatggtggggcggaggcgccgtcgatggtttgctccgacaaggggccatgcaacggcaagaagctgacctgcccgaagaagtgcttcgtctccttcagccgctccggcaatggctacgccgccggcggtggcggcggcggctgctccttcgactgctcgaccaagtgcgaagctacctgctgatcattttactacttcatttcctcacccatcgaatccaaggcctcctcttgcatcagctcaatacttcatctatacacatcatcatcagctgatgataccgctccagatatctatctatctatctatctaatctacaggtttggtgcttgcttgctaatgtctactacgtacccatcttaatctgcttaattaattggtgcaaaatatatttctacctatatatgttcttaactaatcctgcatatatattctggaaaacggacatgcacatctgtttttttttacttgttcgaatgctgcatgtacgtgttttcattacctctactgcagagactactacttgtgtgtgtaaccgtacctataaacttgtactccatcacgtaatgatgaatgaataaaggagcgtgtcatatttgtaacccgtgttgtatctgcgacttgtgttgtaaattgttatgatggaggagaatataataccgcatgtttgcctaaccctgcctgcaaaacgccacccgtctcaatgtttgttgtcagccgctctttcagatctcataactcaaaattgccggtaagtacatatatatgcatcttaattcaagctatttcagtggtccaccaaatgatgaatcttttgctgtaagttttcatgcttgccttcttttactgtcaaaactagatgtatgtatctaaaagggtattttcatggtaaagagtatatgtgtttcacaagtgcaggcaagactgagttacccattaattccaacaacatgctcacaaagaattgaaggcaactcgcaactcatcagaaaaaatcaatgtgaaaagtgttcagaaactatcctatcgacttcttctgcccatcatgaggttaactcacaactccaactctcatcacgaagatcaagagctcatcaggtatcgattcatcagtcgctcatgacctcacttccatctgaatgctcagaagcatcagtaacaccccccagatcttcaccctccccactggtttccatatcatcaacttcagactcttcatcatcagtatccttgtcctcataaattatcggcggggatccttcttcctctccggatccatcatcgtcaatctgggagatacatactttcagttatggatttgcaatgctcaaaatgatggcacttgctggtggggtaaaagtaaaacttacctcactgaaaagataatctagacaggtagacaactgcagcgatgatttgaaggtcgatgttcttgcatcaattagctgagagaaatgcaatcagtaatagtaaaatccaaaaataaacatgagcacatgacttataattgttattatgtctccactagtgcactaaaagctgacatattcacagtaattttgacatccacaaattccaaggggctgtatagcctagatgcagacatcctgatgcacatcactaaaggaggttgtaagtggtgcatacggagacaactctttatgcagtacaggccatactttgctgctaatgctataggtatgtaaactctcagaggtatgttgcatatatatatggaaataatcccacgagtcagaaagaatatgcagtcggtaacactaacattcaaaacaaaaatgacctgcaatctgtctcttcatgtctgagctatagcgtgcatactgatacattcaagataataattggcgctaaacaggttacttgagaatacggtgcttagatatccagaggctagtatcattcaggaggccaccatctggtataggtaaagaaagctctcaacttcacttcacgtggggcagtaaagttctaaatcaatcaccaggaaatgatgtgctggtttttcaaaaaaatatttgttgctccaaaggatataaaggaaaaacatattttaaacaactcacatgatagagtgagttgagaagaagctcaattactgaacaatatccttcacataaatgtagctaattgctacctatgcaatcagaattagttaataaatactcacatgatagagtgagttgagcagaagcagagaagactcctgagaaactatgctactcatgtgttgactgagcaaactttgcagccatgggagcaaggaaaccagcactgcacccctgacaaaggggaaaaaatggaaaacataagacctctacgtcaaaatataaccaaataatcttggcagtatgtaaatataatcattgtttgagtagcccatgaaaatccagtcaaacatagatgcagaaaaaagaattgaagctctcctttttttcatgtctactgatgaattacataataacccgaattgtatatcctaagcccatcttctttgtactgaattgcaaaagtgcgtctaacgaattatcctacctcgattgcataagcaatatgaagaacttgagaagcttcacagcgtctgctggtgtaagaagtgatattgaattaacaatgacctgcacagaaaccaacactgaaattatcagatttgatgaccaaattgcatcaaggattagtcaatgttaacttataacatctctcaataacaggtaagaattagtgattaacactagcagagcaagtgatgaataaaatcatatttcagtaccacgaaaatctggcgatatagccgaatgcagtgcaagtgaaacggcaggcaagcatcgcattgcatcattgcaagaagggaaaaccatgacgataccttgtggtctttattgtacaagcaattgagcaaggatgcgtggtcatcagcccgcagagcctgcttgagcaagacgtgaaccgagtccgcgctcggcggcatcaccacggggagtggctgctcctgggtagcttcacctgctgtcccgtcgcctcctccgttgagcagattcagggtggccagcttttcctccatggtgggttcgtcaagattatactccggattagcaccactgtcgttgattgcatctgaaacatagacaccaagggcatgttcactttgatgccaaaaaaatacttaccaaattttggcattgccgaaattttagcaacttgtcaaaattttggcaagatttcttatatagttaccaaaatttgacagcaaactaaatatagccattttttggcaactttatcaaaatttggtaaggttgaaaatgacatcaaagtgaacaggtcccaaatcatgctgtcaccaatggctgttcagagagctcgcgtttatctgtgccagcggctagcctagacaagcagggaaaaaaccaagaactgaggaacagggttacctgatggcaggggagcgcccggggcaggttgcctccggcggcgccggcgagtgaggtccatccgcttacttcagcacgcagctggcgtcggcgccggtggagacaaacgaagcgagagagcagcggcggcggcggcggcggaagaagagagagagggggagagagagagagatgaaggaagtgcaaggccgcacggatgggccggaatacggcccagcccatcctatctccagacattttttatatttcttcctctccttttttttttctagttttctttccgtgtaattcttttgcacgttcgcgaataattttcttccaaatagtagctgctcatactggcattcctgtctaccttttcaatgctcacgacaagcatgctcattttctcattttcagaggttttgtttccaaaaacatttttactgaaagaatttgaggctggctaggaacaccaacagtccaatgcctatggttgacataggagtacacgcaagtacgcaactcgcggcaggtgaagcaaattaatcatccgaacatactcaacaactatcacaaggaagaattagcatttagttcatcattccaacaacatttcttctccatctggagcaaataaaagccatcattcctgcgtctcgcatgctaaaatcaccacaagcttactggacagtctgggctgaatgttgtaagaatccatatctcaaacaggatgtcaaagttgccattaacctatgcttcagttctaattcttccgaagaagacgccgttctccatactcccaccatgaattcaagcctaatgccaagtactagtactgcatatgcacaaaattgcagctgagctactagttaaactgtctctaaaccaacaaaaaagggcttcgggtcactcggcattactcagttcttcaggtccatcgcctccctgagagcaaatctccattagaacatccaacacaatgatatcaaagcacaacttacaatgcacaaataccaggactagtggtgagaatctcttaccagaacagtttgtccatctcatcactttcaggatccaactctataccatgggtcaacgccacgcaagctttctcataatcctaatgaaggacaaaatgcgcatatggtcagccaaatgagatggtagttagttagcaatgagaatggaatggtgaattgaagttttttttatgctgcaccttctcaagcattagagcttctcctagccgatggtaggcctccgacaacttcgggtgatgttttgcgcatgtggttgcatctttcacagccttttttccctcacccatgcgaagccagcaaagacacctctttagaagagttgtggcatcacaaggatcaacttccagtgcctgcggtgaaccaaacagtatctgtcaaatatagtgttgctgccacatccaaaaatttaattgtcacaaagttacatttctcatttatctcagatagagttgaacccatagtgaaattcacatatcaacaagaacttaaaactgtagatggcatagcaattatatgacagaattcctagaagatatatcatcccacataactgctgttgctcaactcatactgaatcatcaaaataactactcgaaggagacactatttcgtagtacatatactttgtgcacaaagctcatgatgattttatatcaaaaaatcattgcttatcctgtaaaaaaggtataactgctgattttttgaatccatgaaatggaagaaagctgcatcttattgacaattcaaggaaacagaaaattttgcattgagttgaatgaaaagaagtgatgagctcatggcactagtctttcagcatagtagcattctaatagtcgatgcactatttaagtagatagaagaatgtacctgtgtgtaccacactgatgctttttcataatcctgctcatcaaatgcttcattccctttttgtttcaggtcagacattttcgtgttaacgtaatcatcatcctgttcaatttataacagcatgagtcagacagattcagaggtccaatgtgacaaaatgcaatgtaacaagtaaaaggggatgtttattgataaaccctgtttctctattgttaggtctgatgaacaagctacgagctattgttaactttgggtcaaaactaatacaaactatcctgctgctgagaacaaggtggcatgttgcctgcaatgggtacaaacaattgtggttccttgtgtcaaaacagggtttgagaccccgctggtaatccaccatttttaccagtgatcctgggaaacctgatgtgtatcagtatctagaaaagcatgtaccaatccccctcaccaggtatcaattcagggaagcaaatttaatatagaaacaaacttccttcatcttctttttgcaagaacaataaaacaagcccacatgaagaaagctaaagagagcaaccagacgctagcaagtatgggcaactgctatagtaacatacctctagcttcttgcgttccagattggcataagtaattaccccatcaacgctccagtcagcaacagttggaattgggttggtcaaaggaaatagaatctcaacatcttcccttgtaccatacacagcagccagctctattggcattctaccatgctgtttggcaaacgaataaagctttataaagtcatattggagatcagagaaaggtaagacgatgcttccttccaataacgctaatttaggaattaactttgctccaccaaggcacatcactaaatgatgtaatgccaccacataaatgactgatgaatatggaatagtacttgttttatcaataattttttcaaaattgctaccatcagttcttgttgtcctaaactttttaaacatgttgccattagaaaagaccaattagcattatgctcaccgactattaattatctctatgcacctgaccaacaaaaaaagctaaatgaaaatgaaaacagggaatttagcaggcttgtgtcaactctagaagcagatgatagtggtctgcgaaacacaccacagaatggtgtacacatgtctcacaaatcaaatcacactattcaactgatgctcaaatgctccaaatcttttgcataatcttgtttccgaaagaaaaaagaatttcctataaccaaaaactgtgaactttcgatgctctataaccaattttgcctagtatcttttacaaataagcgtgtgccacatatgtgaattttcaggaatacatttcattgttccatactagtgatgcatatcaatgccacaggcctaaaatcattgaagctacaaactcaatctgctgatagtgatggtgtgataagcaaaacagaaggctcaccgtgtcaggacaatttgggtttgctccagccttcaacaacaactttatagcttcagttaatccactccctgcagctctcgccagggggttgtttgtagcatttacatcagctccagcctacaaatgtttatgtataatacaaaatgattatacattttcttcacataacttgatgattataacagctctagccatatatagtatcagttatttagccttatcctattgcagcagtccaaaggagaaaatattgtacctggatcaatagcttcacacaaggtaaggaagtagtgaataacgccgcagataaaggtgttgcttgagaagaaggcataaccttgttgggctggaaaagaaagaaatgtattatcatacattatgacagttcctagagaaagagataatttaagaaagttgtttgtgtttcttccgttgttcctattgattattcagtggagtagttgttaatgtgtggatcacggctcagccagacctgggctagctcagtgctcacacatcaataaccaaaatgagagtaaggatggaacagtgggaggaaatagtaagccccaacataagaaaagtataagcatcgtacatctgcttggtgctccaacaaaatcttcacagtactttcatatcctttaatagcagcaaaatgcagaggtgtcccatgatctgatttgccatcaacatgagctcctctagaaagcagcaattttactatttcagtcctccctgaacaatcacataaaaaaattgaaggtcactgatgtatgagagaaacaatttgggggcagacaagtttgagaagccagagcaaagaggcaatttaacacttaactgcttaactggaggataataaaagaaaaagacaaaccagtcctaaataacacacaaaaagagcagttcactcttggaggaacatgtttcagtggctagaacaaaacacacacacacaaaaagaaaccctggcagcaggttgataaataaatatgaggtttatgaagtagaaacagtccaacagttatactaggatgaatggtaaagtgcagataatctatgatgatgtgaatgatatattttaacattttcttatgatgaattaatatgtataggctgatgaacatgaaaagtgtacatcagcaaggtctatatcacttaaacaacacctgtaaaaacaaaatgcgtcaggaaatgctgcattaggcttgctttgttgtacatttgctagacgctaaggtccccatcagttgcttacaacttattataagccgtaacggcttattagcaattaaaaaatgttgtgcgaaaaaaacttttgtatatatattcttagcgacttaaaagtcaaagctgaaaaaaaaactatgttgaaaaaaaaaacatcaaaatcaaattaaaaatcaagttttaaagttcagattttggctttagcttataagccatagggcaaacaatgaggcccttacagtattgtctgcatttttctccacattcaacgtaaggctgctcatcatgacagaatgcagattggatgtagcagggaatcctacaagaagataggatattcccctaataaatccaagggcataatgctgttccactgaacgggattgggttgaagcagtattccgaatgacacatagtatgccgggtagtacagcataactcagattgttcttttgtaataaaaacaaaaaaagaaaaagaagaagttgaactaaatctgaggattggtttcccctgtttatacctttctttgcagctgaatgaagaaaagtgatgtttccttcacgttcatgatggatatcagcaccatgatcaatgagatacctgacagagggcaggtccccaccggcaatggctcgctcgaggggagtcttcctacctaggtggcaaggcaatgaaaaccagattcacaataacagtgagacatccagctgaaatagctagctagtactcctagctggcgaagaggacaaaaggaagcagaagaggaggatgaatcttgacatgcacctggagtggtgtccggcttgtgacgtccatgttggccacctcgagcaagtagcggtagacgtgcaggcttctggcggcgtgcagcgcgttcatgccgtggaagccgtgcgcgccacggtggccgcgatcccctccccgtcgtcgtccagcgtcgcggcgatctctgattgagcacaacagcaagcaagcaagtctcgttctatcacttccatgagcggaaatcagaagcccganaagattttaaaaaaagattttttttttgtttggtttcttgcatgtcaaatacangtggtcaggggtggcgagaagagaagtgtacccttgatgcggcggatgttgccgtcgtgggcggcgaggagcaagttggcctccgcgggccagctgtcctgatctgcgcgtgaatggcangcaaagggatcgaggaggaggaggaagagattagattaagaataaagaatgaagagaagaagacatgatgaatgcagcgcaataccgtcgccgagaagcttctcgaagaggtcgggcagcgacatgatgccgtcctggctaggctagggtttcgtttgttgctgctgcggctgggttgtgtttgggttggggaaaggaggagagaagggaagaatggtccaagaattgaagaagaagaagaagaagaagaagaagcgcttctctgctgcaactctgcaagtgcagagagagcagagaaagagagagagagagagaggcgaggaggcgggaagtgatcgatcgagtggggtcccactcccagacgcagaggcagaggaagtggagcaatggcgggtcgacatggcagcccccaatccccggcttttttctgctccgattctccccatctttttccatgtctttgccttcttctcctctcctatcctcttcttggcttcttgcttgttcatcctgcacaccacactagcagtggagtaaaactgtaaaaagtatttcagatctttgatttttgcttggtggtgagagataaataaaagacaagtcgtctgcaaccctgcatcaataacctccatacagataaacaaactgggccttgagtagttcccaatttttttttctaaaaaagtcgcatcgaatctttaaacacatacatgcagcattaaatatagattaaaaaatttaattacacagtttacatggaaatcgcgagaggaatcttttgagtctaattagtttatgattagtcataagtgctacaataacccatatgtactaatgacggattatttaggcttaataaattcctcgcagtttccaggcgagatatgaaattagttttttcattcgtgtccaaaaaccacttccgacatccgatcaaacatccgatgtggcactcaaaaattttcttttctcaaactaaacacaccttgggcctcctaacagcagaattactactagtactccagtatgtaaatcattctaaggccgacttcttttgtagattatttttaccgattaactgtacctaaaacgagaaacatgattattaactaaatattaattattgaaatttttaaaaatagattttatttgattttttaaagtattattgtcacggcatgcactacttcaggaccatctcaggaaggcgaagagcaaggcaggagacaagattcaaagcaacccttgttgcggcgatcgacacgtgaaaagcggcccaacagcttgtaccaaccgagtgtgtggacctagtagaattgggctgggccacagtgagggagagaggtccatagctcatcgctataagagaccggcagggaagagaacgaatcgaacattgtagaaacaaatatttggaaatcaattcaaatctctccctgttctattgctgcctctacctgttcttagctgttcttccccaaactctcaattctctccctaaatcctcaatttcttcccttgttgtggcacaaattcttcggagacgtaacaattatctatatagaaaattttcatgcaaaacgtataatttggagtagtgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaaaataaatagaggacttatttaccttaacttaggttgcagctcagacagcccgagaatacaaccgacgacgcggacgaggaaacaccaacagcagcagcagcagcagcggaaccaacggtctaacacccaacaccacaggcgacggctgggaaccaggacgaaaccctaatcttcacttctccttatcttctcttcagggcggaggaactatatatatatttatagagcaagggtgagtactttcgtactcagcaagtcacgggaacttaggtgtttggtgctagcttggaagagaggcaaggttgttttgcaaatcttttgtttgaaatcattttgaaatcactaagtgatttatttctttctatgtttgggcgaaaagagacttgcgtctcgattcgactttaagagatgcttttcaacagctcatttagcaatgtaccgacctcccgggtcagatcattacttctcggctcccagagccattccacttgattaatcggctcccagagcctttttcattttctcggactcccagagtcctgctgcccagcagcacaacaatccgcttccactcgggaagcctagtctatgatgcccgcagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttccccagccgacccagggttacctcatgccacatagaaggatcaaattctctcataaacataggcctttttaggcgtgcacaaatcaaactccaaccaccttgatcggtaagtgagcaagcttctcgttcttgccttaccaggaacccggtttgtccgaccccgccccggcgttcccaactattggcatgcgaggtttccctgaaccgtctagttacttagccagggtgtcccattccaccttgtggttgcacttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaagcaacggtgtatgtgggatatttggtatacgcgctcagagagcacgaataccgaggtaccacaagggtggagcgacaaggaatcagggtagtacgacctacggaaattagtgtgactactgggtaggtccgtcggtctggcacgcaaaccgaggccaagcaagttaagtgtgtgattctaataatgcaagttgcaaacgaaataataatgacttttcaattataggagcaattgatcaaagggtgacttgccttgcttaaggtcttcacgaagcttcacgaatcttcgagagaacccgcgatcgacgaaattccgattaccgcaactatacgcaaacaatcgaaaacctaaacaaaagaccaaaagaaagatcctatttagactaattattagtgccattaaatagatctcaattttacggaattactggaggttgagcggagtcaatcggatgagcggttgggaagatatggattttctaaggtttaaggattttctaatcaaaggagaaaggatttaataatttattaaacccctttctggaaagagaattgaaggagggatgtaaactagacttgttccggtggcattggcgcggcccaagggtcgaaggaggctcggccaagccattgggccgacgcgggcgcaagcaggcggcccattagggcgcgcgggagggagagggggcggtccggtggaccgggtgcacctcgcgggctcccgggtggggcccacatgtcggcggcaaggttcacgggggaatgggttcacgcgggggtggcgctagggtttattgaagatggcgcacgggcggtgcgccggatggaccgagaggcggcgggcccacgcgcagccatagggctctccgtggaccgcgcgcaccggtcgagggagggggaggcggcaggctggtcgtgctgacccggtcgcggccgatgtggctccgacgtggcgcctacgtggcagccacgcgggccggcgggaggaggaagaaggggaggccgagatggacggcggacggcggccgagttcaccggagcttgtcacgacgattcgagagggagggagcacccggattaaagagacggaggagataaagtgcgccaccggctcggattcacggaaaggagaccggcgacgacgaaacgcggcggccctcgccggcggtgagaaaaagggcaaacggcggaggggcgacgaggattcaattcgaggcggtggaagcatctccggggttcaaggagtccgcttccggcgtcggatggggcggaagagcaccaaggagggctggcgacgagcggcggcctccgggagcgggcggcaacggcggcgaggccatgccgggcggcggcgggtctaggggcggcgtctacgcgtgttcgggagtgccaccgagctatcacgcagactagagggggggcgagggagagcgaggaagggaaacgggaggaggcactaccgagccgggcgggcagtgatgggcggtcgacggcgcggggcgagttcttcggccttgggccagggaaggggaagaagaagggtggccggagtcctcttcggctccttgcgcacacgctggcttcaccagcacgcgcgacggcgaagggagggtcggcagctgctaggcggcaacaaaggcgcggcggcggtggaagagagatgccgagagagaaagagatagggaggctcggcctgggcttttatagacgcgggggatgtcggtttggggagggaggaaaccgacctcgtgggcggtcaaggatgcaagggcggcgagctggcggtcgtcgacgcgtgcagccaaggcggcggcaggtgatgacgccggcggtgtcgggcaaaagaaaaaaaaggaagggggaaaggggcttggtcccttgccaaaacgagaaaaggaggagggagagtgaggaggaggaggagagggagggcagctgcttctcccactcttggacgggtgcggcgtggagtggcgggggccatggatgacgtcgacgatgacggcggcggtcggtttggcatggagcgggggcaaggcggcagcgcgtggcgttggcggcgaccggccggtcggccacctcgcgaggcgcgcgcgggaaagggcgaaggcggtggaggttttgggcgacgacggcgggaagcggtgtcggcgcgagagagaacagagagggagcgagaaaacgagagagaaagaagagaggcgatgcctctctctctcggcgcgtgcagcgcacgtgcggggaggaggagcagccgagaggggagaatgggccgagcaagggagaaacggcccacagccaagagggacgcaatttagaccttttccgagagaactgatttggataggattggagagatttag

SEQ ID NO: 76630 - DNA, 3258 bp, Oryza sativa
tatttattgcaaaataatttggggaacaactgtacccccatgtccgcccctagcgggaaccccctccccagctctgtccaatcaattttaaaccgtagttttgcagcataagatattttgagaggcatttgaaacattctaaaaattccatgacttatctagaagccaaccggaaaatattccacttttatggacaaagctaacccagttcaaatccatccaagtttcctttttttattcaatgcccccttaagctctgttaatgcacaacacattccccggcctctctcactgaccagctggtccaaatgtccagggtggcctagttggaggcgtaacacctttctcccagccacttgccaagtagtgtgaagtgtgaatacggcgtcttgcatattttgcatggagttatttcattctataaacataatacacaagtatatctgtttccaacacatctgcaccttaaatgctaaccagcaatgacagcacgcagccaaatccgcacgatcgggtcaacctattgcgatgttgtccatgtgattttgggcctttccttttttgcaaattgtttgatgggctttgagcctttccttttttgcatattgtttgatgggcttcgggctttttcttttttgcaagttgtttgataggcttatggccatcttgttttcctttattaggagatctaccatctcccttttccatagatttgatctggtatctttcctttttattaggccattttttccagcccacatgtccaatatttctgaaaatatagataaaaaaattctatgataaactttacacatataaattttctatagaagaccagtctggaaaggagtattctagcttaccgcaagaggaaaataccatcaaccagggtggatgaagcctgaaggttatgtctgtcagggttacgggttaggcataccctctacccttcgatatacgttgcatatcgatatggcatatccacgcgcatgcggatatttcctgtttacagaaggaaagaatcctactcggacagaactgggtcgttgacgtatcgtatagggtctgatacctccaagttctacttggagacctccagatccgcgatataaaaaggacctcccggggagggctcaagacattaaatctcagagccaacacaaccaacgcagcctacgaagccggaatctgcgaggagccaagtcatcaagcgctagtcgaatcaacttgactacgatctcgtcggatccgacaagttccattgtcctctttgtaacctgtgttttccaccatataatcccatatcaactggattagggctattacctatcaacgggcctgaaccagtataattcttgtcttttaattgcttgatgtcgtactacgtagattcttgtaccaacgtaccctaataccctctatatccggtctacgggtatcacctgtcgacaatgtcatcgagcgagaaatattccccaagaagatactgcggggaccactccaaccactactgcaaactggcgtcaggtcctttggaggtccacacagttgtacaaccatacccataagatttctaactttagaggggtattttagtaatttctatataccattgaggtaggattgtacatgtacctccgaaggctatataagctgttcctgctagatttaagatatcaaaataccatacgacacacgggactttacccttcgagctcatctcacttttatggtaggcgaggaaaatagtactttcccgcctattcctgatttgtccatgagctaagatcacgacagtttgcatgaagaatgacagatgtggtattttcagaacaaaaatgatgtcacctgtggtgttacacgaaatagggtaattttcgtggtattttttgaatttggcttttgaatggtgctatgaaccaaatttttctcaagataaggccccccaatactcattaattaataagatgagagaaataattttacaaacttttatgctggctgcaccaaccaacatgggttatgtcgaaacatgatttcggcaataataaaaaggggtagcgcacgagacctaaaagtggatggatgcagagacaaaggatttagacaggttcaggccctctcaatgagaggtaataccctactcctgtttggggatttgaatccgccgggtgtgtattgatctgacgatcaggttgtctcatatgccccctagagggcctcctacccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctgttacatattacataaatataagttatcccctataactagtcggataaccatgccgtgtgggtatggggtacccataatctccacagtagcccctgagaccttcacagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagccctcgactatgcggttaagtgaacaaaccaagcatatagtcaaggaataaataatccaaccaaccgagtggcttcgataattatagttaaccaagcgacttgatattaatatgtagcatatgcggtgtaaatccctgaataacatgatccgagtgatataccaactgctttgtaaaatatgatgagtgtaacctaaagttggctacattattgaaaattcacatagcaaaacagctataaaaaagcttgtatgttgtgaataaagaaatttccaaagtattgggcatacgccatgcgcacactgttttaacagatgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcatt

SEQ ID NO: 76631 - DNA, 25513 bp, Oryza sativa
atcacacatacgtaaataatatcgtcatggtttattcagggaaaatcataactccatcagataatttgtgcagaacggcagaaccttattaaaaaaaggcatcagtgacaacaaaccaaacattttctgtcgaagaaactaaaatgatcggatataatactttacacgtgcattggggaagaaaacaatttgcacccataacccagtaatataagtttcatggtcgggattgtatactgcagacgtcgcaagaagagtcgagagggcggaacagcaggaggcggcgcaggcgcagatggcgcgctggcgccgtgattgtttccgtgccggacggagaatagtacgatgcttgctctgttttgataggatctgtttataagtttgttacgattagtttcctttcaattagcatccgtttgttacattttgtatacctatttaaggcaattaatcttagaataaaggcaagcaagatcaaagctatctcctcatctccagcttcctctgtttctcatctctttctgtcgctgtgtccatcacgggtcgccgatcattctcccccgatccgccacaacccatttggtgagctcaagcgcctcacgcagacgagcaccgtggtggcgtaccaggagtgttttctggcacttaccagtcgcatcccagaccccctcaccgagagtcagcaagtgcaacttttcatcgccggtcttcaggatgatatcagcatcgacgttgaactgcagaagcctgatgatctccaggacgccatgagactgcctcgggcgtacgagtggaaggccaacaaacccggcgcaccgccgcggagggtgtttgctcgcgctgcggccgccatcacaccggacccaccgccagctggtggctctaccgccgcagactccattccccgacagttccgtcgactctcaccggccgagctcgctgaactgcgaaagtggtgctcccggtggggaggataagataaggatgactttgagtttggataggtacgattattgcggattgactacgtaaggttccgcctgcaaaaatcatatttttttaggtggagcacttaagagttctgcctataaaaataaaggtattttggtctgcgtggaaaaattgattttcgtagatggacaacgaaatataaaaaggcatccaaatatctctttctcattgtaatgcaccaccaatagtgagctatcttgttgcgtaaatctgtctttatgatcctcatagctgaaaagaatctttcaactgatgctgttgccactggaaggatcaatgtaaacccaatgagtcaatacactaatggaaaagtcatgttctttctggactgaaccattttttcagcaatttttgcaagatcatggcagtcattgaattcaacacatctcctgatgttgagaataaaggtttgaagttgatttctcaacatcaaacagtcaactgtcataaaatcaacagcgtaaatctcaacaaatcgaacaaacttatgcatatcaaacttagagaaggagttgcttggattaagataagacatgcacaccaataaataaaaagaaacttaatgaaatctatgattaatatctcccataattacatctagagcaacattgaaaatatcaactcgataataatgaaggtaagtcaccttatgcttccaacgtgcagatttaccgttaactccgatgagatcatccatatttggcactccaattccatttgcctcacaaaagttttttacttggttgaaaagtagtgcccaaccattatccctcatgtcttagtagtcgtgctttcacatccacaatcagacccatagcttcaacaatgttttgatctctattttgcaaaagcaagtgatggctcacttgtgatacttccgtcccaaaataaaaacatcatttttaacctatcccacacgtaccaatacaaaatcagaaagactcgaatgccctctattttagcaaattccaatgcaattacaacattttaataaattcatatgcaattatcccccaccataataaataccaatgcatttatgtactaatttcgcaaactgtaatacaatgatttttcttcaaatataaagtctcttctgaaacaaataaaatggttaaaaaaaatataaggatccaatcaaaagctacacgtagtacaaaggacgagaaagtgcttgagctgcagtcacatccacgttatttattgttttgctaattacaacatgaatttcaataaagcaacgaaaccacagcgggcatgggctagcctagtaataagagcatgtccataagatgggatccgcaatattgtgttctttttgtctataatagatgctacaatatgtatggtttcttctcgaccttaaggtggagcccactaaaaaaaactctattcacctacaatttcaaaagctgctatatatattgcaaatgcataaaatacttttttatttcttatggtctaactttaagctcaaggttacccttagcaatattctcttcttagctactttcccaatgatagagataaaacaaatatattactttatccgttaaggttattttacatgcaacattgtggatgtgctaagtaataacaaatgattcgatgtagaacagatgtgcacacttatggccacgcacgaacttctcatcgcaattatagcgccattattaattaattatcaaaccaaaaaaaattaattatagcatcaaacttatggttaggaccttatacgtcgtcgcagcctcaaacttaacctcttcctcaggagggagaggtggttcactcggtttgccccatgaaataaagaaacattgcatcgccgtcaactacagtagtgcacatgcttttcatattttataatttgaaccatcgaaagcgtgtggttttagtgatgtagcaaagccaactaccaataaaggcccatgaaatttttggattgttggaaatttggtcataattcagcatattttaatccaaaatattaagacaataaacatagcatttgcaatatgagttgatcagtgatagtgctagttgtatacaatatgagcatacataaggtaaaataagcatcaacatttacagagtaacacaatgatgccattacgaagaatattaacaaacaaacatctaacggaatatggagaatagaaatataccccgagaacgtcccaccactggattttgaggcagtattgcctccgttgatgtcgttcacctccttgtctccaatctctgttgacatgttagcgaaggcgtcgatgctgcagcagcagtagtcgcgaagaacaggagcagtcgcacttaaagtgctccccaaaaacatgatcgcttgcctacccatgcaggttctcaagcggacggagtttcggaggcacctgctcgtccccgtacacctatgcgtgccggtgaacggaaaaagggaaggattctgtagcacaggaacagagggaggaacttcggaagtgtaagagacgttgggaagaacttctgttcatccttctggtcgctgcagagtatatatatgcgagcgcgagagtaatgttcgggatcatcaaccgatgatggttttatgggtggtgcatggcgtacaaatccatacgccgtgatgggggttcaaaagttgagatagagtggaggataaatgagcttatgtacgacaaataaatatgccgaacaaatttagggttttaagcgacagccacactcgaggatttttgtgtagaacgaaagtataaaaggagggaacacgagtcaaaaagatgaagcgggttttaattcattcgcaaggttccaagggttcggggaatgaaacgacattgcgacaaaaggaaaggattttgggatttcgattcgctttgcatcgaagcatttagcaaaaagggaagacgtcgattggaggacatcctttaggcggaacgatttaattgaggtaatccaacgattcaaggaagggacggggtattacaattgtctaggagagttgagaggacagagaaaggatttcgctctgtgaggcgattctgaaagaactactgggttcgagtatttcctgatattcgaacaattggttcgggaggggttcaattgagagggaggagtatcgaactgcggaattcgaatccgaaggaattatgacaagagttgagattcacaaggatggattaaccgagatctttggcacaaatcccttttggccaccaatttggtttgaaacaatccgtgtgttagaagtataatatgttagttagagataagagtcaaatacagatatagagataagatatatcctagagatagaatcctagagataagatagagtcctagatatagaatcctaaagataaatctacatttacttgtattatactctaagtatctatccctatgtactcctatatataccccatgagagagtcgatataatatatcagaaaacattagaatacaataaattagatttttccacatggtatcagagctctagagaccccgtcgctctattagtcttccgctcacgctgccctggggagatgacatctttttagtctccctggggcgcgcatccatcaaccaccgaaaaaaatttcatagattaagtaatgattagtattagattagatccttcgttagctagccacataaaagccatgatcctcgtgagcagaagcagcaagccagcaaccactacgcatgcatgcatttgcaatggtcggcggctggcggtcgccgagatcaacttcttccgccgcaacactcgtgtcttcgaacctacaccgacagtactgatcatcatcagctgtacaactgcgcaattgtcttcgccgacacaacatcgccgatggtcttcatcaacaagggaacacgccgccgccgctcgtccacaaggatggacatcccgcgtcctctaatagattaatctgcaagacgctttatcgacgacatcgaccgcgccctctacgacgacaacgaccgcgacaccgacgacggcatcgatcacgtcatctacgacgacaacgactacatcaatccggcatcaccattgtgatgaccgctacatggcgcgaaaggaccaaccgaagtggtggcctcatcgccaacgacgtcctctgacatatgcaagacgtcttcaatggcatcctctgacatctacaagatgcaagatgctaacaattgcagtttcgtctttacaccatggcgtaaatattttttctttcgccttcggctatttgcggctacatcaactaccatgattaccatgaccacgactactacatgatcggctacatcgacgaacgtctacaacgagaatcatctacagaaacttcagtcaaagcgtccgtgtcatcgctattgtccatgacacttccgctatgactgcgggagggaatagagaagagtcaagggacgacacagaaggggacgcaggcaccaggtggaggaccgtccatcagagatgcaatcgatgatggtgattcgaaggaggtgaagaaatagaagattttaaatccagtcgcaatcgttcgcttcgctcccgttacgactgagggggaatgttagaagtataatatgttagttagagataagagtcaaatacagatatagagataagattagccggcaaaaaggggcagctctgcggtggtgacaaattccacggtccagtgacggggtgaccagaatgaagctttggagagctgttttcgtggtgaggggttgtttcctcccgctttcctcatcacttggatcagggaggagtgtcgtctctagcttccagacgcgccgcggtgagacaacagcggcggcggcgctccggcgtttcctggccaaattggatggggtgatacggaccaggcggggctaggacggctcgggcgcggtggctcactgcttgagggccgggttctgtaggacggacggtcgagggcgatgtcacgtgtaaacatagtggcgcggcaacgggtggccgagcacgcggcatgatggtgcagctaccacgcacgacgtctaggcagtcagcacaatccttggtgccaagcactgggcttgctatggttttactatgggaagtccacggcgagaggactggccccaagttcccgcggaggcagcggaggcggcttggcgtgaagccgggctgatgcatgcggctggggcgtgcgagcgcagcgcacatgccaatttgacagcgccataagcgtagcggctgcgtcaacacaggaatagcggcacgtgggagaggagatggctggtgactcgttttctcaccgcgacagacgggaagcggcaaaccgaggttggtgatggaggccgagcggcgggccgcgggcggcaatgcggcatggttcggaccttatacaattaccggacacaaattaattatcagccaaaaggaagagaaattaattgtcaattatttttaaactggagaaagtagcatttgacgtcacatttatttatagaagctatcttcgtcgtcaggcgaccgagcaatcactatatatattcatttgaaactttccagctcgtcgcgcgagtgttcacggctgtggcgtctttgtgcacactcgctcgaactcgcggttcgtcctgggctcccggcggcaacagggcgatgcgttcgccaagcaggccaagggagaagactctagcctagctgggcctggtgaaaaggaaagaggaatgtgacctctgatgggctgggttggacctaacagatggtgggggaaagaacgaataagtctacttataatccctcatatctacacgagtttaattcatatccctaaaccaaatcttcaccaccaacttgaaaaaaccgttcaagtgacatcccttagtaggctcataccaagtatacatatacgtatcataataggacactccagattatgggtactagtcaccaacccgtgcgttgaacgggctaatattattgcacatccaaatctgcttgtttaatgtagaaacttcagtggagtgcccaattagtacaacaaaattaatgtaaatatgtattaacttaaactttagaattccaaattcagaagtactatttatgctcacattgaactctccatttgttatcgttattaacttaaatcgaaatattataatttaatataccgaaataccttagtgtgcagccttagttatacaaattattgctttaataatatcaagatatgaacaaattttccttagtctagtttagaatttgagaactaatatacccgatataacattagtttgcaggctcaactattatattttcataatttaacaacatatcagaattcgtatttttcccctttattcaattcaaagatttagaatttttatagcaagatattgtagattgttgtcttgatcgtagattatcataatctaataattccacaaattgtcttaataaatatcgtgtgataattagtttgatctcaatcataaatttttcatggtttaaaaattcctacaaatatatagttgaatttggtttgtacacagagtcatagttttcccatgacttgcatcatgttgtattttcacttttgcgtcatgttagtggccttaaatcctgtagacctaattaattaatattctctagggttagagttaatcatgggataaaaaaaattaaaaatagatatagtttaagataagcacgtcaagaaaatagaccaacggtataccactgtgcctcacgttaaattaaaaaagaagtctttttctcaatacattctactgctacaaatatgatgctcagatttttatgattagcttgtgagttcaaagcaagtgcctaatagattgaggatgtggtgcttacaatcgaacttcttaactgcaattagtcaaactgacagaaaacttttatgaattaattactgatatgcagtgaccacggatggacttatttggggcaagcaaactttgtaaatcaacatctcaatacataaaagttataatatgatcatataaggtaaataccaaaaattgttggcctgcttaccgggtcactgcatggatgagcttggctgcacgtcttccgtcgtgtcgcgatgcgatgatcggccttgcgagcagaacgtccaggcgggatgaaagaagtccgctcgtcaccatctccgggcggccatgccagcgagcggaactggagtgcaaagaaggaagtcctcacgtttacgagcaaacatacgtaataagggatgagatcgatacattaacatgtgcaaatctaaggttggatctaatctagatatgattggactttactgagcccacggtacataatatacggttagaatgctaatcgatggctatatatttctagttaacgtgagggctcgtagaaagtgtccaattagtataggtaggtatagatgtgtatagatgtgcaaatctaacgttggttctaatctagatgtgattgggctttacagagcccacggtacataatatacggtcaggatgctttaatctattgaatcgatggctatatatttatagttaacttgaggactcgtagaaagtattcaattagtataggtatagatagatagatagatagatagatagatagatagatagatagatagatagatagattatgacaccgttttacttgttgggaaagcagttaggcaatacccagcggtccatcctaatcgaacgcataccgtgcaagctgaccaatcctggtggcggtaaaaatattctgcacgctttgttgatggtttgaaacaaataactcaactcggaaaaaatattatgcaaaatttacaattgtttccctccaaaataacctaactttttgcgaatttgggtccacaaaacgtgtttgccctaaaaatattgaacaatattaaagggcaaagagtaaaatgtgtcgacattacgtgggcggcgtgttgtttgtctgatctctgatgacgaatagatatccgagctgaataaaaatgtcaccatagtatagaactccccataacttaagagttagtaggattgtcgacaaaagtaggaggccatgtccacaccgaagaagcacgttctcttccccttcacgagcaaaggccacatcgctggcttcctctccctcgctagccgcctccaccgcatcctcccgcacgccaccatcacgctcgtctccaccccgcgcaacgtcgccgctctccgcgccgccgccgccgcgccgttcctcgacttccacgcgctccgcttcgacccggcggaacacggccttccgcccggcggcgagtcccaggacgagatcttcccgccgctgctcatccccctctacgaggcgttcgagacgctccagccagccttcgacgacttcgtcgcgtcgaccgccgccgccgcagcgcgcgtcgtggtcatctccgacgtgttcgtcgcgtggacggtggaggttgcgcggcggcacgggtgcggccacgcgttctttgcctcgtgcggcgcgttcggcagcgccgtcacgcactccctcttcacccacctccctctgcgcccggaggagccgagcggacgtgtgtttctccctgagtaccccgaccgaccttgtcatccacaggtcgcaggtgcccaagtacatgctctaccagtacggcctgcccgctgccggtgcagcaaatgacggcagcggcggccgagcagacagacggttcttggaccggcagctagctcacggcaacaacaccgacgcggtgctggtcaatgccgtggcggagccggagccggccgggctcgccatgctgcggcgcacgctcagagtcctccccgtctggccaatcgggccgctctcgcgcgaccgccgcgacgcagccaccgagcccaccgacgacaccgtgctgcgctggatggacacgcagccgccgggatccgtgctgtacatctcgttcggcaccaacagcatgatacgacccgagcacatgctggagctcgccgcggcgctggagtcaagcgggcggtgcttcctctggaagatcaagccaccagagggcgatgtggccggcctcaacggcggcgcgacgacgccgtcgtcctacaatagatggttggcggaagggtttgaagagagggtgacggcgagcaagagaggcctgctggtcaggcggtgagcgccgcaggtgaggatctggcgcacccctcgacggccgcgttcttgagccactgcgggtggagctcggtgctggagagcatggcgcacggcgtgcctgtcatcgggtggctgctgacggcggagcagttccacaatgtgatggtgctcgagggtctcggggtgtgcgtggaggtggcgagggggaacacggacgagacggtcgtggagaggaggcgggtggcggaggtggtgaagatggtgatgggcgagacggcaaaggcggacgacatgaggcgccgggtgcaggaggtgcggacgatgatggtggatgcctggaaggaggagggagggtcttcctttgaggcgtctcaagcgttcttggaagcaatgaagctgaaatgaagtatgccattgtattgctgtaatcatgatggacttgttttatcttttttttcttccatgttattgtgttattatgtttcactcgattttcaataatgcaattcttatctacacatacatgtaaacattcataataatgtgattcttatctggacgtacatggaaacaatcatgtatgtaaacatttatttaacaaactagcactaattgtgccaatttcattgaatatagtagtaggaaaaaaagtatttacatgggtgcggaaaatagataaggttatatacaaatggaaactacatgaacatcctctttgcatctaccagagacaaggttcttgcttcctagtactttattttcacaaggagcaccatcagtgggagctcagtgtatcacaaggactctctttttttcctggatattgcatagaactttggttccaactcctttggttgtagcactatccccaatcttaactcgcatggcagccatgaacaggagtttatctatttcatcgcatagggtttccaaaccgatccacgctttcccgctgatttccattcttgccgaagccatatgaaacgtagggctcttgtgaatctctccagttgcaggaaccctaaacctccatttgaagttggcgagcaagttcttgctcagttcatcttgcatttcctgccggtgattcctgcccagaggaagcatttcctctgcttatctatcacctacagcctatagggaatctttttcctcttttaatatgctatgaggtgagaattgatttgactataagtccgttcttccagccatcccaggtccttcccttcccaacccaccatccccccttccccgatttgtcgaatagtggttgtaggtctgcttttctcaatttacccagcattaaaggtaagcccgggtatttcatcggaaaggacattctggcaatgtttgtgccctcaaggatgttttccaaatctagatagccacatctgattgttgctacctacgattcttggcagttttgtgggcttgtatgtcttgtttcttgggcttaataaagacggttgtgttgtccgcatagatagaaattcgtaggcgcaccgatctccccctcatcttacttatcatcttgggtagtaacttttgaaacaggttgattgccataatgaagaggaggggagagtgggggtctccttgtctaaggccgcaaccatgtcgcacctctcttctgggattccattaaggagtatcttgaagcaggaggttaattatgaggaagcctactatctagtctgtccaacactgcaagaagcccatttcctgcaaaagtgtcgtgaagacgtagtcccaacagactaagtcaaatgcttttgaaatatctagcttgaagagcatagggcacttgttttgatgatatctccaggccatattctgacatacataaagttgtcttggatgcttcgccctctaattaatgcactctgatttaccgagataaggaaatgcatgagaggttgtagaagtaaggcttgaaggttaaagaaaaccttggcgaaggtgtggatcagatttattggtcaagctatagaccgttattttgtctaccccatcttttttaggggatgatgatgatgtcatctaagttgaggaggttgaagtgtgcacatcaaatgttgtagagcgagttgaaagccactattatgtcaagtttgataatgccctagcataccttgtagaagttgccagtgaagttgtatgtcccaggcgctttgtcaatcgacaactattgaattgctttatgaatctcctccgtgaaaggttcagccaaggtgcttaggtctattagtgtaactcccaaggcttgccagttaagctcccactctctcggtgcatgacttcccataattaccgagaacggtccatgatcagattttaattccttttcctcgtgccactgtcaatccattgtttcctacaagacctaggatgcagttttttcttctaggagcatttgcttttagatggaaacacttagtgttcacatccccctcgcgaatggatgttattcgcgacacttgtcttttccttgctctttcaatatctgcttgccgcaacaattcatgctttagggccacgcgcatgtaccctaaactttgttttgggggaaatctgtcatattgttttatacacgatttcagaaaattcaaaacattagatccacccacttaattccatatatccggggcatggtataggtaatataactactagaagatctagttctggaccatgttagcttattgagatttagatgcatgtgggccagacttagggctagcactaatttgcatgtcaaaatcactcagtattggctggtcgacctaacattgttaaagaaatactgcttagttttagctgattcgcagtgaagtgaacaatgaaacgctggttaaggcatgaacaatggtatggtcagtgatataagtgtctggcagaagatgccatgtagaattttatagggttaatttgacccgttagatttatcttcttcctccatcctcccctattctctttttttcccatctgtccacttcttcttagcctcctccacacccatggcccgcgggggaggaaggccggccaactgcatggaaattggcctgtcgtcgcagcgggagcagctcgtgttgaccaacaactttgtcactcctgtgaccaagtatggactcctatgtagtctccctcttgtggtgccagtttgttgctcttgaggttgctcgcgagatctccttatgcatgctagtcttcgaattaatcggatgcgcgattctctgttggcgttggtggtgtagtagcatagcatcttcgtctatgcgttttgtgcagagagatggatgtggaggaggctgagaagtggttgagagagatgagaaaaaagataagaggggaggatgaaggaagaagatgaatctgatgggtggtttccacgtgcagatgcaggagaagatggaaaacatgatgttgttggcatggttccaattttgtaatatttgagtagcagagctacgtatagacgaattataatgacatttatctgaatagtcacatttgcaatggcacgaatcaaattaacccaatttataaggctaagttcttttgttgaggttcccaacacatcttcattgtattccacacacacgcttgtcaaattgctaaacgatgtgtttttttcaatttttttctacacggaagttgctttaaaaaaaatcatattattctatttttaaaagatgttaattagctaatacttaattaattatgtgccaatgagtcattttattttaagtgcgcgagagattagttcccaacacgaagtgccgaacacaatctaagatatgaagtgaagaaagatctgtatagagaatattgtcttccgtggattaactaacggtataatagacagtttaataccatccatattccatacatactaataccaataatgtacttgcctataggatcaaatcgacaagtattcaaatacatataaaatagccaaacatttgacatgttttgtatgtcttgtctatataatatctagatacgacgtgaaagtaatatatagacggtagccatctaaactgctattcacggtttcagatttatgtgtttaaatttgtgcacttcatagttcatccgggaatttaccgagctttgtaggcttgaccctatgacttatgactataatttcagctaggaacatgtccacaggcggatacacattcagttgtactgtgttgtgtgtgctttcgagcacacatattttttattttttatgttgtgttgtgctataaaatgtctcatccattcaaaatctattatattttgggactctcatgcgtctcaaatcctttatattttgacggagggagtttgtcattttcccttaaaaagcttcgatcgtttaacttgcatctatgtttaagtaggctcaaggatagaatcacttacttattagtagtaactaacaaactaaccatggtaatttgcacagtaaaacaacaacggtcaagactaggatcgccgagaaagctaacatgcaagagcgagtagtgcagccttatatgagttctgaagattaggaaatttggactcgaccaagggaatgaaatcccccctccccccccccccccccaaccacttccccggccaagcaaacgtctcactaaatgttttcggaattttccacctttgtataatttcaatcaaaataagtatgaaatttcaaataaaaaactttcaaaattcacgaaatcttggtggtttccaaaagtgtgaaccctgctcataacgtaaggaaacgattaaaggaactttatatgggggagcacttcttaattttgtccgcacaaaaatgttgcacgattatttaacttcatcttcttacagtgtcctgtggagatggaaattggagaggcaaaaggaatactagagttaaagttttgatatgccttcttcttattgatctaaaggaaaagaaatacgagcataatttcttcttcagcccgatcgagtcacaattttcagcaccaatattcttcgctacttgcactctcttgtttgatttccacgtcacgaggcatttcctcagtggatctttttgagggtctcccaacaggacgcttggcagtgttaaaggataccgattttttggttttgcatgtagtcttctcaagcttgcccttgttttttttaacctcgcttgatgaatctgataaatcatcagaggagtcaccatcttcagctatgaaaaaggaaaaagatatattgtcagtcatcatcaaattcaggaggaaaatgcaacataccacaaatacatatggattatggcaaacaatccgtagtactcagaatttttgtttttcttagggaaccagtcctcacaaatattttaggtcgataactgttaggcatgcatattaaggctgaggggttgtttggttgcatgccacaagttgccacgtctaaagttagtcatgccacagttttttagctattgtttggttcatgacacaactgtggctagccacacattttctctatatggccccacatgtcatacactagtatttttttgctaactttggctaagttgtggctagcattttgctagccacacattttgtggcagccacaccttgcctaatatggggtttggcaaagttagtaagcgaccaaacatcccctgagttcggatgggggagatgggaacccaactcctgcgcacggaaaacggagcagtccattaacacgtgattaattaagtatcagctaattttttttcaaaaatggattaatttgatttttttaagcaactttcgcatagaaactttttgcaaaaaacacaccgtttagcagtttgaaaagcgtgcgcgtggaaaatgagagagaggggatgggaaaaggtgcatgctaacgcagcctaagtaaaaaagaaatccatctattcatgtagttgcacttagtatatgcatgctatcatcgactagggcttgtttatcttattgtcaaaattaaccttatctttttttttggggaaaattaaccttatcaaattttaacattgccagatttttataatgttggatgtatttggtttgatgtcttttggaattccgaattatccggaacactaagtttttttaccctatcaaaataagttagtattgtcagccaagaacccatggcctattggtttttttgcccttgtcctgtacagcttattatatggccaatagcatcagaagtatttgaaagtgcatagcgaccagatttagaaataatatgacctaaaatatatttttttagcagcatttggccacatgataattaatttgatctgcccaacatgatcgttcaattgaaatttgcaatgtaaaatcattgtctagcacatactgccaccatgagacataacctattcaattctactgtataatttactcaaattgacacctttcctctgttaattacctactttggatattaatgcgtgcagaattctcatatgtatcagaggatatagatatgacaaataaataaaaagctgtataaattcaaaatacgttgcacagacgattattattgatgttacaaatattaaattttaatgctaaatatcttttctattttcagaattgtagcggtttagattacatcagtttcatcttgctaattttttatttagaattttagaattatattaatataatactaaattaaaattccaaggtgattacatcgttatgctattacaaaattgttttatttattatggactatgaaataaatatggcaaggttatgatcctcaaattcaaaagttgctttatataattgatatcagaataaatgactacatttaaacatgagcaactcagaaaggataaactattatttacaaaacataatataaacaacaacaaatagcttatatgaactttctctgggtttatacattgatgatttaagtctggatgatcccatacgatgtcttatatgaactttgatagtaaaaacatgaagcaatcaatgatagaatcaccagcgcatagaaaccaatgagcagcatataagaagagtaacttacacttatatgaactttcctcatcactgagtgacttttctgtaagcgatgagtttttggatttcaatgatcttctggatttccggttagtcctagctgcaaagtctagtcttttcttcagactttcatgctgtcatggataaaatcaacaaattagggtatgaaccctctacattaaacttagctttctcaccaaatgttgcatgtaataagtgctatagagcaatttatccatggaacatccaatcagattagattagtattatttttcattcattttttttagacacaaaattaattggaactagaccttaggtccgtaattcatgcgttaccataacagaggatgttgaattacaaaatcagtacatgccattagatttttaaataagtaaattataatatagcatatatgtttgagcttcaacaaataaaggcatatatataagctatcactagtgcaaaataaccgtggagttacatatatagcttattcatggagtggcatttttacagctataggatgaaaccagtatcatttgagcaattagagaaaaaaaatgtggtatattgacaattggccaagactgtagtagcatatacgagcaattagcctattcacgcattgaagggccaaagcccaagttgaaggtataacatgccctttcgttgtgttcatgcccagcgaatcaacaaaggatttagtctattcagtaatcctcaatctagtttacttatgcacaaaatttcctagtcgactaatttttctgaagaaagtaataacaccgaaatagatattgctgttcacatacatctatttttttttaaaaaaatgcaactataattttagttgtctttcttaatgtcctaagttaacttcgtaaatgctcaactaagcccaattttattataatagtagatgtacctcatatgctaccatacaaagcccgtaaactatgcatactccattttctttatatatcttatagaacatacattaaaattgttgtttcgttttgaaaaggaacctaaacttgacggatgaaagattttgaggaagagttaccagatctgcggacttctcaaaagagtagaggtcatgaacacttgtcctctgaataaatgcgcgtttaggtacttttccagtttgaacatagagcattgcagatttccttgtgcggaatgaataattattaacaggatccgtgaaatactgcacattcagcaagataattaaaaaactgaagtccatttgtaagtgaagaaaaatgattaagttatactccactacatatatataccgggtcttttctaattactccagtctttgtctttctaaatactacttccttcacccatccttctggcagtgaatgtggattaaattccacatttgcaagaatctaaaaacaagttcaatcattagtttcattcagaaaaatctatatattaatcattaaattctacaaattggtaaaataattaatagataagtgattagggcagatgttgcagcaagaagcacacgttgtctttggttcttgtgtcacattctccatttgtatcaaatccagtaatctcggacttattaatatatagcagtacatcctctttagaaaacagtcgaactccagctggtggataaacataaaactgcaaattgggcataattaaaggtgatcagaaaattttcactaacacgagaaaactattatattgtagaggaccttatattgtactcaaatgtaagatgatgtgtttatgatggaaaatatatttaaacccttgaagatatacaactaattatttcaacaatagttttctaaaagcgtcatcatagtttccagtcaatagaagcatcagcaattatgtgtacaggccaataatgcaaatggactgttacattttggcaatggcttttcagatttgccgttatattttctatactagtgaaacacccatgtgttgcaagggaattaaaattaatcactttgttactttataaaaagttaattgagaaaaatcatatttttatcaaaattcaatgtaatggatgttgctccatatgcctcatcgtttgatgtagagtggtagatgatggattcactaatttgaatttcaagtataagtgggtaggtgatggtggcgaatttaccaccactacagttgaggtcttctagtatagacataatttgtattaacgagggtacatgtccccctattttatagtacattcaaatgatccaccatgtcaagattttttactgtcacaccaaagacaagaataatacacagttggagagctcatttctgacctaattaatactacctactccctttctatcccaaaaaaaaaatctaattctaaggaagtatctgaaaatatataccttatccaaatacatccttaggatttgattttgttttttcgatggaggaagtgaagatggaaaatgataggtgggcctctatgggattttttttcccagccctggccagatataaaaaagtaagcgctatgtagttcaaaaccagttgagtttatatcaaggaataaaaaaccggtttacaaagagctgaggcatggttttgaagttatggagtgcttttaaaagtttacaggcgtaaaatgatgtttttcctttataatatgtcaagcttagatccttgttgaattccctatctcgcttctagcttattggattggcatcctagcactgtcatgaagaataatctaagatctgatgatgaatcactgcatttcaaactactaatgggcatagaacaattagaatacaactatattacaggacaaaataaaaggtaccttatacatcttgttcatgttctttccaccagctctaacctcgattatccagccttttggaagccattcatgtgtcatctgcatatatgtcatggtgggactcacatataccgaattattctatagacaaccaaaatcatgaatagcatattcatatatatatatatatatatatatatatatagaatcactcacaataagctggttatctgcagcacagttctttgattccaggaatcgctcatccatcccagagaaaaggtactgaagcacctctgacttcatggtgaaagtgagtcctgatataggagatgtgtagtactgcacacaaagatatttttgactaaatatcacaaatctcagggacgaaaataaagaatttatatttacagacaaaacttccacacacacatatatatcatccgtaaatctcttatgcatagttatatactatgaactttctagtaacaagatgcagtaaactcgcttttatcatacccggtagattgtgccatcgtcaccttggtagacctccattatccaaccatctggaagccatcctgggcgttcctcctcctcctccaaatcctctacatcttgctgaatctctttcttctcgtcatctgatatcactatcgatgttgatccggccacgcctaaacccttccaaacgcttggaccggccatgcctaatcctctccaaactctttctcctcccttcaccccctctctccctttctctccaacccacagagttgcttgtatataagaacggcaggatgggttgggcaacagatttagggtgctttatatatatgcagcgtacagaaaaatggctgccggccggcattaaatttgcacagctgcacgccagcaccttggaggatgtcatgtttacacctaaatatatggggtagtccagaaacagaaactgttcttttaattcgacaccttgcaaaattgtccatatcaacctaccataaagtgagtaaaattgcagcagtgcatattagtgataagtataacacttatcctgacttcgagttctagtcggcatcttcggaatggttacttactcagttctccgtaatggcattttctgaactgctaaacaatgaattctatgcaaaaattttatatattaattaatttttagagacagtttcataatagaatctcctgcactcaaaattcattgtttaaaatagacgtgagaacttataataaattttagtttttaacctatctcaaataaaaaaaatcagctagatctcttctgtgggcaataattttcatacaagtctgttctcatccaattccatataaaaagttttatatgcagaagttccataaaaatcaaataaaactattttttaattttgtaataatcaatactcgattaatcataaacaaatagctttgtctcgttcgcatgtcaaaaatatccaatcccaaatactggtttttcttatgtgcattgcatcctagttgccacaatcatgcatatgaattcacttagagcttaatggaaactcataaattgaaatctaacaggaactagtggcggacacacgatttcgacaatggaggtacgaagttacagagtacggactacgtagataatacaaaggaaactagatcgacgataaaaatgaactcaaatcactaataagcactcaatccaagcagcagacatgcatatatttggcaatgtatatcttaatcccaatacgcaacatgtagtgaataatttgtagtgaacaataaacaaatgtataatagaaaacacaactaaccattgcttcgttggaagtggcaccggcgatagatgtggcgacgacagggatgttgggctagggtcatgggaggcggcgagtggagctagtgtgccgactagaggagctaagtcgccatcgtgctgtggatctggagcggcatgcaagcgtgtcgtctcctgcccccgacgacttgttcgaccgccgccgccgctcatggcattgctcccgagtcccgactcctaaaccggtaagagaacaaataagaggggaggggaatagggtttagccggaaagggagatcgagatatgcgcacatgggcaagtgggccgccaattaggatggttggattgctattctccaaggcctataaatgattaatttggccgatataaattcatatagttatttatttgcaaaataatttgggaaacgactatacccccatgtccgcccctagcgggaaccccctcccctgccctatccaatcaattttaaaccgtagttttgcggcacaagatatttttgaggggcatttgaaacattgtaaaaattcgaatgacttatctagaagccagctagaaaacgttccacttttatggacaaagctaacccagtttaaatccatccaagttttctttttttattcaatgcccccttatctgtgttcacaatgcacaacacattccacagcctctctcactgaccagctggtccaaatgtccagggtggcctagctggatgctcaacacccttctcccacccacttgacatgtagtatgaattgtgaatgcagtgccttgcatattttgcatggagttattttattctataaacataatacacaagtatatctgtttccaacaaatctgcaccttaaatgctaaccggcaatgacagcacgcagccagatccgcacgatcgggtcaacctattgcgatcttgtccatgtgattttgggcctttccttttttacaaattgtttgatgggctctgagcctttcctttttttgcatattaatgtttgatgggcttcggacctttccttttttgcaaattatttgataggtttattgccatctggttttcctttattagcaaatctaccatattccttttccatagatttgatctggcctttcatttttattaggccttttttccagcctacatgtccaatatttctagaaatatagataaaaaaaattctatgataaactttatacgtataaattttgtatagaagactagtccggaaaagagtattctagcctaacacaagaggaaatgccatcgaccagggcagataaagcttgaaggttatgtcgttgagcgaggaatattctccaagaagatactgcggggaccagtccaaccacccctgcaaactggcgtcaggtccttcggaggaccacacaaatgtacaaccatacccataagatttctagctttagaggggtattttagtaatttcttatctacccttggaggtaggatcgtacatgtacctctgaaggctattaagccgttcccacgagatttgaaatatcaaaataccatacgacacacaggactttgctcttcgagctcatctcacttttatggtaggtgaggaaaatagtactttcccacctattcatgatttgtccgtgaccaagatcaggagagtttgcatgaagaatgacagatgtggtattttcagaacaaaaaagctatcacctgtggtgttaagcgaaataggaaaatttccgtggtattttttgaatttggcttctgaacggtgctatgaaccaaatttttctcaagacaagccgcccctagactcattaattaataagatgggagaaataattttacaaacttttatgctggctgcaccaaccaacagggggttaatttacactgatcatctctcctctgttaccttgacatacttgtttgaatggtgaaagcaaaatgtcataacacttgtacgaacactatttttacatacgggtgatacgcgaattgtacacgagtttagcgaatcgcatgtgatttagggtctacagaaatcagcaattacaaatgtggatttgcctctaccagagttggcatgtttcgaaacataacattagtgaatgaccatactataaagaaaatattttcagaaaatattgagctgaccatattagaaaatattgtaagtatcttacaaacttgagagaatctatttcataccattgagtttgtcacggttctacaatttaccatcgagtttatccacttctattatatgccatcaagtttgtaatttcttttacaattaaccattaccgttagttagtgtgccgtttgtgcttttgaaaagacaaaattgcccataacccatgcgacatgccctttgctcgttcttcacccgtgcagcaaactgtctccggctaggcggccctggcgttagcacgccaccaacttcgtgctcctcgacgtcatgctcgtttcgttcgccggcgagacgtggcgttccacgaagccagagaccccacgtacacgagcagggcgcaggtgcaacatgcatggcaggcggcagggtgactgaagaatgccaattcttcatttcttcgtgggctaacgcataacagcagtccggccggtactccggtaggcactaggcagtagccacccaagcccagcccccaaggctgtgggcatgcgtagcagccagcaagctagctgctctgcttctcagttcagggaatcagggttagttagctagtgaggtgctccgctccacctaagtctgtttaacatgttgttgcttttgttcttttatgtcaaaaaattcggtagcaacatattgtggattcatgcgaccaacaagaagcttagcagtggtggttagcagcagcaacgaaattgattcataactggtactgtagcagcagcagcgctactatggagtacttcctcgttctctcgaatcaaaagaggtgaacattcaataatctgttgtagaagaaatagtatgagagcatttgtgtcatttttgaaaatactaacttgacaaactgacagtgatggtaaatcatagaagaaagttgaaacatgatggcatatagtagaagtggacaaactcggtggtaaaatatagaaccataacaaactcaatggtatgaaatagattatactttgattgacctcaatcggagtgaaaacgaattttcagattttgaggattttcaaataataataataacattccacttgaagacttttaaagtttaatatattaattaatttttagagacagtttcttaatagaatctcatgcactcaacattcgttgtttaaaatagatgtgagaacttataagaaatttttagttcttaacctatcccaaataaaaaaatcagctagatctcttatgtgggcaataattttcatacaagtctgttctcatccaattccatataaaagttttatatgtagaagttccttaaaaatcaaataaatctattttttaagtttgtaaaaattaaaactcgattaatcatacacaaatagctcatctcgtttcgcatgtcaaaaaaatccaatcccaagtactggtttttcttatgtgcattgcatcctagttgccacaatcatgcatttgaattcacttagagcttaatggaaactcataaattgaaatctaacaggaactagtggcggacacacgattttgacaatgggggtacgaagttacagagtacggactacgtagataa

SEQ ID NO: 76632 - DNA, 1416 bp, Oryza sativa
atccctcaactccaaaatcaggtaacctatccctcaactcttaaaaccggagagaattagtctattcaactgtttggcaattgtttcacgcacataagcacattgcacacaggatctgagggggtcaaaacctatttttagcaggatgagaatggaaccatgctaagagttgagggatgagagtgagactttttgtacagataatgatacaacagctttaaaaagagcaaactcatactggcacccaagtattgatgtatgacaaaacttatattcattgcactataaatggaatgccctcgggatgtctctctccttggatccagttttttattgaactattagatggtgaaaacttacttaaatgtcctggtagtctacacatccattcaacatagagcctcattctgatcaacattgaattaacttatttaatttcagtgttacctgcttggatgatgcatcatactcttcctgccaaccattgccaattttgtcaattgatgaaaccttcctgtacttgcttttaagttcaaccaaaggcatttcccttgagaaaaagagaaggatgaagtagttaaaaattgtcaaccaatcaccagtacataatgcatttaataacaagcaacaaataaaagctatgctttttgcataggatggatctctatgaagaaatgaaagtatttattgttccatccctagtcaaaagatgttttagaatgcttgccgagttgcagtcaaactcaataatatatgccaaaatactagatttttttaaccttcatataatatgtggaaatgacatcagtagacttgtcatccaaaataatttcacataggtaatatctttaatatattctatgaatttatgattacaaaaaggcaatgataaacatgttcattggacactgtggaaagggtaaaacgatgaatcaagtaccttaaagcttctccaacagcaggacggattactctgtacattccttctgttgagctggtgaagtaacaaagattcagatcatttatatatcgcaccaagcatccatgaatttttttatatttgttgtcaaccaaggaacaaatgaaaaacataatgaacaatatacaaggcctgtttattccaactaatatactaaactttagatattcagctaaaccactaaaacagatgaatttcatctttcatgaacatactctttccgacctatgatacgagggattttggctatgcaaatgaatagccaaaatgaattgttttatgggacagaggaagtaactattaactactacctctgtcccaaaatataagaactttcaaggttggacacaggtgttaaggaattagttggaatgaaataggggaaggttatgattggttgagaagaggaaataggtggagaaattaaatggggaaag

SEQ ID NO: 76633 - DNA, 1224 bp, Oryza sativa
  unsure (1)..(1224): unsure at all n locations
cgcgtgtttccggggagtaaagagttgtcgtctgggccccacatgtcagtagtactggttgtccgctacgaggggatgacatgtggggtcactgatgagtttcacttgggttcagtttgctagtgccacgtgccaaggataggggcttttccgtcgggatccgcttctatcggcgagtgtcacccccgtctcttgatcgtcttcccgtcaacgtagcactagctcgcggttaaatttggcaaatcaaccgcttgatgatagatacgagcccggaatttgacgaccaaatgcccaaaatttcacgaaacatcgtcacacggacacgtacgtagtgcaaaatcacatggcaaccaaaaaattaccctggcaaaaatgggtgaaaatttttagcgtgtcacatcagatatactgacacatatttaaagtattaaacgtagtctaataacaaaataaattacataatccacatgtaaactgcgagatgaatttattaagcctaattaatatatcattagcaaatatttactgtaacaccacattgttaaatcatggaacaatttggtttaaaagattcgtctcgcaatttatacacaaactgtgtaattagtttttttcgtctaatatttaatacttcgtacatgccttaaaaaaaatttatcggtggatctaaacaccccccccccccctttccccaatcaaacaggccatggctggtggtgctgatatatcgacagaaacatgccatgccatgacaatgcggaatgcatcagcctctgcctgcaccagacatttctgctctgtgactctgtccgagtgaagaagacgacgacgacgctaaaaagcaagtgccacatctgctggctagatgccgctacattttactgttgcgtttggtgttggtgcccgtggtgggccccatcttcttggcgatattccggagcacgtacttctggatcttcccggtggacgtcttcggtaactcgtcgcggaagatcaccgtctttgggaccatgtaccgcggcatgcgctcccggatacacgcgaccacgtncgtcgccgtnaccgcgccgccgccctgcttgaggctgacgaacgcgcacggggtctccccccagaactcgttcggcggcgccaccaccgccgcctcgttcaccgccgggtggccgtacagcacggactccacctccacgctgctgatgttctccccgccgctgatgatcacgt

SEQ ID NO: 76634 - DNA, 3918 bp, Oryza sativa
ttcacccttgatccaatccactcttgtgagccatgtgtaagttttgagtgtggatgtcgaggcaatgaaatgactttgacaaattaaacttcaaaatgttgcttacacgggaggcccacatgtaagtggaaataagcttctttgttatctattagcttcctttctaaccttctctcctctccccacttcaatgagtctcccctgtacaaactgtttgccgggcacttgtgttggacgcactagatcagccagtggtccagcctgggagactttgtcatgctgtaggcatacctctagtcgaaacacacttttcagaacctcaaaaaggatctcaacttcttgattcaattttggttcttggaattagtatctgctgagatgcaactcgtgatgagcattttttttttgtttttttctttgggctctcctttttgttcagtattcgaaaattttagttttctaacagtgcaaaccaaaattcatgtcgaggaaataaaccacactaaaaatacaaattggttcagtttgcggttaaaaccatatattgatgttagcaattcatcagttctgcaaagaaatgagaagaggatgaggagagatggggtgaggatgacatgtccatggggatccaataatttttttcattctgttttctgagtatttgccattccaacaaaaccactgataagtcataaaagatcaccataatttgtctggggggaaaatgcacagttttaatagtaaaaaggttgtgtagtagacattttaagttaagttttgataaatgaacttattcacagtttaataataatgtttgccatcctttacaagctatggtaacctttctcaggtgctcttgagaaaggtggtgtgggtgctcttgaacttgttgctatggacatgaaagccaggttagctcttcctggaacttctcggtggttcggttctaccttttacacacatcgtagttgacatgaagagcccttatgcattgggtgtatatacaaattgctctttctgtacataggtaagccaattacctcgttgatacatttcctcttctaataatgattggtatacctcttgttcaacttgtcccaggggtatgtatgtttgcagaacgctaagttataagggtgctgcttttgctaccgtggaagctcctctagaggaaagaatgatggtaagattgatgctccttattttctgcttttattttggtggtatgattagtttactttgaaccattttaaaaatctttatagtttacaatgtgatttcacataacattaaaaaccaatgttatgtttagccttttctaatcattttttgtgtagtgctggtgttgatttttatttcacattttgttatctcatgatgcagaatatgtataggaaagcagctgaattttgggccgagttgcgtgttgaactcctttcagcaattgaatattatgcagaagacaagggcaattcatctcagatttggcggttatactgggccagccatcaggtggttctctttcattttacgtaacaatatgtttataaccataacaccctagccaattatgagattatggttccccagaaatcatattgcttccttttggtataatatatgatctttgattggggattaaattctgattcagtggatttgaacatggcaatttgtttgaccttctgaaaaactactacatatgattaataactaaataacagtatgctatgtatatatatttttgcagcgtttctttaggcatatgtgtatgtcggctaaagtacctgctgttgtgagattagtgaaagaagccttagcagaagaaaaatgtgtggtgattggtcttcaaagcactggagaagctcgaacagaggaagctatcagtaaatatgtgtgtttttcatgcatagcactttcatcctgtatacctaaagagtgaacttcacaatactacaacttttttttttttgtcaaaaccatctcttcgctgcaactttagccagacatttcacaaaactgcaatcatagcacaatattttgtcagaaaatcaccactgtcccttgtgtgtatttaacatgagtgtccaacttgtagaagtgagtctgactagtgggcctgacctatcggacaggccctttctgacgaagttgcagttattttttggttaaatcatcagttgacttttctgttttctgaaatgttcaacaaaaattgcagcaaaccgatggttttgatgaccaaaatagttgcaattcagtgaaatttactctattctaaaacctattttggtgaattgattcttggaattattttcctgtttactgaatgaatgtggtagggtgttgaaatggaagactttgtttctggtccaagggagttgcttcttaagctggtagatgacaattatcctttgcctccgaaacctgattgctttcaacaaggtttgcatctagacaaactttgtagatggatcaaaatgctaatattttggtgtttgggaagctggcctccaatctaaacaaacatagcatgtatttgtcatgtagaacttgtgtttgattggctggtaattaaagcatttctaattttttgttgtttcttatttatgcatgctgtagtaggtgatgaaaaagttgcagaggttcagcgtaagcggcactatggacctgatgtatgctttaaaggacaagctaggaaactcgcaaaaatggaagatgaaagtgatgatggaactgatgaatattctctacgtaggtttcttgagaacttttgttaatgcttgctaaatgcatgatatttatgtggcaaaagcagttatatttcccaatcttttaataactacttggaggttggaatcatcttttcgggttccatgacatcaaaagtcttagtgggattggtgaagattacctagccatctagaacccatagtatagcacaactagctggcatttagtgggtgatctcaacaaaattttgacataaatcagtgaaaatttcagagtttgtaaatatgccattattattcacctatttttaaccatgtcatcacaatttcataagtattggagatatgccactacgtaccccttcacaacattttctaaccttttttaggaccaaattacccctttcttctaccttcatccccttcttccttcccctctctactattttctagctccaactaacgagttctcgcgactgcaccaacagcgaggactgcaacgcagcctaatctcccagtacacagtcgcaactcacaagcagcatcgcatcggtgcgctccattcacaaagctaccaaaaatgcatagttaccttcaaaaataactactcccattatatgtagtggctatctctcttaacttatcttacatgtattggtatctctcataactccttatcattctttcttttacttaaatgttaatttgcactaatatttttctcataatcaaatacataatcaactgctttttcctagttctccactacggtgagcactggaaaatacagtgtaagattcaaaaattatagtataaatatatggaatttaaagtataagatatagcatagtataagatttaacctttttccttgaaaaatatgacaacagaaatatagctagccattattaaatattggttatccatgcaagcatactaccatcgaaaatatcagtcaaatctgccattcacaaatatagacatttcttcttgctacgcatgtagagaaatacttccttcatttcatattataagttgtttgactttttttaagttaaaattctttagttttgaccaaatttatagaaaaagcaataacatctatgacaccatattagtgtcattacattttacattgaatatattttgataatatttttgttttatatttaaaatattaatatat

SEQ ID NO: 76635 - DNA, 744 bp, Oryza sativa
cagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcggccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtattcccattcaccagctcctacatttaattaacaagagaactattgtatttatctaacacctggattatctccacctttcatttgatccctatttatagattacgctgcgttgctaacgggccgcacctcctatttc

SEQ ID NO: 76636 - DNA, 851 bp, Oryza sativa
agccaagttttggtcaaagtagaatgggtccccacccaaaagaagggtaggtagaaatggtatatgtggtatccccttgagatataaaagaaggcccatgcctaccaagagaggggactgacggactaacagactggagggagctgaaaaagaagaaagaggagagcagaggtcgtagagagaaagagtgagagggtctctagagtttgaactcttttgatctccagctccttgtagctccttcgtacacagatccaccagaacacaggagtagggtattacgcttctcagcggcccgaacctgtctacatcgcccgtgtcttgcgcatttgctctctcgcgaaacattccacagatcgagggcttagaacctcacctagcgcccccggccgaaccggcaaaggggggcccgcgcggtctcccggtgaggagccccaacggtccgtcatctggcgcgccaggtagggggcgcgtgtgtttttctaagctctcgtcctctttcgtgtgcgccaagcttctcccgttcagcccaatggccgaacgggcagtggcgcacaacctctctccgagcgctagcggtgacgacggggagcagaacccgcgccgtcgagctcgtactccaccgcccccctctcgccgaagtcttaggcgggaggaggcgctcgagggggttgaaagatccgcgacttcgccgcccacgagcgatggagaaggacggcgagacggggagcatcgcctcctcgtctacggcgatggtagcacgccccagggcgcgctccaagctgcgggcgcgctcttgcgtcacccgcccgtcgtccccgatccagagactccagcccgacgttggctgg

SEQ ID NO: 76637 - DNA, 716 bp, Oryza sativa
cccactgaggaaggtggagggggtgggtgaaaagtgtccagacctgtgatgacatcagacagcctctgagctactgcagagaccccctatacctatggaccacttgatttggtgacattttcaaaatatatccaaaatctgactatttctcaccacccccagcactgccatgtgccccaggccaccacctcctctccccacagggctccccgctgctgctgtggcccctcccaggctattctccacatggtagccaaagtgaacttctatgaacttctacaaacagatcatgcaactcctcccccagaaacccccaagccttctcttcccactctgtgaaatggccaaagcctttaccacatggatgaagtcctctaagacctgggcctcgccgacttcactgacctcaccttgcaccactcccattgcctggaagcccctcaaagacacagagcacactcccttccgtgggatttgcacttgaagttccctctgcctggaacttgcctgtcttcctcctttgcttccttcaggtctctgctcacatgtcatgctattatcaaggacgtccctgacaccctgtatgacagcactgtcctgcagaaccatctatgatatggaaatgcgtcataacctgagcttccaatacagtagccactggctacacgtggctactgagcacttaaaatgcagctagtgtgctggggaactgaatt

SEQ ID NO: 76638 - DNA, 1567 bp, Oryza sativa
tcaatgtctacatgtcaatgctgtctacctccgtacggatgcgcctcgtcgattcagtgaaatagaaagaacaaaaattaagatgaagaatgcacagtcatatattaatacacgttgagaaaatacaattaggctgcgtttgactgttgcggttaggaacaaatccctcttaaacgcgtaaaacagagcgatccatcaatatgtgattaattaattattagcatttttttaaaaaatagattgatatgattttttaaaacaattttcgcgcgcgtgtatatacatatacatatatatacacacaccgtttagttgtttgaaaaactcgtcaggttctgatttactgtgtaggaggaatccaattcggttgcggttcgtgcagactgagactcaaaatccgactccgacggctggggctgtttgtactcggcttcgttcttcctgcccatgcactcttcgcctacataagagatagatagccacaggactaatttcttcaccaacaaacatcgatctgatccagcgaacgtgtgcgtggaattcacacagcttttttggtgctcagagtacggtatttttggtattttgatggatccgctcccttttccctgcctcgccctgtacgaagacgcggacacgccaaagccgacattcttcgacatattcgaggaggcgaagatcgagtgcgccatcgacagcctgaccaacaacaagaaaaaactatggtagacgcctcagggatggatcctagtccgcgacgccgccgccgccaccacgttcctgcagaatcctcgtgatcccggcgacaagattcacctgccacatctgcccgaggacctgccgagcaagtccacctgcgtcctctccggcaagccgacgatccctggttgcgtcgcgctgctcgtcgagccattcgccaccgtcatctggtaccttcacgtcggcgaggaagacggcgagtggacgaggcacgagtacgacatcggaacgcagccactggacccgcccatcgacggcgaggaccacgagaaggtgccgatatgctcgatcgccgcttgccggggcaagttctacttcaacggtacactctccgacatcggcgtgctcgagttctctccctccgccgctgcgacatcgacatcgccggtgttcagctccctcgagctcgccggagagttcgaggtcgtgtacagggcgaaggtattcctagtggaatccggcgaggatctgtacatggttatgctggtgtaccgcggctttcgctgcgacaagacgggctacgagacccgggtctacaggatggatttctccgagcagccgccgcggtggcgcacgggcgggtgacctcgccgtcggcgcgttcttgctgtctccgtggtatttcggcgcgacgtgttcggcccgtgagcttgggctgcacgaggattgtgtctacgcgttcgttcctggggatgatgaggtgcctacgtgcttgaagatgtccagcgtgaaagatggatgggatgatttcgttgatgttccagcggtacacagggcattgtggattctgcccactgatccatatata

SEQ ID NO: 76639 - DNA, 862 bp, Oryza sativa
caattgtatctattaattaggatatcttatgtaatttccttagagatatgtttggccaaaagtctgccgcaaagacttatggtatcttagagtttgttagagataagagtcgtgtccggcaaggacatattttgtatctcgggtataaatataacccgtacccatgtaatcaaatgacacacgttcaataacactttcggcacatcgccaccctttttactttcgttctatttcgacgagttcttacttttgggttgagctgcatcgattcgatcttcaactagaggtaaacttgtcatgacggtttgtgttctcgggattagtgcttccatctttatgacactataatcttgtttatgtaattcgtcgagttatcatatatgttttataatctctgttagtttcgttatataacttgccatcggctggtttttactattagaaagtagccgatagggttagatctcgttattaatctagattatatcgtatctctaccatctcttagaggttttcatcatcttgtttagatcttacagttatctttatgattaatgctgcatcagatgagtttgatctattaagttttatctataattgtgatatctagcttgttttatgataacccataaagatagtatcggagtttcagccgatcttacctgatttagctattctgatcttatatgcttgactgctatgctaaatttgccctttatattaagatcttgctacattaaagatagagaaaatcccctgtgtacccataaaagttcacctaatcccttttatacccctgaattttgctgaatcccttacatacccctgaattttagtttggatcccttccatgccctttccg

SEQ ID NO: 76640 - DNA, 1219 bp, Oryza sativa
accactcgctgaatggtagctgcatcatgagctcgatcatagcggaggaactgtcattctctgaattttctgcatctctaaacatgcctctgaacacttcgagtttgtgacttgtgagctctttggctttaccactgacctcttcaccaacagtgcgccacttgtgctgcacttgcaagcgcgcacaagttacacaacgagtgtccgtttcagatcagatccaaactgtccatggatccagcggccggtcaaatcgaatgcacatgcacatgcaaaacggatcttcagacagaatcatgggctcatggcctcatcatcatcgttctcttaattaacttgggttaaaatttttatctctctcgcaagaatgtcccccctaagagaagaaagatatttagggtatccttgtttgctccaaaaagaattagtcgtcactaaaatttgagttttaaacataaatttggagttaattttaaggtattttgaacatagtttctttttaacattgattattaaatcgctaaggacacatcatatacaattctttatttacaaattattttttactaataaattatttttgatttataatcagcatttgatcaacacataaaggcctgtttggggagtttgctgtagcttctcccagaatcagaatctttcccaaacagtataacttttgtttcagattttgagaagctgtagttgtagaagctagaaaataaactagaagttagaagctgaaaaaccagattctcaaaggctggctaacaacagcttgtgtagaattaaatgtccttttcgaaccacacgtaccatgcctccatttgaatgcaagtgcaactatgcatgttcatgtgaagagatgcatttctctatgagtagttgtatcatttttgttttcttgtgagatgccaatcaataacaaaatcgcagtacaaatatttgctggattactgttcactactcccatcacggcacactgattcacagcacacagtacaccatcgccaagctggcaggcccgggcccaccacccccctccctccctccctgcctcctctatttgagagagccggaggggttagcgggttacagttgtagatgcacccctggaaaacccaggtaattacgaactagtccttctccagcccggcgacgcgggggaattttacagataagccctcggattccttccccctattctccgctcctcgcg

SEQ ID NO: 76641 - DNA, 647 bp, Oryza sativa
cttctgatgagctcaacgattgcctggaattgctcgatgctgcaagggatccttaaaacgccctcctgttcatgcccaaactccattgctgccagctccagcaacacaaagaagtaagggtggtgaagctcctccatgtggatcactaccctcttcatctcctccccctcgccgacgagcaccgggatgcgccctcgatgaactgagaagatctcccccatcctccctacctaatgtttcttagttggagaaatggtgatgcaccttgatcctcccttgcttatatataagcaaaggtttttcaagttgcaaacttgcaatgcagatgatttcagtgggtgatcttactggtttggccccatgaaaccattttttttatattgtcctatgcatttgtcttctggttaccatcatgtagtagctgttgaatgaatgagagtaggatctaccaaacaatatgaaagattgacaattgctgaaaacaatgggactaaatgcaaactaaagtaatcatatggtcattttcatgcactttaaaaggagtagtttatatagagtcggagagcaacgactaatgtgacaaagtacatcctgtacggatattctagatgactccattatccctgaactcctgaagatatgatcaa

SEQ ID NO: 76642 - DNA, 508 bp, Oryza sativa
actggcatatacatcaagtgatgggctcgatcggaatgggaggtgtcgagaaaatatctttgaccttggggatttcgaattgcatccgctccatacagtttttgcgcatagtatagctcatcggcataggacctcattgttacactcatcctaagccccttagtaacgcctaagggtcttatggctagctttacaaaatggtgggctagctgatctaggttcgaagtctcaccccctctaattatttattattataggtcataccctaatattcgtgtttgggagcctccatgcaacaactgttcatgtggctggtgaactaacgttgaagttgaaatacggcttctgactattttgaatatggtttgtccaatttccgtttggttcgtccattagatagttttcgctggcacctccggttttcttatccaggagtgtaaagttttaacgtgtcacatcgggtattatatagggtatcgtatagagtgtttggatactaataaaaaaa

SEQ ID NO: 76643 - DNA, 14460 bp, Oryza sativa
  unsure (1)..(14460): unsure at all n locations
ggaggggctgtgcgcggcgcctccaccaactcctccgcggtacgccaccgacgatgccaacgccgctcccctccgccggatctaggaggggagggcaagaaggggagggagccagagagaaagggaggggccgcgcgcacggcgcctcctccgctgatggtgtgcatgcgccacctcattcgccaccgtcgccgtgccgccacctacgcctctcccctccgccggatctaggagtggagggaaggaaggagagggagccggagggagaggaaggggccgcgcgagcggcacctcctccgccgacggcgcgcgtgcgccgcctcctccacctccggcgccgcctccgttcggtggtggacggcgccgaagccatttctagtagagggagagccggaggagaagaaaaaaaagggagggagagaagtggaggaaaaagtgagggagaggggaggcacggaactggaaatcaaatttaaaagtggtgtcacattttgcagacggaccgtgaaaatcatttttttcagatgggtccgcctgcaaaaatgaaggtagttttctactcagatctcttaagtcgtctggctggaaaaattaaatttcgcaggtggatgacggtctcatccccggttacctttttgtaggcggctgtttagctccgaggggcctacttgccttgaaaaaaaaacccacgtctagaaaaaatggtttttctagtagtgatcacatgcgggcagaaccatctccagagaagcgattttgtagtattgtttgtcagcttaaccattattgcattttggtttttcggtccgttacaacacatcgacacactttgctagtaattacaatattgaaaaaaatattttcaaatattgataacaatgttacaaatgcagcatgcatgcgatatccatgcgcatcacgcacttattacatatatatcatgggaattatccaaaatataaataaaaaaaatttagtggaaggtatatatagctaagattgaagggatgatcgatcgatcaatcatggctttatggcattgaggaggcggatggctgtggtcgtgagcaggtctatgacccaaacggtgggaaccttcttgtcaccgtacttgaacagatcacctaacttgcacttgctcgcggtctcatcgtattgggtctccaaattcttggtccacttgtgcacagtttccaggtcctccttactgcgtttaccttctccggcggcagtgaggcgctcgagcgcgtatagcgtcgagttggtggtgtccgaaaaggtttcgccaatggcaaagaaagacccgcagttattgatgttttcgtccctgatgcccatgtctcttatcgcgtacgcctcactagtgagggcttggatcttggtgactaagatgatggtggccacctgggtgtaggataatacaagtgagcaatctccgtatccgcataaaaacttgattactgctagtttcatttctcacatggtaattaatgtaatccttgaaagaaaaaagaatatgaacgagaagtggaataagcgggcaaaagaatatcccgcttaccatatagagacacacacacctatatacctacctgagtggccttcacttggttgcccttgaatgactcgccatacgggatgagtacatcgtagcagcgggcaccgatcatctgttccgtgaaggtgctagttccaaaatcgcagacttgttgggtgaaccggtacgcctccgttgagggttccttcccaggcggcaacggcggtggcagctcaaggttgagtttatgaagttccccctctggcgctgcagttgcaccttgtggggataagcagacgacgttgatggctatcaacaccaccaggaagacagcggccatgctcgacctgctcattgtatttatatgcgctctctctgatctctctccctctcagtttgattagaagctacaggatggattagtgcatctatatgatcaatcgatgaggtacaaattaatttatactagctagctaggctagctcgatcgattggtcagtactaattgtcaacctttctaatttcttcaatggctgtgatagcatcacggcatgcttgcattcattttgatacaactagctggtgatccgtgatcctctatgcgtttctaatggcatacatcagctattctaaaaatagccatgcaggggcaggcaacgcggccagcacacatgtggcaaggccgctagcgcaaccaacaccggcacgtaccctttaaacctggtacagttgggctggaaaaggccggagttgggctgcagctagcacctgttgatcaacccactatgaaaagagtccacgcaaattgaacaatgcatgttctgataagctcagtctgaattataaccccacctatccccgtgtttccgtcgcattccgtctcagaaaatatttatcccagtgtttcgcactagtaaaaaagggggaagtcattgccggttcatcactgcctacccgtagtgtcgatcatgccctgaaaaactcacttgataaatggaataatagaaattattagaagccattgaagaaaattcaaaaaataaatacgtccaagaaaaatcgaaattttcttccccgaaatttacgtcaattttgggagcacaataaatccctatctctactacttaaaaatacactacatacagtgtaattttacaaaattacatagttaaattatgcattgcgtttcaaaaaaaaaagaggaaattatagtgtagttatagtttaattatgcaatgtctaaacttagtaccgtgcttcatgtaataggttttctatgctttattgatgctaatttagtgttaatcatactgattgttcgcaaaattattgtttgtttgcaaagacactcacagctgttctatcctgtgatgctgtgttgtttttcagaagaaggatgacgcaaatgaacttttaatagctcttaaagctgagaaagaggaactagaagcagcacttaacagggagcaagtgcaaactatgcatcttaaagaagagattgctgaagcagaggctagaaatgcagagctgacgaaggtgagcctcctgccctccttgtacatattttagttgttctacttctgctcctagtggctcttttcctgcataatctttcaattatgcaatgaaactatttttacagattcttctgcattaaattattattgttacattttcatttgttttgtaatctgctatgtaacctatagtctgagtagtacacaaatcctatggcactatttaacacatgcactaggattgagcttaccctttactgaaagtgtgtgatgttcattgctagcggtatgtattatcactgtttctaacatgtcttggtcctggcatatagggaaaatatgtagtgcaaaccacatatgtagtggaaatctggaaactaccgttggataaaaaaaatgaacgcatgagatttgtctatgtcaccaagagtcatggttgaatctaggagtaaaacttttattctaggcaacttggacaaatctcatgtgtccaacaatagttttccagaaatgctatttgacggaatcccgtcccaaccgtgatggacgggataggacaacaaccaacaaatccaccgattctatctccttctacctcatccattctaccacatctctcttaaagcatgcgtactgctgcacgagctccggcacagcatggggtgtggatggcggagacgcgtcgccaacgacgagctccggtgtgaccactggcgacgagctcccggcgtgacatggctgtggatgatggaggacgcagccttcggcgacgagctccggtgtgatgtggcgcgtggacatcggaggacgtggccccaagcgatgagcctggcatggggcgtgagggcggcggaatcgaccgccagcaacaagcctggtgtggggcgtggcagtgaaggacgaggctaccggcgacgagctccgacgtggggcgtggacgacgcagaacgcggccgccggcgacgacctccgacatgaggcaaggggcgtggagggtgtggccaccaacgacgacgcttcggttctcagcttcttatacctggtaggaatcacctgatatctggtaggtatcatgtaatacctcacttgtatcacccgttacgtggtagaaatcatctgatacctgataggtatcacatgatacctcactagtatcatctgaaacgtggtaggaatagtcaaatacttgataggtatcacttgataccggttagatttcaggacatgataccttagaggtatcaggacctaatacctaacaagtattatcccgttcgaaaacgggattccgttgtataacaaccctctagttttcagatttccactatgtatatggtttacactatacattttccctagcacaaagtggaaggttttcaacttttcacttcaatctcattcaaaagtatggtttcccaaatttcaggagctatgtagtcaatatcatcatatcatttgatggaggtgtttcaacggttcaaatggagccgcatctttctgatgaatgcgattgataaaagggatagaaagcatatgaattaaagaattcagttagacatcacatacggaaatctatatccgtacgcatgaaggcaaagcaaaaaaaaaatcaactctctttgagtgtgtgttagaaggcgtatctgtgaatgtgtaagtatggtgtatgtatatagtggtggtagcgtattgtgttaacgaccaaatttggtaagatatgaaccaggttcgacattggaatcaaagcggattcggcaaagagatggattcgaagaacagagtatgtatcagctgcgagggcatcggctggagtatgcattggctgagatgggatcggacagaagacaggtgatacaaccgatagagatgatgcagccgattcttatggtgatggcttcaaggctgtttgtagaatcaatcaacgtgcttcacaaggattgccacgatggagataaagctctcaaaaaggcaattgtatctattaattaggatattttctataatttccttagagatatgtttgggaaaaagtatgccgcaaagacttatggtatcttagaatttgttagagataagagtcgtgtccgagaaggacatattttgtatctcgggtataaatatgacccgaacccaatgtaatcaataacacacattcaataacactttcgtcgcatcgccacccttttactttcgttctatttcgatgagttcttgctttcaggttgagctgcatcgattcgatcttcaactagaggtaaacttgtcatgacggcttgcgttctcgggactagtgcttccatcttcatgatactctaatcttgtttatgtaattcgtcgagttatcatatatacgttataatctctgtaagttatgctatataacttgccatcgattgattcttactgttagaaagtagccgatagagttatatctcgttattaacctagattatatcgtatatccaccatctcttataggttttcatcaacttgtttagatctcatggttgtctttacgcttaatgctgcatcggttgagttcgatcaattaagttttatctataactgtgatatctagcctgttttatgattatcgagagagatagtatcggagtttcagctgatcttacctgatttagctattttttatatatcatatgtttgattgatatgttaaatctgccctttatattaagatcttattgcattaagaaatattagacttcttgtttgatatattctgcttgttttgatatcttagtatagagtggtatccgagtattagtcgatacatgccagatctatctgatcggctatgctataaacatttatataattattgctttagtgtatacttcgacttaagtgatttatactgtctcggcgtggcgaccgatctatcccaatcacttagtttaaatatacatcgaaggaaggattatatatccttaatatctacagccgatcgaatagatttagttttatcttatttatttataacagccgatcgatttcaatatgacattggcttgaagataaatgatatgtcatcggcaactagccgatcggctatcatttatggatttaactatggttttcttgtctttctttcttgttgattgcaggatcaaatcaactggcacgctcacgaacctaaaagcaagattttggacgtgcactgaagttaagcagattttctaggccagtgtgtgtttttcgcatcaacacgtatgtatccgtgaatgtgtaagtatggtatacaaaacctctatgtaattaaaaaaatatagagaatttgtttgggtagaagctaactttttttaccataacctaacttgctaaaagtatgataaatcacacatagtatagccaaaaaattgttggcccgtatagcaatatttagctacaaaattatcctatgaccctatctagggaagctttaaaattatgaatacagcttatgagaatttagagatgttggtttctcagcttctggtttttatttttataactatttttagaatctaaactacaatcaagactgatcgagagaagttttgataaatgaaagattctaacaaaatgttacccgcttcaagctggagttacatctccctatcaaatttctaaaacttctcttattccctcttgtcattataattaatgttctaaaacttcccttattccctcttgtcgttatattaaattgtgctattctcatttgtgagcaaagagcagcaactgttctttgttccttatttctgttaatttattatgcaatcttttttttgcaccatacacctcaaattactttatacttcgtatatgcttttaactaacactatgcagatgtaagccaacgcggcgaaaagccacgcttgtacttctagtgatattatcagactaaccaatgactgctatggagatttttgaatttgtgaacgatgtagcactggtggagaaaccctttgtagtcccggttcgtaacccccctttagtcccggtttccaaaccgggagtaccaatccgggactaaagatcgagctgacctttttttttttgcatggccctgttgctgcatggtttttatatatatatatatatatatataaaccatgcatatatatgtttcaatacatatatatgcatacatatatatatatgtatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctagctatcatttcgacgtagtagtactcgctgctagctcagaagctaaggaccggtgaattgtgtttccgtcgtagtagaattcacccttgggattaaggatttcttcgttgatgaatcccatgagttgttcttgaaccgccgtgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacacgtaatagccgcacaagttatttccctgcttttgctttgcgcactacaaataaatgacaaacaacgagagatctaattaatatacactagtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactctccgagggtcgatgaatccagtatcgaaaaccctccgccgtcgggccctttgaatctccattctacaacgataaaagggagtatattattttctatagtctacttatatacaaggacctaatttattaaaggagacgtatagtaagaaatctaaccgaacgatatacttacaaaatccagcaactcataatagagacgtcgagggcgtccagctggtatagttcgtagattcccttgaaattgatccagagaatgtcatctccttgcaagaagtccgtgtccctgatcctcgctccgatcatctctctaccggcggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtaaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcgggggagtaggtgtaggagcacgaggaggagtcggtgcaggatcctgaggaggagtcgatgttggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacatgtcgattcgtcctgtgtttgcatggcgtccatgctctgtgatcctacctgcctcgttgaggcgcagctgctacggtttcctgacgggctcaccattgcaggaggaatggtcggctggggatcatgggaccgatgtgcgaacatgcgttcatcaaccttccttgccacctcctcttgcatgttgagttcgtagctcgatacccttaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgtagggcgagtgtcagttcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctcctcccactttggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttaactttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtaaccttgttcttcgccagtacaccgtactgacaggcacgttatcccgcacaacccaaccgctgtgacgtacatagttcttggcggcttcggccggggcactaggacgtccatcttcttgcacttccgttatgatgtgtcgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgtttccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtataaatgtcgtacattagaaccctacacaaccttacgtgctaagtctaattacaaatcgtgatataagctaagtctaggtgacgtatattgtacaaccctagctagtaaataattatatactaagtctaattacaaataaaaaaatcttatattaaaactcaaataatattacatgctaagactacaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattagaacactacacaatcttatatgataagtccaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcgaagtaacatatatatatatatatatgttacttgcgttacatcattggcaaggacaaaaggttcatccgagtatccaaccttgttaaggtcaacagttgtcatcccactgtcatcaatcattacgcctccatcagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgtgatcgacccagacggtcccctcgccaggaaggcaagttgttggttgattgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttctgggtgaaggtcgccgcgttgttccatatgcttcagatcattacgtgcttccagtgtatctttcgactttccgtaaaaacccacaacccctctttaggngaaaagggccaaagaaggtttacgcaaaggttcttagtgaggtgcatcacgtcgattgcgtggcgtacgtccaagaattcccaatatggtaactcccaaaatatagagttctttttccacatcgccgcgtgaccatcatcgctctaaatatgctggcttccaggcccctttccgaacactactttaagatctttaaccatagcaaacactgttttcccgctgcgatgtttaggcttcgtacggtggtcggccttatgttctaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggcccatcgttgatggttaccaacagcagcgctcgtaggttaaaatcctcctgtttgtcctcgtcccacacggggacaccttccttcttccacaactgtttaagatcttctaccagtggtcttaggtacacgtcgatgtcgttaccaggttgcttggggccttgaataataatcggcatcattatgtacttcctcttcatgcatagccaggggggaggttgtagatacacatcgttacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccc

SEQ ID NO: 76644 - DNA, 1035 bp, Oryza sativa
aggatctccctcatggcttccccctccttcgccgcccgggatcgcgccgccgctcgccggaaaccggagccggagccggagacgacgaggagagtagcgaagcggaggagacggggttgcttgcttgggtgagaattcgaaatggtttttttcgccgtctttataccgccggacgcctccgtgggtggagaggcgcgtgacttcggtgggacccagcatccagttgacgtggggcccacgggcaggcgacaccagctgtgccgtggctgtgttattgatctcgaccgtgcgtttcgccatcggacggtcggggacctgaagtttctggaagcggatcagaggtatcgctccccccggttccagcctggcgcaaccgaagatgaatatggggggcccacctgcagcggcagatggaagtgggtcccgcttgccaggatggcataagccagagaggacggatgtggtggggtcgtactacacaccctgtgagatagggtgtgtagctgaaggaaggatgattagatatcgaattgtgacggcaatttaagaggatcatggatgatagcgatgcttgactggtaatccaagcaacgcatggatcatggatgtcaaaggatgtagtaatagctgttgctaagaaagatgaaagggaccaatcaacagcagcaaccacacggatacgggtctatcaggaaacaaaagcaagcaacgataacatctggggccgaattggccgaaagtacaaaccaaacttatttattcttattcatgaaaaaaaaacataagccgaattcgctacaacaggatgagtttgcggttggaagtttgcacaaaaaggcaaagtacatcagcatcaaccggttgaggcaaatcatgggatagcttcccctctagcaaaactgaagttaaagcacaatcgatcatgtcgttgcgatggtaaacggatggtgatgctaccgaccgatgaaacagcatgccaggttcatcaagcagacgagctgttcttgaaaatcattgatcaggtaaggggtgcag

SEQ ID NO: 76645 - DNA, 6972 bp, Oryza sativa
tccgaacccctcctcgccttgattcgtacagactctggttggattgggacggatttgcagcgcaagtgcagctatattgtatgggctggaacgggcagcccacactatttagggcataacgtgattgcagttgtgtatctggccgaaattatttgggcttttgggtctatttggttctctaccctaccaattaattggtagtgccactaccaatttttttttgatagggcaaagttagctagtctatataggccccgttcgttagtcctgaaaagtgtggattaaattttagattaaagttgcacgcttttcaaactaataaacggtacgttttgtgcggaaactttctatatgaaagttgttctaaaataccagattaatccatttttcaagtttataataattaaaactcaattaatcatacgttattacaattaatccatttttcaagtttataataattaaaactcaattaatcatacattattacaatctcgttttacgtgaaacacttcatcttcaggagattcaaacaccacctatgtttggtttaataccaataaaaagccaaaatttaatatgggtgaagaaaattctagagtatagccaaattaagcatgggcactactaattgtttagcgtcaatccaaactagcatgtttactattaaagttactaaaattttagtacgatcatattttggtttcaatccaaaacgccctttgacggattacggtccacgtgcggcctatattccatacgcggcaaaatactcgcctgaacccgttaacgactcgtttgtgaagctttaacgtcaaagctgcagccaaatgtacacctctccaagtctcaaacgaattgactcttgagaagcgttttttctcaaacggctgaacagtacactttttaaaaaggaataagttcctgaagaaaaaatacttttaaaaaaaattaactaatatttaatttatcatgttagttgttctgttacattcgaacagtcttattagaatgcgcttgcaggcagatctcatttcttgcattcccagcaaggaatgcagacatgcagtacacatctgaacgaaaaaaaagggctcaaaacaaacaatcacgattagcacacaatttgcattgccctccgttaacgccatggttctggtttttggaggctaaacaacagctacagatgtacaccatacttttctttcggccgcccgggttcataccaatttctctgacatgttacctcgcataccaatttgacaaacgatgtagtactgcactgcagccaaatacaacagctaagactcatccacatagtttcatcatggtatgaaatgttgcttccgatgcatgatccttctccagggagcaacacctccagcgattgctatggaagcatcaattatctgtgccgaagtagcggtcaccgtactctcccaaccctgggattaccctgtattcctcgctcaacccggtgtcgatctcggaggttacaatcttcagcctcggaaatcgcttgcagacgcactgaattccctcaggagcctgtttacaaataaaggtagacagatccagttaaaactaaaatagggcggagagcaacagaacagttagtttagtatgttaatggatttaccgagataagattgagaaatatgattcgctcctctggaacaccttttcttatcagaagctcaatagcttgatttgctgagttacctacggagtacaaaacaacgatgaaggacactcagttataaagtagtgtcagatactggcgctatgaataaaattgcagatggcctaaagctggtggagcatctagccaaacattgcagcagcagcagtctttgattgttcattcattcagaacataatcatggactaatgattcatacttgccttatacttttttaaaaaaaatcaaggtgttcccaacagggaaaccaataggcaataatatcttccaatgtccagaaaagcttctggataaatgcaagatatataagtgcaggcatgcatagcaaaggcaatgtcgtccatgatcagtggttcacaagtcagttagcttaagttccaacaaatgaatgaaaatacatatagagagaccatgcaaaactgacctgtaccaagcactggatccaaaagaagaacatgccgttcagcaatatccatgggcagtttatggtatataagctgcaatggcaaagtgaataataactattcaaactatatgaactaagtcattctgaggatcctttttcaataatcattaatcataaaatctatgtacttacttgctgtccattgtctccaacacgatgtattagaatcttgccaatttttattcctttacaacaagcacgcaatgcattctccatactttcaccactgcaatacaatgatacatgttaatgaaaagatgttgaaatatcttctgtaatactaatatttcacgacattacggaagaatgacaggaaaaaagtaatttggagttaaaaattgggacatgatgcatggtaccatgaagatcgataaatgcactagtctgacctagaaaaaaatgttacagaacacataacatacataaaggaagaggttccaaaatccaatacaaaacaaagtataatgtaaaattctactaataacaaataatcttgagttctaaggtagcatctcaacacaaggatccagaaaattgctgttggacagagtcaattcagtatgcagccatccttcaaaatgcacctgccaatgttgtctgcttgaatttttagtttgctaattacttcatcatttcataacgtaccttcggacaatagacactccacagagcttcttgcaaaattcaactcccatataaatggaccctagacccagaagaaacaaattatacatgcatgagttgatgttctgaaaaaggaaagcattgtagagctagctaatttcaaatactaaatgcatagaggtacggcatgcagagtatcatgtagcaaacttgttgggaagttctaggtatgctgtttttctatttgcactaaatcagacccctaaaaacctgtttgcagccaaccataaattgctactcctacgtcgaagggaaaatttcagaagcatatgaaagtagctaattccaaaggtctgcagcagcagaattaattaagtaatggttctccataacaacgagtcccagctgcaggccacatctgcagcatcaatcctaaatttttttctcaacaaatttttgggtgattttagagaattgttatgtagcacactagtcaaatttgaatcagttgtcttacaactatgaacaattaaaaaaactccttttcgtaggtggattcacaccagttcagaacttatgatataaaacaatattagcattagcaaccagaatgaaaccgtgcaccccctgcatcacagtgggatggagccgttttgatggcaggatgggttatgtgcgctctcttttcagtcttttgtaggaataatttgtaacactgttaaacaactgaaaaagaatgaaaccaaaaatatgtggtaccatttgaaaatacctgttggagtaataatctgcttttctgtaaatggcaaatgccccagtccgtgctcaactacctgacatggcatttccataccaatagcaaatgagttgaatcaattcaaaatctggatcttttaaaaaaaaattatgaagttaaagagaagttataaaagctatatatacaaaagtagtaccaaacggatcaaccgatctgaataaaagacaaagtcaggtgtagtgatgtccctgtcacgaatcagagtatgcattcctcggatctgttgaattcaccatgaaaagtagaagaatattatgaaatttagcaaagaaaagcataaagtttaaagataagtgcaaataatctaacctggaatgttgtttgaaccacataaacatgtggatagattttgcacaagtcatgctgaccaagcttagtacgaatatgttgaacaatcaggtcaattgccacatgattatcacctcctcgtggtatgatcacgtcggcatattttttcgaagggagaacaaaatcatcaaatgctggcttcacaaacctgccatactacagatgccaacagaatttcaaattatatatgtagaaaaattgaaatcagaaaggtaaaaagacaaaaatctgtttacaaagcacaagaacaatattaatataaaaacgcaaaataaaacaagttgaagtacctgctcaagcaccgagctaacatctctacctctttcaactgtatcacgccttattcgtcgagctagcctaatatcagcatctgattggatgcatcatgggcacccaaaaaagaagtgaacaaatattccagctaataacaggaagcagttcaaggcaaacccaacataataatgaaaatgagaaacctgtgtccacaaaaattttcatgtccatcagattgcgaactctttgatcatggaagactaaaatgccctctaatataatgacatctgatgcattgacctagcaaaacaaaattttatcagtcatttaataagcaacattgcagtttattcgcttaactgttaataaggaatcatgaaaatacatcaagaaaaattaacaaatgtgcacagtaacattcgaaacaaaatgcaatgttgtcaattttcttttttttcatgtacaaagggcatatatcagctataaatggtcatatcattgcagagagattaggggggaaagcaacaactattcaatgttattcaaaaggccaatgacttgaaacctagattaaaagctcacagaactacctttctaaagctttcagaggaccgtcggtgattcttaaaatcatatataggaacatttacaggctgtgcccgttttagctgccccatgcattccagaagctgctctgtgtcaaatgcatctgcaagcaaagatatttttgttcacattagaaacaaaagaatgccaactcaggctctgatcactaaaacagggagtgtaattccatccaaacgacaagtcaagtaccagggtgatcaaagttgtaatcttgggcatgtgcagattcttcagcagttaacccacggtagaaggaatcctgcaagttaaaacccaaatgaaatttactggctcttcaaagcatttctggtggagcgagacgacactaagacttgtcaggaaaaaaactgaagtaactaatgacgcatcatttacaggtggactattggttgaaagatcaactaaccaatgtggcatatgggttgtcacacagacaccaagaagataatttcccaaataaattggactaacggtttctggatttataaacatgagaagaacatcaaagggggtggagccaggacggagctgtggacaatacacatttagctgtgttttgctattccatggaaaacatggttgtgccacatttctgctaactataaatattttgagttgcatttatcacaaactgatattcccatcctctagatcatgtggtgcctgaatggatgcccccaaacatccagttaccgtaagtgacctaaatgcattcatgctagaggtagcacaacttgaggtaacattcaggcatatcccagaaaaactgatcagacatcaagttacccgtgtccattcatgccatgttttccattcatataaaatataaggttgtgaacagtttcattgcttagtttcacagctgtaatatgagcattaggtgcaatgaattgcaagaaagatgaatgcatagagacactcatctagcagaatagatctaaacagattacttttccaaaaagtagtagggaaatggcagaagcacgttagtaagctggttaaaggacacatcaaacctactcgaaaatttcctaatcctgatcactatcagtccatgatttagcacatatgccgcattatgcaaccccagagttcagctaagctagtaacacagatcaatgtgaaactatagaagaaaatgatggcacacacacctggttgacgagcacgacacggtggtcgtgcagctgctggatgatcatgtcgcacaccgtcgtcttccccgacgccgtcccacccgaaaccccttgaaaaatccaagagaaatcctcgcaaacagaggctaaaccaagcaaaaaacaatgccgacgaggaagggctcgaattagttactaccgatgacgaagggctgcctgagcgcggatggcgacacaagctccgcggcgtcggcggcgacgccgttggcgtagacggcgccgttggagtgggcggccgccgccgcggccgccttggcggaggaaggggaggacggggcggagggggaggagaggcggagcgcctcgaggcggagtccgctgaagtgcgcccccaccgccgagtccatgacgtcgtccaccgccttctccggcatgatctccccgccgccgccgccgccgatcgatctcgctgccttcgcgggttttggtcgggatcttctcgctcgcctctcactctctctcgatcggtttttaaaacgaaaataaaaaaaaaaagaaatgtagtttgggaatttcggataagtagtaatttgatggggaaaatgggccgggttttgtggtggggccgatggttgcatggacctggtgtttgtacaccgggtgtatgacaggtggggccggatgtgaaggtgtatgaaagctgggtctagggtggttgggatggggaagcgtacggttcagtggacaggggacatgaggcacagatgcttcctagcctggagctccactatttggaccacctggctgtcattgatctgtctcactcgagggagttactgcctccgtcccacagtaaataaagttttattttttttcttgcaacgttaatacaaatataaaaaaaaagttatacttaaaatacttttatgataaatcaagtcacaaataaaataaataataattttatattttttaaata

SEQ ID NO: 76646 - DNA, 4317 bp, Oryza sativa
aacccagtgatcttttacaacttacgcccgtaattatttacagcattgattgagtaaatacaggtaaataaaatgacttggggtggcccacactgcaccaaaggtaatcttacctgctccaaagtgaaaatatgatctacaaaattatacatgtgaaactttggtcatgaaaaggggaccaaagcgcaattaactctaaaacaaaagcatcatatggatctcaaaacaagaagcagcacgggcatgctggtcatcctatacatggcagaggatccacaaactagataactaataaattctccagaaggttgaatgtattgtgtaattgaatttaaaaactcaggaagaaaaaatttatgggaactttatcgagcatttacctgtcctcggcccacggcacaaacctcctgggtagtgcaaattgagccagagcccatcccaacacgcaatccatccaccccagaagcaactaaattctgtgcctgcgcaatcgtcaccacattacctccaatcaagtccacttccgggtacatcttctttgcatacttgatcatatcaatctggtagatagagttcccctgcgagctatctacaacaatcgcatttgcccctgccttaactagctgctccagccttcgcttgtcatcctcacgggtcccaatggaagccgcaacaacaaacttcccgtccgctccaagagacggcttgcctagcttcggatagctccggatgcgctccacatcattgacagtgatgaggtcgattacctcgctatcatcggatacaagaggggcataatccaaaccctcgtccgctagaaaggcggccgcctgctcgaaatcaaaagaggcggacaccgagcgcggggcggggcgcatgtactcggagacagggaggggagcctgacgagaggaggtctcggctgcaacagcgacgccgacgagcttggagagcgaatcgccgcgctccgtgaccaggccgtagtcgtggccagcgaagtcggagagggatggggtggaggcgggggagaataaggggacggaggagacgaacgggaggcggcgggacttggcggcgcggacgatgaggcctggaggtggggctcggtgttgcagtggacgacggcggcggcgccgagggatgccatggcggcggccatggcggcctcggagacggtgtccatgggggaggccacgcaggggatggagagggggatgcggcgggagaggcgggtggagaggtccacggcgtcggccgggaacccgatgtagcccgggaggaagatgacgtcgtcgtaggtgtaggagacgccctgcgagaagaggcgcggcgccggaagccgtcgtcggcgagatcggcgctgctcgccgccatgggtgaggttggaggttttagggttttagcggcggcggcggcagcggcggggggtcggcgcgggggagggtgaggatgatgagaatgggatgggaaacgtgaacggctcagggtttatggctaacatttggcgggtagcgctcggtggatgacgtacgggcccatagtaatgttaggccgtctgaatttttcgaccgacgaatgggtcccacgtaacccttttggagaggcattcggctcgccatcgggcccgcctgcgagtcttgcatcatcggagatattttcatggtaaaaacggtttacacgcttttgatttttttttttgagaacttggcttttgaattgtctgtcgctaaaggaatggagttgttttgttgctaatactcctaccttaaaattgaacttaaaattggtccggaagccataacacatactccgaaagtatatcatgacttgtatataagaaaaatataaatattaaatattatttctaagattctcttaacatgtatgtagaacaataataagtgaataataagtgagtaatgatcaaatgttggattcagtcaaaggaagtgttacgattttttggatggtttcatccatatcattagatgggattgacccagtgaataggcacctcacccttctactctaccgcaaggaaccacagcggtttagggtgtgtttgagtgtaaaatttttaaaatatacatacgcacatttaaaatatttaacgtagactagtaacaaaataaattatagattccgcatgtaaactacgagacaaatttattaaacctaattaactcaggggcgtattcacaatgggggtcttgagaccctagtaccgccccgggacagagaccccccaaagcccccactaatttttttccatatattcataggatgtgtggactgaaggttcaatttatgttgatgtagtttattcagcccccactactatttttttgagatccacccctgaattaatccgtcattagtaaatgtttactgtaacatcacattgtcaaatcatggcgtaattaggttcaaaagattcgtctcgcattttatatgtaaactgtgcaattgatttttttccccatatttaatgccctatacatatatctaaatatttgatgtgatgttttttgccaaaatttttgggatcaaggccttagtcgcacatcctcggtctctcagacactcctcacacccaaccatcacgtcctctgattgaaaccatttccctatgtataaactaaacatttgatcaatgagaattactcatctctctccctctcgtttcattctcaacaattttgttggtaatacttcattaaatcacacgggacatattgcaatcgtttttatcaaccacaaaacataatttaactaaaaaaacagtccagaaaccaaaacacatactccaggagtatattatagaagagaaatataaatattaaacgtgaataaatatatgttggatttctatacatttaaaattttgaaaatattttttaagtcataagtcaggagttcaattatatggacgcgtgtaaaaccatcaatccttctgaacaagtaatgaaacaattaacttatatatcaacaggcgtgtaaaactgtatattgaagaagttgtccctacatttctcctttccccatttttccattcgaattcctcctcattttattcttccccaaaaagtcaccctttcaaacacttcccaactcatcacgcctctggcaaagggcccacagactcagtcagagccagccaacccgaccccatcccagccgttggattagcccttcaccgccgtccaaaccccacgtctcctcaatccccccacctcctcacccaacccagccactgacaccctgcccccacattacatgaaccccacctgtcagtgacacaaacatcccacacgcgacgtgcaactccccgcctccacaactatatatgaacgcgccccttcctcgcgaatttttcctctccacaccaaaagacgccgcccaactcgcgaaggcggaaaaggaaaaaaagagagaaaaaaaaaggaagaaaaaaaaataaaactcgcgcacagcaaccgaatcatctgcctcctcctcaagtagtctagtcctcctctcttctccggagtctgcgtgcgatcgaagcagaggcgcggcgctcctcctcctcctccggctccgatccccatggcgttcatgcgttcccacgtgagttgatctcctcctcttcctcctccctattctgctctggttcgatggcggcggtccgttttggttgtggtgcctgcgggcggcggcggcgggggtggtttagatctgcgtggtctggatcgagggccccctcgtgatccttctcacggtgtgttgttcggatccggtcgaatgggtttcatctaacggctaaacgtgagatccactggcgtgggaggagtttctttgtgtgccgcgatggatttatggagatcgttttggtttcgtgtggttgatgacgtgatttgtggacggttctggctagcaggtagatgagaggttttaaggggtgattatgtgaaattgtttatggctagtttgggattagataaagttggttactgtatttgaagtttagtgttttagattcctcgtggtcacattgcatgcctaacggtttctctgttttgactgcaattatatgatttctctcattatcttagtgtatatatttgtgagatggtgcagtagggagcgatggtatgtaatgcattagaaactggtcggggaataggcaagacagaaatgaaagggactgattgggaataggcgagacttagaaatgaaagaaaacacgttgtggaaagtatccacgagataatagtttggttttgtgggcggggaatgaggcattgttcttcagcagccgcttgacttggatttatt

SEQ ID NO: 76647 - DNA, 2103 bp, Oryza sativa
acatttttttcgcttattaattagagtaataattgtactctattatcaatttgttattgtgtgcctcggctgattcctggacgagggttcacacacatgtaagcgtttggaattttggatagaaattccgggcgtgacaagttggtatcagagccatcttgactgtaggataagccaaatggtcaaactttaatgacgaatttttccgacaaaaatgatttgtgaaaatttctcctttcttccttatctagaattctttgcaaattatttcattgtctactcccctctctctttcaacttgagtagttctgagacattgaaacttgaagacgccaatgaggtctacttatggaggtcagtcgagtggatcgaggaaggaccgaagtgccaagtggtcaagatggaatgaagtttggatcctaccttagaacctatgccgccaaagtgtctttgaagaatagttagtaggatagaacgtttgttgcttgtttgtgtgtaggtatggttgcattcccatcattggagtggttcattgatgagtgtgtaactatactaggttgcttgcttaatcaacttgaacaatataatggtctacacacatcagatcagtgttaaactggttaaggtcttgtctttagtgtaacctctctccttctatcttctctaatatgcaacagatggtgaacactcgcgctagtggaagtggaaacaataataatgaagataacccaactcttgctcaagttctggctcaacagactcagttaatgaacatgatgatacagcagatgcagaaccagctcaaccaaggaaacaacaatgctccaccgccgcagaacaagttagctaattttcttcgtgtgaggccacctaccttttctagcactactaacccagtggaagcaggtgattggttgcacactattgagaagaagttagatttgcttcagtgcactgatcaggagaaggtctcatttgcatcacaccaattgcatggccctgcctctgaatggtgggatcacttccgcctgaataggactactgctgaacctatcacttggcttgaattcaccgctgctttccggaagacgcatataccatcgggagtggtgtctctcaagaggaaggaattcaggtcgctcacccagggatctcgctcagttacggagtatctgcacgagttcaatcgtctggctcgttatgctccggaagatgtgcgcactgatgaagagcgccaggagaagttcttggaaggacttaatgatgagctttcttacccactcatgactggagattatcatgatttccagaagttagtggataaggctattcgccaggaggacaaatacaatcgcatggagcagaagaaacgccggattgctcaattcaagacacaacaggggaataatcagaagccgcgtcttactttaggaccccagtctatgccacagggaggttcttcgtctgttgttcgtccgcagcgtcagttcttcaacaacaatgctggcaacaacatccgtaatcaagctccacgtcctgttgcagcctcgacacagcaacaacctgccaagagggagcaaggcagcaagcccgtggtgtgtttcaactgtggagacccaggacattacgctgacaagtgtccgaagcctcgacgtgtgaaggttgtccctgcccagagcaactctaccgcaccagcgccaaaggcccgtgtcaatcatgttgctgctgcagaagctcaagatgctccagatgtgattttgggtacgtttcttgttaacttagttcctgcaacagtgcttttcgattctggtgctacacattcattcttatccatgagttttgcgggaaatcatgggatagaagtagtgtttgccgtttcggagtgccaaaagagttcatcactgacaacgacaagcagttcgactctaacaagttcagagaaatgtgcgaagggcttaacctggaaatcaggttcgcgtcggtcgcgcacccacagtcaaatggggcagccgagcgcacaaatggtaagatcctagaagcactaaagaaaaggcttgagggggtagcgaagggcaaatggccggatgaaatgctgtctgttct

SEQ ID NO: 76648 - DNA, 5690 bp, Oryza sativa
gagcctcttaggatcaagaaagatggacaatccattgttggccacctcatcatgttctttcctcttcatgttcattgccacaagattagccatgttctaagctatgatgacagcctcaagacaacccaggacatctagtaatttggagtctattaattaacagaattcagccaacttatctcttgtgaacagaagagttgactaggcaaccaagatgacttggttcctcgaagttcagttgtaatttaactacaaccatggatgttattatggtgtatttgtgttgactaattcaagttgactttgcacgtttacaatgaatagagagtactttacccttagctttttttccccctttcctacggttgtttgtaggcaaaagaaaggccttttgtaaaacagaaaaggtcaaagaggctgctgggtacaaaagaataggaaaaagaccatcagtgatgcatttgacatttcaactcttcatagaacaaaagattgggaaattcatgggaatactatgagaagattacatgaaaatattttgatatttgcttgctggtgtttgagtagaacgagtgttaaatatcaccagaaattcaatataagcacaaccgaacaagcactgtttatttcatgaaattcttatggaagagattgtatcatgtattacaagtttacaacagcaaccacagccagataggtagaattaagcgcctgaacggaacatatggcgccttggacatttgaactcaattcacctaataggtaaaatgaaaagatagcctcaaagccgtaagttcagttcaaaactcaactcttctcaagcaatgaacctcatcccgttctaatcaatgattctacaagagaatcacacaatactaggtgccctttgcactattcggttgcgctaaccaggaggaactccccctcgcacactaggtcaccaccaacgtaagcttttccttccatcttggcaagaccaaatcttttctgatacttggtcagagtcattctcatgatcaaggtatcccctgcaattactggcttacggaacctcactttatcaattcctgcaaagaagaaattgtcccgagatccgccaatttcaggctgcaacatcaccagacccccaacctgggccatagcctgtgcataaaggtagcctcacatgagggaagttcagatgtttgtctacttgatgatagaacaataagcaattaaaaaacatccagccatgtcctcatctatttatgggttctaagttgcgccattggttcagtttggattatgaaaacatagttgttgcaaaacctttaccataaaacttattagttctacaagtcccacatgaaatcattggtcatggtaccaaatatccattacccacctagtgcctgaatacttggatatcaaaacttttcatcagtttgaaaaggacaagaaactaaacaaatcgattgacgcaagttccttattacttcatagtacttttcgacagagatgaaaaatgcagtaaaatggctttgagaaagtactactacttttttcatcaaattcaactttttttttattttgttaaatgagattggtaccctgaaaatggatgaattgagtatcaatatgctcagactgcaaaaaaaaaaatgatagaatgaggtcatagtaaaattaaatgaagaactaagtagcgtagcatggactggcatttctatagataatgtacagagaccacaatgagagatgatcaaacctcaggaaacaacagaggccatatatactaaacaatttgatcacagcacatggatgccaatatagtggaatcatacctcaaccatgagaacaccaggcattatgggtcgttcggggaaatgcccagggaagaagttatcatttatcgtgacattcttgatcccaactgcatattctcctcccttgtactcaataactctatcaaccaggaggaatggaaacctaacattcacattcaaatgcacaagttagagaaaatactaaacaattacatattcgtgaatcatcaccaatcatttctcttgcttgggctcatcaggtgtatatccacataggcgagcataaaaatatccaagatgcatgttagtactttctagtaaaaaagacaatgcctttcttcaccaagtgagctcaaaggaaatgaacataaagcttccattaattcagagggctatgaagcatctttttctttcatctatctatactgctttaatgatgctagtggtagtgtccgagtctgcctccaacgccacaagttgacatgtagagccataaaatccccacacgtgattgtttttgctttggacatggcattatatgcctaatcaactaactatgctatgaagttgcaatttttacttttgtttttatcttttataatatccgttgcaacgcacgggcctttagctagtactgaaaataataataaaaaagagtatgaggttaactctaatatcaggatattgttttttttttgttttcaacagattgcacgcacagttcatatgcctctcatcgaacttcaaaagggtataatttcgatttgtatcgagtaattcgaatggtttcgcattgccaacatcttacaagcgaaatgaaacacacaaggtaaggcaaagagctatcctgcagcagcagcagcagcggaatgcggttagagctcacctgtggggcaggatctcgcggatctggttgatgtccatgacgctcgggaagggagggaaccctgcgagaggcaaaataaacgaacatatctccctcagttaatggcgaacacaggcaaccgatgccatacggagcgagagagagagagagagagaggaggggaaccggacttttctcgatggggagcgcctcctgagcctccaccgcctggccgtcgcccgcggcgcggcgcgcgacgaggcgccttcccggggcggccgacagcgccggcgcgcgtcctgggcgtgctgcggcggcgacgcggctccggaaggggagcgcggatctcgcgggcgctgcggcggcggcggcggtggcctccattggcgcggcgaggtggggatgcgaatcgaggaggaggaggaggaggcgataggaacgaggctggtccaaactgcaaagagagtcgatggggggttttgtgggtttggcttccggctttggaacctccgcttccaccctgggccttttcagcgatttcagctatgctctctttccgtctctctcggttttggaatttggaaaccggtgtttgtctggtttggacctttggaacggcgattgtttacaaaattactacaagggaaaatttagtttcatgccattccaagttttcgagtttagctttatacatcaaaaggaagaagtatagttttactactactttcgtatggaatatacaatgttttcgtgagttaaaagaaaagttgttaggttgtgttcgggacggaaaaagatgttgcacattaacgcgtaattaattaagttttagctaaaaaatttgaaaaatagattaatatgatttttaaagtaactttcgtatagaattttctttttcaaataattaatgcaccgttcagtaaattgaaaaatgtgtgcacgaaagatgagagaggtgagttgggaaagtgataaaattgaactcacccttaggtggctcccaatatatattttttcaattttatgttagtttggtcataaactcaacatcatatatactgagttcttctatatactattctttccaataacgcaatctcaaatagcactctttcaaagaattttgattatttgctacctaggtctactaaaaattgttttcatttttaccattttagcttaaccaactcatcaatctggatgagaaacaaccttcttgccctctttttcttatctcaatctagtggagggggtggaggacaagaagaagccatggagaatatttagaatcgcagtgaataaaaatctggctcaactatctagttattatccttcctccgctgtttaaatcttttatttcctaaactaattattcgatctacgatccaaccacactgttatatttgttgtaattaaatatttacaacaagcacaagattatattctaataaaataaaaatatgtgtttcaaaccgtttaaacttaatgttttatacatgatagatacatgtttcaacgtatctttaccgtgtttcacaacagacatgcatttagtgacattcaaaacgatttttctcctaagctacttatcaaatttacgatctgatcacacagttatattcattgtaattaatctttataacaagatatcacgtgattatattctgatgaaaaaaaaacatgtttcaattcactagcacttaatatttcatacacgatagcgacatctttcaatgtgtgtctcctgtgtttccaaaaaaaaataaatgtttcaatagtgtttcaatgaaatgtataactgaaacatttgaccgtctaatttttttaagaaacaatcggacgtccagtttgaagtttcttccgtgtttttttgtctatgtaacatgtgaatatagaagctaaatttctatccattatcttaaaaaaggcaaagctttgagccccagatatcacaagttagacctggagaattgtgttgcattttcgctattgaatatgccacaatttttgacaatttgatcctttgcaaaaactatttttacaaatgaaccgccaccaaaacttatttcaaaaatgacccttttgttcagtaccaaattgtgtggtgctgaatatgcgttggcacgctgacttagcctcccatccgcggtggcacggcattcagcgccggttgacgtggcgctgagatgtctaagttcagcgccaggtgatttggcgctgaaaaaaagtgtcatttctgaaataagttttggcggcggttcatttgtaattttttttttcaaagggtcaaattgtcaaaatttgtgcgaatatgcattaggctctcgtgtacaggaacgagatccgtgggacaggaaggcaaaagaaccacaaatgatatttttcttttccacaaagttgctagcaacagcatatgatatacagaggtgatgctgctgttacaggacaccatgaacaactgcaatgcagaggtgagccgtgaaagaagcaacagatgctatacatacagttcaagaagctatatattgacctgcagagtcgatcgtacacacaaactagctgatgtacagaatcatgttgtatcctgagagccgccaagagaatctcttcctacgggaacccaagaagggagctgatcgaaaagatcagtgctttgtgcaaacatgtagaggcagaagatgcagagcgctggtcacaacaagttgggcaataaatcattttagacagagagaaagagagcacagaggtgttaagtgataaatataaagtatgcaggaataaatcggatcataagtaagttaatgaggtatatttaccggcgtaagcaactgcggcgcctgacaccaccctccccaaagctgctagaaaatacagagtaaaaaccacctgcaaggttgtagcttactgtaagctaaacagtgtgtatatatgcaccttttatgttatagctcaggtatgacagttcactgtaagctgaacaatatgtacataaagcttgatgtaattggccgagttcaata

SEQ ID NO: 76649 - DNA, 9987 bp, Oryza sativa
ggatggacggtggatggaagcaggtgtacgtactcctaggtgtatagaatcattttcatatatatatatataaaccatgcagcaacatggccatgtaaataaaaaaaaagataggtcgatctttagtcccggttttaaaaccggactacgggggttaccaaccgggactaattagggtttctcccccagtacatgtaagagcatgcatggaaggctatatatatatatatagctggattattaaatctttatgtgattgatgagggagctaacggtgttgaaagtatctccatgggttttctcggcggggagatcatcgctgttctagcacacctttctttctaatttatccaatggttatagcatcttggcatgtctttttggtgttgtgatgtagtgccatgcttgcaattgtaaactactatattaatgcaactaattgtccatatatagacagcctgctcgctttttgtttcttgtccattcacttagaaattggcgtctatattttgacaaatccttgcatttttcctggttaatcattaggtctagaaatataatgatatatagtttaaattttatttaatataatataagaatatctacaacaatctatttatcttaaccaatcacaactactactgctcgtttaatttttctcacataactactcatctcattcaataataactctttattcacatactcattgttaatctcccaaaaaaagcgccaaatatattgtgagacggagagagtgattattttggaagcaactgcaccacaggccagaagccaaattctgctaattaactactctctctatcatataatataatataaatgattttgccctttaaatttgtccgaaatgtaagatattttgtgatcccacgacaatattttatacccaacctatcaacttcgtgctactttttttctcatctactaatttttttactaatttattttccatctatcaattttttttattctctccgttctatattgtaaaactttctggccctgccaatataatatcaacccaattgatgagagagaaaccacataaaataagggactacttagagaactgtcgacagttttttaaggagacaactttcaaatctaactatagtataattacaatataatttcgtatgtaagtataatggaactcgtatataaatattaaaataatatatgtaacactatatctaaattaaattatatagagatgataatatagttacagttcagttacacagtagttacgatgcagttacgatgcagttacaatgcagttacattgtaacagggtgtaactggaatataactaaaatataactcatctaacttctcaaactacacttccaggatggaggtctgggttcgatcccctgcaagcgcacacgcgctgattttttccaaatctcacacgaatcacggcgcggatcgcacggtcaaaaaatcgaaaacccgatcacggcgcggatcacacggtcaaaaaatcgaaagttttcagcctcaaaaactgtcgacagctagctagcacaaccgcaaaaaatagttttgacttgtgtttctcccttcttccggtcttcctccgacactcctctaacgtgccccctgctgcgcgtatggtcataggccatgcacgcatgccccgctgccccatcctcactgctacaccgctttcgccgcgagggcgccgcggccaacaccgcacaatcacgctactgcttctcgcgcacgcgcgaggtaacaggccgcctacacaacggagtcctcaacgtttccgcggtgaccacgtcgtcaacaccgccatccacgatgccccgcccgaaggcctccgcaactgtcatcttgtcactcgggaggcgctcatgtccactgcatcatgcgcaattgtgaacgcgtggctggtgacggcggcaacggtgggcatcgggagtgcgacgagatcggcaaccagtcccgaggggcaccgcctatggaggcgtgcagctcggcgggcgcgtgcgcacccaggcaggccaaagccgttggagaagcacttctccttggtggcaatcactggtgcactggcacccacagtggcgcagacatgagggccaggccaaggcagtgctcaccggcaccagtgagggtgatgacgtggacatacggggatgcacttctccacggtgcacaagctcgccgtgtccatttgcattacttggtaggctacagaaacatttttttttctattacgttgcatatatagtcattctctttggaaatatcataattggaaaatttaaaagatctatacatataattggaaaatttaaaagatctatacatatatagaagtgagtgttctaaagaaacattctctcttatacattcattgtggattaggtgcaaaaagaggccgtaagtcaagcaattcgattaagatgggggaagtaggaagatacagtaaacccattcatcatgagcagagacgaccatttcatgcttatttagttcatagagaggaatcaaattagttcatttagatcaaacacaaagacaacaggccgtgtaggaaatgcaaaataggtgcacccattaatcaatcgttttatagagaggagtattgaattaaattatacagcgaaactattgtttcagaacaggtccatatcatgttgtgtggtaacacaactggatggaatcagaaaatgaaaaggagcagcaagactgctagaagaaatcacaagaagaaagatagggacttgactcctacaaatgaagggattcatcttacacgcagtgcggacattatgggtaccacatacctacatggcacatatatcaacatattttggttgtcatatttttgtgtagtttgttttgaccagaaaaaggttgctcaaaataaaaagaaagatccatgcaagctgaaataattcacacgattgataaatttgtcggtgatatgggcccgggggtatcaggtttagagggaggaggctgccccccgatgccacgtggccctcccccgaggggagtcaggcccgaggtggggtggcggccactccttcccaaagactagtcggaggaggctgccacccgatgccacgtggccctcccccgaggggagtcgagcccgaggtagggcggcggccactccttcccagagactggatggaggaggctgccctccaatgccacgtggccctcccccgaggggggtcgggcccgaggtagggcggcggccactccctggccgagactagagggagaaggccgccccaggcgccacgtagctcccccctgaggtcaggcggcggccgccccctcccgtgactaggggtcgggctccgccgaccccctctctatgtcaccacgtacggtgggttaggtgtccgcctccaggtgcccacctacccgcatttatggcgacccgaacggtcgcgccacgccgcatttaatgcagtgtgcagtgcactcaaccggtctgtgaccggtcgaatgactgatgggacccaggatgtcaggcgcaccatcgcgtatgtcaggcgacgtgcagcccgacatatcccatcaaataatgatggtgagaggttctcatcctcttatcccagccggagtcggtcctcccgctctggtcaaagcaaggctcccgtttcccggtgtaataggagcccagaagtcttcaccccttaaatggtgactgacaggggcaccccccgtgtcaggcggcaagatttgacaggccccatcatcaagacgacgtgcgcttggcttcccaagtcaagagacaagacatgcatttaatgcaaagattataatacttctccaccggagctaggttaggttgttgggcccatgtggtaaccccttgaggtataaaaggaggtccaggcctagtgatggagggggggactaccgagcgaactggcgcttgggtctcgcaaccccaaacacttgtgttctacactcaatcaatcaagcatagaagtagggtattacgcttctcagcggcccgaacctgtataaaccccttttgtctcatcgtctttgggggatgaaaccccctcaagatcacacaacttcgctcaccaagccctcgaatctcacccgctgcccccggccgaacttacaaagaggggcctcacggttccttggtggagttctttctccgacatctggcgcgccaggtaggggacgcgttcgtgatttttgaggttctttcgagcgccggcgtgacgtgcgtcgcaccgccaatgcgggggaaggcgcagcctcctcaggagagccgcgccaccccaggcagggggctagtctccctgcatcttcaccggcctcaccgaaaggtaccacggtagtgtcaaccactccgagtccctccagatccacacgacgatcatagaggcggcatggggtgacgaccgggtgaaggcgaatttcttccccatggccctctagggccaagcgcggggatcgctcatgaacctgccacctgcctcggtctactcctgggaggactcttgcagttgagctccgggtgccgtcgaagcccgggaccccctgtgctggctcttccgcagcggctagctttggtcccgccggctggctacggtgcctggcccggctcaactaatcgtcctttcaagtttcaagtattttcaatttttcaattcatcagcttgaaatcttatatttgattttgtcgggtcccaaaactaatgatttggtaaccgacatgtttagactgtattaagccctggatcagtagattgatacaggttcaacaatctggatcttcattgcatacatttgaacaaggctccagagaagataaaatatatggatatttacaaacttgtggctaactaatacagcaggagctatagaatgaaccaactctaatgttttgctatagagttaaaccatctaacaatactagacttgaagactaggtttaaagggaactaacttatgtgattgaactcccagcttcgataagaactccaaattgactctaaaaaaggtggggttgaagtaagggtgagtacaacgtactcagcaagctattatattcaacatgaatgtatgaaatagtagtatttgagtagggctagatttaattgcagaaagcagaggatatagaataagaaagcctgtaatgactttaatgcaacaatatttagtaaaatcttgaattaggtttctaaccaaataccatatgagtcccggtactcaattccatgagcacggctattcgaatagtttcatgaatattctactgcagtagatgtacactttacccgcaatccacgacttgccaatattcattagcttagtcatggcctagtattaggttattaacaatagtggcacctgttccatgaactctagtccccatgcgctctgaacgtaacgttatcagcagcgagaggagttctggcattcctggggtttttagagagaactggatgagagaccccacatcatctcaaccaggtttccataaaatcacacacacaactcatgagtaaaaatcaatatatttacctgcgcctcgataaatatcataggatgccctgctcggcataagattgcctcctgcgcgaggacttacaaaaggaaccactgtatagaggtaccatattgttaattaacataatatttaggtctgtccccattctagaagctgcagtcgtactcgttcttttgacataagtattttgtggccattatatcgaccgagacagtactagccacccgaaaatcaaccaaatcttacgtactgtcccaatctaagttcattatatttttatgcagtctaactaggcagggctaagcaaaagctagcatatctggtttgctatatgttcaggttatgcattcaaaatcatgaatggctaatgcatagaatagaggtatagaatatagggcatttatgctcaaaggagaggaataataacttgccttgctccaacgcaaataaatccgagataggcaacctgattatctgatcctcgaaataccacaggttgccatccaaaataaaatagactctactaagaaagacgaagaaccaaattcaataaaaatcatgaaatagaaagaaagtgatgaagagcaagaagggctaggtttggggtataaatatctcctttaaaggggtataaggttctaaagagttggaggctaaagggagagggaatcaggcaactaaggttgcttatattttatgggaatgcttggttgctgaaaggatagaatgtatattggataattgaactggttcagttggtatatggctagtattggctggtggtaggtttgggtagtataatacctagggtttggttatatttaagccgattgtggatagggcagcatatcgataggctctatattttatgtgtaggttctagttagttggagagtatgtggctgagagtagggtggatatgcgatactggtgggtgtgaaatttggatgataactggaatttgactggcaaggtattagctagggtttggttgtatgctagtcgatgctagagtataacgacttgatttgataccttctctagccggtgtcgaccgacaacatattggctagaggaataggaggttggtgtaggtttgggtggggcggaagtgttaatccgacaaccgtgaatggcagcggagtggctaggatcacatagagcccgagagctaactgtgcggcatgctgtggaggtcgagggaatagtgaagctccgaccgctatacgcatcaaggtgtggggtgacaggagcagcacttcgaccttaggtttggtttttgccgggctttacaaccaacggtccgacgtcggggatagtggaccacgcgaacgtccccatggaaggcgtaaagttccaaccggcagctttttagtggctaaaggttattttggaaataaaagaaaatatttgaaaagtaaatataagtttaaattgtaaattcaattataggattaaatcaaatatttattcaaataacatttgaataaatcaagaaaattcaaataaaatattaaaatagtaaatttggtaccaaaatgtagattttgaatttagatgaatttaggtccaattttcactagaatcggatctacggtttaggagatatgggcttctaaagaatggtatttaaattaaatagagaaaatgtaaaaagtcactgttgatggacccacctgtcaatactttttcctttcctttcttttcttttctttcttcttttctctttctctctccttcttcacgtcttcttcttcctcccgttacacagaggctcgagaggagggagaggagagggaggaaggggcgccggtgttccagtggtggaacagcttcgccgcgggcggcatagggtgttcccgggtgttgcgcacctagggagtgtggtggctggacacgggagtgagagaggaggccggaacggcgagcacaatggcatgaaccggagagagagagagagctccggtgaggctcgattgaaagtgggagtgaaggggaaaagggctaaaatgggttcttcggtgtacggggaggctggtggcgaatggatttgatttaggatgctctagggatggagatcgatcgatggccggcggtggtcgccataacaggagagagagagagaggagctcggctcatgtgtgtggagggaggagacctcgctggctatttataggggacgataggcggttgtcgaaggtcggtttggagggggaggatgaaggggacacggcgacgacggcgtggagaagaagtacacggcgtcggctttgatcgctgattggctggtgatggcggttcggctcggcggctgacgtcggcgagatgaggtgcggctgacgtcgggcagcaattccttggcgtcgacggcggtatagcggcggcggcataaagatgcgggcgacggcgtctctggttcggtgtcacgtctgaaaaattcactagtaatttccgaatttatttgtgcataaaaccctcgtacaggaatcagccgaggtatacaaactgacaatttaatatacaaatccatcataataataacattacatacttacaaaagaaaagaaaaacagcagcggaataacggtctagcgatggctttaactccactcctacaggcaactcaactggggtataagccaaacgttttctccttctggatcctttttcttcaactgaggttgattgattattacaagaatgagcatatgatatactcaacaagctacatagcaaatatgcaagtgcacaaggataccaaaggatggcataatatagggttcatttgcgaaagcagcatttagcaaagatttagaagtaaaacagtagagtaattaatcatcaattttaaccaacattgcacagcaccccaatgctgcacatgcccaaccatcctgaacaaccatacccagctgtacagatctaactccaagccaggagctaagaaaattattaccagttatagcatcaataattattgtgagaggtgtgagactaatcacgaaaaacatttctcaacccgcccatgaccgcgggcacggctattcgaatagttttactctggccagaggtgtaccactgtacccacaagacacagcctcaacatcatgtttaccatgtatcgcgatactggaaagtacccgaatagaggctgtgacaataccccctgcacaacacaactcaccacagtgcaccatacctggatcataatcaccccctctataaccagaggcatggactccccagcgacccccacggacttctcgccgcttctcagtctggcaccccgtaatgaaccatgctatacaaaaggtaaagtcgttgcccacgctggttgtggttggtacggttaatgtctcacaacagtagctcgcgaaccggtccttaattgtcatgagcacaaccttcaaaatcatatgctcacaacccaccattgtcaagttttaattatcaattaattatcataacacgattaaccatcatgagctaccattaaatataatcataagtgatagtgtaacattagttatcccaattatgtgataatgtttctaagcatggctaagcaattttatatatatatatatatatatatatatatatatatatatatatatatagcatttagctgaaccaaactaatatataaggttcaagctaattaatttattacccaaggtattaaagaatagggtattcaatgcaaattggccataataaaggaataggttcataccacccggtgacattcgaaaataaatgcacagttgaaataaatagagaatttaaatataggatcaacatgctcaaaggattgtgtttaggatctgtgtgacttgccttgcaataatcagtcttcaattaatcttcttgaacacttccgacgcactcacgaaccttcgcaacgacggaaacggcatgctaacacgcaaaacgaaaaaaaataataaaaaccaaataaacagtacataaaaagtaaacaaacatgtagatcatgattttagataaatttagagacttgaacggcctcattccgacttcatatgaattagttatgaattttacaagattaaactgattttaacatttatttttagaagggaaaagggctttatgacatcatcgatgacgtcatcacctgcgagaggctctgaaccatgaggtcgccggagctagaggactcggccgggtcttccgaggactccaacgcgaagaggacgacgatgcgaactcaccggtgcaaagaacaacgacggacgacgacgaacgacgaccggcaacgagctccgaacggcggcaaagtcgggacgacgacggcagtggctttcctgcgacgagcagcggcaacgtatgggtggacgggcttcttctcggtgctgcgatgccgacaacggtctcggggtgaaccagcgacgaccgcaacagcgaggaggatcggccggagatcaaaccgg

SEQ ID NO: 76650 - DNA, 5206 bp, Oryza sativa
cccgtcgtgtacaccggcagcttcagccccgccctgtgcgccgtctcctgcagcaaattcttgtacacccccgtctcatcctacaccacaaaatcacacaccacatcacaaatcatcttcatcaaccacgacgacgacgacgaacaagaacggaacaatcttacgagcacgcgggcggtgagggaggaggaggggccgcggagggagaggcgggcgagggcgacctcggcggcggcgtgctcggcctgccggagcgtggtgcagttggatggcccgtcgaaggtctcgccattgaaggtgacggtggccttgaaccgcggcgcgtggtcgggcccttccctcgtgcacacgtacgacggcaggctgaagcagctcctctgcgccagctcctgcagctggttcttgtacatcgatcctcctccttcgtctctctctcctccccaccccctccctctctactcctcttcttctctcatcatttgatcatggcatcatcatctccattgatggacaatagagagagaggagggagagagattagattaggtgttcttggggagattgggagatggaggaaggagaagaagatgaaggtgagagtgtgtttactagtggtagtggtactactactactctagtaggaggagtaccaaatggtgcattgctttgctctcccctcttctttatttcttcttcttgttgctcatctccctctctttctcactctagcttcactctctcactactggccattgttgtttgtttctctctctagacaatactatggttgtggtatgggtgtagagagagaaagtagggcagagtggggagggtgagatggggggcagagacaccttctggtattaattggggggagagcatttatggtgttttgtaagcatgctgcatcctcacacacacaacacacttacctagagtcgtcttcatcatctcgcagtgcaatgcatgtgttgtgcagacatggatcgagatctctctctcttctctctagcgaaccgaatcgacggtcgtgatgatcagaagggttttcgttttctaccgctgttgttttttcatcgagatgtgatcatcgtcgtcttcactctcgccaccacgtgatcccaacgacccaacggtttgttgaatgtgtataggagtataggtcaaaagatcattttatctcggttggtaaaatgaaaattttacctttgggctttgtttagttccacgtaaaaaatgaaaatttgaagaaattagaacgatatgacggaaaaattgaaagtttatgtgtgtaggaaagtttgatgtaacggaaagttgaaagtttgaagaaaaaaagttgggaactaaataaagcctagggtgtgtttagttcataccaaaattagaaatttgattgaaattggaacgatgtgacggaaaagttaaaagtttgtgtgtagcaaagtttcgatgtgatggaaaagttgaaagctttttaagataaaattggaaactaaatcaagccttggtctaattttacaggctcgcaagatcaaatcattctttgatcttgagaaaataatctctttgttttttaataaatggtgctgatgacttctgaatatatgatcattcgttttattcaaaatttttatataaatgtataagatataaaacatgtttaaaatattttaagtgataaaataactaacaacaaaataaatttcaattaaataataataataataataataataataataataataataataataataataataagacgacgaatggttaattgtgtaaccaagttaacgacatcatctattaaaaaacggaggtagtataccagtaccgctcgtgtataggtggtggccggtggtggctaaacaaccaacaatgaccatgatttaacgaaacaaggttgtgacttgtcccattgaggtgaagttgtaaccatacaccgatacacattcgcatgcctacttacaagagaaagtatataagtttaagagttaaacacaatggtcagatgaaagtttattacacatacatcttatcagatccaaaaattgaggtatatgtgccataacatatttattagtatcatgacttattaattatatttaaaccatagtattatcctctacgttttgctaaaagctatcggaatcgtcttacccgatcagcctagatccaccttgagcccttgatgcttatggtgtcttcaaatgtataaatttgttcctcaattagcactcatggtttgactgctagatataaggcgtatttgaaagaaatggattatagagtttaatttaattagcttagtcccttaacgatgttttggaaaagaaaaaagcaatgctagtgcgtaactgccatgacgtttttttccccatttacaataatactacataccttgacatttggcattggattaaataatcgttccaatagtctacatctatcaaatattcctcctttagttccacttgatctttcttaatttctacgtattttttcctaatcctatgagcctgtttagttggtgaaatgaaaatttttggatgttacatcggatgtttgaccggatgtcggaagggattttcggacacgaatgaaaaaaactaatttcataactcgcctgaaaaccgcgagacgaatcttttgagcctaattaagccgtcattagcacacgtgggctactgtagcacttaatggctaatcattgactaattaggctcaaaagatcgtctcgcgatttacatgcaaaatgtgtaattagtttttctttttatatatatttaatgcttcatacatgtgtacaaagattcgatgtgatgtttttacgaaaagttttggggaactaaacagggccaatgtagaggatttcgttttacattacccatattcataaactagaaatttccctggttagattttagagggggtttttttaagagaagggtatccactcttttagttccacttgatatttcttaacgatctcgctttacattacccctattcataaactagaaatttcctaggttagacttttgagttttttttaagagaatggtatccaaccggatgtatgcagcctttttaaattgaaaacatagtcctcaaataactcaatctgaaattcgatcacattgagatttgaatttaggatattgaagtgctactaaggttactgcaaccactaagctacatatcctttcgcaggctttagaggtatctagctgattttgtttctcattatgcatttgtgcggttatttaaaaaagagaatataagttagagtgaaacacactaatgggatgaacaatgaatggtcctttaatcactattgcaacaaaaagtttaattagttgatattgctactttgcctaatgcatatcattgtgccgacttgccccatgagacctaagtatgctctaccatgtcaaactcgaccatcccatatggccattatttggaagtggcaacaagggttgaattgcatagaagcattcttcgaatgtgtaaacttatgttgaaaaaggctaaatattggtttcttattagcacccacaatttgactggtagatattaatgtatatatgtttgaaagaaatggattattggttgaatttagctcagttcctcttgagattttgggaagaaattaaagaaacgaaatctagctgtaactagcatgatagttttatttccatttagagtatttacctggacttctggcattggattgaatggacatcctaatggtcttacatctcgctagtgtaaacttaaaatattcaaagggaaataaccaagaaagaaattaaagccgcctcttttagttccacttgatcttccttactaattttttagtattttttagaaagctcatgtagaagatcatattttatactacccatgaacttgacaatttctttggttagactttaagaggtaaaaggcagaatcatttggaagaaaacaaatgtgcatagaaacatgagattgagctaatcagtactatcatttatacttattttatattgtatttggatgacactatcttatttttggctgtgttctttgatgtgagttgacaactaatctatgttcacagaaaacagagtgacatattatcacatgattaattaagtataaactaaaaacttaacaaatggattaatacgatttttaaaacaacctttatatagaattttttaaatattgtttaacatttttaagtgtgcgtgtggaaaacgagagattgaaggttgagaaccatcacaaacgaacttaacattagtctgtcttagaatatttatagtaaaatcgtaacggatttacttagcaaattgcaaaggatagacaaatgtcaaacaacttgcaattttttttaccacaatttaaaacacatcgattgatagctacctgacgagactaccctatcaccagccagtccagcccctttggctgctaacccggtcaaaaaaacgatcaaaatcatcaagtacaggggacgatcgttcagccgttctcaccaaccaaacaatgaaaagaaaaaaaaaagccacaaatgtcaacgtgtcactaggaaaagtcaaaataattccctcacttttacaacccaatcttgtcgcttataattatgcatatcagccaaaatttaaacttttaactttaaatttggagttaattctaagaatttttaccgaaatttatttttcagtctttatttttagatcgctaaaaatacgcatataaaatttatattcacaaacaattttcagtttgtgaatatatgtcctatggcttattcaacgacagggataatcctcccacgattttatttcattttcaaaaaccgcgccggcttaccgggcggcgactcgacccgccaacccgcctccacgcctacggagactgccacgcgggccccacccccgcacaccgccgcgaaaaagcttctcccccgggcccaccaccacccccccgggctaccgccgctgccgctgccgttgctacgcgtcccccgacaacgtgcactccctcttctcctctcctctccaattcgtctcctcctcctcaccacgcttgcttcgccatcccgcctccgcatcacccgccgccgccgccgcctcctgctcgtggtcgcggctgcgttgccggtgctgcaggaggtgcttcgggggggagatctcggtggggt

SEQ ID NO: 76651 - DNA, 925 bp, Oryza sativa
tatgctagctggaatcaccttatggccaccaacctgcatgatactgtaattctactgaattggtcagtactcttaagaaacattcgttctcggctttttgagtgtttttgacccgtcattttcccttgtgtcgtgcggcggcggccacttggttccgtgtaaaacgccatcgctacgatctggtctacctacctggacctggctaccaaccagccaattgtttctcttgcaacgtacctggatctctcgcgtgtcgtacagaggcgtttggctgtgcacaaggccacagggggacaattttatcgaacctgttcaattcgataagatgcactctcttttgtttaaaaaaacaagacaaagcagtagtaattctgatgaagaaaatgtctgacaaaactttgtacaccgcaggctattctgtcctactccctccatcctaaaatatttgacgccgttgacttttttaaaaaatgtttgatcgtttgtcttattcaaaaaatttaagtaattattaattctttcctatcatttgatttattgttaaatatacttttatgtatatatataattttacatattgcacaaaattttttgaataagacgaacggtcaaacatatttaaaaaagtcaacggcgtcaaacatttagggaatgagggattactaacttggttctacagaacaagggttttgccctccttacatgagtgaaatctcttatagtttaggatagtttaggatagaagtgatatgcaataatcatccgaaaccgaaatcatagctcgtaacacgtgacaaaataatgcccaagaaaaactttgcacatggcaggttatcatcatattagatgactagggatcatccctgtacaagctacacaaaactcctccaacatttagtagtagctatcaatcacagttctaaac

SEQ ID NO: 76652 - DNA, 791 bp, Oryza sativa
agcataacaaagtggatttgtgattaggaagctcaccaggcgatgaagaaaatcttgctcttttgcacattctccccagtaacaaagtcaaaatcatagagggcatatctgcagtcattttctgggagagatgccaggaaatcatcataactctcagttgttgccccggtcttctccacaacaacttgcttttgcttttcctcgattttgaagataacatagcgaaatgctttcttcatctgaagctcaaggaatgtgtccctgatgtcaggagcaacccccataccggaggatgcattggactgcaaacataattacagacacttgagaacatgatcaataaaaacaagacctaataataagagaaactgttcaaaattcaacatcacatgtcaattcagtattcaagtaaaaaaaaagtgaagtaaacctacatagaagcaaagaccattcaagataaatcttatttagtgtgatagagtggtgctaaactttcagaatcacattgtaaacttgtaagaaaccatgagattgctaacgcattctgcgcatcattgagccctgaacatccacatgtgccaatggcaaaatatgtaacactcatatttggtataacaaactacaatatcagtaatcgacttgttgtaaaattgttaacagtaacataacttggcttgcgtatatttttttatgcttggccacagctcataggcagtaaaagaacatgctcacacagaaaaaatgcacaaatatttaaatcaaatagcacagaggcccaggacccagggttg

SEQ ID NO: 76653 - DNA, 12198 bp, Oryza sativa
  unsure (1)..(12198): unsure at all n locations
gaagggaaggcggcggcggcgtctctaccgaaggagcatctcgccggcgcgtcttgttcgtccgccacgtcgctgtacagacatcaatgggggcgtccgtcgccgccgccgccggcggccggacccaagatactgcctcccctgcacctgctgcagcagcagcaagcggcggcgtccggctcccgagccgccgccgccgagctggagcaagagcggaggaaggccgccgagctggtgcacatgctgcacgccgtcatgctgcgcgacagggcggccgacgcaatgccgccgccgatgccgtgctactacgcgccgtactaccaccacggcggcggcgtcgccccgacgaggcccttcgccggcgccgccgggttccacgcgccgccggcggtgagcgtccgttcagtgatcccggtctgcgccgcgccaccgtcgccgcggccgccgccgcgcaaggaggacgatccagcgacctcatccaagagggcgtagtagtagtaaaaactagtatccaatcaatcgcgcagcctgctccgatctgaagacgacgacgaggaagacgatgagagatcgatgggtagccatgaactctgcttcttgcaggggaattttgatcacaagtctccctgtatatctaaatcgttgcaaagtgatcagcatttcttcttcttctcatctctttgctgctgaaatcttcagaaaagaagcagaccatgaaggattgaagatagttgaatatagctcgatcgatcgatctcctagggcttcattagaagccatccatccatgctttgtcgcatgaaaaattttaagctcatgagaatgcacattacatttctttcccttgttcttaatctgctcattattcctcttttatttactactttataatcgattaaaatcgcatcactaacacaaatccaatcagatgtaaccatgctgctgacgatcgatgcagtagtaattacatgtatatataatccggtacggcgagatcagagatcaactgtgagcagggtaaaaacgaacgaattattactatcatctcatgaagaggaggttggcgaggagacaaccaatcaaggaagaagaagggtacgcatctcatacgctgcgttttatggcgatcttgactgctgagcgaacctgcacatgccaaccccccgcaatcaaacgcacaacacgtccaaatcatcaacccatccatccctaaacccaaattaatcgatctcacaaaagccctaattaattattctctcctctcttcttcaaccaacaaccagagttgttattacagcagtagatacactcaggtctagtttagttctctacttttttttaaaccttcaatttttccatcacatcgagactttcttatacacaaaaacttctaactttttcatcacgtcgttccaattttaatcaaactttcaattttaacgtgaacacaccctcatccatgctactccaaaccaagaaagcaagcaaatgttgcaagaacacagagatgctgatgcagatgcaacggcagcaaagaatcaagattcaagaatcaatccgatgaggaggagaagagagagagagaggacatgtcttgacattaatgggcgtagcgcagacaataaatgggggttcagaggggggaggccggcacggagaggggggagagagatggcaggcaggcatgctttaatggcggcctgtgcccattcagtgggcactgtcttcctcctccatctcccctccccccatcaccacactagttgttgttgctcatcaccacactagagagagattgagagtcatgagagacgatgcaggcacaacgatggggatggatagccaccatagccaaagcaataccccaatgctagctagatacagtagatacagagatcaatcagagcaagggctcgtttgaatcaaagaatttatacaaatcatatgaaattcctatgcaataactcattgcatatagattttgaagaaaacttagcaagagtttcaacctcttacaaaatttcctttgagtatatttctctactgattcctactccccccggtttcattttaattgacgttttggataatgacacggtctacaaaatatatctttgaccttatttttctattataatatacacaataaataaatgcatgtttaattttattatagtgttttgaaagacaaatctatatatattgttccagtttctttaaactaaatatttttaaagttattgatggtcaaatttataaaaacttgatttcaaccttgtccaaaacgtcaattcaaagtggtctaatcaaatatgttttgcaatcctctattctcacttgtatttctgtctgaatcatgtgcttttcctattgcttctttttttcaatcatgcaattcaaaacaaccctaaaccttaagcccctttgaatcgcatgattgaaaaaaaaagagaaataggaaaaaatacagaattttgacaggaatgcaagtgtaaaatagagaattgcaaaacataggaatgactgtttaattggatcgcaggaaaaacacaggaatcaaatgagaaaaatagacacaaaaggaaattttctcatagattggagctcttgctaagtttcctccaaaatctatatgcaatgagccatttcatgggaatttcataggatttaaaaaacttcaatcatttgaatcaaatggcaacataggaaaattcctataggatatgaatcctatgaaatttctacataaaatcatttgattcaaaagagccttaaacgactaaacagtgtatttcgtgctaaaacttttttctatatataagttactttaaaatatcaaataaacataattttcaaatttgtaataattataagtcaattaatcgtgtgctaatgattttcttgttttacgtgccttaactttatcttcatcaattttaagcacccctctcccacacaacacatataaatggaagatggaagaaacaaaccaagaaagaaaagttggttttagttgtcttcgaattgttaattggagtatcgaaatagattatttgcttcacatttagaaaaaaataactcttttcttaagaaaaaaacttggttagaccatttgttttgaacttatttttagcaaaatatttaatttatccttataattaagtatatacctttagcaataatttgtacaacagtccgtttttaaacaaaacattagccgtgtgttctacggttcctttttattgaatgactgaacatatgaatgatttgtgataattgtttaagagtactactgtttctgtaaaaaaaaaaaactcaatctcgtactatgataggttggtttttttaaggatgaagggagtacatatgaatgaattaacttatcataaagtttaagaattggatttgaaacaatatatagaaaggttttatgaaaattgtactacctattcatcaatccannnnnnnnnnnnnnnnnnnnnnnnnnnnnnntttatctgcgaaagaagtgtctgaattgattatctgtacaacacaaggagtaaaaaaaatcgcggtaaaattctcgtgagacgatagaacggagtagaaggaactggagcatgaaaggacgagtgaaaacgaacggaactgagatcaaatgtcaagtaaaatggacgcactggctgtacgtgctcggtctagcttgattttaattttagaatttggttttaatgttcatttcaggtaggcaaagtcatatgtacagtatttttcatgcaaatattgaatgctgccatcggttggcttattagcaaaataaaaataatttatggataaaaatataatttaaaaaccaatctatgcagaaaagaacacatataaatgcagaaaagccttatttttatatgtctgtatttagcaatttaaaaaccaatgctgaaaaataattttgataaaaattataaaagatgtgaatattatggaattacctaatatcaaataattaaaagagatgaggtttcaaatctagatcgtctagcccactaccttgtgaagctagtcgaaagactcatatgcgtttctcatttcgataaaaatatcaaaattaagttttaaaatttaaattttggaagcgtttaaaattcaactaaatatgccgacgaatggagttttagatcttttgcttgtactgagtactctggagtagtacgtaatctgtttgtgaggatattttaagcaagcatatgattgctcttttctcaagataatgaccatcaattctccttttggcattgatccctccctcgtatcctgaaccacaacacatggcaccatctgcttggagtaatctacaagaggcgatcgaggctgcgacctacaaatcggcgcgccatttttaaccacttgttaattttactcttcctatgcacccacgcttaattttagttgactactgcctccatttcaaaaaggcacagtcacccttaacctggttaagacaaaaaaaaataattattatcatctcatagtttggattaccctaataatagaatgcatgcacccaatataattaaagatcttaatggtagaggatttaaataatacggagtaatattttagtgaaaaagaggtaataattaataatatgcatgcatagacgtcttatattatgaaacaactttaaaaagtagttgtttcttatattatgtaatggagggagtactgaagtactccattcgttcctacacctagtatagtataataacggatcaggtgccacattttgtagtactccatccttccaaaagtattttggaagccctttttctttttaaccaagatctagttaactataaaaccaatgaacatgcaacctataactactaaaatggttttttgggtttcgataaaatatttaacatagcacatagtaactataaatatgacttagacttttggaaaaactaaagaatgaaatatgacttagacttttggaatgagagagtatagtactaacgaatatggcatttcgtagtacaacaaatctggacaactacctattcatattcattttattatgaaatatcgcatccgattctaggtacacttatattgggacggatggagtattaaccgttatactctgtattcttttgaagggattggaaaacccctaccctccacacataaaacggaacgatgaattatgattaattaagtattagctaaaaaatttaaaaaatatatcatcaatatgatttttatagaaacttttctatagatttttttttgtaaaaaaccccgtcgtttaatagtttgggaaacgtgtgtgctaggaaggaggaagcggaggttggaaccagttaagaacacagccaattcgtccgtttctacatttcgacttagctctctccacaattatcataaacagtttttctaactgcattgctttctatttaaaagcttatttaaataatcaaataaatatttttttaagtttgtaataattagtatttgattaattatgtactaataatggctcatcttgtttcacatgtcgccaaaaaatctcatcccacgagctgacctgaactcaacattaatgcgcttggagctaacaagtagctataagaggaaggctaataatacagtcgacttattgcatgtaaggttctttgcagccttctctcaggccacttaaattatagttagctctttaccattaatgtaggactcacttatctctctcacagagtttattgtttcttgtgccaagctggctgtaaatttatagcccgcttctcctctttctcctctcttctcctctctacctcagtactccttccatctacttttgataggcatatttctaaatctgaaaattttatttttgataggcatatttcaatccaacaacatatcatcttaatgactttctcagatttaatgtgcgactctccgttctttcacacaaaattggttacatgggcatcgagaaatgtaaatattaatgaattgtttatttacaaggaatgactagtagcatgtttaaatagatgataagtaaaattacttatcctttgtctgtgtgccaagataaaatataactatcaaaagtagatggagggagtattgctctaagcccgtattaaagctaaaaagtagtataatacttagggtagcttcaattttttctctctttcactatgaacttaacaatgcatctatttgaagcatgtgtaaagttaatttttgcataagagccaacatttcatatttttctttatcttctcactcacataagctcataattggcttatagtcaactattactagttgaaaccccgtgtattgcagtgggatattttgttaagattggtgattgggatgaaaaaaatccctcattattgaattgggcgacgatcaaattagatgggcctcccatggtgactgtgtgaggtggattaggatgtgttttttcatccaacggttcagagatgatcaaatctactgatccaacggctgagaattaacgataatgtagcacatcgaggtttgaactttagaatcttaattgcagttagtgggtcataactttacagtaagaaggggttcttgcaacaacaacatgatctccaaaacacaattctttataatttttagaaaataagtaaatatttaattttataaaagttttcttcaaactaaatattttaaacattattaatagtcaaggtattactccctccatttttaataattgatagctataatttgttcccatttaaacttggaccactagttacaatttaagaacgaagtgagcaaataaaatgtttatttttagggtaataacatggcttaaatattagaagaagaagacaagcggtcttagtttgaaagtgaatattccaaaaaaaattatataaaaacggatcttttaacctcaatcttattcaacacaataatagttattgtcgattctataaatcggtaatgagaaaagtgagtagcgcacgacatctaaaatggatgagtaaagagacggatttaaacaggttgagaaataataccttactcccgatttcgggattgtatccgccgaatattatattgatatgatgatattggtgttcctatgctctatactttttatgtaggttcgagggcaaagttacaaagggatggattttcttattaagttattcaaccgtataagactaatactacgggctatgccttcgaatataaggtaatacaatgtctaaattctaatctatttacatacttcagtcggataagctttccgtgggtatatatacaatgtctaaattctaatctatttacatacttcagtcggataagctttctgtgggtatatatgtaacccgaaggtggccttgtttagttctaaattttttcttcaaacttccaacttttccatcacatcaaaacttttctacacacataaacttttaacttttccatcactacgaaacgaatttattaagcctaattaatatgtcattagcaaatatttacggtagcaccacattgtcaaatcatggtgcaattagacttaaacgattcgtctcacaatttacacattcgatgtgatggttgaaaagtttttgtcttgggaactaaagcaggcctatgtataccaagtgatgttcacttgtttgtcagccatcaccaaaagaacatttacggcagttgaaccagcttcagaatctctgcagttaaatatttaattttataaatatttcttcaaactaaatattttaaacattattaatagtcaaggttgtactccctccatttttaataattgatagctataatttgtttccatttaaacttggaccactagatacaatttaacaacgaaatgagcaaaaaatatttttatatttagggtaataacatggctttatatctagtttttgtaaatattagaagaagaagacaagtggtcttagtttgaaagtgaatattccaaaaaaaacaattttataaaaatggatcttttaaccttaatcttattcaaaacaacaatagttattgtcgattctagaaatcgacaccgagaaaaagggtagcatatgagatctaaagtggatgagtacaaagacaaagatttcgacatattcagaccttctcgatgagaaataatacattatttttattttggggattgtatccaccggatgttgtattggtctgataatcttggtgttcctatgccctcaggggactccctccctaggttcgggggcaaggttacaaaggggaaaacctagtcagacatgatatggattttcttattcagttattcaattgcataagactaatactacggactatgccttaaaacaacttttaacactcaagacttatcctaaaatataataacttctccaccaacattctgttccaaccaatcaccactatccatcattcgctttttccacctacctccatttcttaaccaatcacgacctctccctatttaattctacctactttcttaaaaatcatgtctaactctaaaacttcttatattctgggacggatgtagtaatatacaaatctggtccacctcctaccttcagtcggataagctgtccgtgtagatatatattacccaaaatctccacagctatgtaacccgagggagaactagcatacagctgcgtgtgttgtctcgtcatctaggtggtgtttggttgcaaggatgggatgggacgaacccactttgaggagtatttggtttatgggttagtgggttgggttggtccctaaagaggaatattcctctcaaaatctaggaccaagccatccggtaaaatcaaccggacgagctcgtcctacctagacggagtacacgacgtcagcttgtctctacatccgctggcgctcatccgtgctgtctgccacctccgcaactgccgacgcctctctgcaagcggccgccacctctcctccacgaccctccgccacctctcctccacgagcggtcgacgaccctccgcgacccactgctgccgaccctccgcgacctgttgccgcttctcctctgcgagaggccgacgatcctccgcgacccgtcgtcaccttgtctccgccgcctctcctccgcgagcggccgcctcgcctctcctccacgactggtcatctgccttctcgctcgtccgcccgtctgcctgttggtcgccaccactcctccttccgcctgctcgctcgtgcgctcgtcgagtcatcggccacgccgtccctcctccgcttgctcgctcgccgagttgctggccgcaccgctcccaccagcttgccgccgggatcgaacgtgggttgacggtagccacaaatggcgtccatcccatacctccctcatcctttctaccaaacaaagaactgggatggtctcatcctatgaaccaaacatgcgagtagaatcatcccatcctaaaaatcagggatggtttcatcccaccccatctaatcccagaaccaaacaagtgttgttcttggctttgatgatgtgccgattaattttccaacgactttcggtactccaaatactccatcaatgcactggcacgccatatcgggggtgtttagatccaggggtgtaaagttttggcgtgtcacatcgggtattatatagggtgtcgtatggggtgctcggacactaataaaaaaactaattacagaatccattagtaaaccgcgagacgaatttattaagcctaattaatccgtcattagcatatgtttactgtagcaccacattgtcaaatcatgaagcaattaggcttaaaatattcgtctcgcaaattaatcgcaatctatgcaattagttatttttttagcctatatttaatacttcatgcaggtattaaaatgttcgatgtgtcagggtaaaaaattttgggtgggatataaacagggccaaagccaaagtctgaactttcgaaatcttctctcctgcatctgcacaaatgtgacagtttttaattatacatgctttgactatgactggtactagccgggagaagaaaggagaagagaagatgagagcaagaactgaactgttccaatccaaggccacttggaccctgccttctccagtcgtatctggcgcaggtggcgatccttgatgatgatgaatcggtgacaaccttgtggagatttgcagtttgcagatttgcagatttgtgatgatgatgatgatgaatgtgagcttgagtaagttgagtttgcagagcagcatagcatacggccatggcagctgcatactccactatgcacaagttcaatgcatgcatttacaaactcctcgtaccccctgtgagtgtgacagaagaagagggaaaaaacaaggatgcaatcttgcattcttgcttcttgtccttgtccaggtccaggtccaggtgcagtgatccatcagatttaagacattttgttaccattatcatactagatgccataccattgttttcatgaaattactccaagcagatgcaactagtactagactactagtatgtataccaagtgatgttcacttgttcgtcagccatctccaacaacatttacggcagttgaaccagcttcagaatcactactcctacctgcagtagatgccatttcagatagattggcaatcaattaagatggccttttggccgctcaagaaactgtgtactaccaatgaattgaatgcagatggaatttctcgcaagatcttcagggatatgttcagtctgcatcggaggggagctgatcctgcacagtttctcaattcttggcatattagtagaagtagattactagcagcggcatcgacgatcaatgcctttgttggcttttttttttaatacgcaaggagcgcatctttgtattaagaaggaataaatatatgtacaaagcgggaaaaaaaacaaagcgaaggggacagggtacaggaggagaaccaagaaataaaagcctaatctccaactaaattttgcgacccttctccactaacatgagctaccaaaacggggattgcagctctagctagccgccacagctccgcttcacccgtcataacccttgcaacctccgcccaagttctgctcttctggttgaagactcgattgtttctttccttccagatcgtccatgcaaccaacgtcacgatggtgtcgaaaccccggcaatgttccttgaccatcttcttgcgacagtcgcacaaccatgagaggaaagagtgttcattgagcggtaagcactctgaatgcccgatagctctgagcgcaacccaccacagttgccacgactccgggcatgcgaccaagagatgatcaattgtctcttcgcattgatcacacaaaacacatcgatccgggtgcgacaaaccacgactccggagacggtctgctgtccagcaacggttaagagctacttcctccgtttcataatgtaagtcattctagcatttctcacattcatattgatgttaatgaatatatatatatatatatatatgtctagattcattaacatcaatatgaatgtggaaaatgctagaatgacttacatcgtgaaacggagggagtaccaaccaaaggaagtagcgacagcgagggggtgccaaagattgccaaattagcttgtgctggagacgagttcttccaaaaaagagaacacgagaagccgagcgggaagagtattctcctgaggtctcccaccgccaagatagagagtccggctcttcggaaagccgcactgaccgaaggcaatcccaaagcttgaaatactccaggatcgcttgaatacccaacgccgaactgatgtcctggatccatcttctgttagtcattgcctcggccaccgtgcgtcgattccggagatgggcagggattgcagcatagacagccggcgctagcaaccgaatggaggaaccctgcagccagcaatcctcccagaacagcaccgaattcccatcccctaccaagcataccatagaaatcgatactagattgcgctccttctgcgagaccagaatactaagcccttgccacggcttttccggtgaagttctctgctgccagagccatcgcgacctcaaggcgattcccaacctctctagatcaggaatccccaaaccaccatactccttgggcgagcaaactcgagcccatgcgacccgacagacgccgccgtttgcat

SEQ ID NO: 76654 - DNA, 1236 bp, Oryza sativa
tctgattagccatgacttgggattgtggctgatctttgagaggtttgacgtgggaagcttatagaattgagctgagttgatccatgaaactgacgggatcctgatccgttgaaattgcccctcacactgaccatctgctgcaggcacgagagagagggggagggaatgagagggattactagagatgaggtactaaaccacttgcctactgatctgttgtgagtagacttttattgttcaagttgcttaagcaaacaacctagtatggtcgcatccccaccaatgatgcaaaccatacccctacacacaagcaaacaacacacgacctagcagctaacgaaactactcttccaggaagtattgggtttaggtaaactccgggaaaactctccttgatcttcgcggaacgacgactctgaactgaccttcccgctctttgctgcatgaagcttgatgcttgacttgacttccgaacagacacgaagctgacggtttatcctccacggtttaacaactataagaattggagggacagggaggagaattttgaaaaaccgtttcgcaaagaaaagacgaagggcgaggggagacatttttcaaatagggttttcagaaagcttgtccttagggtttgaccgtttggctcaacctacagtcgagttggctctgataccactttgtcacgcccagaaatttaacccaaatttccagactattttgcgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaagactgagtacaaccaccgtactcagcaagccactccaacgatgcagacgtgcaaggggatacaaggatggtttgtggctatttgcataacggcggttgtaaaacattttattgagcaaaacagtaaaactgttgagtatttagagtaacattaaatctccactgatcaacgctacactacgttgaacaggcccagccaacccaccagaactacagtgcattgagtcgatttattaaggggactaatcac

SEQ ID NO: 76655 - DNA, 1616 bp, Oryza sativa
  unsure (1)..(1616): unsure at all n locations
gttaagaatagtacagggtcactttatactacacaaaccgtcacgtttcttttgattcatgtattcctgtttaagagacttttaactcatatgtcgtcgtccaaaattttcagatcttttggaagcttctcacgctgtatgcgtgcaaggctctgaggatttctgattgcatccagcatcctgtccaagaattcaatgaactggcgatcttcatgagcaacctgaggatctgaaaacctatcgaagcgatactgatcctgcacgttccattacaaccataaagcttcaaaaaacagaggaactccagcactaagcaatagatacatcgtggggatatcatatactacataagtacgtcttaaatcacaggtatgtgcaaacagaaggtcagtaaacttgtagatatatatttacctcaagtttagttttatgatgattatgattactagtttaccacaatcttggaatttatttgacactgtacatgaaaagctgaacaacaacacatctacttgtctaagcacaaaccttttatttaaacggaataaccaaaccacaaacattcaacttcgatgtagaaaaaaaaaaaggcaaattttggatagaggtcgaaccttgatcgtcgtgtcgacttgcccacacgcgctgctgcagaaggattgatagctcgccggagaaagacgacggagcccctccccatggaacagctgcagctggcgatggccggagaggcggcagatcgcctgaattctcccgaggaccaactccgatgccatgtttgcccaagcaagcggntatcctttgttcccctcttctaattttcccctacttcaatctacaagcttctccagggatcgagcagtagttgtagttgtagtactatcggagtattacgcaaggtatcggcagtcatggaaagcttcgttggcctcgtttggaccggccgggtcagagattgactgagattagcagtcatcctttgacggaacgttctttggtctcgtcactgatgactagataatcgcaagtcacaacgtgtctcctgatctcatctttgatttctcctcctgtagctatcttgttgattactactaggtttgtctccgcacacctgggatgctcccagtttagttattatccctctcaggctctgccacgtagagcagaattaccatggctgtagaccccaaggcgccgtttgggcgcgtaactgaattttttagagatgtttcgttacgatccttgattgccaatttggctggaaagatatggcatctgtagcaataattttgatcgagaaaacgtgtacgcgtttcagcggaagcctggaaagatgcttcgagaagaatattttgccaattggtcatacatattacatggtcgctggccaactttcttttatgactcggctcaaacttttaatccatggtctctgaaaacttaatatagacgtgattcacaaaaaaaaaaacagaaaaattcacacgattcttcacagtaactgtagatctcgggttgtaaaattctccggtcgtgtggtggttgtcataaaccgaccggcaacaatgtcgtatggtgaaaaaaaatactgccacacgattaactccctggcattt

SEQ ID NO: 76656 - DNA, 933 bp, Oryza sativa
caaaatgcttatgagaatatgtatcttgatgatgaaattgatgtaaacccttgaactggatgattgtaattgatatgaacattttagctatgggctgtactcttttcctttctagggttttctcacgaggtgtgagtttttacctagaaaggtttttaatgaggcagccattgcacaatcacagcttatataaaccccttttatattctaactttctaaggtttgtgattctgagatggacttgatggattatagtagatgacttgatgtatgcatttgatgaattgatttgaactgattgtaaatctatgagactgtgacttgatgaattggtgacttgaagaattgttcatttgtttgtaaatctgtgacttgatgtatgcatgatttgataaactggtgacttgatgaattgtttgtgattctttgacttatttgatgaattacatgtgaatttcatgaatttgatgtgttatgtcaatttgttgtgttgaattgaacctttgaaggggttttttgccagggcgtgcctgggccggcacgggcacgatgggcttgccgggccgtcgggccagcccggcacggcccgaggctacttgggccgtgcctgggccgtggttgtagcccgtgggctggcacggcacggcacggcttgttcgtcgggccgtgccggcccgactgacctcggcccaggcccggtcgtgcctgggccgtgccgtgccgggcggcccatatggccaactataactggggcggacggaggatttgggtggtatccggaaaaggctagtgccgtccctggtcaattaaggaccgagccatgaagttaagcatgaaacgacccccgtacaaccgcgcttctcgtatgggtatagacctagcggagtagatggctgagcggaggcagtatccatgcatagtggtttcttgatg

SEQ ID NO: 76657 - DNA, 711 bp, Oryza sativa
ttcctgcagccctactatgacaaattacatacacaattcattgcttatgctatgctcttatgctaacatcgggggttcgcattctcaccaaagcctgaatggattctggtaaattcgaatatctagaggcggatcgaactatgcatatgataacagtcctatgtgaaaatagtagatattcttcataattaacaaacaatctcaatgtgtctatggggctcgagactcacttgcccatctctaaaacctgggtaacatgcttggaacgagggagtagattttctactcgctaaggctctctttggcacaactactaattgaagaatttctttagctgagaatccctggcttcatcatgccatggatatacacgatcgcgatgatgatattatagactaatgctactattgtaggtacaatttaggagtaatatcactactataatttagtaacatataaatgttaaatcatacacatatatgatatgtatacgccatagctatatggcgaatggtcctatgctataacacggtttacgctgtgttaggatacaaactctcaacttttttcatcacatgaaccgcgtcatacacataactatgtactcacatcgtactaattacaaccaaaaactataacattggacacagacttggaccgtttcatcggtgcagaaaaccactcgatgctctctatgcaaggggaccccct

SEQ ID NO: 76658 - DNA, 1066 bp, Oryza sativa
tcatctaaagcaagaaattgatttattcaaatattatacacgtaatcgtagatccaaatccatggatgtattgtggaccttgaaatactcagctccgtaaaattttggagctctgctaaagaggaccttagctctaagaaatcttgaatattgagttgtacaaagaggaccttacctctaagaaatcttgaattttgaattttggagctctgctaaggccgtgtttagtttcaaagtttttcttcaaacttccaacttttctatcacatcaaaactttcctacacacataaatttctaatttttccgtcacatcgtttcaatttcaaccaaacttctaattttggtgtacactaaacacagcttaaagaggaccttagttcatggcaccatttgatagggagaagggcaggagattaaatttgctaaaaggcccctgcaaaaactacaaataagtactagtcctactttattacaaggcgttctctcttccttccttctcagcttctccaagctcgcgcgcaagcaagccgccgccgccgccgccgccggagagatggactcccgcggcttcgattccgaaggccgggaattctccagcgccaccgagatgtgggcgcacgaaatcggcgccgcggcggatgccccggtctccgccgcggtagccgaacccgctccggcccccgccgccggaagcaacggggtcgccggcgaggaggaggcaggcggcggcgggaagcgggaggagtggtactccaaggcaatcgcctactggcaagtaaagagcgctcactcactccctcctcctcctccctaaaccctaaacccccccaaatccgagcgcattgtctcctcgcggcgaattcggctacaagttttcttgatttgggtgtgctagggcgtggaggcgtcgaccgagggtgtccttggagggtacggatgcgtgaacgacgtggacgtcaagggcagcgacgcgttcctccgtcctctcctcgccgagcgattcggctccgcgaggcgccatctcgtcgccctcggtgagttcacttctgtggaaggatattcgtt

SEQ ID NO: 76659 - DNA, 15846 bp, Oryza sativa
gccggcgcggtgggtgggtgcgtgtgggcgtggaggtggcgcgccatggcggcttcgatttgtttaagcgaacgcgtggagcacgagggcgacgtggcgcgctctggatggcgccacgtcgcccccggtggcgcaaaatatctcgcgcttttttttcttccgccgagctggctgaggcggggcccagtaggttctcttggcccatatcagttttttttgggcctgacggattgacggcccaggagcccagttaagaagatcactaacggcccaagtcttcataataagaagagaaattataaaaagtataaagaaaataaagaaaaagaaaaacacaaacggcccagcgaaaagtctgcacggaaatgctttgggaaaagaaagaaaatattagattccaatgattgaacaagatctagcagtggcagcgacaagggattatgggcttgactaaaggatgagggaatgatcaattgaggtcactggtgacatccaaatcccatttttgaaaaaaattcccctgtttttgccaaagcaaaataatgggaagaaatttcgtttataaaagtttgggactgtgtagcttccagtctcctcaaaatacctacaaatttcactcactcttagaaagccaagatctcggcttctattttgattacttttacgaaatataaggaaaattaagtatacttttttgggtgaatagctaatttaatctctcaagtttcaccgaaggctcaatttggttcttcaggttttattttgtccacatatatcctctaagtatttgttttggcttaaaatcatccttaggctcacttaatagttaatatgccatatggctatttctagtcaacaattctgttagaaaatgtctcttttgcctgtaatttgtatgcaactataaactagaaaagtgaaaaccaagataaataaacaacatttttacttcccattatttcaacatgtgcatatgaaacttagtctaatggctatcgtatacacttgcaagtacataatttatttttgttttacataaattgctatccattatctataaaaagaattcattgcacgcaattttttctcttatatatgtgaatgagggagtataattgtcatttatcaatagagttgttggttatgtgagtttaaggataagtttaaattaaaataaaaacttgaaggactaatatggacagattagaacatcaagaactaaaccgagcctcgcatgaaacttggaggaccactttgactattcaccctacttttttcaaaaatgtcgacacataatcaccacttccttgccacttgaaatttgaaaacacaactatccacatacgttgctcctgttatggaatattatctcccaatgagataatatcctttcttgtattataatctaaaccgaagtatagataagatctatttcctcctaagacctccctatatatacagggacagagtgagatatctaaggttgatttgtactccagataagatttataatgaaaagagagctccaccctacatatgtgttcattgtctatttctacaatgttttctgagggcaaagggaagggcacggatgttctatatcatctcacacgtctactgttatgggagctgagggacaggaaacggatccgtgatccgctaatgaacgcgttgatttacaacaactccaacatttcgaatcaaaggtgggggtagcttagcaatggtagcatgatgggccgcaggaaatggcgggaaagataacgaggaacatatcctgcgccctttccgataatggaaaaaaagagaccaaaatgggctcgcaggatcggatcggatagcagatcggtcggtggtcagctcatccaatccaatttctctttaattctgcaactgcgatcgctttcagtgtcaacttttgcagggtataaatcgggcaacggacggagatcttgccagcccaaatcaggaaagtttctcagcgagctagcagctatagcttagctggagatcgatcgagaggtagaagaagaagaagaagaagaagaagaagaagaagaagaagaagaagaagaagaagaagaagaagaagagaggcctcgcatggcgatgagagctcgcatctggtagccaaggatgacttgcctgtgtctctgctcatgtgcagtagaagaagatgcatttctagctgctttctgcatatgtgatctcacaggcagtctccttggctagcctgagcggctctcatccttcatgcctggctcatctcttcttaatgatctcttattagtcacagatcctgtagagattagttgatgtttgatgcttgtccacttcagtgccacacataaacatagcggccgtgatcaactgatcagtccagcctgacagagaattcagagagcatgacaagatcagcttctgacaaaccgcgcgagattaaccaacaaatgtattcagggagaatatctgaattgcattgcactttgcatgatcgggacattctcgttaatttcataattaaaattcagatgctctctctgtacgtaactacgtataatactaatatactttgctgaattgctttggttcttatttgatgtgtgcaggcaggcaagatcaagactacagcggtgcgtgcttcctgaactgcctgtggacgaagacgaacagacaaagctagtgatcgatcgatgctctgacgacagccactcctgcaggctgcagcttatgcactggtgcatctgctagatagagcctaggagagtaggaggatgcacttacagagagacagaatgtgttgttctctgcttaatttgttagttaccacactgtttaattcctctgttcaatgggaaacttcgtttagggtgtgtttagttaacgctaaaattaaaagtttgattgaaattggaacgatgtgatggaaaagttggaagtttaaagaaaaaagttgaggactaaaccaggccttagtttgttcctagtactgcatcaaattttgaaacttttagggcctgtttagttcccgagagtgtcacatcggaagtttgaccagatgtcggaagaggttttcgaacacgaatgaaaaaactaatttcataactcgcctggaaaccgcgagacgaatcttttgagcctaattaatccgtcattagcacatgtaggttattgtagcacttatgactaatcatggactaattaggctcaaaagattcatttcgtgatttccatgcaaactgtacaattagtttttgtttttatctttatttaatgctccatgcatacatgtgtctaaatgttcaatgtgatgtttctgggaaaaaattttgggaactaaatcgggccttagtcagttagtcctcctgtgtcatctcatagacactgaaacttgtgttacgccaaagcaaaactatcaaaagatttataaagaacaccttagtacgcctcgatcatggagaagtcaatttagggcagttggtgaaatgaaaattttatgatgtcacatcgaatgtttgaccagatgttggaaggggtttttggacacgaaggaaaaaactaatttcataactcgcctggaaactgcgagacgaatcttttgagcctaattaatccaccattagctcatatgggttactgtaacacttatggctaatcatggactaattagactcaaaagattcgtctcgcgattttcatcataaatgtacaattagtttttttcatctacatttaatgctccatacatatctctaaagattcgatgtgatgtttttggaaaaaaaaaattggaaactaaataggcccttacaatgtaaatgcatgtacgcctatacccctattgtcttgtttgctttgagatttgtgtatgtagcatagatttcaacaaatcacaatattatattcctccttttagtacatcacgaatttcaataattcatcaaatgcatccaaatatagggcacatacacacttgcgttgtaaaaggtatgttccctcgacaattaattccacgcacaagagaaatctctaaccatgaagtagtgagaatcaactatgggggctccctcgacaattaattcgaagcacaaaagaagatctctaaccatgaagtagtgagaatcaactatgggggctccctcgacaattaattcgaagcacaaaagaagatctctaaccatgaagtagtgagaatcaactatgggggcgtttagatccatggtgtaaagttttgacgtgtcacatcaggtattatatagggtatcgtatgtggtgtttgggcactaatgaaaaaactaattacagaatctgtcagtaaaccgcaatatgaatatattaaacctagttaatccatctttagcaaatatttactgtagcaccatattgtcaaaacatggagcaattaggctaaagattggtctcgcaaattagtcacaatatgtgcaactagttatttttttagtcaaaaacttttaactcaaacttaaaactttcagcccaattgtcaaaactttcatctcaaatttaaacaacttttaactcaaaactcaaaactttcatctcgatgtctttgcgtttccttcacataccaagaaatggtccctgaacattggattgaacattgacagcgggcaattcaaggaggtcggatacggatcactctcatggttggagagattttacagtcattgagagatatcacgaggtgtcgaggtaccaaaattgttagttaaaaaaaattctgcatcacagcagaaatgactactgttttttttttgtctgagctctgaagcagcagtttactgcaagaaacagcagctaaagtacggcatcacttgaacacaaccattggatttcaatcaaacggttcgaaagaacctcttgaatgctcatcctctgcacttagaccaccaaaagtcagaacatagagaatctgttctcaataacaaccatccccactacttctacaagcatgtcaacaaaacctgatcttattcagatcttgaagggcatttcgagtgccaatcctgaacattatattcgttgcaaaatgtcaacgagtgatccttgccaggatatgcacggaccgtgcatatattccccgctttccaaattgggcaagattgaaaaggcgccttcagggcttgaaccgaatccaatccttgtaatttgtaaaggagatcaggagagtggatcaaattattcgatgctgcatggacccttctctccctgtcgagatagatagatagatagctccgttagcttcttccattcatggctgtctctcctgcttcagattgctataaattggccatgaacttgcagtgtttttttcacacaaacagagcccaaacacacacaagaggagagagatgaaatatgataagagtctgtctagatagccaaggatgacttgcctgtggcctcttggagagagaggtgtagcttaattagcagcatggtttgagcattgcttgatcggttgatcgcttcgcttgctctgcatgagatcttacaggcagtctccttggctagtctgggcggctcttatccgttctagtacaacataggcattaggcagcattgcagccttgcaaagtgcgaacagcagtcacctttgcagtgttgaagcaatgccacatataaatttagaaattttctcatggtttatatggttaattatagtcgttaaattatttgggagacgaaactgtcacatatcacaagttatatttattagtagtagtgattttcttatggtccgaggttatattaccatattttcgcaaaaaagaaaatgttcctctcaaggaccgtaaaatttccttgcatttatgttttttgaacttctgttgatgatatgcaaacatataccaagcaattctagagatttatgtgttatataattgactcaaaacaagggtttgttcagcatttaggaaagaggttactcggcggtatggcacttgctgtgaaaaccaagaggttaaggttacctataaaatcgagagggttacacaaacacccgtgatatcacaaaccctagggttgtagggcaataattatgggggtatgggtattacgacgtcaatctgtgttatctgaactctaggtgaagatataatttagagcatccttagtggttcatccaaatctgatcctccatatacttatttggatggtcatctaaaaaagattctcactctgtatcccttttcactccaaccgatcatccatactacatccttcatatcacactctcttatattaacatctttcaactacccatacatttgtactatttttttcgtaatagctaaattttgaatgactaaaatttaacagtgttatttgtagtggattgttttaaataaatgactctatttgaatggatatatttttgataggtaattttttaattgctatatttccaacggattggtattttttcaaagactaagttgtaacggcatattgcatatagccgaggaggagaggcgagtggctaggcgttggcaggtgcagacggccgacgacgggagccacatggcgcattgggcaagggtgggagcaggcggtagatctcggagcaggcaggcgtaggtggctgacggcaggagttggcacgagcacggaatcagggccaacacataatctatccccacctctaacgtagtcttcataaaaaaaacgttggaaaggaaggtgggagcgggagcttgcaagatggtgcacatgctatttttggaccatcgggtggagtatttgctggagcctggttttcttctcaagtaagctattttcatgatggaggatgggatgaagtatcttctaggaatgatcttaagtgtagcacgtagtattttcctttacattttcatgctttatgtgcatataggcacacatttttactatcgcacaaacatgatagagtagagaagatagaggaaccatctataaataaagtagagaaactacactagtttaaattaacacgggtttttactatcgcacaaacatgatagagtagagaagacagaggaaccatctataaataaagtagagaaactacactagtttaaattaacacgggtaaaaacttacagatacaagaatctttgaatttttttcaagcattgcactacagataaaaaaagctttgaatttaaattctggcactgcagataaaaaacacatgctacatatacaagaatctttgaattttattcaagcattgcactgtagataaaaaaagctttgaatttaaatgcaatcactacagataaaaaaaactttgaatttaaattcaagcactgcagataaataaagaaataaatctttgcatttaaattcaagcactgcagttaaaaaaaactttgaattttattcaagcattgcactgcagataaaaaaaagctttgaatttaaatgcaatcactacagataaaaaaacctttgaatttaaattcaagcactgcagataaataaagaaataaatctttgaatttaaattcaagcactgcagttaaaaaaaactttgagtttaaattcaagcagtggatataaacttcagatacaagaatctttgaattttattcaagcattgcactacaagcactgcagttaaaaaaaaatttgagtttaaattcaagcagtggatataaactacagatacaagaatctttgaattttattcaagcattgcactacaagcactgcagttaaaaaaaaactttgagtttaaattcaagcagcggatataaacttcagatacaaggatctttgattttattcaagcattgcactacagatttttaaaaaaatctaatttaaattcaagcataaagcataaattaaaagcactgcagtttaaaaaaactttgagtttaaattcaagcagcggatataaacttcagatacaagaatctttgattttattcaagcattgcactaagattttttaaaaaagctaatttaaattcaagcataaagcataatttttttaaaaaactaatttaaattcaagcataaagcataattttttttaaaaaaaatctaatttacattcaagcatgaatttgattttattcaaacattgcactacagattttttttaaaaaaaaataatttaaattcaagcataaattaaaaaaaatataatatctgatttaaattcaagcataaatttgattttattcaagcattgcactacagatttttttaaaaaaaataatttaaagtcaagcataaattaaaaaataaatgcgttagaaggagggcttgaacctccgaccttgtggttaacagccacacgctctacccaactgagctattccagcttttgtctcttaaaccacatccaccattttctcctttgatttcttcatattgggccagacatgggcgcacgcgtacgcatgggctcctttctcgctggaaataagttcgctttatatccctcatcttgacgtcgagtttgtattacttccttaaccataatgccagatataatgtatccgttaacttacaaaaccgtattaaccaaggtcttagggtaatattatatctagtttggctgacatggtgagctgaattagtgtgggaccacacgggtctaacatgccagcgaccggttctttcttcctcctctcttcctctctctctccccatctctagagcgacgaccaacggagagaagggcggtgcgtggtgagcatcggcataatccgacagtgcgatgtggccagcgacacacttgccgagcagcaacgcgtcctcccactcccgcgcaagcaatcactccagcccgacgtaggtggaggtgttaacctggttttccttggcggagtgtcgcttcctcaagtagaaggcgttctcggtgaagcaacggctacggatgtgaacgtaggacttggcctcgcgtcgcacgtcgctgttgccctcgatgcagccacccgacaccttattgtgtttcttctcgtagccaacacaagatttttgatgggttacatgtggtccctccgtttcacaatgtaagactttctagcattgcccacattcatatatattagacatatatatatttagattcattaatatctatatgaatatggataatgctagaaagtcttgcattgtgaaacggaggaagtattgtccacattcatatatattagacatatatatatatatatatatatatagattcattaatatctatattaatatggataatgttagaaagtcttatattatgaaacggaagaagtattgtactattgtggttcaaggatggtttttaaactcgcactcaagtgattgagggatctttggtgaacttattcctttctcgctgccccgagcggagcagcccacttgttgggcctccaccaccgccggtccggcccaaccatcccggaatactcgttgacatcgcgatgcgtcgtcgtcgtataataccacagatacgaatccgctcgccggagtccacggggagatcggagcctgcaaggcaagcaaccaccgccgccgacgacgacgacgttgacggcgacgaggagacgatgagctaccagaaagtgccgcctcctcaggacggctaccctcctccaggcaattccccccttccctcctcccccggatccatccctcgccggaccgggataatcacactgcggcggcggcaggggctttcttgatctcagcctccccctgttcaggatccccattctgttctgggttgatttggatgcgtgtccgaaatctgaatctgtgacggcgcagcatcgggtgtcgccgaattcgtgcccgattatctgatcgatttttagggtcgttcttccgtgatttctctgatcgattcttgggctgtttgtttctgtggatgcagggtactcgcagccatacccgccgccaccgtccggcgggcagtacccacctacgcagtactacccgccgccgaaccagcctcctccggggtaccagggctacttcagcgaggggcagcagccgccatactactacccgcccccgcatgatccccaccaccaccatggtcaccaccaccaccacgaggaccatcaccaccacggccaccaccaccatggccaccacgacgatgactgctgccttggcttcctcagaggatggtaattcaaagctttactccttttcatttcttgccaatttcgtgtgaatactttatactttcggtgctcgtatgcgttgttaatcatggatgctctattgctctgtgaactacaagttcattgtgtgttgctgtctttggtaaatttgtttcacagaatgaaatttctaaaaaaaaaaatgtttcaaagaatgaagatctggaacaaatgtaaaacatagacttagctcagcaatctgattatgaatagacttatattaaaaaaaaacttaaatgaatgactgattttacgatatcggctggtacctccttgatgaccatgtaaaatctccaaacaacaacatctctaccatggtatatccattatagaattatatattgcttgtgcatctttggatagttaatactttaaacatcggaatcaattaaaatttctcctcaaagataacttttcgatgaaaactgtgcaatataaataaaatcatgctagctcagctgtactgtactttgatgaagtgttaattataggccaaaagaatattcagtatatggtgtcatgggcaggatcacaagattaataaattgctttcttgagtactgaggttctgcaccataaaaaatgtattgctgaatgctgagctgattggatcacatatgatctgaaatacttcttgtatgtccttcgaagttgtacatactccttcatgatgcagacaatagttgaccttggactgtgacaatttcatgaagctggtttatttttatcttccgtctctatctctatttttttaagagggatattcatccatctaaccctccaactagataaaaaccgccttccaaaacccacctcagaagaatcaccgtgacttcccactgaacaggataactcttctccatgtcctctcttgcattggtggagcttgcaggttgttgcaaagggctatctaataaacatgcttagataacttgagaagagaaggccaattagtatttacattgattccattgattaatctacatggtaaaactaatcacttatttagcaacttgccatggccaagcttggccctaaaaaggctctgccctgctctcccggtatggtgaatatttttgtatgattataggaataataatgtatacatgaaacatacaattagctaatactccctccgtcccaaaacgtagtgaattttagagttcaaacattgtcccaaatctagaaacatatgacatgtaaaaggtagcttttgccactaaactatatggactaccactactatcccttagccctattatagtctgggcctacacctcacccatcccaagaagacaaacaagtcatacatgttccgtcatatattctgcgacggtgggagtattcattttgtatcaatcacttccgcgcaccaaaagatgccatttgtaaggttccagaattcgtttttgatatacctgtgtagttttcttttaaccaaatgtacctgtttaagttgatacttttttatgtttgataaagggttttaacagaatgataattaatagatgaggcattttatattgagaagactgctgtgagtagggttcctagcttaaaattgcttaatctctgttttctttttattaggttggccattctttgctgctgctgcgtgctggaggaatgttgctgctgctgctgctgatggcctgaatgctttgaagctccttgttatcaactattcttgaatggaaaattttaagtgtgaatttgattttctgtgattgatggacagtacgtagtgtgcatcttgttattatttgtcaataagtggactctgttatctgtatatgccccgctcaaatatgaaaggtgttcagtttgtttcagagtcaataagctgattgtgctattctgtctgtccatgtcccgaactagaacgtaaccccccatcccaaaaggaaaaaaaaaaggctatcggaagttttctcagtagtagtggattgctgagatagtgtacagtttgtctaaagaatttggggatggttgtagttctaaacttttgtgctattcgagaatcaaaataaacccatgatcagattaaggatgttcattacaaattgacaaacactgattttaaaacgaaaaaatttagaaaaaaatatatttttgtaggaagttttttgacaaaactcagcatatgacaaaatttatgttgtttaattcacaatcagcaatggtttcgtggtgtagttggttatcacgtcagtctaacacactgaaggtctccggttcgagtccgggcgaagccatatttttattttttactctcatggaccgtccattttaagcccagtagcttttaaaaaaatcatgggccggccggccgtcctactgaaagcccagtatcgtatgttgcgtggttcaccggtgacctactcggcccacgggttgatataagccggcccaacccaaaaaactcttacttctgttgcctcccgaagcatctggagaattggaagactggaaggccgacctgccgctgccggaaaaccccgccccccgcgccgccgcttcgatctccggctcccctccgccacttcccttgcctcccccacctcgggtcggccagttcctcctcgcagttgacgagctacctccggatcgagggtgcgatcctctactctcttttttttgttctactttcgcgagctgatgaaactcgagatgaatccgcgtatacggcactcttttacgtttttggagaaaatttcacccgatttgattgggttagcgattctccgtggggttttgagcgcaactagggcttggggttgggaggacagttcagggatgatgcacagcccctagaattttaagttaggtgcaatggttaggtcatgttttctgaatttagattttcgtgacgtttttaatgtgagccgatgatagttgtatgtttgagagcttttctgattgtttgatggggaattagaggagagatgctaaatagaagaggggctgcgattatattgttttattcaaaatttggattgtttgatgcaatgaattgcctgcctgttaatttatgaaagatagaaaatgctaggggatgagcagaacgaaagtgctccactgtactgctgcgatttatagtgttcatgcatttggatgttcctagctgacacagacaaactttgaattgcagagaggtgttctcatttgtttggacttggaaactctgggaaaatgttcaagaatacatttcagtctgggtttctatcaattctttacagccttgggtatgcagtgcggtgatctactcgcattttttatatcatacattttctgaactgttggatatctcattctttactgttgtcatttggtcaggaccaagcctttgcagatatgggataaggaaggtgcattattgtttatacttggattctccttaacttcagtcttttactcatgctatactgtagacagagcattgtctgatattcaggacttatctgtcacgatctaaagatatctgcttctgattgttgccagagccagatctgcacatgggcaattcccttgactctatatttggtttgtgacatatgcattgaatatgtgttgtataatctacagagccagcttaactgtttaactaaatctgagttgcttgcccccccccctcctcttttattgaaccttgttcagaaacgaaaatgtgtttccattatcacatttgggactactgttgaccctttctcaaaaccattcacgtgcatagcttaacttcacatggtctctgtgggaattttagtaggggtagttattgatacactgtttatttatccaagtaagggtggaaaacataaactaagtgtgcttcagctgtagtctatgccaccaaaattgattattaaaagctttactataatcttgtttgtcaaacatgctgatctggttatttacctttcagtgaagaattctattctatgtttacttgtttaacgccttgtctattatgcagttgtagatgggcacatcaaaaggcctcaggatgaggatatccagtctaatgtacttgaaattattggaacaaatgtgcaatcgacttacattacctgcccggctgatcctgctgctactcttggaattaaacttccatttcttgctttaatcgtgaagaatcttaagaagtacttcacatttgagatccaagttttggacgataagaatgtccgccgccgatttagagcatcaaattttcaagtatgtataatctggaattcatttttctctctgtaggcattgcgtatctacaagcactgaaagtctaaaactttcatcatgttgttctgcttcataacttgaaagtatgaaatgcttttgttcaaatttgttaattgtcctctcatggtatttaaaagggcttagtgagacgtaggttgactagaagtgatactttacctgcaacattctagttcagacttgaagttaatgttttatactctgtttattcatttgaacagtggaattcatattagaagagttgtttatttaaccactcggaaataagaaaaataatacattttctagatttgaatttgtcaggctcatactgagatagatatcagtttcttgcttcgcccagtcagcaatcagcacatgagtctcatgaacatgtgtcatgcttgcattgtttttcactagtcttatgatgtggttgtagtcttgtacgcaatttgccatgtttcagttcccatttttatatttttgtaccgcatcaggtgcaatagcatatgtaatgtttgacatggccttcttattaaaggtagttttatggcatcttttgtttctgctcttcttggaatttgaaaggtctaaagttgggtttctacttttttgtttctacatgtaatgcatattgacttgtaaccgttactattttccagtctgtcactagagtgaagccatatatatgcacaatgccattgaagctagaagacggctggaacaacattcagttgaatctctctgatctgacaaaaagagcctatggcacaaattatgttgagacactccgagtgcaagttcacgcgaattgcagacttcgtagaatttactttgctgaccgcctctactcagaggaggagctgccacctgagttcaagctctaccttcctattcaggtgagaacaccataccttctctactctgttatgaaacatttgcttgtttctgatccatctgttctaagttgtaaccttttatttgaacttcagaaggcatagaccttggagcaatcatggagacgggttcttgatcacgaaagtagccagccccaggagataccactgcgcgccctcgtgatgactcgtttaacgcgaagctattcacgcgcaagcctgcacgaaacctcagggatcttcctggttgtttgataattgtaggagagtagttagtcgtagcctgaatgagttgccggggtacccactgaccctcatctaatgcactgttactcggtgttgcatcctcccctacaactgtaccggatggtccaactcccatgtttgcaaacccagtagcacctaccgttgtgtttggccattcaatttgcagcgcttttgccatagtatgtgaccacttgtgcgggctcgttttggatgggcatatgtcattgtcaggccggcgcgggcgccataaaatcttactccat

SEQ ID NO: 76660 - DNA, 5374 bp, Oryza sativa
  unsure (1)..(5374): unsure at all n locations
tgtaaccaggtatcttttggactttcgtatccttcattaaccttctcacttttgatacaccatcccatcgtccagcaactgcattgatattggacatgagcacataataaccagaattatgaggatccaacttaaataattcctgtgaagcaatctctgcaagttcgacattgcgatgcacacggcaagcatggagaagagcaccccaaataccagcatctggcttgaaaggcatatcaacaatcaattccatagctttatccaacttccctgcccgactatataggtcaaccatgcaagcaaaatgctccattcgaggtgcaatctgatattcctcggtcatacatcggaaaagtcgcaatccttcctgaacttgtccagcatgagcacaagcagaaaccaaagcgaggaacgttacatgatctgccttgaatccctcctcttgcatatggcgtaataaacttactgactccttaacaaggccataagccccataggaagcaattatgctattccatgagacttcatttttctcaggcatggactcaaaaacacgatgagcccattctaagttaccacatttgccatacatatctataagagcactctcagcaaacaagtctgctcttatggggccctttatgacgacaccatgaatctcctttccgtaatatatagctggtaagcttgcacaagctgatagcacagaagatatggtcacattactgtactttactccttccatacacatttcacggaaaaggttaagggcttcttctggttccccattttgtgcaaagcttgaaatcattgagttccatgtcacttcgtccttagcagatatcttagagaaaatataatggctcaggtcaagcctgccacatttagcatacatgtccattagtgcactctccacataacaccttccttcatatgcatttttcagagcataactatggagttcctgaccaagcttcatagctgccatgctagcacaggccggcaacacactagcaatcgctacagcatttggtctgatgccttgttccaacaaatatcggaacattttcactgcctcttgactcatcccatttagaacataaccagaaatcatagtgctgccgataaccacatcaatggctttagaagaatcatagacactttgtgccatcctcactgctctgcacttgaaatagatatccaccaaagcactaaccaagaatacatccatgtgcacacagtttctgacaatataaccatgaagctccttcccctgattgaaaccattcaagtcagtcaaagctggtagcaagctcaccagtgtaactgaatccggtcgaataccactcttctgcatatcacaaaacaaaagcaatgcctgatcaacaaaaccattttgcacacatccggatatcatcccgttccaggtcaccaagtcatcacgcggcatcaggccaaacaacttccagccatcatccaggcatttgcatttggcatacatagacaccagtgtgttcgccaccgccacctcagattctaacccatacttcacagcaagcgtgtggagctgcaccccaaagaacaagtcactctctgtggcagaaacagatagaaagcatgccaaggttgcgaaattgggttcgcaaccgctcgctctcatgtccccgaatagctccaccgcgctcgacacgctcccagctttcacatacccgtccatcatcacattccacaggacacaatcccgctccgccattccgtcgaacacctgccgcgcgtcccagaggaggccgccattggcgtacattttgatcagcgcgctgccgacgaacatgtcgccgtcgagcccgagcgttcgcgcggtgcggtgcacgaggcggccgagagcgatcgcgccaatcgcggcgcaagacttgacgacgtaggggaaggtgtggctgtccgggagcggcgcggaggggtgcgcccacatcttgaggtagaagaggagcgcggagcggtagtcccccgccatggtgagcccgcggatgagccagttccacgggagcgcgcaagcggcggcgccccgtggcagcgaggagaacaccgcgacggcgtcgcggaagcggcgcgcgaggacgtacatgccgacgaggcgggtctggagcgccgtgtcggtggcgtggagccccgcggtgacggcgcgcccgtgcacctgcagtccgagcgagaggtgcgacggggagacgcagccgcggagcacggcgaggaggcggcggtcgggggaggcggcggcggccgtggtggagaaggtggtggtgcgaaggcagcatggccgtggcggcggcgtgagctcgacgcggcggatgaggaggcggcgcagtgggaagcgcatggcagccgccgacgaggccgaggaggggaagtgaggcggcggcgactcactcgccgcgtttgatttcgaggcttcgcttcgaattttttttttctttccgaaccattgaattttgggaaaattgtaaccatgccattataattttgtaaaatttaagatatgctattctgactcatatgtcattgactcatgtgggtcctacaggtcattgagataccgatgtcatatcttaaactttaattttaaatttaaaaataaacttttcttaaaaccttcgtgtcacgccgacatgtcaaaacaatactgtcacgccagtttgaccattcaaatctagctggtttagcagcgcacgtctggtctcctccttgcttacgcatcgaccgtcgagcgtcgtctgctcccgcgaagttcttcaacgaggaacgagggaggagccactcctcacgtacgcgtcggctgtcgagcgccgcctgctcccacgaagttcttcgacgaggaacgaggaatgagccgatgtgcatggagaagacgatgctgttgggaggaaaaaaaaggcgtgcataatcaatttagttccaaatcgtgttctaacgtgtagccattgattgagaatacattttattgaatctcttttcaaaaatggtctttgagcgaaacttataatgtttgatttctccattctaaatggtgtgacaaacgtgtcactttcactatgggtacgctattttgtcacaccatataggttaacaatagtcggagattttaaagtttgaaaataagttttaaaatggttcatttttaaaattaaaatgcatttgtgttccaaggccgtgacgtcacgagcggctcacgtgccatctcatctactctatctctcacctccgcccgcctcgtcgtctctctgacaaccgtacagccgcccgccttccgctccgcgccgccgcctccgccgctgccgccgcgcgggcgtacgtgtctatggcgacgatgtctcgccgcgcactcggctctgcgttcgcgggattcacgcggacaccagctatgactccgacggccaccttgccttcctcgtgcgcgtccccggcgcgtctcctgcggtggcgccggagcgcgggtgtaggcgcccggcggttcgcgtccggccgcaacgcgcggattagcatgagcctccgcgcnnnnnnnnnnnnnnnnnnnnnnnnnnnnnnnnnnncaagtcccactcttcaatgccattgtaaggaaccttccctctgcttcttccgaagaattccgtgctgttatgaactcgtttttagctggaagcaactcgaggagaaagaaggcgatcttgattatttgtgcttttgaggagttcttctcgattcatggattggttttggtcgaggatgaagtgggtatgcggcgtcaatggaactgcgcatcaactgtttgattctttgccacacagagatgcagctctccaacgtttgactagttatgaacttatgatgcttaacttagataggactcgtcacagattttttgcactgaattttcatttccctagctgcaggagtgcttttgcagtcgtgatgattgtttgatgggaagtatagtgaatctttaacgcatgaaaatgcaactgccgtattgcacgggacatgccattcctcgcaataatgtgcatgctattgttgattacgttgtaacatgaattcttttgtcaacgttgtcaggttgaaaatgggaaggcacaagctgcaaactttcccttctgcaccataaaccccaacgttggtgttgtggctatcccagatgctcgcttgcatgtgctctcaaaattaagcaagtctaaggagacaatcccaacatccatagagcttgtggatattgcaggtctcgtcaaaggagcaagcaaaggagaggtgtttcattaatgacttcgctttatgttaggatgtcaatgtgctgttctggctgatgttgtttctgagttctgactagtttatataaccgtgatacatcagggactaggaaaccaatttctttcgaacatccgtgaggttgattccatccttcaggtcagtttcttgtcgtttttataaatcttttgccatcagatatttgtcaagttctggagactttaaccatgcatttttcgcatgcctcattccattgttcatcaagtactacatattattctgttgtatttttcatattgctaaggataactttatattattctctggtagatgttttttcaatgttcgtaaagtaccaattaagcttctatacaaaatttgaacacataatgagtgtcactttgtttttcttggcactgcaattcattatcggtattttaactttcttgtgctgtcttatgttttgcctttggggcctttgggggttttaatcgttgagttttaaggccttttcaggttgtgcgatgttttgaagatgatgatattgttcatgtgagtgggaaagttgatcccaaatcagatattgatgtaattaatctggagcttatattttctgatcttgaccaggtaattttgtaactgcattatgttatctccttgcttgctttgtggggtgaaaaaaaaacatgtatggatttaattatgtgctttcttttttgccattaacgctgacaattgtgttcgagatgcagatagagaaaagactggataagcttaaaaagagcaaaactaaagaccagcaagtaaaggtcaaggtaaggttttcaggctcttctccttattttgatggttattatagatcccaacagttctcactactcaggaacaagcagagaggactggattggaaaaaattcagactgtacttatggatggaaaacctgctagatctgttgatttggctgaccatgagaaagaagctatccaacatctttgtctactaactatgaaacctgtcatttatgttgccaacgtaactgaatctgatcttgctgaacctggtaacaaccctcatgtcaaagaggtagccaaactagcaaca

SEQ ID NO: 76661 - DNA, 630 bp, Oryza sativa
ttctctccccgaacccctcgaagaagacggtctggtcaatctccggcttccacactccgatcaatcgccaccctcgcgatcaccacctgccggctccacctctccaccgccgctgcctcctcctccaacgtccacaccgagatcacctcgcgctccgccatgacaaggctcaacaccgccccgccccgcgacatgaccagcatgagctcgctcatgctcttggcgttgctgcagcccagcatcctgtcgacgcaccccggtggcagatcgatcgtcctggccgccgccgtgtcggcgtgcagggcgacgacgcgcacgccgtaggtgttagtgctagaccctcgatcgaacaccttgcgtgcgtactgcagcaatccggcacggcaacgaacgagattcagaggaatacagagcagaacaagaacacaggaaattgagaagtttcagaaaacaatagcagataggaaatttgtggggctaattttctgtggttttcattcactgaacagagtaacatgcaactagaataacagtacaaaaactcctacttaaattccacacaaaagaaagaatccccggctcaaatcgtgccatcccagatccggtttcctctgatccgacgactcacgc

SEQ ID NO: 76662 - DNA, 54568 bp, Oryza sativa
  unsure (1)..(54568): unsure at all n locations
atgggaaatgctagaatgacttacattgtgaaacggaagaagtaattaagatgcagtacggtgagatacgcgactttcagccgtcaatttgttcaggtttgtatctgaatttctgaagccaatgtcctgcgactgggagaagacagatactggtactagtactatatctaacctggaatgaaggggaatttcttgggcaggaagaggcggagcatccccttctgaatcttccagtcgatggggttgatgctcgccgcctccatcttgatcagcaactccccttccttcggcgccgggatcggcacttccacatgctgaaaatttgaaaatccaccagcagcaatctcatcagaattcagaaacaaacacgcagcatatgttcagttcttgtgaactgtaattatcagttggtgatgctggttttttttaccttgaggccttctggtcctccgccgtacttatcgtactgcacagctctcatcgtctttggagcagcgtcggcagcggcagccatggctgagacggagagcacgcaacaccgagagagagagagagagagagaggagatggaaaagctggtgattttggtggtttgtgtggcgatgttgatgttgatatggttggtgtcgtggatggaagtgagccgcttctgtagcatagcaccggcaaatatcagcctcgcgacaacgaacccgcgctgtaaagtttgcctggttgattaccaatatattcctttcgttaaaaaaatactaacctggagtatataagataagatataacctagtataataaatctggatataaacatgatcaaattaaagttagtattttttggaacgagggaatatgcatctcgattgttcaccaccgtgggtgtccatttcgggttgctctgaaagcatgatagtatatggttccgagatgcatggattgtttgttatttgttcatgtcagactaaaaaatatataaataaagctgaatctgaaatcttgagtgcagcaggagattgttgcggatcaatgcatcgatggagttctaaaaacagaacaaaaaaacaccaataacaccaatggacctccggcagttgtcagagcatcaccaacagtctatctattctatctccaatcctatttttttgggattttggttttaaaaaactgatccaacatattcccaaaagagctctggacgttttggagttaccatctccaattttctcggtacgtgtatttgagggcgagagaacgactcccaatcccctccttccacgcatttctcccctccttccgtgtttctcctctccttcccgcgtcggggcgatctccttcggcgcacgggaaaggaaaaaaattagaatttctgttggtagtttaatagaagggcccacttttagttttggggattgaatttaggctatctcttggaggaatgggttttttaaccacctattttcagtttaggaaacccaaaaattaaattttggggatagattattggtagactgttggtgatgctctaaagttcgctatcaccaaaatacttcctccttccctaaatgtttgacgccgttgacttttttaaacatgtttgaccgtttgtcttattcaaaaaatttaagcaattattaattcttttcctatcatttgattcattgttaaatgtactactattactcaagtttttgaataatattcacaaaaatttttgaatgagacgaacggtcaaacatgtttaaaaaaatcaatggcgtcaaacatttagggaatgagggagtaaatgaacaagccacttttcaagtgtcattttaaaatatataatttcctgatagtagggtcgcatggtcacaggtatgcgttcccaaggagtacggtggactcggtgtccctgacttagagaggatgggaattgctctaagggcgcgttggacctggttgcagcgagtttcaccagagaaaccttggctgggtctcaacatcccgtcctcgccgaaggagcgaagcttcgtcgccgcctccattttgtgctctgtggggaacggcgtgaaggccttgttctgggaggatagttggctgcagggagaatccatccgctgcaaggcgccggctctctatgctattatcccggctcgcattcgcaaaataagaatggtcacataagctctgtctgataggcggtggatcaaggacatctccggtgcccttggtattcaagccattcttgagtatttatcctagtggcaagacattcgtgcagtgcacctcatggaccagcccgatgtgctttcttggagatgggagggtcgggcgattactcttcccgatcggcttatcaagcgttgttcctagggagaacctggttccagtctgccccgatctggaaatctctcactccacctcgatgccggtacttcgtctggttagtggtgcttaacaggtgctggacgggtgatcgattgaggaggcgcgggctgccacaccccgatcgatgtgtcctctgcgatcaatgcgatgaaatcatcgattatctcctggtcgcttgcccagagtcccgccaactgtggtggatggcactgagggccattggacaaacaagttctctgccgatgaacgaagtctccttccacctctggctttgcgatagccgaaagagattgaccaaggcagctcggcatggtttcgacaccatcgcaactctcattgcctggacgatctggaaagagaggaataacagggttttcaatcagcagcaaaagacttgggcggaagtggcaagggcaatggccgccgaggcggaactctagagacttgcgcgagcagccattccggagttcttgccacagccaattgtcgagaggtcgcaacatcggttaggagaatagatctttttgggcaattgtattcctgcatcccgtccccttcacttcttgtattttctgtaattaaacttttttccatccttaatacaaagatgcgctctttgcgtattccattttttaatttcctgataaacttgtgaaacaaaggtgttctacaataaatcgtgggcaacagtgatcacatgattgaaacattaggttcaatctttcggaggtactcgtaaagatagagtgtgcgtgtgtgtttataggagtgagtgcacgcgtgtcatgaacgtttacgtttgtaccgtgtttctttaaaaaacattattttcatacaataacagttaaccgtgcgctgccactgaacatactgttccaacatccaacggtatctccctgcgtcgtgctcattcttcttctccgattttgacgacgaccttgccggtggcgtcgctcagcgggtggcacgagtcgacggcgggcttgagcttcccctgcctcgccatggccaccaggagctccatgtccgccttgctcggcgagaacatgaacggcgtcagcctcttcttggagaaggtcaccctgtgcagcagcgcggtggccaaggccgcgggggaaggcgtgatgtcgacgacgacgccgccggtgtcgccttcggcgaggacgcggtcgaacacctgccaggggaggtgcggcgcgcagtgcaccacggcgtcgtacctcctgcccgacgggctccggagcgcggcgccgtccggggtggcgtagtcgagcgcctcgtcggcgccgagctcgccggcgacgagggcgaggttgcgcgcgccgcaggtggccgtgacgcggtggccgcccagcctggcgagctgcaccgcgaagtggccgacgccgccggacgccgcggtgaccaggacgttcttgggcggcggcgcgtcgtccaggccggcccccgcggccctcagcgcctgcagcgcggtcaccgccgcgagcggcaggcacgcgccctccgccgcggacacctccggcggccgctccaccgtgagcgacgcctgcgccaccgcgtactcggcgaagccgccgccactctgctcggataaatcacactcaaaaactgaactcaactcgatcgatcaaaagaagagaaaaaaaagagaaagaaatcaaacttctatcgtaccgggaaattgatggcgatgaccttgtcgccgagctcgaacctgcgcacgccgccgccgaccgccgcgacttttccggcgagatcgcacgctgctcgaccacgtatacacattagcgatcactagctcctgttattcttttagcttgctagctagtgcatcctactatataaaaaaaaaacaaatcctagctacgaatatagacacgcatatgtccaaattcatagctgttcttgaatcttaaaattttacttgctagctagtgcatactgcatactactatatatattaaaaaaagcaaatcctagctataaatctagacataactgttcttgaatcttgaaatcttaattgctagtacctggaattgatgggaacttccatggcaggaatggccggagcatccccttctgaatcttccagtcgatggggttgatgctcgccgcctccatcttgatcagcacctcgcctttcttcggcgacgggatcggcacctccacatgctgaacacaaacacatcagaaaaccagagaagcagaagctaagctgggagtgggagtgaaactcgcaggcgtatgtaaccttgagcccttcggctccgccgccgtagccgtcgtactggacggcgcgcatcgtcgtcgcggagggaggaggagacggcgtcgtggccatggccgccgacgcgcgcggtgtgtgcgtttggtgcgccaatgtcggcgtctgcgtctggatatgtacgcacgacggcgtccgacccgtggtggtggtggtggacgactggacgtgcaccgtccacgtcggaatctaaatagcatgtgcaccggagagggattgatgaacaatccactcgtttattgtaagttgaccaaaattaataagatgattaatacgaaatatagcgttccacagacagacaggttgaaaattcaacttgtataaattgcgagaatgctcaacgtcgggcgcgcgggggaggggaaaaaaatcggtcgctcccccctccccccatcacgtgcccacctggtcccaccacatatcccgtgtccccacctgtcacttatccatataaaacaaatcacctacatattttggaaaccatctattaaggaaatttggtttgttttttttcataaaaaaatgtttcacctagtgtattcgtactgtttcactatatataaacccaatgttgcagtgaagtgaaatattgcattgcaacaaaaaaacccacatatttttaaaaccccatattaagagaattcgttttattttttttccaccgaaaaatgtttcacctagtgtacttataatattttactatgtatggatcaaatgttgcagtgaactgaaatattctttcgctatttactggaacattgtttttatataagataaaacaacacccgatttaaacgagtgaaacattttcgatctacttagtgaaacaattccgatatatatagcggaacattgtgcaacattttaaaataattcaataataagcttaaaaaaattcgtcggaatatatccatgtgtggtcttgttttgaatatttaattgcaacgaatttaatggtgcaatcggatcatgatttggataagtaatttaagagaaaaatcagtttaaagtagttttgcacgtaaatcgggtgttgacggtagcgcccgatttttctccaaaccgatcgggcgcctgactcgtagactcatcctataaattatgacaaaattaacttaaaatatatgtatattagtacaagttgaatttaaaagttgcatgtttgtgtactaatttattacacactaaggacacataagagaaaacgagttgagggttgaaaactcacaaaaatcaaatctaaagtttaaactcaactttatttgaatagtaacgtgacactatttacctgaattttgtttttttctctcaaatgaagttgagtttggtgagaatttattttacatctacatttatctatattattttaaatgaacttacaaaacatattttttatgaattttcaaaacttttagacatgattttcacatttctaacacttgatatttctccttacacattaacctatcctgtccgttttttttttactatttagttgacatgaataatcgaatagatatctacccagatgattaaaagagttccgtgcacgttgacatacatttttcttgcaatgacttttactgaataatttaccgacggttggagagtttagattgggttcacctcatgtaaaattaggagtaaatttctcgaagatatttacgctgtgttaagatgcattcgtgaaaatttctacagtgtcacattggatatacggacacagtctaataacaaaacaaattacataattcgtcagtaaaccgcgagatgaatttattaaacctagttaatccattgttagcaaatatttaatgtagcacaatattatcaaataatggaacaatcaggcttaaaagattcgtattgtcgcaatttgtgcaattagttttttagcctatatttaatacttcattcaagcgttcgatatgacagggtgaaaaattttagtgtgagatctaaacatggccttaatttatcgtcataattaaatgaatataatccgtagtaataatcggcccaacaatccaaatgaagtaaaaaggagcccttcccaaggaaacaaaagcaatgataatcccctgggccatcctggactcctgatgttcggcgccaacacgatctcctcctcctccctcctcgtcgcaggatttgccaataaatagcaagagagatcgatagattagatcgaagtagaacagcggagaaggagagtaggagcgacggcgaccgcgcggagttgattcgattccgggtgtcgccgccgccggccatggggataacgctcgagatgaaccgggtcatgcccacccggcggaggcggcagcgccgtcgccgccggcgaaaccgacaccgctgtaagctaagctccctcggcctcctcctccggcttatataacttgttcagattgttcttttgcaacaaagcggccatgcccgtgatggtgtttctatccgggctagtatgtttctttgtaggatttctttaaaaaaaaacctgttttcttttcatcagggggttaaacctagtgcattggttggtaacaagattaagtgttcctcattgtttttgtttgagtaggctaggtatccaaactggcgtctttctgaacaaattttaatctacaatttattttctcatgattggggggggggggggattgtatgagatgtactccctcccgtcccataaaaaccgaatctagatgggatgtgatatattctatatgtccagattcatagtaataaaatgtgtcatatccaataggattggttttttatgagacggagatagtttttttttttataacaacatgagatagttgattcgttggtgaaagagtgatgcagcctatcatagcatggggcacttaactgaacatggcaaccagagctgaaacttgtgacttgggtttaccgaattgtgagggtgaggagaggagtggggaatttagggattgggaaagaaggatgtgatttttcactgattcgtctgctccaatgtattgctgttcagttggatactttggagtgcaggagatacacactttggggagactgcggtatttacaaaattttgcgcctgcgcactatgaattgttcttttctcttagattgctacaagttggaaactcaattggcattcaaaagctggataacagaagaaaattttgatttccctgtgcttgtttgtgtgcttcgatttgtccgcttccttctgttattgtttgaattaactataaccatgcatgatgtgcttgcagatagatcaattgctaaattgggtaaaaggaaattctcaccctcccaacaagatgatgattctcagggtgctaaaagaatgaaaaattcagggatgttgctttcaaaggtatgacatagaaaatgaatgatttacatttcaagggaatatcactatgactgctccaacacagattagtacacccgttacgcttgtttcattggtatgccatggtctaggtccactatttgctgtttattcttaccagaatcctctagatgcaagttgttcttagcctattccacatcgagcacattccatcttcattctactaaagaaagaacttttccccccaaaagcaagactcatatactatttacctacgaaggatatttacttgaattcgtcggaaattttcatactaatgtgcatttcattcttatatttcactcatgctacaatttttaggacaccatgccagaaggcctgcctaaattatatttcaacgaattacactgttagagcgaaacaattatatcgaatgcttaatttaggcaccacaattacattctaatgctcaatatgcctatgtcatgcagtgtacttgtgcaatcatgagtgaatacctggggtagagatagaatgataccccatatggttttgttctgctttttcacccaatcaaagtttatcacaatcacaatatccaaactttatcccatgatggtgtgtgcaggacatctggcgccgtatacattgcctgatgccaatgcgagatgcggctcgtgttgcatgtgtgtctcgtgcctttctaaattcctggttatgttatccaaacctcacctttaacaaggatacgctgggattggatgaacatgtttgtgagacagatttcatcagcaaagttgaccacattcttaaaagacactcgggcacttgtgtgaagacattcaagcttgaagtcccgtatgagctagatgtctgtgaccatgttgatcgttggcttcaatttgctattacaccagcgatcgaagaactcactcttacgctgtatggaactgctcaaaagtacaatttcccatgctcacttctatctgatgggatggcagattctattcggattcttgatcttggccattgcgccttctgtcccacaatcgaacctggttcatggagaagccttaaaaggctatgtttgtcttttgtgcgtatcacggaggatgatttagggtgccttcttttgaattcgttggctctcgaggggatggaactcaggcattgcgatgagatagttagcctgaagataccttgcacactgcagcagctcagctatattacggtttcagaatgcagcagggtgcgagttatagagaacaaagctccaaatgtatccagtttttactttactggaaacaaggtaaaactttcacttggagagtggttgcaagtgaagaaactaaatatgcgcagctcacgcattgtccgttatgcccgtgccactcttccatccatgatgccaaatgttgaaactctttccataggttcgctccgtgaggtatacaccaacactttagatgattatatagactagtttgttatccatattatagtactcataccttggagtttggttaatctgagacatctttatgcaggtgttcaacacaccaatgctacctaccaaattcccctacctgaagtacttgagtatttctctcattggattgaccaattcgccagcttatgattatctctctctagtttcctttcttgctgcttctcctttattggagactttcttcttggctgtaagatgctattcacttttcatttcatcctgcaaaactatctactttggtgaaagcactaattcaagtatattattacttttcatcttcagatatctcagcaacaagcagaacaggaatcgatatttggaagttcctcacttatgaggcagattccggagcaccgatatgagtacctcaagagtgtgacgatcaacggtttctgctccgcgaagagcatggttgagctaacatgtcatattcttgagaacgcagcatctcttgagcaccttactctgaacacgaaccttggcttggctaatcgttctgaacagagtcctggtattctcaaggaagtgcctaaagctctctcggctatccagaaatacatcgcagggaaagttccctctactgttagattaagtgttctggatgctagtgaatgaaacgctatagggcatcaattatcattttgtgaaccacgcgtccacgctcattttgtgcaactttttgatgaaccacgctctgtttactaaattattggggtcgttaaaagtttagttggagtatgctttcttggttacaatctttgtaagacttttgtggtgttcttataatatataaaatataactggtgggcgaatgcctgtcagttttcctggtcaaaaaaaaggtgagtgtttagttcttcagtaatttatcagcaacaaagcgggctgctaatagtgggtaactgtgctgtaaagttgtactgtaaaatatagattttgaatgacctggagttcggttggatgtgttgtgactacaatacttgtatgggtaaatttggctaaaatgttaaatgttgctcacttttgtacttccatttgataatgctgtgatctactgattgggtaacacggatgtgcagtaaggatttacaaattgcccattcatgaaaattagatttacataatgccaacaagaagcaacatgaacagtataacagatttaggacaaatgtggtaacttgtaatgtgcatgtatccaacaaaaatactaccacaaggccagaaacacaaatctgattccctgttagttcccccgcgaagctcccagttatacgatgattgagtggatttcacttgttagtcggtgtaagtttagttaaagacgtcacgttagtgtccgtgtgacatgccacatcgaatttcagaccaactaggataaccacataaaaccacaaaccaacaaggatctaaaaatataaccatatgcacaaggaacacaccatgcattttgtttttatatttttttaaatcctgcagggtgtatttgtattaaaggagaaggaaacactgtacaatagccttagtgcctaggaggttgcatcaagaaaggaaaaaaagaaagcgggtgaggcatgatgcagcttaaaaaaaaagagacgtgtgggtcttgtgactaggctaattacgtattgtcggttgcgctttcataattgtttggcattaggcattgaatgccctttgccctgcctgcatgccataaccaaatctcatcggtcactctatcaatgatttcgtgcggcagtgtctctatgtaactatgttccttaaaacctctctatttctctctttccaaatttcccaagagagtaggatgaggctcgatttgatgccctttcttttctccttagccatcgcacgaacggtttaagtccaccagttctcgagtagtgtcgtgtgaggccaattttgcggctgtagccgagggatgtctagccttgtcgatatggctttttttatttataaataaactaacaagtactggcagtatttactaccatgacaaccatgaattttttcttcttacaagagagagagggcttcgtgctatcgacatgttggcaaagagacggggtactttatattgatgtcctaatcgattgcccatattttctattaagataaaacagtttattaccataagaattaatttataggtaaaacttaaaaaatacatgaaaataccttaaaatcaactttaaaattaaaatttaaattttaacctttgttttgatttattaagacagccacatgggaggggactctgagaagataagaggaaaaaccgaaaaagaccagtattttcctggtcgagttgggtttcgtcacgctccgcttccccgacggcgcggcgccaacacgagatctccttctgctccgccccccgcgattcttcgggtgcgcgctctcgattcccttgcctcgatcgtcgcgcggcgccccgccatgggcatgctcctgctgagccggctcatgcccacccggcggccgcgccgtcgccggccacacaaatcccgccgcagtaagcgcttctaattgccctctcagttgttcccctcaaccctgaaactcattagcattataacgcaaaagtttggttaatggagacagatcgattggatttctctatgctcgtttgtgtgcttcgattttttatttttatttttgtttttattttcttctgttaatgcctgaatttatctgtaaccgcgcaggcggattgattgctaaatcggctaaaaggaagcgctcacactgccagcaagatgatgatgattctcagggtggtaaaaggatgagaaattcggtgccaacccttccagaggtatggcatgtaatgttgatataatcgaatagttatactgaaagtaaataccactatcactactctaacacagattggtacacctgctgtgcctaaagaacaaaagttatgaacagatgagcaaaactttcagtgctatatttacattatcaattatagtcttactgcattagtagctttgttttcttctagatatcgtggctttcgctctcgagctgcaatttgagtccttgataatatggaacaattttggagtaaacttcctagatctatctccctaattagcagtagctagagcatatcccttatttactcaaattcctcagaacttagagcttttcaaattaatatgtacagagggccttgctaatgtttttcagaaatctacagagggcaaatactacttaactaaattatattccaactaacaacactgtcaataaaagataactctatgcaatgtttcatttgcgtgccattgcattctaatgcatgcatagtacgcatatgtaatttagtgcacattgtgcaatcttgcacatagcacctgggttgaaaaagaatgatgccccatatggttctattttcccctctaatcaaataacccaatccattgaaactctatttttccccctctaatcaaataacccaatccattgaaactcacattgcaatgttgaaattttatcccatgatgcaggacatctggtgtcatatacattccctgatgccaatgcgagatgctgctcgtgttgcatgtgtgtctcgtgcctttcttagttcctggagatgtcatcccaacctcacctttaacgagcgtacactgggattagatgaatatgtttttgaaacagatttcatcagcaaagttgaccacattcttgaaaaacactctggcattggagtgaagacattcaaccttcaagtcccctatgagctagatgtgtgtgatcatgtcgatcattggcttcagtttgctattacaccacggattgaagaactcaatcttatgctgtatggaaccgtgcaagagtacaacttcccatgctcacttctatctgatgggattgcaaattatattcggtttcttgatcttggccattgcgccttccgtcccacagtcgagcttggttcatggagaagccttaaaaggctatgtttgtcttttgtgcatatcaccggggatgagttagggtgtgttctttctaatttgtttgctctggagtggttggaactcatatattgtgataagatagctagcctgaagataccttgcacactgcagcagctcagctaccttaaggtttcagaatgcagcaggatgcgagttatagagagcaaagctccaaaagtatccaatttttacttcactggatacaaggtaaaactttcacttggagaatggttgcgagtgaaggaactatgtatgctcagttcacaccttgtctgttatgcctgtgccaatcttccatccatgatgtcaaatcttgaaactctttctatatgttcactcgatgaggtattacacaccaacagtttagatgattatatagactattgttatgcatattatagtattcatgcattggactttgattaatccgatacatctttatgcaggtggtcaacacaccaatgctaactaccaaattcctctacctgaagtacttgagtatttctctctctggattgactgtttcgccgtcttatgattatttttctctggtttcctttcttgatgcttctcctttcttggagactttcttcttggctgtaagattccgttcactgttcatttcatcctgtaaaactatctagtgactatggcaaaagcatcaattgatgtatattatttttctcatctctagatatctaaggaacaaatgaagcgtgaatcgaaattcagagattcctcacatatgaggcagattcaagaacaccgtcatgagcacctcaaaagcgtgacgattattggtttctgctccgcgaagagcttggttgagctaacatgtcatatcctcgagaacgcagtatcacttgagtgccttacactgaacacaacccttggctttgctagccgttctgaacacagtcctggtacatgctttccaatgggcaaggctgttctcatgggagtacctaaggctctctcagctatccagacatacattgtggggaaagttccctccacagttagattaaatgttatggaaccatgcaacctgtgcaatggtattgggcattaggtgttatccgaattgtccattgtgtaactcttctgatgaaccattctctgtttcctaaattatcagactcgttaaatgctaaattgtgtagttatcaacacgagtggtttgttctccagtaatttttcagtaacagagtggtctgctaatagggtgtattgctaaactgctaaagtgtgcgctgtaagttgttagtaaaaatatagagttatcctgaaggttggatgtgttgtgttgtgcctacaaaattagtatgggtaaatttggctgaatttttttcgtgaatacgcaaggagtgcatttttgtattaaggagtaaaaagtctatacaacagaacctaagagcagcaggggacaggagaactggacacgggggaactaaagcctaatctcaggggacaggagaactggacacgggggaactaaagcctaatctcagggtgcgacctaagagctcctagctactagaggcgaatcgtcggtacagcagcgttggctaaccgccacaacgccgcctcattagccattcctctggccacctgcacccaacttctttgttgctggttgaagactcggttgttttgttctttccaaatagaccatgtcgcaagtgctacgatggtgtcaaagccacgccgaaggggttttgcaatctgctccctgctgtcgcacaaccaaacgtggaaagagtcttcattaatgggcaagcattcaggatgccctatggctgagagaagcatccacaagagttggcacgattcggggcaaccgaccaagatatgatcaatactttcctcttgttgatcgcagagaacgcaaaggtttggatgaggaaaacctttgggtcacagtctatcaaccgtccagcaacgcttgaggcgaccaaccagaggaaatattgacaacgcaagcgacctccagattagcaccgactgaaataggatccgaccgagaaacagggcttgataggctgaactagaggagtaaacaccggagctctcccacttccgaacgaaacgatctggccgatcctcaagctggaacgactgcaccctcgaccaaagaaggaggtagtctaggatggggagtcctactcggcgcgtgtgcgccaagggcgcacacgacccccctccttttccacgctaaggcagttagtaatctattagtataattacatttagagataaatgacggtagtagttagaattttttttgtgagatttttttcaattaacaaattcaaaatgaaatttatatctaaagtcaaattttcaaaattttaaacccatatttgaaaactttcaactcgaaatttgaattttttaagtcaaattatgaaaactttcaacttttcatgttaaatctgaaaaactttcaactcaactttgaaaacttttaacccagatttgaaaactttcaactcgagatttgaaaactttcaacccagatttaaaaacttttaactcgagatttgaaaactttcaactcagattttgaaaactttcaacctagatttgaaaactttcaactcgagatttaaaaactttcaactcaaaatttaaatttgagagaaaaattttggaaactttcaactcagattcgaaaactttcaactcgagatttgaaattttcaaatccagatttgaaaattttcaagtcaagatttaaaaactttcaaatcaataacatttgaaaaaacacgtgtgctaaagatttaaaaaagtaatctgaaaaaaactgcaaaaaaggaaaaaaaacgcgaaaaagaaaacggaaaaaccggcatgaaggaggggaaaagaaaaaaggtgaaaaaaagggaaaaaccggcgtgtggggaggtgacagctggcgcgtgcgcgaattagcaaatccggtctaggatagcctgtgtcctcagggcaccctggatatcatggatccatcttctgttgagcagaccttccaccaccattctgcggcaccagacgcgcactggaacacagtcatacaaagccaacgcaagcgagcgaatgcacgagccatccagccagcgatcttcccaaaaccaaatcaaatccccattgcccacctgacaggaaatcgaggctgcaacaaagataagttccttctgtcaactcgggatggacagaccttgccaaggtttatcctcagcagtgcgctgcgaccagatcccacgagagcgaagagccactcccatgagttccaagttagcacacccaggctgccataatcagttggggagcaaaccttggcccaggtgaccctgcaatgtccacctcgaggggaggccctgcccccccaaaggaagccatgtcaaaatttgtcgatccctttgatcacccattttggaggatcaatggtgatgagaaagtagatgtgaattgagctcagtaccgatttaaccatggtaatgtgcccaatcggtgccatctgttcagcctttcaaagaggtaagcggttggccactttgtcgacaaggggttggagatctttcctttcttagctcgaagatggatagaggcagccccaaatatttgcacgggaacaaagcaacaggacaaggaagttccctcaccaccgaactgagaatttcctcggagcattgaatcggcagagcagtgcatttggcaaaggttgcctttaggctagaggcttccccgaaggtgttcaagatctcgccttgatctcttccactgaaggttggataaaagcgaccacatttggctgaaatgttagatgttgctaccgatgtgggtcttgctccgttgcattttttgtacttactacatctgataatgctgcaatcttctcattgggtggtacaatgaagattgctaaaaagaccctccatttttggctgcaatctatttgcaactgctgcctttactatttcaatatgactgactaataattgatcgaaatctatcaggactgtcaatgcattactgatcactgataatatatatgtggtccttcaacctcggggtttagagggccttgggaggcgaggcggcggggacgctaccggagccgtgggaatggaagctcagcgatggcgaatatgacggcagaagagagagggggagacgtatctcacctacgccattgacggcttttttttagccgggccaaaggttggacccaaggaaggacttggagtcaatggttttaagaaggaagaggtaaatatttcccctggtgagcgcgctcgacaagggtcgaacccgggccagcggggtgcatgccagcgacccctgccactgcgctactagcgcatctcgttgacggctttcggccggccaccgaggccgagcgtggtgcagggcggcgccggcgagcattcgtgcggttgtgcgtggggaggtgtaatggcaatctcgaggccatactggccgtctaaaaaattgacttgagttttttttttctgccacgagaattagacccttcgaacaatgataaataattcaacgaaaacaggttaagatgttaccattctttaaactgcagttacgagtcgatgttatgctatcattcaacgaaaacaagtttgtatttgatatactcctttttttcattagctaaacgagcaaatcttacagaagtactgcaaggaaatgaatacagtaaaatccagtgatgtgatgttgcaacaatatattaccatcaatttctatcgcaagtggagtttaattaggcagctagctaacatctcaggtattaaccaaagatttatttgtggacgaagacactaacttatgaaaaaaaaaacacaaactggaactacaatactcccaaatgccaatcagaactaacattagagtcatcagaacttgtcctactctagcttcagtcacaaccttgagatcttcttcaaataaatacgatgtgcgaagaacatagcacttcaaaacctcaccaaggaaaaaaaaacatagcacttcaaaaagggaatttagtagattcttgtccagacaatttttttttatgaaattgtcaaaccaacttcatttcaagatttacaaactgccggcagcaagcaatggagaacagtataatagatttgggacaaatgtggacatgtggtaatttgtaatgtgcatgcatccaacaaaaatactgccaaaggttagaagcataactgagtccctgcacagatcaccagcaaacgccccaatttacttttgcaacttcacaatgaaaacaaattttgagccacttactcatagcaaagggcattgatctgcaattaaaggatgatgagcctaaaccatggaaacagctagatcaacaaacatattcttaaaccacacaattgcccttaaatgttacagtaatacagctacagacactgctgcgttaattaactttcaacaggattcacattttgataaataaaaccaactgctacaagtaaagtttctgggttaattagcagttattcataagggtaggaatggacacacttccatcaaaatcattaaccgagtatgacaacttttggatgcaagcagagtgctaactgctaagaagttgtaatcagggcgtgatgttttcataggagaaaacatatcctccattgctggagtacaaaactggattaccttccaaacttttcccataagacataacaaaaacccatgaacccttcccaacagatcattatttaacgaaccccagcagattagtatttagcatgacaagaaaatggaattcagtagctgcgaatggggcacacaagaacaagctggtccaatggcgtattcactgatcctaattaagaggcacaacctgggggtcaaagctactacaacaatgcactaccactaacaaccatatatgctccaatgcatctacacctttcagtcagtattggtcacaagtgagacaatgcttatcacaattaccaattttcagtatagtatggaactatcaatcagaagttgacaagcttatgtgatctccccatagcaataggatacaatgtagtgaatcatatgaagccaatgctgattattgcttgtgcaactaaaaatgcagaaaaaaaaaggtaaaagctatctactgctgttcgattagacatctgtacgattccacgggggcggcaattgcagtgttattgttcaacatcaggtcaggggcgatggggatcagggtgacgtactcaatcctcgtcgatgaggcgatcaccggccgcggcgtgatctcgcgaggtgatcaggcgggggcgcgcgcgcgaggtcgatgcggtgagtcctcatggtggcgatgcgggagggaacggtggcctgcaggtttttgaggagccaaccatcgccgcgggttcccttgaagacatggctgacatgtcgccggagaaccagcgctagcgccttcgacttgcggcgcgcgtagcctccgatgaggcggccgacgcggtggatgctctgggcgcagcggcgaagctcccggttggcgtctgggtcgcggaggtcgttgaggaggagcgggatgacaccctcgctcacgacggcgaggagggcgtcgagcttggacaggttctccacgaggcggaggccgacgatcttacacccatggtcggacgacgcggactcgagaaggtggaggagcgcgggcgcgtgcttgagctcgcgaacggcgagcaccttcaccgcgtgcgggtgcggctcgacattgctgaagaagacgggctcgaagtccgcgaaggtggagaccgcgacggagaggacggaggcagaggtggtcggcatgggggagcgtcatccggagtctggatcttcgtcgcgacgctgggggcgcgcgcgggcgcgaccgcgagcgaggcggcggcgctcatctccatcgcgactgcggcgacagaggaggtcttcgtggcgatgctggaggcgtgcgcaggcgcgtcggcgacggaggaggaggaggcgcgcgcgggcgagacgacggcgcgcgaggtctcggcctccccgagagaggcggcgccgctcttcttcttcatcgcgtcgaggtgtgggaatggcggagaggacgcggtggtgagacgcgacgcgagtggatgacgtggctatgggtgggcgttgcgagccggcattttatagccggtagggagccgtgctggagaagaaattctggaaaggagaaatcaaaatttgaatttcgcaaggggatcacgagaatattgagcagttggcccaagtgagcggttacagctaggcctcagcccaaccgtgctgggcaagaatgtctccagtggcccattttggggcaaaaaattgagtaaattgcgttctgggccacattttattatctaagtttcactttggccacctttaaaccttctatctttacaatttaaaataggtaaatttgcagtttggatcacccccaaacgattttttcagtacacatcaatgaccttaaacacatcggctctggtatacgggttaactcatccatgcatggtcgatatatttgccaaaaagaaagttagatatggcgagaaaagatgttcagggtaatccaaaccataacaatgctaaatttacccgatccatattgaaaagataggtttaaaggtggtccaaagtaaaatttgggtaataaaagatggtcaaagtgtaatttactcaaaattaagcgtgggcttctatagggggctcgtgggccgggccttggctatttgcaacctctgcggtctgtacgagttcggtatcttccttctcgtctcgcctctccagccgcgacggcgccggcctccgccgcgccgcattcttcctcctccggcggcggcgcagaccgaagccgagatcgcgcgcgggtggatgccctggatctctaccccctccccgacctcgcgcctcgatcttcgtaggtaggagaggggcagggaggagagaggtgggccgcctcggggtgctctcgatttcctcggctcgatcccgcgtatgccgccatggccctgctcgcgctgaaccggctcatctccatccggcgggagcgccgtcgccggcgaaacaaagcccgcagtaagcgctttcccctcggcctctctgcacttcatctctccggtgcgttgtgtgtgatgtgctgctcggactttttttgggagattgcggccagtatttttccagaatggaaaattggattggtttggtgaattgtttctctaaaattggaagaatttggtttggtgaattcatcagcattctcgcgcaaaagttggataaggaaacattttggatttctatatgactcgtttgtgaggttgaatctgttgttctcttctgttaatgtctgaaattatctattacaatgcatgatatgcagaaggaggatcaattactaaatcggtgagaaggaagtactcaccctgccaacaagatgattcccagggtggtaaaatgatgacaaattcaggggtaactcttccagaggtactgcactgcatacactgttttttttaaaaaaaaaaatctatgaattaattggaacatttcaaaatactactatgcattccattcttaagtatgtgcccttgctagtgtccttttaagactctaaagaggaccagagacctacctaaactatattaaactaccaacactgttaaaggaaaacagctctacgcaatgcttaatttatgcgccattctaatgcacaacatgcctatctaatgcaacgcaccttgagaaatcatgtgcagtactcctggggttgaaaaaaaatgatacgccatatggttctattcatgtttctctctaatcaaagtagccatttaggtttataattgcaatgttgaaatgttatcccatgatggtgtctgcaggacatctggagttatatactttccctgatgccaatgcgagatgctgcccgtgctgcatgtttgtttcgtgccttcctacgatcctggagatgtcatcccaacctcacctttaacgaagatgcactaggattgaatgataatgcttgtgaaacagatttcaccagcaaagttgaccacatccttaaaaaccactcgggcattggtgtgaagagattcaagctttcaatccactgcaagttagataactgtgattatgtcgatagttggcttcagtttgccattacaccagggattgaagaaatcacagttatgctgtctggaaacaagccacagttcaacttcccatgctcacttttctctgacaagattgcatactcaattcggtgtcttgagcttggcaattgtgcctttcatcccacaattgaacttggcccattaagaaacctcaaaaggctgcatctgtcttgtgttcgtatttcaggggatgagttagcatgcctcctttccaactcgtttgttttggagcagttggaactcaagtactgcaaaaagatagtcagccttaagatgccttgtgtgctgcagcggcttaactgcctgaacgttttggaatgcaagagggttcaggtgatagagagcaaagcccctaacctctccagtttttcctttagtggaaacaaggtaaaactctcacttgtggaatcatcgcaagtgaagaatctatacatgtgcagttcaaacatcatatgttatgctcgttcagatcttccatccattgtgccaaatgttgaaactcttgccgtagcttcacactgcgaggtataaactaaactttcattattatagactatgcaaaatgtacagtatatacattggttatacctttgagtgactattctgagatatctttatgcagatggtcgacacaccaatgctaccaaccaaacttctgtacctcaagcatctgactatttctctttttgcatggaccttttctcgagcctatgactatttttctctggtttcattttttgatgcttctcctttgttggaggtattcgtcttggatgtaaggctctgtgcaacgttcccttcatccacaaaaatatatgttaccacggtagaagtactgattcaagtatatgtcttttttcatcttcagatatatcaggaaagcatggagcatgaatcaatctttgagagttcctcacatctaagacagatgccagaatatcaccatgaacacctcaagtccgtgacgatcagcggcttctgctccgcgaagagcttggtcgagctaacatgccatattgttgagaacacaacgtcacttgagcgccttgaattggacaccactcatggcaatgctaggtgttctgaagacagttctgatgaatgctttcctgtgagccaggtgttctcacagaatcccctagagcagtcttggctatcagaggatacatcgaggggaaaattcccaccaatgtgaagttaaatgtgttggaaccatgcagccggtgccatgctggtggtggttaggtattatctaatcctaattactagccattgtgtaactttttgatgaaccataaccatttgttttctaagttatcacagtagttattaaatgtttgactctctgtagtcagtagcacaaaccaagtttatctaaggccctgtttagatcacctgacagaacttttcaccctttcacatcgaatatttggatacatatatggaatattaaatataaacgaaaaaataactaattacacagatcgcgtataaattgcgagacatcttttaagcctaattgccccatgatttgacaatgtggtgctacagtaaacatttgctaatgacggattaattaggcttaataaattcgtcttacagttacaggcggaatctgtaatttgttttattattagtctacgtttaatatttcaaatgtgtgtccgtatatccgatataacacgccaaaactttacaccaatagatctaaacacgccctaagtgctagtcagtagtgatcaccatagaccaagtacgagtatttgaatgacattggttgcatcggttgataagccatagaaaaataaacaagacaatggtgaacaataattagggtggggtctttatattttattcttagctgtttaaaagccaaaggttaaagaaaacaaataataccaaatttagtttgaaaacttaaattttgatgattgtggcttataagctaacaaacaaacaaacgatgagagtcaataaaagactcaagcagtacatctatacatgcacagttgcacgctacaaaatcgtatcttattctgttcttccaggccacaaatccgtcgagctcacactcactgttcgtctcccatctcgacgatgatcttgccggtggcgtgccccgccatgctcctggcccagccctcctccgccctgctcagcgggtgcctcgactcgatcaccgccctgagcttcccttccgccaccatgccggcgacgagctccatgtcctccttcgtcggcgacacgaacagcggcaccagcctcttcctggagaaggtcaccctctgccgcagcgccgtggcgaaggccgcggcgcccggcgtgaggtcgacgaccacgccggcgtcggcgagcaccggcgcgaacgcggaccacgggagccccgccaccgccgcgcagtgcaccacggcgtcgtacctccgccccgaggggctccgcagcgccgcgccctccggggtggcgtagtcgagcaccttgtcggcgccgaggccgccgacgaggccggcgttgcgcgcgccgcaggtcgccgtgacgcggtgcccggcggcgctcgccagctgcaccgcgaagtggccgacgccgccggacgccgcggtgaccagcacgttcttcttggcgccgccgccgccgccgtcgccggcgtctaagctgacaccggcggtcctcagcgccacgagcgccgtgacggcggcgatcggcaggcacgcgcccacggccgcagacacctccggcggccgcggcgccgtccgcgacgcctgcgccaccgcgtactcggcgagcccgccgccgccctgccattacacggatcacagcaatattatcacgtcgaaatcaacacaaactaatctactctgccaaaactcatatcatataactaacaatcttacagggaaattgatggcgatgaccttgtcgccgaccttgaagctgctcacgccgcggcccagctccacgacctctccggcaagatcataaactgttcgaccatccatgaatgcatcagtgattaatcaacaattgaccatttcaattagcagttggtgtgctatgccaatgccatgcatgttttgatcttggattactactacctgggatgaaggggaacttgttgggcatgaacgggcgagcgacacctttctggaacttccagtcgacctggttgatgctgccggcctccatcttgatcagcacctcgcctttcttcggcgtcgggatcggtacctccacatgctgaagcagtagcacccacggtacaaaccaacacaatcagacataatcacatatgcttgatgcattgcttaatagctaaccatggacgttaattgaacgaatcattgtataccttgagtgcttgagctccaccgccgtacttgtcgtactgcacggcgcgcatcctccgagaagaagtggccatggcccttgcccagaggtgaaaccggttacagaaattcctaaccgactgagcctcgttttcgtacgaggggtaccgttctgcgactgagaagagggaatcgggggcaatttgcgacagtagctgccaggcgcggccgtacttatggcagcggcggatcgaactagtctaccatcgagagatagatggagagaggccatgggatcggatcgcattggcagtagcctttgtttgaccggcggcttggctcctcgccgaggcgaggcggcggcggacgtggccgcgctccgcaccgcacgccggtacactgcagtagtaaactagtagtagtactttactgcggcttaggcattgacgacaattcagtcgggccagtgtgtagacaactcaacatgaaaatttcaaaataggagaaagtccacgtaacccaacgacgggtcaagtttcgttcgttggcgtccctgaaccgtagaatcaggtaaaaattacgtttcaacaattcaacttctaaaaaggatacaaattaagtcactcgatactattaacagcggtttcggctagcacgacatctacatggcttgctgacttgattttaattccatgtgacgtttatgtgcacttacataacaatagaagcaaaaaaaatatcaatggaatccacatggtgcctcctcactctctcgcctcttatctcccttcacccatctcccctcccgtctttctccggaaatgcttcctattagacgtctgacgcaacaaacaaaaattagacgggcaaactactacctccctatccactccatacatccatacatattataatgatcttcaaaataattttttcttatgatttacttatccaatctgtgatatgatcacaccattatatttgttataattaaatctttataacaagatatcacatcattacattccaatgaaagaaaaatgtatgtttcagtccgttaagtttaatgtttcagacgcagtagcaatatgtttcaacgtgagttttcattgtgtttcatagaaaagttaaatgtttcaataactgatttttttttgtttcaccacgtataactcaatgcttcgcgctgaaaaaatatgagacacatatgcctccactctctctctcgtaccattttattgactttctccccacaccatacatgcatacaactatttagtaatcttaaaaagaatcttccaaactacttatttgatgagcgattcgatcacaccgttgaattcgttataattaaatctttataacaagatatcacgtgattatattctgatgaaagaaaaacatgtgtttcaaacaataaaaacgtaatgtttcatacgtgatagaaatatgtttcaccatatgactttattgtgtttcacagaatttttatatgttttagaggctggattttttgtttcaccatgtataacttaatgttgcaccaacggtcaactgaaacatttatccgtccgattttttttacaacatcggacgttcgatttgtagctctctgcatctctctctatctctctctctctcatgtggccaatgacattggaatgcgaaggtggtgcggcggcagcccgatatgctctttccatcggcaggcctcgttgggctcctcatctggctaaaccgcttggatcttccctgggaacctcgataaccctataattgaggaaagcgagaaaagggaacgagatggtgtggatgctgtaggcttggtgggaacgagaaagctcaaaattgctctcgatgccacggagagatttgatttgtactaattttaaaagttcgtggacgttctatagcctgttttatagttgagagatgcgaatgaaactcaagacacgtagttgaggacgtgaagtcgacctttccctctaaaatagtactccatccgtcctagaatatgtaaggtactttgatcgaatgggacacatcctagctgttcagatttgtagtattaagatgagtctcattcggtgaatgtaccttatattttaggatgaaagaagtatgaacgagttaacaacgcaaaatgggctttatttcattcggactttacaccatgggctcattccaaccataaagaaggaccggaaaaagtacattgaaggtccctcaacttgtcatcgagttacaaaatcgtccccaaccgtaaaaccagatatccggcgtcccttaactaatcaaaaccggtcacaattggtcttttggtggttttgacaccagttttgtcttacgtgacagctgagtcagcgtgggacccacatatcagaatgccacgtcatctctgtcctccctgttctcttctctcttgcctgctgagcgcgagcgcgaggctgtactggactgcaggcgagcagaggtgggggaagacgtcggcgccgcgggggaagcaaccgctcctggagcacctcgagggaggaggggagctcgacggcctcgagctcgccggcggggtcggaggagagcggcgcctccgtactccggcggcggcgcggccgccttcgaggagagcggcgcctccgtcgcccccatcgccgttgacctcgcccccatcgtcaagtccctccgcggcctcgacgtcgactgccaggacctcccccgcgccgggctgcggggcgtcgacggggcgatgtggaagaggaggaggacggcgccgcagtttttctcttgcaatcttttctctcagtttgatgtcatacgcagttggctctacatttagggattccttttttgtatgaagtgaaactatctgttccccgtttaccaggttcattccgagtgctctgatcatgaggtttcagttgaaactactaagagccagaagcatcatctcaagaaggtataggtacaatagagatttcgttcctaaaatctgtttgtatactattgttctgcggtttgaatgaagtaaatatgctcagcagtttgttgcagatcaagcataatgatgtgatggagcctggcatgagaattcaccttcctgtgtcagtggcagagggcgagattagagatgagattgagaaggcctgtcatccacaaggtaatcaatttagtgtattttttggagcttactgtttttaatttacatcattcagagtcataattgtatgcaaaattttgaaatttcaggattctgctatacttgtgcttaacaagcccacgaaagtgcccatgaagggaaatttgccagtacataacagcatggatgtgcttgcagcagcagctctgttatatggaaatgaagaaggttcaaaattggtgagctcaagagtctgttcatcataggtcagcatgtataaccataagcttgcactgaagatttttctcgatggattttgtgttttgaccacaggttcatcggcagcgggcgtccctcctcctcgctactgctgagcggggtagagaccggcgcgggggtggtggccggggacctcgccctgcgagtgacccccatcccggcgcacaagatggctccgctccagggcctgcgcggcgaccgtaacggcgaggagggcgacgacggctagaggagagaaaaggaagaaggagacctgaccagtgggcccagcctatttattattattatttttggatgaaactgccacgtaatcgccacgtagtatgaacacctagtcaaaggagccacgtaggcgccaagtcagccaaaaccggtaacaataccaccgagggatctattttgcaccagtttttgggttgagggatgattttgtaattcggtgacaagatggaggacctccggtgtacttttttccaagaaagaccatatgtcctcaaaacccttaacaggccggacaaacagaaggccaatcgatctcgcctacaagcccagcaacgttgccactcgcccccacgtagacgcgtgagacaacatccaccgacgcgtgatcaagtcgtcgcccttcctgctgtcgtgcgtgcgtgcgtcgtgcggcagcggaccgcgtcgatggcgcagtcgtcggtgtttggttgcggtgtccgtccgtgtgcagtgcagccaaaatgacgtgcgcgtcagggttcacaatttcagtggactgattcatcgaatacataaaccactcagatttttaggttagattaaaaaaattgaactgaattttaaaattttgatagaatttattcagattttattggtttttgtcggtttatcaatggattcagcgaaaatccaatgatacttatggtgagcggattttgatccgatatcagaattgtgaaccctatagccacgcacattctaaaggaggaaggatggatcaaaattgtgaaccctatagccacgcacactctaaaggaggaaggatgaggcgagggggtgatttggttcgacgagaaaaggcaggaggacgagggattgtgcgtttcttctcgctttcctctctttagctgcatcatgttattcctcctactagctactccctccgtccaataatataagggattttgaatttttatttgtattgtttgaccactcgtcttattcaaaaaatttgtgtaaatataaaaaacaaaaaattatgcttaaaatactttggataataaagtaagtcaaaaaaaataaataataaatctaaatttttttgaataagacgagtggtcaaacagtacaaataaaaactcaaatcccttatattataggacggttagagtaacagtgctactgccaaaagccaaaaggataaagaaacaaaagcgatggaaacttcctacacatatatgctcgttgcacattctctcttcatctaggttgcgttcgagcgcaggagaaagagagaaagattgttttgtttttcgcgcgcacgcttactgaattactaaacggtgtgtgttttgcaaaaaatttctatagaaaagttgatttaaaaaatcatattaatttattcttaaagtttaaaataattaatactcaattaatcatgtgctaatggctcaccttattttacgtatcttcccaacctcctcaatccccttctcctcaaacacacccctagtacacaacactgtcaagtgtctaacacaacacatgaagtagagtactctttattctttgcacggttttatgacaggtcgcatctaattaaaacaatccttaaaaataaaggagaaaaggccctagtgaaaaaaagagacaaaaacaataggtcgattgcaaagccaccttcaccaaatgaccaaagtgaacttctcccccaaaacggaggatccaatgacccctgaaacgaaaaaaaaaaagtaggcaaaaaaaaaaacagaggatccaatgcacaaaagcagagaaggcaatgggcaacggccaatgccacaggtaaaaatatacaaatccacaggctttccctgtaattttctcccatatcgcctttctcctcgcaagcatgtgtctcctccccactttgcacttggcatttgcaccccagctttgcctctacctcactagtagtagtaaaaaaacgttaattacattgtttactcgaaagcccacaggattaaccgcttaacccaatgcaaccgttgtcaaggctaaccctaaacactttaatttaaaactcctacttaaaaccccccttccagaagacatcccgctccagtttcccacgccaccgtcgaacaccttcacccatggcgtccatggccgccctcctcgtcgtcgtcttcctcgccggctgccacggtgagcgccgccgcccaccacctccgccttctcgtgttcttacttgagatatggctaaatgttttttttaatttttttttggctgggagtgggggtagtggtggcgcaggggaggagcaccgcggcggcgcatggcatcggggtgaactacgggagggtggcggacgacatcccgccgccggcgaggtcggtggagctcctccgggcggtgggggccgggtcggtgaagatctacgacgcgaactcgagcgtgctccgcgcgctggcggggacgcgcatgcgggtgtcgatcatggtgcccaacgagatcatcccggggctcgccgcctccgccgccgccgcggacaggtgggtggcggagaatctggtgccctactacccggagacgcgggtcaagtacctcctcgtcggcaacgagctcctctccgactactccatcgccaactccacctggccccgcatcgtgccggccatggagaacctccacgtgagcctccggaggaggaggatcagcagcgtcaagatcagcaccacgctcgccatggacgcgctcacgtcggggtcgttcccgcggccgccgtccgccgcggcgttccgccccgacatcgccggcgacgtcgtgcgcccgctgctccggttcttgaacgggacgaactcgtactacttcgtcgacgcctacccgtacttcgtctgggccggcaacaacgacaccgtcccgctcgagtacgcgctcttccagggcggcggcggcggcggccgctacgttgatccgggcacggggctcacatacaccaacatgctcgacgaaatgctcgacgccgtggtgcacgcgatggcgaagctggggtacgggggcgtgaagctgggcatcgcggagaccggctggcccaacggcggcgactacgagcagatcggctgcaacgcccacaacgccgccatctacaacaggaacctcgcggcgcggatggcgaggagccccggcacgccggcgcggcccggcgcgaagatgccggtgttcgtgttctcgctctacaacgaggacctcaagccggggcccggcacggagcggcactgggggctgtactacgccaacggcacggcggtgtacccggttgacctcgccggagcgcggccgctccggtcgtacccgctgctgccgccgccggagaacgacgcgccgtacaagggccccgtgtggtgcgtgctcgccggccgccgcggcgagaagctgaacgagacggcggtgggcgacgcgctggcgtacgcgtgcgggcaggggaacgggacgtgcgacgccatccagcccggcggggagtgcttccggccgaacaccacggcggcgcacgccagctacgccttcaactcgtactggcagcagctgaggaagaccggtgcgacgtgctacttcaacaacctcgccgaggagaccaccaaagatccaagtaagcctgaaaaatatctggaaaattttactccatttttgctcagatttcgattgatacatgcaaatgcaatttatgatttccatctttagtgatctaggttgatggatgaatttactttggatgctggttctttagaaattagaattctgtaaggtctagaatagatgtggcgttttgctggtgagggaataaaggcgatgtctttatggcattggtgatgaactcgtgaaagctggtcaagcttgcaattttttgtgagcattacagcactaggcgatgtcttctcgtttagttgtcttttctgatgattgggttgatgaaaacaaataatcttacgtatctcctgggattaggtttgattatttaaatgacttctgaagtcagtgtcaactggagaaggatgaaatttctaggacagtaggattacaagtgcattgtcaataagaaactatttgctggaatcagattacaggtgcccaggatataattgtacctgataatattaatcaacagcacttcagttgacccaatacattatgatctcgatcccgattggttttgatttttgaatgttactaatttaagcatatctaatgctagtgttttcagataggttcatatttagaatttgggttaccgtagcttgtgtagtcctataattggaactcctcgctaggattttggaacatacatttggtacttaatttaaatgataaagtataattttaaagaatgaaatttctgaaccatgttgaacaatgagcatatgttaaacactactgtagaagctaattcatttgttcatgctaatataataccccaaaattccccattagtcatttgcgtagtgcatatacagtagaaggcatctttattaggatctatttatgatgtttgtctctccctggctcacttccaaaagattttcagtctgcacatttgttctgaaagattcattcagacgaatggagctgactgcttggctgtcattactgcggacaaagtatgatccgtgggttgccttccatccaaatgccacagtacatgctcgcatgcttgtgaacttggaccatatattgatttggtcaaaagactcaaacccacctgcacatttcgcatagccttgagtaaggccaactgcaagcctgcaacctgcatccctgcaaagcatacacaggcattgncagggccatgactataaactgttcttagacagctggacatttgggagtggggaaaaatgctgagacactgcctctttatttttctcctttacaacgtacttcctctgctgacaaatatttggcgtttagaacaagggttggtcaagcttctggaactttggccatgaataatttctcaaatgcttagttttgccttcaaaagtactatcataatattataatatcattagattttataaacttgttatgatataaaattgattatcaaagtttcaaaagttcgaccaaatcttatcctaaacgtcaaatatatgtgacatgatgagtattctctagcaagttctctgtgtgcagaagaaaatagtcatttcattcatgacagtgtaagcattttaggtgggacgtcagtgtaatgctccctttcatagctaaacatccttggacactagctcgtgtatgtatgatcttcttctgttctttagcatctcacttagcttataacttggtaaaagtagccttggtggatgttgctttcgactcaaaagaaaggtcctttgctaactcaactaggagaaatcaggataccaaatctgctaatggtgcactattatctgttactcttgggcacgcactttaccattttctgcaagcacaagcaacttattcggtgtatcttaatatgcttctattttacacttcagtggttaacctgccgtgctgattaagtgattagttcgaatcactgattttgttgtgtgtgttttttgcaggccacggatcatgcaaattccacagttctttggactaactgattgcatgggaggacaatatgaaaatgaacaacattgttctcgatttattttatttttgtcaaacctgattagatttagacccaggaagttaggtagttgagtacttctgtatctgctcatcgtctacaaaacctgtgaactgtgatgtaacagcgaaatttgccgtctgtttttctgtggcttaatcagtagaagaagatctgtggcttaattagaacgaaattttcagaactgaaccacctgcctctgcatgggcctcacatgggccatacatgggcctgcacctgcctctgcaaccgagctaggagtagcagttctgccacacggcccgtctacaaggatggtgttgtactgtgtcactcatccttcgagttttagttttttttttgtaatatcttttaatagtttgcacatcatctacagaaatattttgatgtacgcaagttatttaaaaagaatcttttatattttcaaacaaaaagaatctttgagtgtaacacttctcttaagaacaagtactactagtaactatagcaaggccaaaaaagacaaatcaattcagttaaaattgccaagctgaatttcagtagtacatgtgatcggtgtttcagccaaaaaaaaacatggaatattcatgccctttcctttgtcacactggccactacgattggttcaacaaggacatgagcagaatagggccatttacatcggcgagtgactcagctcacacagcgactgttactgctctgtccgtgcgctgcagagagatcacgcacatttacatctcaaagacctttttttttccttctctgtgcctctaactgcactgtactgcttgtcagttactcgacagcaacatccaccgattttttttcggttttcatgaaaaaaaaacgcttcaaaaccaatggctccatgtaaaatctggtcaaattttgtatttaaaaaacagtttgatttttataaaaactttactaggaaacgagcggtttctattctcgagccggcttggaagtgcagttttttagtgaaaactggttggtttttgtcggttttataaaccctaactgccaccctatgatgatctatccatctctgaatctcactctcacgaccaaagttttttgttgttgtcgtcacagctggaagaaaatgtgattaaaaaagagagagaaaaacagccgacgaaagaagcagcttctgattgcagagataactaccactacaagaacaaactaatggtgaggatatggttggctttgcttggcgtaggtgttaagattcagagattcctccgaccatgcgagagatctatctttgctactgcctaattgcctatagtggccggtataatgaccaagggggttacctgtccacttcacttcaccataagctgcaaaatgcaatggctgcaattgcatcactacgtcttacaaacgtacttattgcgttctgaaataattggcacttatactattcaagtttattttttcttttttctataaaatttataaatgttgaaaatatgttattctatcaaagtgtgtaatatcataaattcaacacggctgtaatcaacggtgtcggttattcgatattggagggggtattcttgtagttttttttttagataatgagttcgcaaacatgcattgcttgagatggagataatcatgagatggtgaattggtgatgactgatgactggtgatttgggtttatgttttcttaaaagaaaaattggataaccacctcagccacttcaactgctagctaagctagacaatagacagatgtagagatggatagatgtgtagccatagatagcttcttaaagctccaacacacttatacctgcaacaagaaaagagcacaaattacttgcaagtgagctaaagtccggtagctagctagctagataccaacacacacatttgctgccgtagcttactagattatggtggtgttcaacgagattagtgtggtgttggttgggaactacctttctcaggattagagagccatcatttttgttctgtgattccaggtcagtgagcagttaagcattaattgaaaaaaaaagaagagttggacattgacagtttgacacattgttgttattattatctaatgactcctgcagaaatagagcacactgcacccattccggaaaatctcatggtacctttgtcattaatcatgctgagcacagcacacatggctgcactgattgccctgtgaaaattcctactcctggctactacccctgctcctgatccaatcaagacgatgattaaatcagatcaaagtttgtgcttttccagcaaaaacacagctactgcaaagatagatttcaaagccatttatctgaaaagttgcaaagaaaaaggggtacaagtgccatgaactagttcatgatgggccagcagcagtggatatcatgagaaatagatggcgctctcaaaattgcaaatcaatcaagtgccatttttaagcaacacgtcaaactgtgcaatgagtaatctgcaggccaaacaagctcatttgctctagatgaactcccaatgcaaattaccaacacaacaacaggcaaacacaaatttcagaatccaagattattccactaatccataaaataatgcaccactgaacctcacattttgcaaagaatttagtactcactaattctagtatattaaaactcctaattaagttatcctgactccattggaaagagtgaaaagcacatcaaaaacctcagcgaacaaaaagaaacaaaaggcaaacgcatcattttagtggagccccaccttcacgggctcgctggccggttcacccacatcctcagccgtccatcacccccacgtcggacggccagatctcccgccacgtttcacccccgccgagacgtgcgtgtctcttacaggtgggtcccacgtaagttttccctccacgaagtgccctaaaaaaatatataaccccagcgaaaaattttcgcgctcacgcacgcacacacgcggcgcacatgggccgcattgattgcggcacggcccgggctgacccacacgcccactgacgtgacggccccacctagaggtggccccacacgtcatactcttggagcgggtttgggtagagctccacgtcgcggtgggctttactccaaaccccccgcctctaaaaggaggaggagtttagtagtaacctctttcttcttccatccatcgccgccgccgccgccgccgcattcgccgccgtcgagtcgtcgtcgtcgccggtcaccgccgccattggcgagaagcggagaaggggaggggagtgggggggcatatcaatggagggggaggaggggaggaaggggaaggaggcactgagcggggggcacctctgccacgtgtgcgggtaccagtaccccaacgcgaaccctagcgcgaagctccgccgctcccaccggaagaactgcgggaaggcgccggccgcggacgagcgggaggagggggaggaggtggacgccgacatggagcgcaatgcgggggaggggctcctgccaggtacggtttatatttggtgtgcttctccttggattgggttgtctcgggttcttgggtttttgatggtttcgcgcgttcgtgttcgctgcagttagagcaggaggaggtgagtcggaggggaatgcaggctctccatcgctcggatctgcgagaggagatgctgatttggtggaggtgaaggagattgcaggtataatctctagtattttttttcatcggtaattttctttcttgctttctcgtttaccgctcaatctatctcgtgtatcttgctggtaatttttctttgttgccttttcgtttaccgctcaatctcgtgtgctatattaaattcgaggttttcgtgtggggttcgttgcaattatccttgattttgcctgcttgcattgtgagatgtgagagctgacaaaatcgatgatagatcgcgatgattgctgctaactaaatccgcaatctttcataagctttgcttctgctgcgtgcaacgttgtgctttttgttgtcttgcttggtttgttgctagagaggctgaaaaaggcaaaaagtatggctgccttttgctcatcagtcccccccttggagagggacaggaaactcacatggcatagtgagatggtactgttctggggtactggagtaaaggtccgtgtggttcttggttagcattaaagctgaaagcattggtactttcttgttttctttggagttggagagatacttgtgtgagaatgatgtagaaatagttggagtgaattgtttttctgacttgcaaactgtagatctgaactttgctgagtcacttggtgttgagtgttaaataaagtagtaaagctaatcactgagattcaagtgttccttccaccgtctagcacctagattatctctccgtgtttcacggcaagttggtggcttggtaatgttagtcagcagtaagaagcctttgcttgtctttgtggtcatatacttcatcggattctttctcgaaactggcagtcagacaaggtgaactgatttgttggtttcttggtacatctttcatgctaaatatccgacatatctgtcattactcttgttggtaggtaagatagcttagaagctgtcttcctacacatggtcttacaccacatgctatcctagtgacatgtgcgtttggtttgctatgctgaattgtttagtctccttatgtggatgcatgtctcttgaaattttggttgtatccttattataatactgtgaagtcatctacttggacagatcattcagggtgttgacatgagtttctgtaatttattacctaattgttgtgactagtccatgtttttttaaaggtctgtggccatgctgttatgtagtatcgtccattaattctggagtcattatgctgctaagtttctaatgactgcaatcccattatactatttacagcaaactcgtctttcaattgttttatgggcccgattttcagggttagtcctctatatcaatataaagttagctagggcaaacttgtgcagcagttacttaagactgtgttattaatcaaattatgaattaggcgtgtacagtcttctgtgaatagtaaattatgaaataggtgtgtacagtctttccaccttttgcggtgattttttattgtcttctgtgaaacctctcattttgctcctattagcaaataatgacagtggaaagagtgctactgtggaaatactaaatatattaggaaataaacctacgcaataaaaatagcttttatgggtcttatttacactctttagtttctgttagtaataactccctatgtccacaagctaattttggtgcacatcaggaatttagagacattttctcccaataacctagtatagctcacgttattaacttattagaacatatccttttccacaataacttagcatgagttcttaacatttcctgttacttcgtctagtcttttgtatccttccatgcttttattggaaacacctttaatggttactgatttattatgctgacaatcctagtaaaatattaatgcttttgagttgtttttgatcattcctgccatcctttgtttcactaataagtgttcttttccacgttacttattatttcatgttttagttcatctaacaatgtgttggtttgattctttaatagaacatgcttctccaaacgttaccggagttcaagtcatcactggttactgcagtgaagctggtgtgattaattgcgcaagtcattctgatgaaatttcaaaagaaggtatgaaaactaacttatgaaggccttgcaccaatgaagtcaaaattaagttgcagaacattactctgaaatttcaccacttgcagttggacgtccggctgaacgagaagatagtcttgatgagtaccaggacgcgtctccttttcttcatcaaccagattctgaagttggtgcagcagtagcacataagtcagatttttctattgaagaaattaagaatttggatagtgtttcaccagcagcaagtgtagcagcaaatgaaatttctgtggaaatggatggagtatcgaaagatcagttatcaggacaacccaatatgactaatttatctggtgaatccatagttggaaaagaagttgagcctactgtgatgcttgagagttcagatgaattctcagttaatgttcacagtgataatacatatattgttgacagcaaacctgataagacatctgagtttattggtgatgtgaatggttcaacttcatttatttctgacctaacatcccaatctacaagtcccataatggttgaaagcttgatggaagatagcatggatgctctgcacatcatatctgaagtatcaccaagtttggaagaaaaagcaggatcagccaatgctgaatctgtaacagaaaattccagaattgactttgtgcaaactgaagatcaactgaagctcaccaatgctgtaaataccttgacagattgctcttcacagtacaagtgtgttaaagatactttagatgcccagctgcctgttgagaatccgttcctgggtaattcagtatgttctttagatggtcatcagagtgaccatgttgttactaatatggatagcatgtggggttctgatgatgaagatatttgtagtgaaggcatcaaagcgaagggcagtgagttgggtttttcttgtgaggagaacccacaacatgtcgagttggttgataaagcagatgaaaatccttctgtagagaagcctaatggattatcagaagaggtggtctgcagcaaagagattggccctgaggttcctattataggccaggtctctgcaagtcagcatgttgccttactaatggatcaagtgtccacaaagaatccgttcattctagatgataccaggagcgacgacttatttgagcttccaactgagaattaccattcggaagcacaaaatgttgctgaatcaaagctgcaagttgactttacacctctgccattggatcagctgataattgtggaccaaactagcattgctgaaggccagcaatttgtcatctcaggttaggattgttttaccgtggattatgtacaagccagtaattctatttctgctgtatgttttttaatgtcgttaattcattgctgaaatttaatgcgtccaggctatatatgctttagtctagcttttatttgacagcctgtacatgtttgtttggtttttaaagaaaattggtaaaaatgctaagctgtggagggaatttatctaaaatgtcacgtggttaaggtgttcaggcaaatgatattctgctttagtgccttacatggatataaagaagttaaatcaacagcggtagattcttaaattatatgtactacttcctgcataaatgctcactcacgagtcatgacgatggcttcacttgcttgctggaattcacagtagacttttaaatcctaatcttgttagcagtattttcttggggatggctactgtacaaacaacttttatcatagttttcctctctttgcatggcacatgttgccttgttatcacctctggagagaatagtggataatggtaaaatgattgtgaatacagagctagttgctctgtattgtcatatgttaaaatcgtttcaattctccctattccaatgttactgtatgactttcttctagcagacgttactagttttgattacatggtatcagtcactgaaatttgttgctcatttctggcaggtgatcgtgtaccagctatctcaagtacctgtggaaatgaacctgcagttggcacagaggatgtgtctgtcagtagcacttctgatcctgcgaagaacatttccttgcatgatgcctcagtgaacaatagcagacaggaagacggggagcctacaagtggcatcaattttgtgccatctgaagtatttcttccagcagagtttagcacaatgcctacttctcaggatatcaatgctctcaagaatgatggtaacgagaagacgccacttgaagacataagcaccaaggatatgactgcatcacttagtgaagataatgttgaagaaaagaaagagaccgaaggcactagtgtgaaggagatgaattcaatactgaaagcagacaatgttgaagaagagaagttgactgatgacacgagtgcagagaggaatgcaatgcagcacatagatgacgctgaaaagaagcaggctgctgacactgtttcgagggaaacgagtgctctacaaaacatagaagaaagggaaaacgttgaaggtactggtgctaagggagtgccagcagtagggagcttggaaaatgctgatgcggagaatcagactgaagacaccagtgcaaagacagaatgtaaatcagataatgctgacaacaagaagcagagttacgacacaagcacagaggagatgaatgccaagaatcaagctcaagatacttcctcaaaggagatgaacaccatacaaaacacatctaatgctgaagaaaagaaccaaactgaagacccagctgtccaggagggaaacaagcagaaggaaggcatctctcccacagtagcgaagcagagttcagaaagagttcatgtccctctcaaggtgctcctagccgaggcgagtgtggagacgaaagaaaagaaaaccactgccaaggagcgtgttttgtcattcaggcgccgagtatcgaaggacgactcatcgtcggccaagtccgggtccccaaaacctggtgctgatgacaacaaattctggagctccccagcaagattgcccgagaacaatgctgagaagaaatccaaagcaaggaagcagccatggatgccgttcatttgctgtcactcggtgcactaagcctgccatccatcttcagcagcacaaagcttctccaagctgctgctatacaccatgtgcatgttgcatcttgagttattattgatagcactagtagtagtaacagtagtaaagggcttggctatgctacgatgctctttctagtatttgcattggtctacatttgccgctgtaactaaagctccccacatcttttgtgtagatagtccatgcaagtaagattgtttggtaatgtcgagctgatacttgctgatctgcattgatgttcagactttgtgaatcatgtgcgattttgatgttcatagtaaacttgctcgtgaatggatgtggattcagccctgtgcgctgcattggatcttagacactgtttgaaacaaattttttttcttttaactagaaaaaagcccatgcgttgtaacaggtaaaatctatttatatcttattatggttatatgggctatgtttagatccaaagtttggatctaaacttcagtccttttccatcacatcaacctgtcatacacacaacttttcagtcacatcatcttcaatttcaaccaaaatccaaactttgggctcaactaaacacatccatggtttagtttaaatcttattatggttatatggtttagttaagatgaaattgactgctggaattcgtttggatatatatatatttttagaaaatcatgagctgcagttaggagtccgtttgtctaaagttagcacgtgagttttcttatacgactcattctgtattaaattggaattcacttggatatatatatatttttagaaaatcatgagctgcagttaggagtccgtttgtctaaagttagtatgcgagttttcttatacgactctttttgtattttcaaaagagaacgaacttaaaaaccgactcaaatacttaaaaactgactcaaatatggatatgtattttcaaaagcgaacaaattgaaaaaccgacttaaatacggatatgtattttcaaaagcgaacgaaataaaaaccgacttatatatggatgacgtaccaaagtacaggtaaaacatcttcaatttttataatagtaacgacttatgcgagaattgagcaactttctggcatacttgtacgaaaattttgtatagcaaatttgtgcgttccattccacaaaacttgactacgccatgttattatctgattcagattttggaatcacttttttcttggcaacttttaataataaactttgtagtagtaattcgtccatcaatttcagtcttttttttttcagtctccgtcgtctcactcaaatgacgcctacgttgtgatacagtgcggcccaaacagtcttacatattcatggagtgatatattttatattaatttatgttgttaaatttttgttttattttttgataactatttatatacttcctccgtttcattttaagtgcagctgtagttttctgtgtccgacgtttaaccgtttatcttatttgaaattcttttaggcaaaatttgcttgtatttttgttgttattagatgataagacataaatagtactttatgtataacttatttttttaaaaaaattttaaataatacgaacgattaaatattagacacggaaaccgcgactgcaaaatgggacggggagtaacatgcaagcgagtggacctaaaagtgaacttattcctattcggattgccgtgcgggccaatcagatagagtttcggcttcggctttgttcccgcgaccgtgatcgattccgagtcggcgcgggagatatccatcccagtataaatcttacgagcggcgggcgctcctcctcctccacagatcgcttagggttcgcgttgcaaatcaatcaatcaaggcgcgtgaatttctgggacgctcttcatcgatcgatccatccatccgtcagcatgtcggcgatcctcatctgtagcgtggctgcagcgtctgcttcagccaatacgtcggcggcgatgaggaggacgcgccgcgcgcgagatggcggtggcgcgccgccgccgccgccggccgggtactccgcggcggccacggcggcgagtgttccggcgtctctcctgttgattctggggtcgtgtttggtggcggcgtgcatattgttgtgatcgcgcgacggcgacgtgaagcctctttggcggtggcgcgcggcgtggcgttcacgactaattttgatcggaatttaagtagtagtttctgggattgattgtttctcccatttttattccttttgttactgctaagttttatatatgtcggaacaagcaataggaagattaatgtctatatttaatcaagatatattgtttttttttctgatttatattaatataggaaatattaatgacctagagtgagtgcgcgcttaaaaaaatacgaataacagggaatgatctaatatcgaataattaaaaaggttagacctcgaagaaatcaagtgtggagctagctatccgtgggcgtttctcagagtgtgtgcttacacattgatgaattggtcgaagaaatcaagtgtgcgtcgatgcgatgattctgacgtcgctagtagtaaacttgctcatgaatgtggattaattttggcatcttgcgttgcctagcttggaacacgagatgttttaacgatgcaaattcccgtgttagatgatgcctactaatctgttccgaccctgtttctgaatagctgggccgagtggcccactctatgtacataaaaatctctcttaactatgttctacatggttaagcttctgacgttgcttttaaatcgactatatttctaaatggttcagccggctctgtttctaaatggttggttgagccacggatgaagaagctgcctattaatctcccgacttctggcagcgttcgtttatccaacaaactgttggatgaaattttggattatcgtggcacgttttttaaactgttaaacggtgcgttttgtgtaaaaactttctatatgaaagttgctataaaatatcatattaatccatttttcaagttttgtaataattaaaacttaattaatcatacgttagtatcacctcgttttacgtgaaacgtttaatttttatctttatttttcatcttccggagattcaaacaaatcgactcgaaataatggttgagccgtggatgaagaagaacaacgacgcattcgctaagtttcgagtagtttcctggtgattactgattaattgttgttctttcccttttcttttgattctgattatatatatcgaaataaagaaatattattgtactgcatggatatagatgagtttgacgcacatgcatcacttgctcagagtaaaaaactaattctgaaatgtttgctcgatcaacgtctgctgcacggcttattgcgtggctgtgaacgtccgcaccgccagtttggtggtgatgaggcacccacgagcatttgcgcttcgtcgacagtttcgcggccacgttgtccaaggttccggtgtattgttacacggttgtggcggcttatttcgccgtggcagcggtattggcgcggtggccattgctcaatgatcgttgaagtaggaattaagtatagccaattgctagctttaaaaattaatatatcatatatgatctctctaaatatcttattcatagggctgatcggaactgctggctgctgcagccatcacggctatggccctttttggctgctgctgctgcagctgatttttagctctcgcagccgtagctgctgcagcagccagcactgccgatcacgctcaatagttttatataaattatatatcgcaccattaatactttggtctacgtattacactcacgtaatatcttgaagctcaggttgtagctagatataaatttataactcgtttttcttctcacctcttctctcttattcacatgtgtgtaaacctatactggctagtacagtacttgctcttagattcattgagcgtgtgatgctctctctacgatagcgaaggcgacacaagccgcaacgcaggcgacggccttgggctcgctgcacagaaccgaccgcgacggcccatgtactcctacagtctcgcaggttctcggcccaatcgagacgttcgcgtgggccgtgattttcccggcccactcgcggcggcccatctcaccgagcccaccgcctagggttctcgcgccgccataagaaccccttcattccccacccagccgccgcccgccgcaggggttcgcgaaggtaacgtgcgctccggctcgccgccgcgtggttttccggtgacgttctcctcccccccccgtatccctaacgcggctgtttttcgcgtgcagatggcggtgccgttgctgacgaagaagatcgtgaagaagcgggtgaagcagttcaagaggccgcacagcgaccgctacatcggcctcaaggtttgcatcctccccttcctcaaatccctcgctcgcccctcccaggatgcaagatgcgctgctgctacgcgcgagccggatgcatttttttaacggtgtttctgatggtataatgcattctagagtgatgttgaaatatgatcatccgatgcttaggaaaacagtttatatgcctctaatttgtaattgtagcttaggcaaggctactctcaaatgagacgaggatgtttgttgatatctctcgctactagctaaattgattctgtctaaagtctagacatgatggctaatcatgtaaagctaagatttacacatgtagcttgagcattgtgctgtctttgtatgcctaaagacaatggattccgaataaaaaggccatctaatgcaggcttactcatttacatgaaactttcgaattgagataaaaaaattgaattggtcgtgtttttgatttttatgtttgatgttcagagtgaaaggaaatgatggcttagtaaaaggtctgagtgagaaaacattttcttagtgaacattgggggtaaaggaagagggccctagctcttgcactagtgtagcattgtggctctcgcaacctcttctacagcaattacttcattgctttgtgaagtgggttggatcaaaaggcgtgggcttcattctgagtatgaatgcttgcctagacttctccctacattttttcccgatgttcacttaagaaaatcctgttttttgcatgataacaatccttatgtctgatcctttcagcgaacaacttttgcagttgcatatattagtgggtgaacttctcaagtgcaggacttaagttcttattatcgtgttacatatgaagttccttatatgaactgtcatttggatgtactctccaaagttgcataattgatagtcattagtatttagttatgataatcatttatgttgtaatccccatcgtgtgcacagtataccactcaaacaactttgttttaaaatgaactgcttctagaaccaaaaggctagctgcttatagttgtattctgtgtttaactaacaaattatggatgtgtgaaatgataggttcataggataggctagcttttaggattttggcatgctgatgatttgtttctaacttgaatacacttctccgcttatttcttttgtgtgctgccttgcttaaatttggtgttctttttacttccctatatgtagacaagctggcgcaggccaaagggtatcgactcccgtgtcaggagaaagttcaagggatgcactttgatgcctaatattggctatggttctgacaagaagacgaggcattaccttcccaacaaattcaagaagtttgtcgtccacaatgtctctgagctggagttacttatgatgcacaacaggtaacacatgctgccgattcaatttagtgactgaagttgagaagtgaatattctgaagttctatgctatgctgtccactcttacaaaccttgctaatggttaggattaattcttgttattgcacatttcatacaaacaggacatactgtgctgagatcgctcacaatgtctcaacgaagaagcgcaaggagatcgtggagcgtgctgcacagcttgatatcgtggtcaccaacaagcttgccaggcttcgcagccaggaggacgagtaaattgttacgctggttgagctgttttttggtcgcgttgtttgtaggaggaacattaccctgcttcgagaagttcacctaatcgttgtgtaattttctcatgtaaacgtccttaggatttcagtaatgagctgtgctcctataattatttactgtactcgacttaccttttcccatgtacactgatatcggcagtcagatgagaaaattgcatgctttgggcactatagttctacatttttactgctctctgatgaagcactaatagaggataaataatctcttgtgatcgtcgaggacctgctgaatgcgcatcgcattgctgcgaacctgcgatgtttggaacatgaataatcgttgatgggctctatatttcctccgcattcctttgtaaattgtaagagactacaagtcataatttgccattctatgatgtataaattgacactgtaaaatgtaaattgcagatctcaacgcttaaatttattcaattgagttatgattatgaaaaaagagatgtaatcatactttttgccgttaaatgcttcggaagttcggatcggtcgaccgagccatcgggctctcatgcaaccacctgcaccctattatcttgcaatcccttttatctatgcatgtatgcatctagcaatatttaaaatatttttttctcctaatctatttatttcatctatgatcgatcaaaccattttatttatggcaattaaaaactttgcatcaagacatcacacgattttattctaataaaaggacataagtttggaacaattataacccatcaattcatagcgatttgttttaacatctattttcactatgttttagattttctttttaaatgtttcaatgcctgttttcttcatcacgtagaggttaatattttattcgatgatcaataaaacatttgaccaccaattttttttcaaaggaaatgggacgatcatttgtagttttctcctagtttgtcacgtcggattttgtaaaaaactgtttctactacgtgtataaatatttttccttgaatcaaatcaaactactctgacaacaactagttcatactctgcatctaacgaacattaaaacccaaatcaaaacagcccaagagattcaggaagaataataataataaaaaaaaaggccatgctgccgctctataaacaaacagtcacccttcgccctcctcgcggaaaatcctagaaacagaaagaaatcgcactcatggcgaagccgcagcttcttctggtcgtcgccgccgccgcactgctactcgtcggtaagtagcctcgatccatggccatggggggcgcccctcaccccctacgcagcgacatctctgatccgatctgagcctgactcctcctcgcctcgtcttgcagttgcagcctccgccaagaaatccggcgacgtgacggagctccagatcggcgtcaaggtaacccgctcctcccagggggattaccctgccctctcgcctgtgtttccaggcgttggttctcttgcgctcaaagactgtttgtattcttgcttgggctggatcggctctagttgactgacgcaagaattgtttgtttagaatttcggattttattgggtcgaggggcgcgtgcttcgtgcgtattagatcatgtcgctgtatcgcgaattgtacgggaattagtttttggtggaaacaatttgtgaggggtggtgttgtgaggcgggcgagtttgcctgattcaactggattcacatctgaatctatagttctttcttcttttttttttcattggaatgcaaaatgttctgaagaaagcggaaaattgaggctcttttgtggaattgattgggcaggtgttaccttgggttttgatcaaggttttccttcgggaagtttagccttctattactgtatttcctgtacattttaattgctatcaaaattagttcatggagaaatgaatctctgcgtgaataattgcttcagggcttttaggttccgtagttctaatatcccatttgccatcgagtaaagctacttaacaaatcgtaggaggaactacaaactaatactcccttcgtttctaaatatttgacgttcgttgacttttttaaatatgtttgaccgttcgtcttattcaaaaaatttaagtaattattattttttcctatcatttgattcattgttaaatatacctatatctatacatatagttttacatatttcacaaaagcttttgaataagatgaacggtcaaacatgtgctaaaaagtcaacggtgtcaaatatttagatatgaatggagtattacatagtaccttcctgtaagggacagggcgtcttgaacatatgacctcggacataaatttattctctaccataggataatctgaaatattggtgttacgctgccatttcttataggaaaaaaaataaaacaaaaatctagcttgccccacgcagcatatcttcagaattagtacagccttgccaaggaaagaacattgtaattgtcaccacattggtccaaaaatatgcattttatttattttgatgctctagagaaaacggtagccttttacaaaataaatggctctttcaagaagctggatctcaaatttgtgtgccatatagaatttagatagtttaaatatcatatgctactttcattttgatatatttattttattgggctcatatagtcatatatttgtgttgtgaccttgtttcacttgcagcacaagccagaatcctgcagcattcaagctcacaaaggcgacagagttaaagttcactaccgtgtaagtttgatattctgctgtatggcctgttttgtttttatttactggcatcactttatttatgaagcctgtagttcacttggcctctgtcatccatttacagggaaaacttactgatggaacagattttgattctagctatgaaagaggtgacccaatcgaatttgagttgggcactggccaagtgatcaaaggtaatagtaatggtcccaatcaatagctagctactcatttaattttagtattgtttaaaatttcaatgctccattgtctatctaaaaatttcaatactccatttgtagggtgggatcagggcattctgggcatgtgcgttggcgagaagaggaagctgaagatcccttcaaagctcggttatggtgctcaagggtcaccgccgaccatccctggtatgtcgttttgtagttcttgtctcttgagtttatgccgctgtcaagttagaatggtacatccttttcaagagaagttgtgtataataaaaatagtttatcatacaacagcacatggccacattgtctgagggagctgctgcaatgctatattttttctagtcgggactttttcactacatatgtaatatatctgatctgatctggtgttgttatgttccggcctgcaggtggagcgactctcattttcgataccgagcttgttgctgtcaatggcgagccagccagcaaatccgatgaggacgatgatgacagcgagctttagatagccaggatggttcacatcttacgcgccaaaacaaagtctagttgtcgaatcaaatagtgagtagtgaaatgcaatgcatttcaaattcaggaccccatagagaaatcaactctctttttttttcaccatgaccttatctgctattttataacataagcttctatttaacttttagcctttctgaacaattgcatgatctgtgatgcatcttttgttccaaattgtagacttgttttgcgcttcgttttgtttggaaaatggttacaaacataactgctgtgccggtttggcttctatgtgtgatatagcatccgaattgtatgaagttcgaagtggacatatccaggctaaaacctgatcagtttgatttaatttgagttaatttagcttatactccccaaacaaattctggtaaagaatagtaccacatgattaaggagatcaacaaactttttcccaaacaaatacaaacggaaatccgtaaacctgattcgatttgcatcagctgccaccgcaatgtagcctttcagaggtgaaatcccagatcatatatgcaaactaaatccgtgaaatttctacccccagaccctcaaactaaatccgtttaaataaccaagaattgcaattagaaattgcataaagatgttcacagaagagggaggcaaacaaaatgctatgatttgcttgcattttcttcagtctacctcactctcgttcatctcggtgaaaatcaattcaattcgaattctcatttcccaatgtcaaatctcagcaaaatctgggccagaaatctgaactcaaa

SEQ ID NO: 76663 - DNA, 632 bp, Oryza sativa
tattattattattattattattattattattattattatcttcttgataagtgtggagattatggataccccatatctacatgacggttgtaatttagtcggatatacagtaccaaatatagatggaatatctctatgaagactcgggttaggttctaaacttgtatgtcaaggaaatacccgggatcttagtcggttacgattgtattttatctataattccatattccgttaggatatggactgtattttgtaaagcggactccttcccctatataaggagggtccgtgtgcctcttggggggcgattcttttttccagtttatacaatcaataacatactcggcggaatcatccccggacaggagtagtgtattactttttgaacgagaaggcctgaacctgtataaaattccttgtctccaaacccatccactttcctagcttgatagccacccccttttattattgccgaaatcttgtttcgacagttggcgcgccaggtaagggtagcgtcaagtttttgccgactaagtgcgatggggttctggttctggcatcgacgacttcgcctttccttcccgggcaggcgttccggttcggcagccttaactttatcaccaaacgacttc

SEQ ID NO: 76664 - DNA, 550 bp, Oryza sativa
gtcaggccgcagttcatgaaatcgtcgcccccgccgtccgactagaagctggcggtgttgagctcgaagtcccccgacggtggggctttgacggtcaccgtcgccggcggcctccaggcctgctgctgctgctgcttcctgtaggtgatgcttctcttgaagattctgcagatggtccagacctcctgcatttttttcagtcagaagtgcacaagttagaggtcaatgctattaggaggctgtactcttatcggttagaaatggcaatcggtagaatactagaaacacgtcagaacgtgagaggatgtccagtactcctttaaaacgtgggaatttcagtaggactttcacatggattagttcaatttttgtagaattttcgcaaaatttcttcgttcaaaaggaggcctgtaatctcgaaagaactgctgaacttagcttgaaaaaaaatattaagacgatttggtgatgtaaagtattgcagatgatattgtactccacactatcaaattgtacgtagttgtgatctgtcacagatgaggagaaccgg

SEQ ID NO: 76665 - DNA, 730 bp, Oryza sativa
ttggttttgaattttgtcaaccatcacctcataacatcattatattgcccatgtatatactctttccgtctcaaaatataagcatttttttagatcctgacacggtcaccgagatgctactttaaccaacaatatctataaaagtaagatgttttaaataaaaagagttgcatattatgatagtttgtttaatgataaatttaggaacgtcaattttacatgattggtttttttaattttgttgctattaatggttaaagttaaaattgtttaacttgtcaccatgctaaaaatgttaatattttaaaacagagaggggacatgccagcatacatacatatatatatatatatatatatatatatatatatatatatatatatatatatatatatatatatatatatatatatattcccacttccctgtagcccacgctgctcctctttggacatggtcgctacagaaaataacacattacaattcagtagtggtcttgctttctcactctctctctcttaaaaaaaaaacgttttggcctcagaaatgggatgtgtcaggaaaacacattcgacgacataggcaaatctgacgactaacaaggatggtcaaggctcctgagtgggtatatgtgcagtggctcttctagattggccatgcggataggtgtcctcctcgtctttgctctattgatgtggagtattagcagccttttaacttctggcaacta

SEQ ID NO: 76666 - DNA, 509 bp, Oryza sativa
cgtcttaatattttttttcaagctaagttcagcagttctttcgagattacaggcctccttttgaacgaagaaattttgcgaaaattctacaaaaattgaactaatccatgtgaaagtcctactgaaattcccacgttttaaaggagtactggacatcctctcacgttctgacgtgtttctagtattctaccgattgccatttctaaccgataagagtacagcctcctaatagcattgacctctaacttgtgcacttctgactgaaaaaaatgcaggaggtctggaccatctgcagaatcttcaagagaagcatcacctacaggaagcagcagcagcagcaggcctggaggccgccggcgacggtgaccgtcaaggccccaccgccgggggactcgagctccaacaccggcagcttcgagtcggacggcggcggcgacgagttcatgaactgcggcctgactccggccatctcccagcagcagcagcacggcggccgtcatcagatgatg

SEQ ID NO: 76667 - DNA, 50229 bp, Oryza sativa
ggggagcgcggggcgggagggtgtcactgatggcgctgctggagcaggcggagcggcagtggacgacggccgccgccggggacgccagccggaggcgcgtcgcggacgaccacgcggcggcggcggaggcgggcacgaacaagggcttcgccggcgccgccgccggcgtgggagggcggtgctgcgtgtgcatggcgcgcggcaaggccgcggcgttcatcccctgcggccacaccttctgccgcgcctgcgcccgcgagctccgagtcggccgcggccgctgcccgctctgcaacgccgccatccacgacgtcctcaacctcttctgatgtcaccatctccgccgccggcgacgacgccgccaccattaattccgtcgacccaatacaccattgctgtaatgtacttgtagataaaaaaaaggttctactacttcttggcttcttggcaactgcaaatcatatcaaagaattctcagagcatcacctgttcatcaatcacccacccgtgctacacaaccaatcgcgcgattcttggatcgatcgaataaccctctgttcctccatggcagcaacgatccgcagatcccggcacaagtgctttgctgctgattagtaattacgtttgcagccacgcgagtgattgaagattaagttggcgcatgtaattagcacataattaattaaattttaattattataaacttgataaatgagtgtatttgatttttttaaagcaacttctatatagaaagtttttacacggaatatattatttagtagtttaaaaaaaatgctaatgaaaatcgagatataatctacccactctgttttataatgtaagttattttagatttattaatatttatataaatacggacaatattagaatgatttatattatgaaagcaaatcttaatgagaaaataacaggttgctcggtttcagtgcatcgcagtcaccgttgaactccacccgtttgctcggtttcagatcaacgcattagttaaaataaatcaattgttttttcagacgatgcgatcatgtgatgtcatggctggaggagagaagattagatagggatgagttgaaccgtgagcccatctgaccaacggtactccaaacctgacaccttcgttctgatgatgttgacttccctgaagaaatgatcaaattaatttatttcagactaagatcacaccaattgacggcctctgcatgatccggagttccggacagtccacttaaacggctaaaccctgaactgacaaaaatttactgtactataaaatggtttcagaggagatactaaaaatgtggcacctttaggatcgtaaaatcactcttgaactgaaaacgtagaggatacgtacatcattgcttattgcatatgaatatgatatcttgtatacttgtgttgaggctatcaaggccagcactacagtgccaatcactttaatcacacttgtactaccatatttgttagttaagtactagattgagccaatggggcactaacacacactaacatatgcaaccatgcaagcaatgggcactgaaagtgtactttgtaacattggatatattatatcatgttgggtaagctaacttttaccatcaatccatcatgcagaagcacgggttcagagtttcagagcaaaaaacaccccaatcttaaatctaaatctatccctctctagcctgtgattgcgtgcattcgtcgccgttagcctgtctttgcgagcggcgacaccgggaatgatggcgacgccctgcatctgcatgcaaatatgcaatgcaaagcgctagggaccgggaaatggttagctgaattcgctgaaatggcaggagagaagaactggacctttttggagatttgcaagggttcagacaaagcgcattagctggggtggaattgccgtttagcgagcaggaatcgtgtagggctcatgcagtggctgatgacttgtgacagcctacaggaatggggtacccaccactgtactggtacttcgcctgtaatggatcgagagaataattgtacactcagatcttgttgcttaatactttaattccttctggaattacagtcccatcgatcatcgttttgtctccaactaattgtaacccgtgagaccataaaaaactaatatgtaggtaaactttttatatatgtgttcttagctatttaaaaattaatgctgaaaaataaactacgatgagaaaaattatcaaaaacaactctaaaattaaattctaacattaaaatttgcatgcgagcgatggccaataagcatattttacaaactttacaaaaaaatatcttgtgatagattttagcgcaaatcagtctctgtaaaacatggcatgggtagctagctctggtcgccaataattgatctcctcatgaggggacacaatgacctaagcttaattaggagtttaggacagtgattcagtgaacaccgttggttgatgctgtcctagatcgcggtggttgagctgccccgtccgtctgcatggacgcagtcacactatcacaaattcacacaccatctggcattctctgcttcgatggagatagcttgcgaggaagaggaagatgaacagtggcgtcgcacagtttctgatcccaatttttatccattgccacctcagcatggctccccacaataggactatatataaatctttgcctgcctgtcgatctctgtatcttgaattcttgatgtgttcatcggacatgcattgattgattgattgcatgggactccaatccatccactgtttggattggatcgaccgtttttttttttgtggttggcactgggaggaatgtttgtcagaggccggccggatgattagttaaccaaacgtacgatgagaaagaaaattaacaatgcagctagctttagctcatggttgcgaacttgggatggcgaactgtgcatggtccagacaccatacacaaatttcagaggagacgatatacgtcgtgatcatgtactccctccgttacatattgtaaggcattttagtattatcttaaatcaatttttagtgctgattaaatttatagataaatatatgcaacgcttataataacgggcgtattgtttatccgtcgagagcttaacacaaaaaactttactggttgcccatatttcctaataaaccaaacgacttattagggaataaaaattaatttataggtaaaatcattatatatttattcgtaactacttaaaagacaatgataaaaagaaataacgttgaaaatatcttaaaattaacttcacattcaaattcaaaaattcaaattatgcctttttgttttgacttattaggccaatcaatggggctccaagatccatttaggttggaggagatgggagactacggagacaaagagaaagtagccaagtaggatcagaaaagaagcctttcgccttcccatcaacgagtattcctcagttgaggtccttgagccctgaggacgccagcttaggggcctcatgcctcctccgtccagtgtcctgctcgataacgtgcttgtccatgcgattccatgtaacatgcgctgtagccatcagctatgctatgcaacagttgcaggctctacaggttagcacctaacagggatctcctcttagatgctagcacagtttgttatgtttcaagatcaatgtaaatatttttttagaaacacgttacaatcacataagctcacaacgcgtgccctacccctataaacattttcggaagattaggtcaatatatatcttgagattaatgaagtcaccacggccgtatctaactatagtacttaatccgggtgggttggttccaccacaaggaacctaactagttgagctacactcacttcgcaagatcaatgtaaatattaccacgttaaatctagaaatcttctattatatactaaaagtccattaaacttcctacaaacgctctcaagttgccacatggcgctctaataaattagagaaaaccctagaaaatctgagaaaaaaagcaaaacatccgtacattgattttcattaaaattggtgggtccaatattataaaccgttatattagatttgtcttaaagctaaccgcaactacaactatggtcccaccagcctctcacctccccataggtacgtacatgatgtacgtatgtatcgcaacaaaaaaaaacacgccgctctccttccttttgtatctttttttcccttgtatatagtttctttggaatataaatgcatacatatatatgtcgtatttttggattggtactttgtaaagaggagaagggttaatgcaaaatataagtacactgtaaccatgtaaggtaattattatgtctatattcgcggacaactagctactaagctcataactaaaatatcacaccagcgttaaatctaggtctttacagacatatataaattttatcatcatatcgctctttccaaatatacatacctaaattagaaatgcaatattttaaaataaagtttacacccattatatatatagccatttattatctatctattatatactaaaagtccattaaatttctagcaaacattctcaagctgccacgtgggactcctataatcattcctaagacgccacatgacactctaataaattaaagaaaatcatataaattttgggccacatgggacttctataatcgctcctaaaccatatcacgtgaccctctaataaattagagaaaatcatataaattttgagaaaaaaacatatgtaacgtttattttaacttaaattggtaggtccaatattataaactcttagattaaattaatcttacaacaacctagacattagaaattagaagtacatatggtcacacctgtacgtacgttacgtgcatatactctctcccacccactagcccacattgcaagtacatatatacatagtacgtatatgtttcttccttcctctaatcatccctccctcctacttatataatcctattctatagctaataaaatttgaagggtagaatccaatacgcttccggtccgtcacagtatatcaattcattcattttcacttaaatgggtggttccaatattttataccattagattagatctattattaaaaaaaagtaacaccttcctcatatatccatatacatgaggacaaatatattattgtggacctgggcaaaaaaatacttcttacgtacgtatgattgaagaaagaaataaagtaattattacttactactgttcgccacaagaaaaataaaccataagcacatatatacttataataaatcatgataaaggaaaaaacatatgtacgtactacgtgtacagttaggaaaaaaggtcgacgtgttctaaaataatatttctacaatttaaagataaacaacttacacagctgaacttgatctatatataattcaaatataatatatccaatcaatgttctttaaatgttctatattttaaattattttaaaattacatatctactttattatttatatttatgtaattaaataaactactaatatctatggtcctaaatacatcgcaatacatggagccgactgttataataatttttaaataattttacatcatattttagtttagggtgtcagataccactagaggaatatataacactaatttaaatctgcatatgtgaaaataaaaataaaaataacataatttagttgtttttaagtagatatgatttaattttaatttgacaaaaaattggaattttttaagactatttgattggtatttgagaagtgagagaataaatacaacataggtgtgaaaataattatcaaaaatatttccagcctatgatcttgctatatataatacaactccttaatccatcttgatatttatggtcattatgtatgttttttctttgctatatagttttgataacaaataaataatcaagtaacatgtgcgtaacaaacttgacgttacactatagatatttgtcaaaatataaacaataatatagtgcttaggagattatcttggtagtattctttaaaaaaatgactttgtcccggttacatataaattcctcttttgttttgggataaaatttgactcatcgaaattatgtgacgaagggagtataagcaatataagtctatctttaattagataaagtagtctattagctacgttttaacgaaaaataatttcattaatatataataaatccataaagtcatctatagcacacaataaaaaatgttagtaaaattttggaaactgaaatgctaaattctaaaaacgaatcacatatagtacaaatatatatgaaccaactccatcattgtgacacaattttttcttggttgtacagtttcaaataattttagtatagagtttatacgttgcaaggataatcagaagaaaaacataaccaatgtccaaacctattattaaccaaaatatgtttaaaatggactcaaaaaaatatttcaacaatatcatcctaacatttgtaataaaaactaaagcaacattaaataaggtgtctgcgcgtatgcgcgggctactttcctagttttctataaaacctatatataaaaatgtaatccatgtctttgagcaacggtgctgaaaaaaatgtgaaaatgtggtgacaccggtataagataatagcagcgcattgccatagtgagttttgttcggtctctaaaaaattcagctttgaacgtttgagatagctgaaattgatggattaatagatagtctgacttttctgataactatttaagggtatccacgaattaattctctctttcaaagttgttgcataaaaacatttcaaggaaaaaattatatagtttttttacacaaaacgtatgatttagtagattggaaagcatacagatgaaaaatccaaaattcataatcagaaaaagaagtacgtgaaaaaacaaactagcaatgggccaccaaggcccatctcaacattgccaatttctatatgggccgcaagtaaaaccaccgggatatacgaccgccgccgccgccgccgtgctctcgctcgcagggcgcatcggcgagccgccatggcggagcggaaggaaggggaagggaaggtggtggtggtggaggaggaggaggaggagcggcggctgcggggggcgctgcggagcctgcagcaggaggccggggtgctggagcggctggtgtacaagcaccggaaccagcaccgcggcgccgcctacttccagtacctcctcaaggtgaggcgcgacgtgaggctgctcctcgccgccggcctcggggacgtcctcaccgccgtcttccccgtcctcgcctcccgcaagccggccaacaccatcctcgccgtcaacaggtcaagcttcattcctatgcccccccttggaacttgaatcaacgctgataaaattttgtcgtagcgaggcgtagaattagacgaagccgctctaggattatggcttgattgtgttttttttctttaggcagagtaagaagaagcctggtgcaaaccattgtcaccatgagaggcttttgggtgtcgcacgcttgttatcagaggtgagtgttatactgttattcttttttaccccattgggattcaacacttagcttaagtgtttagagaagttggaagttggaaacactaatggtagtttggacttaataatgtgatgtcaactgacatttttttttcttttctgctactatccagctaattatgacatagatgcaaattattgtgattatctgtaacttatttaggatggcactcttcaccggcccaatgaaaattattgtgattgtccttgcatatttcaaagtcctaaaggaaattttaggtcatatgcaaatccatttatttcctctatggtatatgcggaaaattaagtgacaagctttgtatgctatattcaccattcttgatatgcttctggacagctctagctgatgatagctttacccaaagagaaacttatattttctctgttatgtgcagatggctgaacctgttatgatgggagcagtgtatcctttgcctttttttttgtttctttgttccttgtattctcttgtgcatagaaatattttttttgactggatgcataatatattaaactgtacacttacaactggtttgtcttgtgcaacgcgtgcctcatatttgtactagtatctttgcccattcttttactttcatatagttcaaatagatatgttcatttccctgttttggtaacaatcgatagttccttaacctgcggtatagtcagatctcgtttttacttgcaagatcattttttgttgatctttgcacagcgattcttgctttgctagcaagagtgagggctctggttcaacaggtgagagcagctgcagaattacctacagccaagactgtgttgctatagttatagtaggaaatatatatagtggaagcatatgttggctagtaaggttctttccctcttttcactgaccctatattgtgtgcagatgctacttgatgttgtctcagtttacaacaaggcttctgatcttattgataggaagcaatctgttaagattagtattggtggagcgcaggtgagtttgcttccagagtagcactctgcatgcataactgtcaaatgtcaagcatgatgaaactatactacgtcaaatcatgtttggattggcagaaaactatatttattcaccacataaatcattcatgtcacctttttttttaaaaaaaaaaatccctacaggctttcagagagtactatccctcaagcaatgatgcccgtacttttctggaatgtgtttgggtgaaagataaatttgttttgcatgaaaatacaaaaggtaactgtgagaaaacccaagctgaggatcaaaagtcatgtgcttccgaatcagcagtcctgtatgaaactcttggacaagtttctgaaggttgggatgcaatattttctgttcttcatgatatatttattaatactttggtttcttggtcgcattcttggaatatttacaaatgtccatggcatgttgttttgcatggtatcatgatgtatattagtatggcatttaacttctgattgttgtatcgttaccaccagataatttgattgtgataggtgatatggtgctggctagtatgttttgcaaatttcttcaattgcaatgattacttcatggaataaaatgaaaatgttttcattaccaatagttatgtactccctccatccacaaaagttacacatattacttttgacaccaagaccaaggggaaattaaatcaccttggatgttacaaaatcaagtagtgttgcaaacatgcaacaaatgagtatttagatgactccttaagttctaataaaacatttaatttatctcttcatttaagtcttgaatacataaagactacaaataggaacaacttatttggaaaaactcaaatgtgaaataggtgtaacttttgtggatggagggagtatttaatatgagagggcactacttttatttatggtttgatagcgtcaaactttaaaaggaagtttcagataattctagtgcttctgacatttttttcagatatggaaaatgctgaaggattgaactctcccatgaagctaccagatgccaccttagcaaaccagccagagaaaacccattgccatcgtgatgaagattctcaaagtaggaggcaattggtgaatgacaacaattctaattctctttcagatgcagttgctactcatgtgcattcaactccatgccctgatgtcaagcctgagacaaagaagagagttgcattcattgcagttggaaatccgaaagccactgctagttcgattggaacaactttaactaagaagcagagactagatgtgattccacgcgccactgcagaacctgaagatctatatgtcaagcctgagacaaagaagagagttgcattcatcgcagtaggaaatccgaaagccactgctagttcgagtggaacaactttaactaagaagcagagactagaggtgattccacgcgccactgcagaacctgaagatctatatggcaaattttctgaggatacagacaagtccatattttagattgttttgcactgcagctgaccagtgatcactgaaatacttctcagctttctaacatgaaaagaacaatcaatacaaaagagggctcggtgtagctcaagatatggttaaattttgaagcaacttttgctgtagcatctaggaggttgcttggtttatctcgctaaatcattagtatagccttcattgtattctgggatgcaatattattttgtcatccatttttcaggtgtaattttgcacaaagatgaattttagttcgtcccatctgatgttcaatgtaatatgcattcattctttgatttgacgctgactgcattacgtttgtggagtggccttaagaactcgaaaattcaggagtctggaacgaagtgtatcttgaacttgggttctaaagcatcagattatgcattactgtcgaaaaatcatatgcagacaaaacatggtaataattcctctgaaaaatcctccgtaagtgttaatgctgatctgaagttatacaagaacaccagaattgcatctaataccaagtgatgtacgtcacaagatcagaagcagaaaaaactaacagtaacagattctcctgctgctatctcatcagggcaaactagggagagcagctttgttggaggagaggaagctgacccgtccgttgtcaacatggcaaaatttcagaggaatgccctcaaacttgttttcaacggtttctagttcttcccttgatggtggtttgttgctgcaccaaattgaaaagcaatacatcaaaggtaggaacaacaatcgaagtacacgcaaataacccaaaagtcatgaaccatacgtcgttctcaattttattgcatgtaatgtgacctcttgcgcatttctttacctaccttatgacttgtatggtattttcgttacttctcagtattctttaggggaagttggtgaacaaaaagagtaagtcaaaatagatggagtcaatgataaaatataaaagaaatcatatgattgggtatgcaatttgatgagatggcaaccaactggaacttcggtgctaagcttgaatcgcattcatataattaacatagaagccactttgagtggatataccaggatgacaaacagatctatgactacgtagtacatgaatagcacgtcatagatacatcacgcatgacaaaatacaaaagcttcataccatatatgttactaaatttatatcaagaaaccacaaaaaatgatcatttatgaattgacaatggacggtcaatgcagtaattcaaatatagcactagtgaagatgaactttgtgatcaaaataaaacacaaaccatgatgagatgaaactagagcacgtttctaggtctggatggatgacattcaagtgaccggaaaaggcaacagtaccttaataggcataggacgaaactagggtctcctggggatgtcttcttaaatttgctattcggtagatacacttcaaaggatggatgcatatcatctatgcacatttccttgagcaatttagttatgtcattggaggcaccaccgactctatttaagctctgaatctgatcagtttcaaccacacttgtggaggcatcagtgacgctgtaagtatggctacgcttaactgtccagggaacgccatatcgtccaataatatagccgagcaacttcaagtgcttgtaagcttggaaggcatcccaggagcacccatatttccctccagcaatctttccgtagatttcctccattccaattgtttcaccctcgtaatcaagaagaaccaatgcccctctttctgccaagaacctgcacggtttggtcagctgacaagcctcaaattgagaacgaagcgaaaatccaaggcgtgagaatcatctataatctaaaagcagtgcagcagcgctagtgtagcattgtaaacagagtgcaaactttgggaatgtgaccgaagcaagtgcaatcaagtgtacaaggaatccgagtagcgcaggcatttcatcgaacaggtggcgtacccaatctcctcgacattgtagtacagcttgccgtcccggttgacaccggtggtcagccagagcttgcccttgctgtccacaacctccgccgcaccagcctcctccagccacaccgcgcgcgacgccaccttcctgctcccccgctacacaacccgatgagctaacacgaagcaaaggaaaaaaaaaaaaagacagcacctgaactggactctcgacgaagacgacgacggggcggcgtccaagaacggattgagatggtgctcctcgccatcatcctccgcggcaacggcgacggcggcgatcgccggagctcgcccgctcctccgccgccggtggtcgacggcgcgcgtgggcttcggcatggccacttccgtaatttttcccaccaaatttacccttttacctttttaccccccaaccactgccactaaaccaacgggcccacgcgccgggccggcccaccagccggcttctcagccacatgggccacggcaggtggggcccacccgcaagaggtcgaagcccactccgcctcgtcctctaccccctcctcgtctcccttttaaacaggaggagaagaatgggaaacgacctctcctcttcttctctcttcactcgtgttgaaattgaaataaatcgcggtcaagataaaaaaaaaagaaaaaaaaagaagaaaaaaatcgcggtctcctcctcatcgagccgcgcggctggatcgaggattcgagcaggtgcggaatctccaatccctcccgcttctgttcgtttcgatttcgcgtgggtgggattggctcgggtttgggaggcgttagcgatttcgcgtgcggatcgacggggagtttaggtttgatggttccgattcgtgggggggggggggggggtgttaggtttggatttgatcggggaattttggtttgggtggattgattcggtggagatctcttcttcttcttgggggaggttaggatttgggagcccgtgaactacgtgttctagtttacttcttcagtttctggattgttcgtgtggattaaccggggttgatggctacttgtacgattggtggtagggggttggtgggttggtaggttttttggtgataaggctattggatttggcaagtcgagaggttaatttcccaattctgttaaactgttcgcgattttcatttcctagtaagtgtgtatgttgtttcaagattcgtaaatttgtgttctgaattttagaagtatgaaatcctaataaattcaacagttagtttgaattgaaagacgcgaatattagggaaggacctaatatcaaataattagatatttagatggggcgaggcttcgaacacaggtcatttagcccaccaccttgtggagctagccggaagacccctaggtgtttctcaacagttagtttgaattgaatcatataagttcgtaaccccttgaatttcaggttgatttcagagttgagtgccactgattcagctccaaagttagcatgagtactgtcagcggcactcggcgtgccccaaggaggcaatcacaagatggtcctggtgataaagtcgttgtgaacctggacgcgatctcctccccagtggttggaagccgtcgcgcggtgccgacctccactggtgcgcgcgcctcccccattgatgtggaagctctggatgatgaagtgcagacattgtccgcttcgcaagtgcctcctccggtatgtcactttttgttatcttgaactgaaagtattagttcagtcttgattatattctgtactattatctgtagttattgttatatgattgggttcataatgatgtttaagtcttttaccagggtttatgtactactccctatgtttctcaggcacactagatgttcctgttaagaacgaactggtgactttgtctccatgaaaaaaatgatgcatcccttgcccacatttgttgaactgtcttgcattttgcagagaaggaaccggagaactaggaggcagcctgtggcagtagttgatctggaagtagatgctagccgggaaggttagttcatttatacaaagattgcattaatctgtcctaattcataaattagtaatcacgggaaacatgggaatatgctatctattcctatgtttgccattcatcaatctgtcctaagtcataacttaataatctgtcctatgtcacaacaataatcatgtattaagtcaagtgtgttttgtgatgataatacacagggaacaaacgtcaaagggttgcacctgttatacactgcctctctccagaaaggggagaagggtccagcttgaaggtatcctataatactatacaattgatccccacttagtttattttcatactccctccgggctggttttatttgtcgttggagctaagttagctgtggatgagaaaatttgttgttcgagtgtttttctcacgtatgggacgagattgcccttgtgcattgatgttgttattcttcccagatcaactcctccttaactccttgaatgcttcgttcccatatcacttaatgatggcatgcatgcatgcagcaaatgtggtataaatacatgcgtaatgtgtggcaaattagcgcggcaaaaagcgtgcgtaagcaaaaacgagattttctagcggcaaaacgcgcgcataagcacaaagtataattggttggtttaattttcgtatgaccttgcacgctggctgcaccgaagctgcatgcatggtgccatgcataatcgccaagacaaaaaaaatgcgcatatccgagaatcgaactcaggtccccacgcaccaagacagatgcactaagccaactgagagtaattagttgcttgtttggatgatacacccagccgtatttaataaggacaaaacaggaaataggaactttacttagtgacttcttggtttttgagattgtgtccgaaacgacaaataaaaccagcccagagggagtaatttccaagtcttcaacttttcagctttaagggcctggttggttattgattacttgtcgtcgctctttattttcttctatgtaaaaagtagctggtactgctgtgcgctcaatattgactcttttggcctccctatagagtttacaagttggcctttcagtggagtgagttatttgttttaagttgaaacttgtaggcatttttcttggtccattatgtcatagaatactcatgcttgtagtattatgtatttatgatgatctggtagagagctattaaaattgttcttgacagccactggtagttaagattcttgcttgtcacaaacaattaggattttgctaaatttcaagcattgtcttatgcattctagtgtaaaagtatctattacatgcatttgatacttgtggctgatggcttattgcgttatgcatttagcttaacactgattgcatttcctgttttggaacaatgctgtgaagactagcaatgagcctcctaaggcaaaggaaccggtttttaactgtccggtgtgttggaacaagttggaggagccctccacaacaatttgcggccatatcttctgcacgacatgcatcaagcaagccatccagattcagaagaaatgccctacttgcagaaagagtctgagggcgaacaatttccaccgtatttaccttccaaactctgatagttaaggtgagtcgtttacctatcaattgccttctcttgtatacctggcactctagtgaacttctgatttcatcaaatcgattgccttctcttgtatacctggcactctagtgaacttctgatttcatcaaatgcaggctcattggatgtaccaaaggaacttctggcagcagcagcagcatcctccaatctaatatattcagaggaacaggagttctcccataacgtgtaccattttgctgtggaattgtgtcacggcaaaatgaccacctagacccgcatgttcatccaaggctactgttgtttgtatgtagatgcatcaccaggagctcatcagctgcaggtgacaactctggtttaggctaccgaatggcctctctgcctccaaaggatacacaacaaaactaactatagtccccattggttagatttatctagtttgtgtactgttgtatttaccatgcgtttggccatgtaccttaccttctctccatagttgttgacgtagccttgaatcagcttgaaatcgtgatgatgttaacgcattacatgtttactcttgcttgtactcgtttgctgttctgtcttctgtgtcttcaagtttgccttctgtggcagagttgcagccaccaagtcggcacaagtgcagctacatttgtgttagaagtgatgttttttttttcagatgaaatggcccgtgatgaacgaactcggaataacaggagggttgaaggatgcaatcatgcaggtcgaacgaatttgacaggcacttcaacgagcaaacgagcagagacaccgcaagaatttttcaggatttcatttgctatagaaactaaatagtaccaaagccatgtttttttttacacatcaaaaacacatacagatacagaccattcccaacccgttgggatcttcattgtaaatgatttgcctcgcaagctgctgcaacaggaacagctgtatatagttcggaattctgaattaaatcgttcgttaggggcaattctgaattctgatactatatatatatatggctttgaaatataaagttctccaaggaaggtgacacatatttcctgttgtacgagcataaggtgatttgacgctcagactgataacaactgaactagggctcagtctgctttaggcctttgaaggcagtttgttcatcacaggggctattttgtcctctgggagccctctttgaggatcaatcttgtaggtgtcatagaagtccaaaatttccatcgagatattcttgacctgagaattgatgaaaatacaatcaatcattaatggatgaaaatagcaagagaatcaaacgatgggagccagggcaagatcaagtgatcaacaggcacacttacaatgttcatgtcaacacggagctcttcaaaccacagagttatgtccttgtctttaagaacgcttgcaatgtagatgcaggctaatgctatcatatatggtgggtgtatgagaataagatccatcttgtaagtatcattgacaattcccctgcaagtaacagcagatgataagcataggaaaaggtatagttgaaaattttgcgtgcattatgttcactaatcataataaagacaattcaattcatttgtttatttctcatgtgattccagataaaagctactagatcttattgtactctatcacactgaaatgattaaaagtggtaagagtccttcaaaggatattcaatatgacaataataaatggaaatactctcttcaaatctaaaaataaatgtcaacaaattatccatgtggtaattaaaaagggttagacttggaccaccaaatgccagaaagcatctaaaacagcttttctgcataaaacaaaactcaaaacagacttcacagatacaaaaatgcaaattgttataagaagagtaccaggcaaattgtgtcagatctgttatgccagcatcctgcaataacctaaaatcaaagcatctgttaataccattgcagctctgatgttcatttaaagtatatataagggcttcggtaattccggtgaaagataatgttgtttcatcgcatgatagtggaaaaagaatcttactgtaaaagaggacgatatgggtggtaaacaactaaataatagtcaagtgcctccaggagcttcatttccatttcaaggatatccttgatttcaaaccggtacttctcatcagaagctacattttgcggggggagagcacatgtttagttttaggttagtgcagttcttcccgataaatatgtgtccatttatgattatgagccttaccacacatcttttttatgtaaaagacaagaagtcttgcttgcactgtgctctcttccacctttgatgccaaatacaaacaggttggtgctaccagacgaggatcatattcagtcatgctctttctgtaaacatatccagcatcagaacaaaattctaatagcttgatgttccactgcaacaaagaattaaatgttctggaatgaaatattagaaagcactgtgcactgtgccactgtgtactctagttcttatcgaagaaagtagagaatcacatcaacatagtagagaatcacatcaacattttgcaagccccccacataccataattcttagggcattaattagctagagaaaggaaaatgatagccttattaggaagttagaaagtatattgtttatagattataaggtagtcaccttaatgggaaagtaaggccatctacagtgtgaattcgcaccaaacaagctataaagcagtctcgcagcttagcattgttagctctagtgtgttactcatctcctaattaacatttggaacccataatcaagtcactctcctctccacctctctcttgtatatcagggaatatatttattgtgcaccaaattgagaagttctattttacttacatgagagatggctttactttcccattaaggtggcaaccctataatcttaaaaatacgctttctaatttcctaataaggttatcattttcccttctctagctagttaaattgacagtcaaattcatatggatatcttaggcactctttctcctcgatgaatagaaggcaactgcctttcccatgtatccttaaagagaatcataccttgtgtatacacgcctgaaataagtaacagcagtagctatcaccctgaaaatacaaatgacataagatcagtatcttcaaaaacttgaggtcggtatctcaaggtaataatggataagtctggtggaaaatggacaaaattagtagatatagagtaaacattatgagttacagttaaccttgtgagaacgttgaaatgcccttatggttgacagatactacagtaaagggaaaaatataaaagtataactaacatgttcgtttttctcttaaagaaattatatctcagtctttaaggccaagcagacagcagaaatgttacagcaaaaatgaatcttgacgagggaaacattaaaacaaaaccaaagtatttatgtctctaaagtaatgagccagcaatttatacactataacatatatttccacaggcttgaaagtaatccttcagaaaagtaactgccaaatttgttgcaagtagaaaggaagcagaatccccttcttaaaataattaccctaaaaaagtcacccttggtaacatttttagaaatagtctacagcgcatagagtgtacaaggaaagcctgctaactaagtcccaatgcaaaatgacaactttggttgttcgataagggcatcctataacaaatggtacaggccagaaagtggagagaaggtttaacctttgtctaactttcacctgttgtgccaatcgccagatatctgaaatcatcaaatgatttgccttaatttgtaggactaacacaaaagtacaaaacatgaacatcgagcaatcttaagtgagacgctacagcttctataaatggaacgaaatactatgcgctcctatccattttcatacctacggtagttatgctacacctttgtcgatttatggaaacaatgctagcatagcttgcagtgaccccactataaccgaataagaatacaaatctgtatgttcgagaattttccatacgaagatgcataacattgcgcaagggcatgactacacatcctatgacaacttgattcattgcaattacagcaaaaatctgtgcatattaatggctaaaagttccctttcttaaccaccgaatgaccaaacaacacatgccgtgagctgaaaatgctttgcatacaacaattatacactacaagcatactacacaaatttctaattgccttgtaactatagccaattcctttgatcaacacaacccaattaaaacgtactagtatgcatgtgacacaaagttgtatatactgactaccgaattcatctagaacgagcccactaacgctcgcatactagttcctaaaatcattctcaaatccgtttatgctaagtagcagtatctccccaattccagaaaccaggcaatcacaccgagcccggagctgagaacaaattcgcgtcaacgaaagcatcacaggaaagctaaagggaggagaagctcacggaaggacatgtggatcttgacgaggcggaactcctccagcgtgatgccccggtcgctgtccgcctgggggaccttgtccacgtcctcctggtccagcagctgcttgctgccctcgctcgccgcgggatcacacacgaacgaacaccccccaaatcagcagcagctcagctcacggattcgcagcccaagaaaccgaatcgagagggggggaaacgtgggggaggttggacgcttaccagtgcgacgacgtccagaagttggcggccatcgtgggcagggcggaggcgactccggcgagcctctccggccgaatcggcggcgctcaccgggaagagctcggagttcgccggaggggaggggggaaggggaggggacccaccggcgtcggggatggattaggaggtggttttatcaggctcgagttttgggccgtttgggctttgggctcttcgaggcttactcggcccagaccaaatgatgggccgattcactatttcgctagtattttgcctcctaaagttcaaaattacaggagcctctctggggaatgttaagattgtaagaaataattggttggtaaccagtttttgataatgaaaaaaaaataggtttttcaacttctaattttcagttcatttttttagtctacaactatagattcttagaatctggacgaaaagctctgggagaagcgggaggtgatagaaactcttcaaatagggccttgaactgtttggtgtttggtatgttacccaaatcaatcatgataaatcaaattatgtaattcctctattttgttgttgcgtcagcaaaaatgtaattctgaattgtgacaaaaaaggaacttgtatggtagaggtatgtgaatgcggatgtgatagtatttttggtttgatgccttccaagatgtggtacctcgtattacatttttggtatagtggggtacttagggtttgtttggattgctaccttccagaaatttgctatggttggtttgggcaaacataccaaacactttgttttcacaagcaaattggagctcttttttaaggagggaaatataattaaaaaccaaccatgaattatattagctttttttctaaaaggtgaaaaagtataacaaccatgaattcaaaagtgctacatcatcaacattgatttaaataaacaaagggtaggagtaacctttcatacctgtcttgtaacatgaggattgctgtggataaaatgcctatttaccccccaaaagtgctcattcccttatttatccctcgttctctcaataacactcgagcccatattccacatgtcaaaactaagacatctatacattctatatagttataacccactaagtttaaaactcaacatacaaatatactagctcatcattcactaacaataattacatataaaaactcatacaagtattcaacattatttacaattcattgaattctacaaatcaacatgcaaagcatatgtgattatcacaccttacatcatttccataatattttaacatatctattcatcattatattacttaatatatatttatccggataacatttattgattgctcccagcgaaaaacatttagtccttatttggttaatccttacgagggaggaattggaggggatttattgtggtgtggaattattccccctcaatcccctctaaaccgaacatggccttaatcattgccaaccggggctccccttttcccattaaattggaagtcatcgggaaatacatttcaccgagggccctggcaaatgacactgtagctagctctggtaggccttctttggctggtatgacaagtgccctcacatgtaggtcgttgtgcagtgtcatatattgtacagtactacatatgagtacttgacaggaggaaaaaaaaaagaaatctctttaaggtggtcgctcagtcgtctactcaccatgtaagaacaaacagttgctgctcccaaacattcacatgctgtcctctcccaagtctgaacatgcatattcagaccaaaaaaaaacatcagtataactaacagtccaatatgtactcgtgctatgtcatttgctctctcctgtatcgtaggatcagccgcagctaaaatctataattttaaaacttaattttagagttgattttaaatttttttcgtaatttatttattaacactagttttgaagtaactataaacacatcttacaagttatattttttaaattgctaataattaactgtggacgaaacgcgatggaatcatactgttcatcttcgaagaacagatgtcggtttgcacgtccttcttggcgcaattcaatacgattcaggcttgatgtcgacgacgacctgtcatggaatgataccagaattaatggatggggaacacccagcatgttgacgtctcagcaaccaatccaagtgaattatgatctaactagctactgaaaattcctttatccagtgctaaccaatcagctctaacgatgaaactgtcagggaaaaggttggagtgaatatccatgaaaacgaccgggttttctgaagaacattcagggagacgaaatgcttggatggatacatacatacatacatacatacatacatatatatgtatgtgtgtgtatatatgtatatatatatatatatatatatatacatatatatatatatatatatatacatatatatatatatatatatatatatatatatatatatgatggatggttagtttctgcattgggtctcattcatgagatgggctgtctagcttatccttcagtttcagattcttgctaagttctagttccttctgtttggctgaaaatttgtagagtgctgtttatctatctcccactgtctgaaactctgaattacagttcactagtatgagtatgtttgtttcagtctttcagaatcatgtaaattatactgttttcagtaattattgcccatatgtctagcactcaactccagtgattcctcaacttttgcatctctggctggattgctgtccattgaaaacacccattgaaaacacttgttttcagaatgttccaaagtttctttaaccaaatactgccatgtgtgtatacctgtttcagaatattccaaagttttttgactaaatattgccaagtgtggcatactcatttcagaatcttccaaagtttttttgaactaaaatattgccaactttgcatctctctatggattagatttcactaaagatattttcatcatgcagccacccatatgatccttgtacttacgcaggccgtagggtcccttggcttcaaaaaagtcaaggaatccaacctcaaatcagataaactttagtgcagcgattggaacagatgccacattggatctgattggacttgtctggataggattatcaatttatcatggccaaaacatccgtcatgtcatgtgcatacgcctgttcgtccattgccagctaaatattcagaacctaacactgaactttttccacactgatcagaaattaagaatgccaaacacaactagctcctgatcaatcaagcgacattacaatctgcaactgcaagtgagtagatgcatgtgtactgtagtataatcgcattcaaaacgaggagtactacattgcaatgaagaatttgtttcgccaagattgatcaacctgacatggcagctccttcgcaattgcagcattgcctgcccttctcctgaaagtgccataagtcttcctgtacctgaagaacataaattcttgcaacaccgaacagatcaccaataaatcatggtacttttgaaggacatatgttcgtcagatctatgcatattcagacacaatacttatcagggcaaatacttatcgttggaatcagctagcaattaactccatgaagtttcagctatacatatacatattcgatgcaagaattaatcaatacggttatacggagatcgacagacataattgcatctagcttgacgccttaatctgtctgacctacactcgtgtctctcgtagtactactactaaatatcaggattatatatgtcaatggcatcatttccattctctgcattcaatccaagaacctttcaggctttcagtgacaaccaaacggtccccctttgcaagcctgcaactgccatggattggagagcatgcttcgtcataaagtggcatgctctccatcgaaaatgacatgcgtgtgcttgatgcttcgatcgatcttgatttggtggtctcatgacaaattacgaattggggttgcacaaacatgtcgacattttctttcaggattttgccggtgccaacatgatcaatggacttattaatagcagcagcattagcagcatgttcaaccacatgtatcatgtacaagtacaactgcaactcacttaatctggaacatgcgtaattaaagaagggacatggattacagactcgtgtgtatagctgaaatagtgaaattaaactgtactctaccctgttaatcatttacgtttcagttttttgctacctaatactcgtcaaaaatatttgacgagatttcgttaaaaatttaaagttccgaccatcaataatttctttaaatttgctgcctgttactatagaaaatatttagggcgagattcagttaaaattttagaattccaaccatgaataatttatcaaatgcttagtttttttaagaaataataaacatggatttgtctcaaaagtagtatcataaccatgatatcgtaaacttattggatatcataaacttattctaataaaaagttggtttttagaatttaaaagtttgatagaattttatcctaaacattaaatatttataaccgcgcgtgggactaccaaattacgtgaaacatagtactaggtcagttcaacccaaacaaataacatggaatgtaaaaaaaaacacaaatattagataataaatagaagtgtgagccttcgaatctaggccggctagtctaccaccctatggagttagccgaaaaacgctgggcgtttctcaacagtgaaatatataacaatcaaattaaagaatcatgcatcatatccaattatatggtcgagcttaaccaaatgattagaggggagaagggagcacagacgttgctctcagctcgctctgtcactacccagtgagccactctgtcatgcacgttgcctcgattgctcagtaacgcactccctccgtcccacgatataagggattttgagtttttgataacaacgtttgactactcatcttaatcaattttttttaaaatataaaaaacaaaaagttgtgcttaagatactgtagataataaagtaagtcacaaataaaataaataatagttttaaatttttttgaataagacaagtggtcaaccgttgcaagtaaaaactcaaaatcccttatattatgggacggagggagtagttactagagtaatacccatgcttttctaaagataaaacaaaatatattatgatattatctaaaataattcttttataaatatattatctgtcttttttctaaggggaatattcatcttaacttagttttatatgtgtttatcatttagatttggatagtttgtaaaatttatatgtgtttatcacttagatttggatagtttgtaaaatttataatagaaagatgaagtggtagattactatcaagtaccgacatataattaagctggattgaccaagcatgcaatgatataagttactaagaacatccatgtgaaataaatatatattccttccgttttttaatagataacattatttactttcaaacacatatttaaccattcattttattaaaataatattatgcatatgtataagatataaatcatacttaaaatatttgaagtgataaaacaactcacaacaaaataaattataattatgtatttttttaataatacgaacgatcaaatgtgcgataaaaagttaactacgttatctataaaaaaaatgaggtctatggcattgctctcactctcagctagccaccgacacatccagaaacgcgtgcagacgccggccatggctgatggcttaggtacaggtacatgccctaacattgtctgcatttgcatgtactcctatatgaatgcgagaacgacgacgaccgtacgacagtaccggcttttgtatcttacgatgggagctgggcactgtgctgctgtctaacgctgataataataatactagtaatcaattaagtcatacccttgctgctggacctgtctgtcatgtggaagatacgactgcacccccccatggtctgctactcatatgctagctgactgatcagtgatccagttgtagtttttcgtttcctttcagctatctttatgataataagctgtaggtgtagggaccaaagaggatttttttttatttatttttgaacttttctatttttaatcttaaaaataaacactttcaaaacttatttacttataagatctgaatcttttggttatgtcatgattggcatggcaaaataacattgtcacgccgatctggctggcgtggcagcgttatttggccacaccatcctcactggcatggcgggataaaactgttatgctcgctgtgtgtgacgtgtcagtattgtttcgaaaataagttttgaaagattggcatggccaaaggttcaaattctgaaaacaagttttgaaatggtctacttttaaaataaaatataaaaaaataaaaaaataaaaaaatcaccaatgcgtggttctttaaccttttgagatcaatcttgcaaactcgtgcttgttttgcaccctatattcatcggatttttctcgcctattagagcaagtttaatagtactctttccgggttgataatacttgtcgttttggataagggtgaggtcaaactttagaatctttgattatcaatcatttttaaaatatttctctttcaaatatggtgactatatgtatagattggtcttaaaaaatactttaataagatcatatatttgtttaacacttttatatatattatagtagaaaataatggttaaagttgttttttggagaccgtgcctttgtccaaaacgacaagtattatcaacccggagggagtataaccaactactagctctaattcatctatagtcaatctaatagttcattcatacaatagttacctatagacatatactaatccattaatatatggtctcacctctcatacacatacaacgtattggagtccgtgccgcagctagctataaatctgtagtctgctttccttctctctcttcttttctcttctctacatgtgtttgtagctgacttatagcctgccattgtactcgctcttactcgctccacgcttgtaagattatacgatttctcaaaaagctttcatctaatgcattggttaaaccattatttcagatgttaacgaacttgccgtacacattttgcttggactttttttctttaatttcgggttgagatggctcagttgttttcagttttcagttggcagatcattaagtcgattcggatcggagtttccgacaggtacattggttaattaattaagacacaactgagaatacaaagataatgcacccggtttttttcaagctacactatcgaattatttccgcgggttttttttatttactatacgtcttgaaaaatatgtttcctcaaaaggatttctcaactttttttaaaaaaaaaccattcctccaaattgtcgacgggggatacccatagactggatatagagggtattggggtacgctagtacgaggatctacgtagtacaacatcaagcaaacaagagacagagattatactggttcagaccccttagtaggtaatagccctaattcagttgatatgggattatacgatgggaatcacagattacaaagggaatagtggaacttgataccaacgagattgtagtcgagttggttcgactagatcacccggtgacttggctcatgtaggctccggcttcgtaggctgtggtggatgtgttggcggtaagattccatgccttaggtcctcccaggggtcccttttataccgcaggtcaattggtctccaagtagaacttggagatgtcggaccccatacgatacagtaacgatccagttctgtccgagtagtactccttccatctgtggactccgtgatgaatttccttaacgtgtacatggaacatccgtatacgtgcaggtataccatatcagtacacgacgtatatccaagggtagagggtataccttatccgtaactctgacacaaatctttgttaaatttattttatgaagtttataaaatatttaattcatcacgataatcaagtagataaataatctaaggtaataatgcgcaataacctgttttcagacagcctcgctggtgacggttgagcgctagcaaacagctcgcgcatgctgcccatgcagagagtcaatggatcaatccatgtatgcgctcgccggcggccgctgctcctcactgtgcgccataaattccaccttcggattggatctgaatatctatcatctatttttagttcgatccgtttaatttaatttgcccccaattttcactggttgatctgacctctccatcgactgattgatcgatcgatcgagccctactagctgtacatgaacaatgaacaattacatcgtgatctcttaattgaatgcatcttaattctgcatgaattcatgcatgctcttctcgatcgatcgtgttcttgaagcgatcgaggacggacgacactgtgtacttggacgtgaccgatatgcatgagagctttgtaatggtagcgttccaacgctaattaaatacaagcaaattaatcaaggtcatgtcctaatttatgcatgactaaattatgtatgagacagtattgcagcttgcaggtatgccatgatgatgttaacagtcctgcttctggtatccttgacaatgaacgatcgatcgatcgatcgatcaaattaaaggacattagctacgcacagtactgatcaccagcaaaacacatggtcagttgttaatctaatcaacctcctttaatttactccgatcgatcgatccaggtgctaaatagctgttcattaaattcgcagaggcatcagatcaccgttacattcatccattaatccagaatttcaggtactatttcactgcctgcgactgcagtatttgcttctgtgctagtaagagtacttcttttctgaagaatctgttactgctgctgtgctcatacccaactcgatcaatcacccatgggtttagtatcctctatcttcgaagctactacataattttatcactggtatatgggtccgatagaccctaggactcacatgtgagacatagttacaatcggtgttgggcctatatatggccgccgctttctcttccttcctcagggcaagcggcgtcccgcatgctcaccacacctcgaggctgattcattgctagggatgcggttatgcttgcggcatcttaacatgggcaaaggtcattacccacaagaagtggcggctcatcgtccttatagatagagttggtcctcttagtgcggcatggcctcacatgatcttttggctaaaacaactacggtggcgtcaccatgacggtgacaacaacgactgggttagaggtgaactcgagttaggatggactagttatgtccgcacgatccgaagactgccacaatcagaacggtatctttagtggcgattgatgagtgtaaccggtaacgtcagaaatgacggtcggtgcgtcgtcattggcgagctggcttcgatagccatggtagtggcaagatccgacaagtgactgttttacacttcaattactcttcagtgatatttttcgctttggcttgacatcaatcatcggcgctgatgtgcacaaaaattgatttgaataatgatcggacgctgattttgagattctatattccgttttgtaatttgatttatatcgacggtgttatctatttctttagactaatgttctagctagttttcttattagctatcaagttatgatttgtaatccgcggatgcccgatctataaattctataataattaagtttagcttctttaaatgcttcggtccaacgaaaaatatctcgaggtaccgatatctcacggtaccaaatcgttttcgatcgttagatctaacaatatctatcctgtctagttagattcaatgattgaaaatgatttgacaccatgaggtaccgatatctcgagatactttttgcagtactggagtatatctcttattaaacaaactaattgtctcaaaatcctcacgaggaagaggaatccgacgttatggcccgtgagaaagatggcatcaatgcgcaccccccgcatcgcctcatgggctcccctcccctctcgctacacccccggaagcaccgacccatcgacccccagcacgtcacatgcgctttgacaacgatctgagatcgatcgatgtgccgccgcccgccggcggccgcaaccgcttgccggcgacaaaaaaaaccggcgatccccttttgaccttgccagtctccacatgtgcaggcaagtccgtgtgtgtgtataaactagttcagcacggaacgaactcacagcacagcacaatgtgtcattctgcctgctttttttagaatgatattttttatccggtctctacatccaaccatatatatatatatacaactcttttaaattgaaaacttaatctctcaaacaacctaatctaaaaattcactcatatgaagatttgaactcagaatcataagatgctacttagtcagtgcaaaattactatattttgatcaaagttaaaacgtctttgtaatctggaacggagggagtagaatatatgtgtcattctgcctgcctagcttgctagctccactgccgtgcggtgcatgcgaggtcggaccactcccactaccgcgtttcgcccaagttgcgacgagccgaacgaccaaacacaaacgctggatgctgcgattctaccgaattttcgcctgctttctcccgtgcgatctcacccgaattcctctctctctcgtctcgtccccgtttttttttacccgtctccacgaaccaaaaagaattcgaaaccaaaaaaaaaaaaaaaccgcagcgcgcgtcctctctctttataaccttcaagtgttcgtccactccctcctcagctagcagcagctctagcttattactaccaccaccactgtactaccccgcacgacacggcgcgacacggcgcgacgcgacgcgaggaggtgagcgcggatgccggcggacgcggcggcgaaggggatgaagctggagaggtacgcgagcggcgcgggcgcgatgctgctgctgcggcgggcggcgagcgggaaggtcgtgtcggcgtcgtcgcacctgctgttccgcgccaccgtgctcgccacgatggcgctcgtgttcctcttcacgttccactacccgtcgctgctgtcgcgctccttcacgctctcctccggcgccggcgccggcgaggggggagccgcggcgcacgcctcgcaccggagcttgctcatgtcgtcgtcgtcggcgtcggcgtcggcggcgtcggtgtacgggggcgcggcgtgggagaaggaggtgaggcggagcgcgaagccgaggaaggacggggggatagccgtgctggtgaccggcgcggcggggttcgtcggcacgcactgctcgctggcgctgagggcgcgcggcgacggcgtgctggggctcgacaacttcaacgcctactacgacccggagctgaagcgcgcgcggcagaggctcctcgccggccgcggcgtgctcgtgctcgacgccgacatcaacgacgcgctcctgctcgagaagctgttcgacctggtgccgttcacccacgtgctgcacctcgccgcgcaggccggcgtgcgctacgccatggaggcgccgcagacgtacgtggcgtccaacgtggccgggctcgtgaccgtcctcgaggtcgccgccaagcacgccgacccgcagccggcgatcgtctgggcgtcgtcgtcgtcggtgtacggcctcaacaccgacgcacccttctccgaggagcaccgcaccgaccggccggcgtcgctgtacgcggcgaccaagaaggccggcgaggccatcgcgcacacgtacaaccacatctacggcctctccatcaccggcctccgcttcttcaccgtgtacgggccatggggccgccccgacatggcctacttcttcttcgccaagagcatcgtctccggcgagcccatcacgctgttccgcgccgccgacggcgccgacgcgcgccgcgatttcacctacatcgacgacgtcgtcaagggctgcctcggcgcgctcgacacctccggcaagagcaccggctcctccaagtccggcaagaagtccggcccggcgccgctccgcgtctacaacctcggcaacacctcgccggtgccggtcacccgcatggtcgccatcctcgagaagctcctcggcaagaaggccaacaagcgcatcgtcgccatgcccagcaatggcgacgtgcccttcacccacgccaacgtcacccacgccgcccacgacttcggctaccgccccaccacctccctcgacgccggcctccgccacttcgtcgactggttcgccgactactacaagctcaagctcgacgtccccaagatcgccgccaaggtcgccggcgccggcaagccctcctcctcgtcggcctccaagaagaagaagaaggccgcggcgatgtcggcgtcatcatgatcgagcagcacaacaccatgagacaccatgcaagtgtgtattccatagctagttcttggaggctcttgtctgtataacattgtaagtgcttattgtttaagcccctattaatttcttttcttcttcttcttgaggtgtttaatttttagtgattagaaacaagggaataatggtggagaaataacactgttgttggtagataaatatgagaggggtatagagatgatgataaagatcaaaaacacttggaagccaggacagaaagaaagatgaagtcactggcttccttcgaatcaaaatgtctcttttttttcttgttcttttcttttacagtgtcatcacttgttctgttcttgttccacctgatgatgtaagccatatcaacatgctgttgctgatggaatccaatccaatccaatccacatcatgaagctaagctcagctgcaagcaagaaagaacttcacttctacacttctacttttatttctgaaatctgaatcatcacaatcttttaatagataaaaccatatctttctgtctacagaaacttgtgcagattcaggccctgactctgcatttcagtgaggctcatcaaccactgacatttactacttctgcagagtgtgtatgtatgtttgtgtgatcaatcactgaatcacatggctcttgattcgtccagcaatgaggcagcaggtagtggctggttggtgaggggatcatcagcatggtccagtctctaatttgctgctcatttttagcatctttgatgggcagcatgagcacatattcagtacaggccgctgctgctgcttgccgtttcagagttcggccactgtttgcgagattttgtgcttggagacttcgacgcaagtgtactacaaggaagaaaagagagtatttttcctgccgatttgtgcggtgtttttagcgtaaattcagtagaatgtcggcacgatgtcacgaggctacagttttcagaattttcggtgcgttttcaggcacagggttcagcaaatggatattaatcaagagtgccaggctatcttcacttcactcgttcgtagtgagtgagtgatgactgaatgaatgacaattgacaaccgactttttttgtttatggtgagtaacaatcatcttgttgtgatagttgatagagacactgcatattgtctgcaactgtgctttttttttgcagttttttcccagtaattagagatatagttttactctctcctttgttctgccgcagattataacctgaaaggaattttataatttaaattcatactcaattttaggggttttcttcatgattcatcactttggttgctctataagaatccctttatggtacaccgtactacattatactattagaaaatctacctaagattatttttaaaaatcaaattctttttggattataatctgcagctgaactaaacggggtcttttgaactttggattccttttataagccctatttattcgcactggcaatctgtccatgaatggccccctttctgaaccatccatcatgcattcatgctgctaagccttagtcctaggacgattcttgtccatttcctgcctttacaccacagctgcttctttgcatggggccatcagattccagtgatgttgttccattattctactactagatttgtgctacatgatccaaaaaaagagcagagaaaacatcattgtactctgtgaaaaattgtgtatatgctgcagattccagtgatgttgcatattctactatacttgacttttgctacagaatccaaaaatgagcagagaacacatcattgtactctgcgaaaaattgtacattctgcaggcaaaaatatggccttcttgtcagcatttgcctttgtttcttctccctgattcaattggttgaacatgcagctcacagcaagaaagccaatgtgtgttcttttctaaggaaagcaagaaatacttcctctatatgagtttcttagaaaattattttaaatccatttttccgtttgtaccctcgaataatcgtcacaaaatcatttagctatttattagtgtggtgcttctgggattttgctcgcctaaccagatatctcatatgccattttctaacgctgcatcggacaatattttctgactatagttttcagtacacatcattgaaccaaaactatatggtccagtttaaatcttgggaaataaatatgtcggcatctagattgttccaagctccaaacattgcattgaacacggatagtatataggaccagagagaatccatctcataaattatgcagaaagcaacaaataatataaattaagaattagagataggcctgtacttaacaagtctgaattgatgatgaacgaggtctgtctatacaacagtctggtgatcatgttctggagcagcatgaacagaatcatttgtgagcaggaaagcaccttggatctgaggcttgtgacttgtgagatcttggaagtgttgcattgcattgtgcaatgaataataggtcaaagttttcagctagtatttcaggtcatctgtttttttttttttttttggctagagacaattgaactctgccattttacagctaaaaaataagttatagtaccaaactaattgttcagaaatctctgcactagtgcacttggtctgctatctgaagccagtgctatagtgttagtattatattagtactgcaagttggaagtctggtcccagtggctcaggtaagcttcacagtggagcaatctttgacttgcattggaatggcattagaccagaaaaaaattggacctaatccagattattggtctcccagtgcttcttcaccacttgcaaaaagtatgttactttaattaattccatcatgctgatgatctaagttgatgagcctccatttcaactcttgctgactattggtttagttgtagtaacatgcatgttcccatcattccagcttgcttcgtttactagttgatttctttgtgttcagtctttgtgcgagtctgttcaggaactggagtatctgcaaatctagcagcatgaattttcagctggattgtgatatgtgtgtgtggccatccgcctgacccactataatgaaaaattcagttatttttcagcaaatacagaaaagaaagaaaaaaaaggtccacggcgtcggtcatggccgtggtctgcatccacagtttcagagatgatagaaggcaacaaatctatttggaaatgacactctgacagtaacaaacagcgcctgcgggaagagaaaaacgccgcgggagtttttacggacaaataaagctttgatgaagtcttaaccgttgtgaattatttatggcctcgttatattccagttataccagatactccctctaacttaaacattttagaattttataaaaaaatataacaacatttatatcattaaattagtttcattacgcctagcattaaacatatattccgatagtttcttccaaaaaagtattgccaatttttctataactttgattaaaaaaaaagttgcagagaaaattgcgtcgtcgccgccacaacacctgggctccatctctctagtgggccgggctgagagcaccaggcttcaaccgggggaacaagttcacttagactcctttaagtagtggtcgaatctgattcatatctctgaaccacaataccggatatctcaaccccttaattatcaaaaccgatgcaatttgactccctcggtggttttggagggcggtttcgctgatgtggcggtgttgacttggtcttcatcctacgtggcgtttatgtggcactacaattaaaaaaatatatatggcggtgttgacttggttttggtcttatggcatagagagaagctagagagggaggaggaggaaggaaaggagagaggatgacctgtggccccctatgttagtaggtcccataatttttttttatcactaacaaatggatcccacatatatattttcttaagtctaatgccacataagcgtcacatcaccgtcacgtggaacgaagaccaggtcaacaccgtcacataggtgccaagtcagcgaaacctccctttaagaccgttgagggagtcaaattgtaccggttttaatagttgggagtcaaattgtaattcaggggtacgaattagattggaccactattaagggaacaccgtcacataggtgccaagtcagtaaaacctccctttaagaccgttgagggagtcaagttgtaccggttttaatagttgggagtcaaattgtaattcaggggtacgaattagattggaccactattaagggagtcaaagtgaacttattcctcgaccgggagaccccagcccagcccatattagccaccgggggccggggcctggaagccttagccctcgctcgccgggcgtctccgtcacgaacaagcgccgccgccgccgccgccgctcgccggtgctacggaagacgcggccgcttcttattcggaggcggcgaggagagggagaggggcttcatctgctgctgcttcggctaggagcctaggacgccatggcttcctctccgacgacaggtacgacgaactcgacgagctcccctcttcttgacttctttgcgcagcatgtctacctcagattgaaccaaaattcacaaaaactccagaaaaaaaaaatcgctagctttcggctcaactagtgagaacgaagcttacggcacaaatccattagcttccagctgcagattgtgaacttttcaaatcgcttagattgaagactatcaactcatatctttgtccttccaagaccgagtttaaagcttccagatggattaatttaacttctacattgcaattttcatgccatgcttgcattccattattattagtttatttttggggttcttatgatagtgtgatgtatttttagatggattaactgagtcagtggccaaaaggaagggctctccttgccaacaagatgatgattgccaagatgacaaacgaataagatcaggtgcagaccttctagaggtataaattactatagtgcaaagcctacatgcatgtgaattagttgtggctcgaataggaatttgtaggtaggagtaatgtggtgggcatgggaatgtgaatgttagtgtgaacccttcatttggcccgtgatatttaaagagaaaaattcattgctaaattcactctctacaagatataaagataggtatgcttatataattttaattcttttgaagataattttagatataattttaatgttaggtgtagggttgaatgcatcacattttcagtcgtgtttatatgattctgttactaatattctctgatcctagttgacgaactgcatctttggttataagttgtaggatttaatcacatctgattcaatattgcctataaagataaggacgattcagataaatatctgtatgaatttactcgtcattgataactatactcaactttgctttgacaatctccaaatcttttaaagagaagtactgaagaaaatccccagatattgttatgcacggttattcattcatctggtctactcattctatgttcttgctgcaaaacatccagatgcactatacgtatgctgtacagagtatacatgtttatttccggttctttgctattctgtcatccttagcttataatatcatattgcacagtataacaacatgattttcccgaacgcatggaaatagcatttgttgattgaacatacctatttcaatttttgctgatccttactaatcactgtctggaaaaagatttatgcaatattcatataaagatcccatgtctcagtccaccaattttttcgagggaaattctcattccacctaccacagctacataccagtgtattttcttcttctgtatgtgatgcagcacatctttgcattgctttcgtacttccagtactactgttctcacattgctttgcatgcaggacattttttggtacattcattccttaatgccacttcgagatgctgctcgtgctgcttgtgtgtctcattcatttttacgatcttggagatgctatccctaccttatgttcagtgaggagctactccgattgcaggagagtgcatttagtgatgatgagagaacgagaaatctcatcagcaaagttaaccacattttacaaaatcactcaggcattggcgtgaagaaactagagcttgttttcttggatagtactgatgtggacttaagttatattgacagttggcttcacaaggctgtcacacgagggattgaagaactcaccctgatactgcctataaacagcaatgcagaatacagcttcccatgttcgcttttatctgatggtaatggtaactcgattcagtatcttcatctctctcgctgtgccatccgccccactgctgatcttggttgcctgagaacattgacaacgttgcatctatattccgtgcgaatcactgggtttgagctagagtaccttctttccaattcacccgcattggagtggttgataatgatggattgtaaagagatagttcagttgaagataccaagttgctgaagcggctccatactctttttgtgagtagatgtcaaatgctgaaagtggtagagagctatgctccaaatatcgccacctttcacttccggggtcatgttcatgcagtgcgaatgttgggtttactgcaagtaaaagaccttgagatgtcatgttcagatcactctagcattctctgctatgctctcaccaatcttttgtctattgtcccaaatgttgaaaaacttagaatatcatcacaaacacaggtaaactctgaagcattacataattatagagtagcaattgtacataaaattgtagacatctattaaaaaattacataaaactgtagacatccattaaaataaaataatacgagacatctttatgcagattgtcagtacacaaactgtaccagggaaatatcttcgcctcaagcacttgcatatatctcttaacaggtccccaaactttgattatctttctcttgtttcttttctcgatgcctctccttcactcgagactttcatcttgcatgtaagtaactagtttcatcttgtaaagacaagtagtatatatcatccataaatataaccatcttttgaagtgttctctctgttttacaattaattttgatcctatatgtgcagatatgggacatatacataccactgggtcatatggggcatccttggactcttggagactctgaacagctgaggcagatgccaggacaccgccatgacagtctcaagaaattcgaggtcgtcggttcctgctacgcgaagggcttggtcgagctaacatgtcatatccttgagacgacatcgtcgctcgatcgtattaaactcgacacctgtggttatgttgggctttgtgcttccggcagtggcagatgttacccacattatacagaacaaatcatggaggcctgtaattcagtcttggctatcaggacatacatcatggggaaagttccacctacagtgaagtttgaacttgttgagccttgcagccgttgccctgtacagtagatgctaagttattaccggttaccatgcccatatgttttttttaaccatttttttaaaaccctacggattgccgacataacttgttgagaaaggatcattgcatcctagtcaatatctttaatatatttattcacccataaattactccagcacttgttgagcaattgttgtacaggttacatatttgttgtacagatctctagtcttaaaataagacatcactgaaaaactttacctctgagcaatggactgagcaactgttggacagctactttccaattcactcgtgttgaagtacaaaataagcagcagccttctcaatccaaaaggatataacaataacatggagttctgccgcctcagaagatgataagatagaaagcacctttctgtaaattaaataaattgtacactcaaatggaattaacttggtacagaaagaacggtggaactattcaaatactggttaatatcacaatattaatcgttttagaagaattaaatgaatatagagataacacatgtcactacagaaaaaaggcatcgttatcaaaaatagtggaacaataaagccaccatgtaagtctgaacatcagaacaggacagaatcatggaactaaaatgtccctaaagttgccgtagaacaattctagaatgttatcgtggcaaaatacagtgactatacggatcggggcagaaatttgcatcatattggggagaacatcagtataccagagaactggaaacatccagtctgtcctaatataactattagctggacattttattttattgtagcacaaaaagaactctgtactgaaacttacaatcaaacatgaagttatggtggtcacttgatgttaaattgttgatatgataatagtttttttttccttccatttcgtgagtgaaatacaagcagaaacatctaatgcaatgcaatctctgtataataacttcaaaagcttccacttacctggttttcagcaagcagatactacctccgtcctatataatataggaatataatataggaaggaggtagtatgattaaccattcatgttttgagctgggccacgatctgaagtatctgagagaagcttaaaattttcaaatttccaaactactgggaactaattcacagataatgaattaaacaagatattttcagggatcttcatgatcacaaggctgaaattagcgacttaaaaactgagtgcactgcaaataaatgacaactgatcaataaaggaagaacaatctgtacggaaccaacctgcaatcacactttcagaggtggaaactttagtgcgattttcaaatatatccagttagaactgagtagattggaaaatatccaatgtcaagttgtcgactaatattttatcagcctgtaatgaacaaaaaatcacatataaatatgttacctcatttagggaaagaacacactaccccccaaaagtcagatgcagcaactcgcaacttcttatattagacaagtacaacactaatagctagtggttttaagcatatagtacagtatattgaacaattgataactggaaaaaaaatgcatatcaactcttacacttggttccatgatgctatagagtcttcaacagagacatcagtgtgaagtgtaaacaacttgtcacctcttcagagtggaacacaatacatgatatgctacatagtaatgaaactaacattctgcataactcaaacatcacatccaacagaaagtgaactggtatagaagcatcaaattcaaacctgatgcaaataaaactcattcaatacactcaattattcttcaaaatgggtttcttataccatcactgttacagggaataaccaaactgttcttttccacaaaatactatgatactgtagaagctgcaagctaacataactttaacttgtgcatgaaaataaggaaatctcagtgaactcctcctaactattcattttgcaatttcattgtgacagttaagctcagcaccgcgcttcgaggtctagtttgctcatgaagattgctactggctcaccaggagaaggcggggtcttgtccagcatagaagcatgcacgccagctttagcacgagcagcctcatcagaagcagacaggacctctgcatgttcaaggcctacctgcctcttgatcagctccaagttctcctcgagaacactcatttcaccaaaaggaagcttcaaattcaaagcgtggggcccaacactcctcgcctcatcttttttcgacttgatgaaaggcatgcagagcttctggacttgtttgaagttagtttcctgtccgatggagcagttcttcaatgcttcattaatctcctcatcaggagcaaacaaacgtgcttggctatcaaatttagactggagaaccctcaaacattgctctttccatccataatagttctcattgacgtagaccagaccaacagtcagcttgttttgctcagatggaggaggtgcagttcccttcttgggtttcttggaaccagattcttgcttctggagcagcttcctgaatttaactatggagtcctgtaaatatttgttagcaattcttagtgtgggatctggggttccagcaattggccagcctgcctttattgcaaatccttccttcctcaggatgtttcgccacacatgctcagcatagtgtggacaaatgggggtaatgagcctagtctgcacctccatgaaccgccataataattcacgattcatgcctgctgctccacaagagagtctgtactcatctctagccaactgtaggtcatagaaccccaacttaagggcatctctgaacatgaaggcattgtagctcttctcagtttctatcaccgcaatgtttatctcgttggcaaacacatggtcagcataggtagagggaggcccagctctcagagaagattcagcggctataacctcttccatccatgcaatttcttttgtaagcctcaaaatagcagcatttgctgtttcaaagacaaagtttgcatcatccataccatcaccggcatcagcaagggcaaatctagtggcatcagaagagaattcttcaatggcctgtcgaagagttcggaaattccctgtggacttggacatcttctcagaattaagcataagatgtccattgcagcggaaaccacgaggccaatgatgctctggaagaagtgctgtatgattgtaaatgctgaaagtcagatggttttggataagatccttaccagagacacgaatatcaaatggataccagtactcaaattccagcttcattttgctcaagagggcaggagggatgtcactattgggtgctggaccatcacagaacacataatcccagacttcatctgtcatttgttctggtctgatagaagatatttccttgccatacatgttgccattttgcaaaaggtgagcgattgtgtaatatgccatgtagagggtggaatcagaaagagattctacaaggaactgctcatcccatggaatgcgagtacctaggccaaaagaacgagagcaggcccactggttcagccagcctaacgtgtgttcaaaaccattacgagtttcagctgagaatgtattcatcttctccaagcattgaactgccttctgcttccattcagtctcaccataagtaatgtaccattgatctgtgagagcaacaacacactcatcaccagatctcgacataactttcttctcaggctcgctatacaacactgctgtgccttcttccaaaagcttgttctttatcagtggcttcgcttcttgaacttttctgccattgaactcccctacaatcattgtcccatcagtaaaacctttcagatatgtcatcctttttgcttcagcaagcttctccttgtcattctgactcttaatcttaagatcgaggcacaccttctcagcagacttgtctccaaattcaggaatgttgattattggtacaaccttaaagggaagaacccattcatctttgacaccatacttctgtctcaaagctggctttgcgactaaatcctgtagtgccatgaaatcatctggagaatcacttgggacactagtcacaatgccagtacctttatctgttaagatagtaagcatgggaagtgcatatatgatctcattgaaggcaagaggggatttcagtggtaaaccaatcagatcacaaccagataactccattaagcaagttggtttttctgggacccttgatagattctgatatgcaagattaagagcagcccttgatgtaacaatgaagacatcagtgtcattgatctcaaaggccccatattttccatcaggcaatacccaacagtttgtctgcccatacattgtctcaggtctcaatgtggctgctgccaaataaacatttcttccttccatggtcttcaacttgggaggaaaaggtggaacaacttccattttaattaacacatattcttgtggctgtacaccttcaccagatgctcgatcatggtcagcacaaggttgaccatccaatggagagtagattgtgtacctcatatctttgacaaccttgcccattttcttcagctttctcatttgccaccggacaaatgcatcatagaaggggttcatgtcagtagttatgaatgacctcctccaatcacagcccagaccaaaggccttgaggtcctccttcgccaatggagggaagtaagttaaccagtggtaaggatcctgaaatttggcgatttcttcatctgataagccaaagcctctcatgatctcccactgaaacttctgcatgccaaccttcgaagcagccttagatttcttgctcttaaatttatctgggacaacagaagccgcattgtcagcctggctactatcagcaacttctgcacttgaatcatcctctacttcaggaaacgctggaggatatccatattgttgcgcctccctagagagtttatctgctgaggccttgatgggcattcccgtacagtggaaagcaaatggcaaaagaacatttgaaccacgaagcctctgatatgcagcaccaaactcaagtttagacaaggagaacgcatggcccaaatgtagcaagccattcatgtaaggatatggaaagttgccaaagaacttttccccagggcccggaggtttattcccaggttcagcctcaaaaaccttgctctcctcccaccatttttgagcatctgactggatcttgagtaaaatatctctccgagcaaaacttctgcctccatcaggatttgatgacattttcctaatcaatcaacaaaaaacaagtggttaaggctttttgtttaataaaattgaactcagtccagtacttaaacaatgtttctacacaaacaagaataactaaccaactcatcaagcacacataaaaaaataagtttttaatgaaccattgttatgcaataagatttgattgaagtcttgtgctaaacatacctacaactcatgacagggcaagtcattgatatgaagctattatgtgatctaggataacaggatcataaatttataaccaaacaaacatcttcaagaagcgaaggggggggagaaagatcagaaagaattagttaatttacacacttaatagcttgaagagaagaaaattcacactaactcaagtgttccataaacctaaagactaggtggatcatgcatcctatggatactacagcatatccacaattccacataataccaaggcagacaaatgatggaaagaagaaatccacctccaggaaataaagtgtgaaaaatacacttcctaccaacggctcaccataacaaaaggaaaattttaggggggttttttccctagaaatgctcatgtaaaactacacgaggaagtagatccccaacaatataacgcaacccagtgacataagcagagaatcaacatacactaaacttccactcttgatcagctacgacgattaactaaaaatcttatcggaaaaacgacgaaccacattgagtaatgagcactctgcccaaagccacacgaaccaatacggaaaataatcaatccaccccctatcaactaaaacggcatgataaaaactaaaatccccaacactgatgtgctaacccacccacccatccagacccctccccgacccgtctacacaaggagcagagcacaaaccgcacagcaaattgcatagcatcaacgagaaaacaaatttccgagcagcagctctgcaaagggggaggcgcgggggatgggatcgatcggccggtcggtacctgacgacggcggcggcggcggcggcggcgcgcaggcgggggagcagcagccgcagcctcagcccggagagcaagttgggagccagcagcagcaggaggaagaggagaaggcggcggcggcggattctttctgcaggggattaaagccgattagggcatatgcttgggaacgacgtgggctttgacggctttgtgaaactaatgggccgagcttcaagtgaagcctctaatgggccatgctcatagagggcctgtctgcgttcgttctcctaagttgggatagcattccctccgcacgaaaaatagagcgacctattttcttataattaattaaacatttatttttaaaaaaattattaatatgattttttaaaaaaacatctttcaatatataaacttttttttacaaaaaaactgtaccgtttagcagtttggaaagcgttgcgcggaaaacgagacggaggacttgggaacagctagaacgagcacagccttaagtatgtactccctccgtcccaaaataaatgcagttttgcactattcatgttcaacgtttgatcgttcgtcttatttaaaaattttgtatgattagtattttttattgctattagatgttaaaacataaatagtactttatgtgtgactaaatatttttaaatttttcacaaagttttcaaataagatgtacgatcaaacgttgggcacagatattatccagtcaagtccatcggaaattcgatgtcttaggtacggccaactccatttttcgtacacatgttttccaaactaacggtggtttctttaaaatagatatgaggaaagttgttttaaaaactatacagcatttaattatttttttaaaataaataaatacttaattaattatgtgctaatttattgttttgttttgtgtgccggaaagatcctattccaaagtcggatgagtaaggatcattggtctcgtaggtggtagctgatcgcgttgtaaggtgaatgactctggatcgaggctgaatctttgcatgaggagaatgattacaacagactcaatccgaactgttcatcttttttttatgacatcatgaatccatggtgctaatcctcacacttagggaggtacattgcaatttgcaatgctcattctgtgcctcccatttctacaacgatcttgcccgtggcatggccttccatgctcttagcccaagcctcctgtgctctgctcagagggtacttggaatctatggtggtcttgagcttcccttgcttggccatgtcgaccagccactccatctcctccttcttgggcatcaggatcagcggcacgagcctcttcttggagaaggtcaccctgtgcaggaacgacctgacggtggcggcgacccccggcgtgaggtcgaccacgacgccgccggcgtcggccagggcgtccctgaacaccggccacggcgccggcggcgcgcagtgcgccaccgcgtcgtacctcctgcccgacgggctccgcagcgcggcgccgtcgggggtcctgtagtcgagcgcctcgtcggcgccgaggccgtcgcggacgaaggcgaggttgcgggcgccgcaggtggccgtgacgtggaggccggcgagcttggcgagctgaacggcgtagtggcccacgccgcccgacgccgcggtgaccagcacgttcttggggccgccggcggcggcggcggcgtcggcgtccgcgtcgaacctgactccggccgccttcagctgctggagcgcggagcccgcggccgccggcaaggtggcgccatcggccgcggacacctcgggcggcctcgccaccgtgagcgacgccggcgccaccgcgtactcggcgagcccgccgcagttctgccacggcgagacagatcgtcaaggcgtgcgaatcgagacgaaatggcttacaacgctgaagaagataatatatagggtggaaactacgtattaaacttgcaaattaccgttaaatcaaaaaataggtgtatttgtccatgtcatcacgagtaaaaattttactcgcgggttcccaggttcacccatactcatggtaacatgaacgaatatcagacattaatttttcaatccaacgatagtttccactgtatttgtagtatggactaaatatttttccctgaagaagatgctcaccgggaagctcatggaaacgaccttgtctcccggcttgaagccgctcacgccgccgccgagctccaccacctcgccggatagatcaccaactgttcgaccatggcaagagttcatggattagtctgaactttaaaagtggcatctgttaacagttgctcagtaatcagtatgcatctcgttcaacattttcaatagcttcttctacaaaatcaatgagtagttagagtacttgatggtgatttacaggagtaaatatcaatgccattttgttcttgaggaaatactccatccgtttcttaataattgacattttttactttctcgttgaccattaactacctttaaattattagaccaaagtgaacataagttactacacgctacttcgagtatcttagccaactactactgccgcgttgttgagcatccgaccatttcccaatcacgccgttttcgtgatgtaatgaactccgaaaagcaatcaaagggaaggaaaaggacgaaaatgtacatgaaaatgaagtgaaaggtagccgaatacgaaagggaagcgaggaagaataatgtcctcatttgcacgtacagatagcgatcgcattcttcttcttcttttttttgcagtcttaaacatacttgtatggacaaatcttcagatttattaaaaagaaataaatgtatcttacgattttctcatggaaaaaaagcattaggcgtcacccatctttagccaactgaagtactgaattagcaactctttcatactgttatacggaagaaaaggttgtggcttgatttcttgtgtagctgaacatgtatcagtcaaaaaaattcagaagaagagcatagattgttgacacctgacaggagtacttacatatcaaaattgccaggcaaaactgaaattcagttactactccctccgttttacaatgtaagtcattctagcatt

SEQ ID NO: 76668 - DNA, 519 bp, Oryza sativa
gccagcgcgcgtgcccgagccgcgccactccatccgccgcgccctcccgttgtttcccgcgcgcgcgtgccgagtggccgaccatctggtcgccgccgccgtcactctctgccgcgccagcccgcgcctatcgcccgtgtcgtcgcgccgctccaaaccgccccgccgtcatcgccgtcgtcatcgcctcggccccgccactccgcacgcaagccgccaagggacggaggccgagccctcctccctctgccgcgacgcccccgctcccctcctcctttttcctaaatcggcaagggggcaagcccctttctccccctcctttttccccttttcctcccgccggcgtcatcctccctccctctgtcaccgtcttggccgcgagcgccgagtgccagctcgcgccttgaccgcccaaggtcggttttcaaaccgacatcgtcgtcctataaaccaaggcgccctcccatccattccccctcccgtttcgctcgccgcccccgcgccattgccatccctctg

SEQ ID NO: 76669 - DNA, 776 bp, Oryza sativa
cagtagttcatcagaaggagggagtactatttttgtgaatataaacagatgtcaatattttaattgcatcggaatggtgttcaataaatacctgctgtagctgattaagattgttggcgtggtaaggagcataggagccatcaaccgacataccgactagagcaaagaaatcattgaagaagattatagtattttctcaactctgtaagaatggatctcatccccaggatcagacgtggttgcatgactaatcatggtattccaatcttcattcttcatgccagtaagctggttgcaagaagatgtgagtttcttagcacgtgaatatatatagcattactagcaattttcctttcaggagcaaacatggtattacaaggtaaagtaagcaattaacttggtaaataaacaaaactgatgttcactgaacattttattccaattagtatacctgaatgatgaaatgtaaaatagatcaacttggtttaatctttaataaattggattattataataattctgatgtgtactgcacctacaagaatgtctgggttaacgttagtgcaagcggcaagtaccgccacgttttaacccttcagcatgtgaaaggtaagtagttgtgttccacacgtatgcgagtttttcttaaagagatttcttatagattccttctatatttccaaaaaagaataaacttagaaatcgacacaaatacggatttgtattttcaaaagcgaacgaaccttaaaaaccgattcatacacgaatgatgtacc

SEQ ID NO: 76670 - DNA, 1324 bp, Oryza sativa
acacacaaacttccaactttttcgtcgcatcgttcaaatttcaatcaaactttcaattttggcgtgaactaaacacacccaatgttatactatggcctggttcagttcccaactttttcttcaaacttctaattttttcatcacatcaaaactttcctacacacacaaactttcaacttttccgttacatcgttccaatttcaatcaaactttcaattttagtgtgaactaaacacacccttatgtgaggatgcacaaagatgagtaagggggtgtttagatccaggggtgtaaagttttggcgtgttacatcggatattgtatagggtgtcgcatggggtgttcgggcattaataaaaaaactaattacagaatccgtcagtaaacagcgaacgaatttattaagcctaattaatccatcattaacaaatatttactgtagtaccacattgtcaaatcatggaccaattaggcttaaaagattcgtttcgcaaattagtcgcaatctgtgtaattagttattttttagcctatactaatcttttatgcaggtgttcaaatgttcgatgtgacaaggtgtaaaatttttgtgtgggacctaacagggcctaataagattgatcagtgccatgtcatctggcctattgtggaggcttggtggagtattaaaaatgggatgaggagggttcccagaatgtctcagttttcaccatgtggtgttaaatgctgttgaattctcaactgagaattattgacattgttggagtgtcaattcttcccttaaatatagcattgtatactttgtttgtcaagaagcttgcgttgatgatttaggagtcgtttaagatcagcaagaaggaaccgagaaggagcgtgtgatacacattcagctccacatttatagccgaagcttctgcaggactgcaacatcgctcttgccatgatgataatagtagcagataacatcagaacagcacaaaacaattgctgtcaagtcgcgattagtttgtcacaggtcaaaatgctgttgctaatgcagttgatcatctaacaatgtgctaattatgagttctgaccactctacgatgtgacagtgtggttgaccttggattgccagaggttgatgagtgatggatttatgagtttatcctattactacaagtcagttttgctgaggtgaaagtgaaacaatctgaatgaagaagggacaggttacagtacttggcaacttagctatgctcagagtaattgtatcatcatcttgatgtaattaaagctcaataaaaaaattctattatataaaaaaacagtacttggcgacctc

SEQ ID NO: 76671 - DNA, 30172 bp, Oryza sativa
aatcatatggcacaacatttgttagaatatagttttttcttttttacatgatgcaatcctttgagttataatttacatgatctggaccagctattaaatccatgcacatcctttttcattcatgtcttctttggaagagtatttggttgactccaaattaccaggaataatacttggtttactataaattgcattattgttttctacagacgtactaagcactagcaaattctacttttcagcttttagccatctacgagcaccggattgcagtccagggtttcctatggggaataaactcatttgaccagtggggagtggaactgggcaaggttagtgcttgaatatttatacatatatttccattttgtttgaaggtctagtttttggcttcaattctagcatgtgtgactctcaactttccccaggcatatgtttgtcttattttcttcatctgaagactgaactgtgttgtctgtatttttttttcgtgtcagtctcttgcctctcaagtgagaaaatctctacatgcatcccgcgttgaaggaaagcctgtcctggggtttaacagcagtactacaagtttgctgacacgatatcttgctgtacgttctttgatagttcatcataatttattatccatgttatataattaaatttagtttcctaagtgttcttgacagctcataccctagaactgagggatttatgttgtaatttaatctgttttgtaggttgagccatccactccttacaacactaccacactgccgaaagtttgacacgacacgtttggcacgctattgtcttgagttaaacaagattactagagtcttcatatcttgtaataagtttaagttcgttttggagttgttacaggcttacagccagttctacagtactgtagtttcgttgttttcctttactccgacctccaggaaacgaaatggaaaagaaaaaaaaaggaaactgttgttgaataaataaatcaagtcgtgtcagcatgaggaagctgtcattaaataaattaggtgaaaccccgcgcattgctgcgagaatttagtatgaagatatacattaaaacattatgtaaattatgttggatgataatttaatatgtttgtgtttgaaaagctcttaaattataaaaactataaagatatagcatgtttgcatgatgtttaaatgtgatgattgttagtggatgatgatgtgacatctttgcatgaagatatacattgaaatattatgtgaattatgttggatgataatttaacatgtttgtatttgaaaagctcttaaattataaacactataaagatatagcatgtttgcatgatgtttaaatgtaatgattgttagtggatgatgatgtgacatcttgttaattagtggatgatgatgtggcatcttgttagtggatgatgatgtagcatctttgtatgttaagtttaaggagttcgtagaggataacttttatagtaagataggatactactactgtttggcttgaaaagcttgtttgtgtgtttacacattttggttgggagaaattttacagtttggagagtaaccaaattttaaactggtaccttctcgatgaccgtattatctgtgtatgctgccacttacacttattttgctactgctatattcaggcgaatgtctcgagaatttgaccatcacacactgtcagtcatttgaacaacctgaaacaaaattcagttctgtattctgttagcccttcactagggctgagtttagttctaaaatttttcttcaaactttcaacttttccatcacatcaaaattttactacacacacaaacttctaacttttctgtcacatcgttctaatttctaccaaacttttaattttgacgtgaactaaacacaccctagattttgtttctcattcaaaatctgcaagcagatttatcgattctttcatttaatggaacaatcaaaccatttcctcctctttctatatccaacaatatttccaataaaaattgggcacactttgtgttagttgacttcccacaccacacatggccaccccaagtgatacccagcaactcagaagctgctgctacctgctcacccggtgcggaggctgcttccactccgcgctcatctcgccggagaaagacacatcgtctcgccggccggactccagcctcgccgccgtcgcctcctgaatgatccggtccatgtcgaacgtgtacgacccggaagcctcgctgatgctgcccccggtctccgccgtgccgaacaccatgctctgccccggccgcatcccctcgttcaggtcctccagcgacatgtccccctccagcgccctcacgatctgcaccgattttcatctccggtgagccctgcacggctggcggcggcgccgccggcgccggagacgatggtcatgacacatggcattgacatacctggctcatcttggggcgcttcttcgccgagtggcggacggacgcggcggcgctggcgacgacgcgcgccatctccaccgcgtcgtagctgccctccagcctcgggtcggcgacgccgccgtagtcgccgtcggccagcgcgcgcgccatggccggccgcgcccactcgacgaggctgtcgtcctccatgaaggaggcgggccaggggtggtcggcggcgccggcgtcgatgggccgccgccccgtcacgagctccagcagcatcacgccgtaggagaacacgtccgacttctccgtcagcttcccgctcgacgcgtactccggcgccaggtacccgaacgtccccatcacgcgcgtcgacacgtgcgtgttgttgtctgacgtcagcttcgccagcccgaaatccgccacctgaaatgacacaaaccatcagataatcggatgccgcaatttgaaatgcagcaatttttttttaaaagaaaggaaaatctgcagcaatttgaaatgttacctttgcttcgaagttgttgtcgaggaggatgttggcggatttgatgtcgcggtggatgatccgaggatggccttcatggtcaaaatggcaaatgcaatttcaattcagatatgaaaaatcgtagacatttttaaacatcaaatttattggagcaatggtgctcacagtcttcgtgtaggtaggcgagccccttcgccgacccgagcgcaatgcgcagcctcgtcggccatggcatcaccggcaagcctttccctgaaccaacaagaattggatgtttcttgatcttgcggcgaggtgagggaggcagcaatggcgtggtaagctagagtgatcgagtgactgaccatggaggtggaactcgagggtcttgtttgggacgaactcgtagacgagcacgcggcgcgcgccggcgatgcagtagccgacgagggagacgaggtggcggtggtgcacccggctgatgatgtccacctcggcctggaactcgcgctccccctggccgctgccggacttgagctgcttcacggccaccgccttgccgccggcgagcacccccttgtgcacgtacccgaacccgccctgcccgaccaggttctcctccgcgaagccccccgtcgccgccgcgagctgctcgtaggtgaacgtccccttgctcatccccgccgcgtcgctcgtcgacggcgccgcgcggggctcggccagccatggcggcggtggcggcggcttcggcccgctggtgtcgcggccgccgccgcctttggatcccgaggtgtccgcgtcgaaatgcgtgacggggttgtgaggcttcttcttcctcttcctcctcggcgccgtcttcctcgagcagcaaaggcaggcggcgacgaggagcacgaggagcgcggcgggcccgacggcggcgaagacgatctcgaccatggcgttgtaccccccgcggcgcgcggaggcgagcgccgacctggcgacgtcctccgagccggagccgccaccggaggagcgagacggcggggaggggaccctgtccggcgacggcgggggtgcgccgccgccgccgccatgtggattcgacggcgccggtggaggcgagacggatggcgccggggaggaggacgaggacgaattggtgggcgacggcgaagcggccataagaggagggctgcttttcggcggcgggacgatcgacatggccccgcgatcacaaatccgtctcgccgggcgttgatatcgtgctccgccgcaccgccataggctcaccggcgaggaggaggaggaggaagggaggggtaggtactcagcggccgcgttcctgggtggcggtggcggcgcccggcgctgtcgtttccatgcggccgccattgggggggggggggggggggagtgtctctggttggtgtttggttacctcatccgcactgatcagcccgtgactttgacttgtgaggctgccatcgcaggaatgccaccgtggacatcccaatacctctccctccgtaaatcgtactactagtggagtatctcgcatgccatggcgtaaatatttcgcacgtgatggaatgctcagcctcagctccatgcttgttacttactactctctccatcatagttatattttatcttggcacacagaacaagaataagtaattctacttatcatccatttaaacatactactagtcattcctcgtaaacaagcgattcattgatatttatcatccatttaaacatactactagtcattcctcgtaaacaagcgattcattgatatttacgtttcttgatacctatgtagccaatcttgtgtggaagaatggaaagttatgcattaaatccgagaaagtcattaagatgataggttgttgaagtgaaatatgcctatcaaaaataaaattttcagatttgaaaatatgactatcaaaagtagatggagggagtaacttttttttaggttgttttcaatatttttaatgaaaatattaggagctctctaggattgtttttaaatacttctttctattaatgaaaattaggagaagatcaagattacttactattttgttagagaaactagaggattgcccccgcgcagtttctcttagctcctattttttgagactttagatttaaaaagacgcaaatattaaggaataacctaactttgaatttaaaaagatgcgaatattagggaaagacctaatatcaaataattaaaaggggtaagacttcgaacccatatcgtctagcccaccaccttgtggagctaaccaaaagacccgtggccggaaaaccaccttgtggatttcatgtataactcttaaattatatttctataatccttggattttatatacaactcttagtttctattcctataataccgagatttcatatacaactctcaatttatatttctataaatataattgtattttatacaactatatcaatcaatttataccgttataatctcaaattacaatagttcaatggttaagacctttttttatttttccccaattaatgtggaatttatagcctccacaaaaacatggtgcgtgctatattaataatacaatagataagttaattttaaaagaagttaggtgtatgactttctacttaaagtacggtgtatgactttctacggatatgtgttttttacattaatggacgttttgcggttgtgtttttatctttcttttttctgttcattataaggttaaaaaaattacctccatcccatgaaaaataattttttaggatattaaggacatatattaggaggatagacaaataaccacaataactttatttaatgaaaacaatacatgcacacatttcatatataaacttaattaaaaggaaggttgagacaacgtattagagatgagatggaagaaagggaaattacaaggaaacatatttaatgtaatcaatttgccaggtgctacattaataaaaatacaatttttatgagataaagattcaaaggtagaaattaacttttaggacgaaggaaggtagaaatttaacttttataggacggtagtactttatattgttgatatcacgataaagtcaatcaccctgatttgatactaagttataacatcacggtatctacatttgaaacaattaagaagcccctgatttgatcgaggaaagactcacaccatcgtaagcgcatgaaaaaaaaattgaatatgcattttgctattagcacaagtaataaagcatatacggaaagatgaaccatatataatcgtaaatctgatgatccaattccttaacgacgagacaatactaccgaatacaaaatcataatcataaacataatagttcaaaacttcaaatcgactactgatatgaaagtgctgaaatccaattatccaaactaattaaataactgccaatagtaatacgattgtttcgatcgagccaataactagctagactagtagaaatacgaagcaagaagaaacgagtagaggatcatgcacgaggaggagaacaggtaggctatggcgaagtccgccatgtccgccgcgctcggctccgagccacgccgtcgctccgtggccaccttggttcgagcttctgcggcggcgttggtggtagcaggcggcggctgggtgcgagcctcgagggcggcggactgccccgagccatggcggcgatcggccggcggcggctgggatggagcttctgcggcggtggcggctttgatggtggcgtggaacgcctcggcgcgcctgcgagcttcgtaggcggcatggtgtgatgcttcttcctcctccccgacctcccgaatcaccatgcacctgctaccgccgccgtgcgccgtgtccttcttcccgccggagtcgctcgccgttgctttcatcgctgctgctgctgctgctgctgctgctgctgcagcagctgctgcagtaagcacatggacaggctcgtcgttgatcaccaccacggacttgtcgacttcgccggacgttcttgcatcgagcggcggcggagaagtcgccgccggtgaaaccatcactgcggggggagtcggtggcgcgtcgccagatttgctcttgtgctcgtcgatgaccggtctgtacctccagggcagtctcggcgcccgggaggtccttcgtcgcggcggcggcggattagtagccctcgatgcagccacaactgcaggagtaggaggcgatctgatgctgctctcatgctcgccgtcgacttcgctcgtagtcggcggcggcggcggagcggctgatactgtcgtcaatggtggcacttcaacgacggagatgacatcagcggccgcgccgccgtcgtcgacatgcgacctggccgtgtggtcgaccacgtcggtgacatcaacgacggcgatgccatcgtcggtgctcgtgctgccgtcgtcgacgtgcgccgtggccgtgtggtcgaccacgtcagtgacttcaacgacggcgatgccatcgtcagtgctcgcgctgccgtcgtcgacatcggccgtgtgctcggccacgtcggtgacttcaacgacggagttgtcatcagtagccgcgccgccgtcgtcgacatgcgccatgtccgcgttgtcgaccacgtcggtgacttcaacgacggagatgtcatcagtggtcgcgccgccgccatcgacatccgccgtgtgctcgcccacgtcggtgacatcaacgacggagtcgtcatcagtagtcgcgccgccgtcgtcaacatgcgccatgtccgtgttgtcgaccacgtctgtgacttcaacgacggagttgtcatcagtggtcgcgccgccatcgtctacatccgccgattgctcggccacgtcggtgacatcaacgacggagatgtcatcggtagtcgcgccgccgccgtcgacgtccgccgtgtgctcgaccacgtcgccgtcgcagatcacaacgccggcgttaccgatctcgcagctggtgtcctcttggctcgcggcgtcgatggagcgctcagttgttgcctcgatctccgaagctgccggcctctgcttgatctcatcccctcctccgatcgagagcgcctcgccataggagtacctaacctccttcacgaacttcggaggcgctggtggcgccgccgccgccgccgccgccacgacggctcctagaggcccgtcatagaatagcggcggtggcggcgcgccgccatcgacgccgccgccgccgccgaagtgggagacgagggggcgtgacctggccatgtagttgtagacatcggaggcggcggtgtcgatatcgtcggaggaggcggtgccgtcgctgtcgtagctgccgtcgaggaccaccgccgccgtgttgctctcgccgtcgctgaggatgacccactcgtccatggcggcggctggcctcttcgccatctagggttcgtgccggctctctttgctgctgatgatcaggagaacatgtataagcccttcacgagtcctctcttgttacgttccttgattcttgcgtttagttagcgtaagttgcgatcttatctaccaaatcccctacaaatcgcgcatttaaacttgtgcataactctgattgggatgtgggccacgtttggctgggcccagtttcagtgagttgggtttttactggcgccgtattgcctcgttgatatcaccgtatgtaaactatttttctttctttttaaacgttattattaatatagtagtattacattgccaatgattctatttttgctttttataaactttcattgccaaaataagactagtaaatataatggaatatcaacccctgttttcatcgattgaatctcgaccaaatttattccgactaaacccaattggaggattttgttcgtacttactacatatatacaacttgagaaatttcaagaaaaaaacaggcaaattaggagtaacaaacatataccatcagtcaatcacgatcgatcatatgattcatatcatatcgtatataccatatataataaaagaacatgataaaatactatacattgatatttgcagtactaaaccacaaactttattagcatcactccctaataaatccctaattctaattcaatgcgcagattcgcagaagaaggtacacgacaccaaagagcaggtagaagactgcaagcgaaaccaccccgtcttggcgtgcgagcgtatcagggaggaaggccgccgcagtcgccgccgccgcgttgctcgcgctaacgtcaacgccaacggcgaagctgggcgcggccgccatggcgcgcaggctcgtggctccctgcgacagcgcctccacgtcgtgcgccgccagcccgccggcggcggcccgcatgtacgaatcgatcacgtcggccgccctcaccatcgcctctgcagcctggtcccgcgccgccgcttgttgcatcgcctgccggaactgcgacggcgtggacgccggctcggccgtcgccgccgcgctattctcgcctgccatgtcggcgctgttgccgtgcgcctcgccatcgccggcgtcgggagcagtgtcgtggtcgctctcaccggcgtcagagggctcctccccgtcaacgccgcttgcgtcgccaccgatctcctctccgagctgcgtggcatcgaactcgtctccggtgagctgatagaactcctcgccgtcgatgagctccatgcagcggccacagacgcatacgtgctcgcactcctcgtcgctggagctttcagtttcatcgtcgtagagcgtgtcgccatagaagaaatccaggaactcatcgctcaagccatggaagaaatccatgacctcatcgtccaagacgctttcctcctcaccaaagttttcattgtcaatgccaccatcggcgagaacctgcaggtactcctcgaagtcgtcgccgttaaggctttcgtagtcgatgtcatcgtagccgccaccggcgaactcctcgggctcctcctcatcatcactctgctcgtcggagacgctctcctcctcatacaagctctcactgtcaatgtcgtcgtacttgccgccgtcgatctccatgtcagagtcggtgtcgatgtcgtcgtaacttacagggacaccggtgaactccggccactcctcttcagcatagctctgctccatgcagacgctctcctcctcaccgaagctttcgttgtcaatggcgtcgtacttattaccaccgggctcctcctcctcctcctcatcgatctcctcgtcacaatcgctctcctcctcgtcgtcaatctcctcgtcagaatagctgtcctcctcgtcgtcgctctcctcctcgtcagagcttccggtgtccacgtattcatcgtcgaagatttcatcgtccaggttctccgcgcagattatgtcctcttcatcaaagcattcagagccatcgtcgtcgaggctctcatcatcatcatcatctaggtcctcctcgtcatgggaagattcagtgtcatcgtcaccgaacaggccactagcgaaacccatgagctcatcatccaggttaatgtcctcctcaacagattcatcgtcaatctcctcatcatcgatctcctcctcgtaatcgctctcctcgtcagtgctttcagtatcttcgtcagaatcgctctccaagtcagtggtatcctcctcctcgtaatcgctctcctcgtccgtgctttctgtatactcatcggaatcggtctccaagtcagagcttccagtgtcgtcctcctcgggatcgctctcctcctcatcgtcgtcgaagatttcgtcatcggggttctcctcgcagattccgtcgtcctcatcaaaacattcaatgtcaccgtcggtctcatcatccaagtcctcctcgccggagaaggtcgtgtcctcggcggcggcgatgttggagtcgacgtggtcattgttgctctctgccacgtcagatatctcggcgttctcgtgctcacctccggcgatcgccggagacacctcggtaatgtcctcctcgtcctcttcggctgcgtcgagcaccggagcgtgagaagaagctgcgacgagctcggaagctattcccgagaacgcctggcggtacgagacggtcttaaagaaccccggcggcgaaggcgaaggttgcagtggcacggcctccacggcgatcgtcgtgtgcggcagcgccgccggcgtgtcggcgccgacgaccgcagcggcacggccgcggacctacacgaccgcgaagccgctctcgctgtcggagccgccgacgtcgctgccgtcgtggagctccacgctgtcgccgtcgctgtcgctgagaacgacccagtcctccatggccggcgctgcgctctcctcctcctcagcggcggctgctgcgtgcgtgagcctgagttctcggctgcggcgctcgtgcgtagatcgaagtatcgaaccgatcgtggtgaactctggttggtggggtggtgatcaggtttcgctgtgaggttcaaggcggcgaggagcgctgcgtatatagggggtggatacgggtgtaggattcgaactcgatcggcgctgtgtgcagatgtccgtttcagtttcagaagaaagaatccgagttgatacggaatttcgtcgttgggaacaccgcaacaacatgagccgtgagcgtgagtcggagttgggatcgttttcctgtgaggctgtgaccgtgactgacatctccttttccttgagtattactccagtttaaggacttgtaacttgtttgtgttttggggatattcgtttcgtgttgaccgtgactgcaagttgtgggaagcgcaggatttttatttaaaaatataagtttagttttccatcattaatttgccttttaagcttatgaccgaagctaagtttattaaaataaattacccaagtaacctataccactattgcttcaggtacagaaactgaagaactgagtcttggttagcagttctgattgtgtttgcttatgatattactgtgttaaaaaatacaataaacattccagttttggagacggcggcgatgccaccgtctagcacctggtcggaggcaacatggacgggcaagggctagcaggattgaccacagtcatgcattaatctcatgaggacatggaacgaagaggaagaagagactatttgcactgagattcgtactggacatgtgtcacggaaagaagcgcggtctttcagatgagtaaaggactggagtcctgtgcaaaggctagcttgggaataccatgccccaatggttgtatcatggtgagcccacagttacctttattttctcccctcccctttactttttctcggcaattgtcggctaatggcagttaagataagtgcaatgacacggcagcattacttgcagggaaagctctggtaaaagcatagacttatacacactcggtacacatccatattgtcgtttcgagtttgaactaaatcatgcaatttaacgagcatccacaagacaaaggccgaattaagttctaaacctttttcttcaaactttcaactttttcatcacatcaaaactttcctacacacacaaactttcaacttttgcgtcacatcgttccattgaacgtcacattgtttcaatttcaatcaaactttaaattttgacgtcaactaacacacccaaaaacaaagaaaaaaaagtgacaaagtagctattcattctcccactgttaaagtatagatcaactcaactggcaagtacctcacccaaaaactatttgaaaaacatatattgaactggggaaaaagctcatctgatgattaatatacacaatttattgcagcttgcgagttaaatttctcaaaatggaacttcacatccacaaacttactcttagatcgagtgattgatcgccatgcattgcagtaagattcgctaagatgacgatgccattgccacttcatggatcagccggcggcttcgcgagcggcggctcggccgcgagagcggcgggcgcgatcagcgcgagggtgttgatgtgcgcagcgtgctccgcgccgtcccatgccgcgtcgacctcgtccggcacggcgacctcgcgccgccgccgcgtccgcgcgtcgaacgccaccaggcgcctccctgccagcaccaccacctccacctccgcgccctggaaacccagcagccgcaccccgtcgtccagccggagtggtgcattcgccgcggcgacaacagcgcgcgagccctcctcctcctccgcgccggactcgtcgtgctgctgggacgccacgatctccgtggacgtcgtcgcccttgccggcggcggcggctgagatggttgcagtatctctgcgacggcgaccctggtggtcacctcccagattccgtgctcgtgcagccggaacaccaccacgtcgccgccgtcgatcacggcgcagtggagcatgcccgcggccaatccgatctcccactggtcactgtcgccggggcaggtcacgaggtcgacgcgccccgtgacaggggtgtaccccaccgcggtgccgatgctcgtccgccaccacgccgtggcgccggccgccacgcccgacgcggcgacgagcccttcggctggcgacatcgcgtcggtgacccaccacgcgccggtcccggacgtgaacacctggaagcagtaggcgccggaagaacccggctccgactcgaaggggcagacgagcgtgaagtcgccgcggaagttgtaggcgctcgtgtcgaagaggacgacgatcgccgggcgcggccaggaccgccacggcggggacgggacggccgtccacgacgccgtagccgggttgcacacggcgtacgcgtcgtcggcgggggagaagcagcaggcgaccccgcgcgacgacgacagcacgacgagctccgacgaggccggcacgaacgagagcgacggggacggcacggcgtcgtcgtcgccgtcgaaggggaggaaccccgctgatgggacgaacaccccggagacccgcctcggggcggccgcgtgcgcgacggcgaagagcggggacgacatgtggctcgcccacgacgggtgcacgacgcggaggcgcgccgccgccgccggcgggaggtgcacgagcgagttctccctgaccacgtcggcgagcggcaccccgacgaatcgctcgaccgccgcagcccgctcccgccgccgccgctgccgcgacgcctcgcgggactctgcttcgccggacatggcctcctcgacccgctcggacgctggtggtcgtgggggaagtggacggcttgatgtgggaattgcacggtggtttcgtggtatcgttgtcgtcgtggtcgtcgtcgtggtcgaggcgtgtaagctatcgatgggttcgcgagtgggggcacggccggtgcgcgacttcgtcgtccacgcccgcttgactcgtgcgagaggtcaatctctaaacctgcacgtacgtactacgtaaattccggtgtgttttaggttgatgaagcgccggtttgcgcggccggcccggcactgagccacccgtgattttagatgtaaacagcgataaattttggaaatttaggtgatcgatatatacgatacgtgcaccgtctggtttctttattcacgaaattatctcataaggaaacagccgttcgagagtatctcgcatcgcacacggccgctagataaatccccgatctcgtgtaataatggtataggctgtgtttagatctatgtgaaaagatttggtgtgccatatctgatttacggacacacatttgaagtattatatgtagactaacaacaaaacaaattacagatttctcctgtaaactgcgagatgaatttattaagcttaattaatccatcattagcaaattaatgtttacttagcgcctcattgttagatcatgaagcaattaggctttaaaaattcgtctcgtaatttacacgtaatctgtataattagttttttttgctatactagaaaaaaaatatccgtgcgttgcgacaggtaaagactatttcaatcttattattattgttatatgagttagttagggtgaattcactctgttaaattcgcttggatatatattttgttagaaaataatgagctgcaactaaaagtttgattgttttaagttagtatgcgagtttttcttaaagagatttcttatagattccttctatatttccaaaaaagaataaacttaaaaatcgacacaaatacggatttgtatttccaaaagcgaacgaacttaaaaaccgattcatacacgaatgatgtaccaaaataccggcaaaaacatcttcaattttcaatttttataatagtagagatagagatttaatgtttcatgcatatgtctaagagagatgctctggtgcaatatacttgaattattctgcttcgagtagaattaatcttaagggaaaaatttttgctaggatctaaacaggcccatagacttctttatatttgttaccttcaaactcttttcctaataatcactactagtacaaacaggtaacctgtcagcctgcagtcgatcagcaatcgtgtaccacgctcgatcacacggatggcgtcgacgatcctcccggacgatctcatgcctgagatcgccgtacgctcagacattgtgtccatagttcgttgcgccgccacctgcaagtcgctccgcggccgcatcctggaggaggaattctgccgccggcacaacaacgccgcgaccagtctcctccgcggcgtctcctacaggttccgctgtgatcttaacacctttgtgggcgtaacacaggccgcgtcgtcaccatcgtcctcgcctctcccccgcttcgacgccggtatcctcaacactttcgagcccatggtgtcgcgcgacggcctcgtcgtcgtcctcgaggactacgtctacgccggccccgaccgtttcaacatgtgcgtctgcaacaccatcaccggcgacgtcacctctctccctgccatggatcctgccatgaaagtcaagagaaggttgatctacccgccggcgttgctcgacgtcggcgacgccggccgctcgttcgagctgctcgtcgcggacaacgagctgcacacacagacattcacattctcgtccaaggacggcggcggcggatggggcgccgcccgtacgatccgcatggacgccggccaccggaagccctccatcccgatgccgtttcaccacgttcccggccgtcgtcgggcgcgccgtgcactggctcgccggcacggagcggtactgggagctccaagcccacggcgtggtcatcttctccctgcgcgtcgacgcggcgtgcgccgcgacgatggagctaccgccgggctccgccgacaagatgctgggctgcaggaaggacagccatcagctcatgctcgccgcgtcgcggggcggcacggcgttgagcctggtcgtggcggagcgcgagctgatctcggtgtggacgttggaggaagaatcatcggcggcggcgacgacaacggcggcgaggtggagccggcaggtggtgatcacgaggctggcgatcgaccggagcgcggaagccgcgagaatgtacagcacgtcttcttcgaggggttcggggagaggagcggtgtcgtgctcttgcgcttgcatcgttttgggctcgtgcagctcaacctggcgacgaaagaggcgctcgttgtgcgccgcgttagcacgaggtggtcgggctccatctccagggcacgcttgcacgaggtggatctgtactctttgctccgagccatgaaacacttcgatcttgcgcctggcagagaatgaattcaactcttttctgaacatcctagtagcaaaataatatgaatttttaaagaaattttctgattagttattaattatcgcttgttcggaaatcaggacagcactatcaagtatacaactcttttataaacctcctagcaaaagaatgatttttatttctttttatataagtagaatttgaacttgcatacttaaatggtatataacatattaatctattatattatttttttaaaaaaaatatagactgtttaggccctgttcagatcctccaaaatagcaaaagttttgccattttatagcactttttgccattttggatataaacactagtagcaaaagttgacaatttggcatttggcatttgctagtacatagtagcaaattgtgccaaaaagtgctttgggaccgctccctctctctttttctctctcactttagtgctagaatggcaaaactttaacatgcatctaaacaccaactaggacttttacaatgccaaaatttttaccaccaaaacttttgccatttaccattctaaatggatctaaacagacccttagatgatacatgaaaatgagagaatattcgctcgagagaggaatagactttccctagctagatatacttttataggttggtcaaaagatcttacagccacaaaaatcgctgacatgttgaaaaaaagggatcgactgacaaatagcaaaactgtactctgtttttttaattaattataacgttcttgatatttttaaagatatgtttaatcattcgtcttatttaaaatattatttaattattatttatcttattatgatttgatttattatcaaatatttttaagcatgatttaaataattttgtatttgtaaaaagttttgaataaaacggactgtcatataataattgtagaaaagtcaatgatgtcactattaaaagacgaatgctgtagtatttattgtttttgaaattccttggacttaacgaaaccatcgttcggtatagtgtaagctgtatttatcagcctttacaaaccatagaccaaattatgtttcattgcttgattattttggcctagtcaaactcatgtgtatatctgttctgaagttatgaaacaaagagacttacttttggatcctatactagactttcagtaatttagcagtgcagtaaagaattcgtaccatatatagttatccttctattttatgatttctaactcactttcatattataagtcctgttgatatttttcttaatcaagttttttttaagttcgagcaagttttaaaaagaattagcaatatctaccgcactaaattagtttcattaaaactaacgtttaatttattttaataatatgcttgttttgggttgagaatgtttctatattattctataaactttgtcaaactttttagaaaaaaaatcaaaacagtttttaatacgaaacggttgctactctctccgttccatattacatacaagtcgttaggactttttcttcaaactaagtcaaattttgatcgaagttatagaaaaattaatatcgtaacattttaaaccctaaataaatatactatcaaaatatatttaatggtacattaaatttactagtttggtgttataaaagttattatatttttatataaacttgatcaaaatttgatcaagaaaaaaatcaagtgttttgtaatacgaaacgaaaaaggtgttaatctgttttcctattcaccaaatccgcgatttataccaactgacaaaaaaaacaaccattctctatgaagtatcgcgtcacggccgggaaagcaattcccgagcttgttaccttcacgactcatttaatttcctcatactaatacaaatgcgtcatataaaacggctggatttccatcttcttctttgtttcttcaccatcaacaattgtgtcttctggtgaaggaccatccacctgaaatactccctccgttttttaataaatgacgccgttaactttttctcacatgtttgaccattcgtcttattaaaaaaatttacgtaattataatttattttgttatgagttgttttatcactcacaatactttaagtgtgatttatatcttatacatttgaaaaaaaattttgaataagacgaatggtcaaacatgtgagaaaaagtcaacaacgtcatctattaaaaaacggaggtagtacaatcttgtcgcaatggttcactgggctgctgtagccgtgggttatgcttcaacaactcccggatttgtcacaaacatcgccggcgttgctccgagagacaggttgatcaatctgatctaacactaatattgataaagtagctaattgatgcggcctcctaagaaaattataggattgatctcatctctccggggatgtatcaagcaacgttagtctaaggctctaatatatctatctctactattataaaaattaaaaatgtttttaccggtactttggtacgtcatctgtgtatgagtcggtttttaagttcattcgcatttagaaatacagaaagaatcgtataagaaaccttttgaaaaaactcgcatgctaatttgagaggatcatatttctaattaaaacttatgattttctagaaaaatatatattcaaacgaattatcaaagtgaatttcaccttaacttataataataacaagattaaaataatctttacccatttcaacgcacggatattttttctagtaatgtaaaaagatatattattctattatattgtattaaccctctcaatagatatatacagagtacaatacaagttatgatagaatttatctctacaactatatcttatctttatctctagaactccatttatttttaattttgtaattcaactattacgtctaaacgtacatatatttacttctaacgcacgtactactggcagacgctcgtatcttaaaatccagttaagctagcgtgtatggattcgagttcaacgctcccggacgatgtgctgctcgagatcttcgtgcgctccgacgctgcatccatagtccgctccgccgccacctgcaagtcgctccgccgccgcatccttcaccagcaattccgccaccggcaccgcgccggcaacggcaacgccagcctcctcctcggcgtctcctacaggctccgcaccgatcttaataccttcgtgggcgttacgtcgtcgtcctcgccgctccgcttcaatgccagcctcctggagtcgttcgagcccatggcctcgcgcgacggcctcctcgtcctcaagcagcgcgtcgccaacaatgccggcgacggcggcgagcaccgcagcaacggcttctttttcaaggggaggagctacagtttcaatgtgtgcgtctgcagcatcttcaccggcggcggcgacgtcaccacgttcctccctcccatggatcctgccatgcatgtcaacatggagagccacaagaacatctacccgccggcgttgctcgccgtgggcgccgccggcggcggcggcggccggtcgtcgttcgagctgcttgtcatggactgcaacctgcgaacccagacgttctcgtcggagaaaggaggatggaacgccgtccgcgcggctcacctggcacccggccaccaccagcggcggccgcggatgccggtgcccaactcgctccccgccatcgtcgggcgcgccgtgcactggctcggtgtcgcgagcgactactggcaagacggcgcctactgttgagtttgttatttcagctgtggccccaacgtgttcctggtgattgcagttgcaacggttgaaggaataagtctgtgtttgttagcagatgcaaatgatgcggtgatcgagtcagaagaagaccgcgtcggtagcgttcgtgtgcgtgagtttagcgcgggtgcgtgagtcgtcgaattcagagaaaagcggatcgtgggatggcacgatttgagcctcggattctttcttttgtgtggaatttaagtaggagttttttgtactgttattctagttgcatgttactctgttcagtgaatgaaaaccacagaaaattagccccacaaatttcctatctgctattgttttctgaaacttctcaatttcctgtgttcttgttctgctctgtattcctctgaatctcgttcgttgccgtgctggattgctgcagtacgcacgcaaggtgttcgatcgagggtctagcgctaacaagtggtatcagagcaatcaggtttgagggctaatttgacaccatggcgttggttctggcaacatcggatccggcgagggggagctcggggagcgctttcctgtatccacaactcacagccaccaactacactagttgggtgatccgtgtccaggcgatgatggaggaccagggtgtgtgggaggcgattgaaccggcggccggggcggccgtcgaccctcggaaggacaagaaagcgaagtcgcacctactgcagtcgctgccagaggatctcctcatgcaggtggcgaagaaacggtcggcgaaggaagtatgggattgtctcaagacaagattcgtgggtgctgattgagtgcgtgacgcgcggctgcagacgctgaagggcaaatttggcgccatggtgatggagccgggggaaaccctggatcagtacgcaggccgcatcaccgcgatgagcgtgcgccactcggtgttgggctcgacgttgaccgatgccgcgatggtgaagaagttgttcgacacggtgccagagaaattcgtcagccttgtcgcaggtattgagcagttttataatgttgatgacatgccatttgaggaggctgtgggccggcttaaggcttacgaggagcgggtgcgtaagaagaaggcagcagccggcggagtcaccgcgacgggcaggttcttctcactcaggctgagtgggaggcgcggtttaagaaggatggcggggagtcatcgtcgcctcagaaagggaaagcttccggcgagggagctaaaggcggccagagcggtcgcgaacgcgggcgaggccgtggtgcgggtgggcgcggtggcgctgctcgcggcaactctgcaagtggctcaggcggcggtggccgtgacaagagccacatcaaatgcttcaactgcgaggagtatggtcactattccaaccagtgtccgcacccgaagaagaagaaaggagaagcacacttggcccaggccgaggacgctggcgccgtgctgttgcttcgggtgaccgaggacgcgccggcgcgagcgacacaggagatggttgtgccccaaggatggtgtgtggcccaaagttgctgctggctgatagtggcgcaatggctggaaacgtctggtatttggacaatggcgctagcaaccacatgaccggagatcgcaagaaatttagggagctggatgaatcaatccccggcagcgtcaggtttggggatgcatcatcggtgcagataaaagggaagggatctattctcttttcttgcaagaatggtgaccagtggcttctccaggatgtgtactacattcctagcctctgttgcaacatggtgagcttggggcaactcactgaaacagggcatcgagtggtgatggacgaggatgtcctcgaggtgttcgacaagtgtccttggcgactggtgatgaaggtgaggcgtacgtcgaatcgtctctaccggatcgagctcaaccttgcccatccggtgtccctgctgtccagccttgatgatccggcgtggctgtggcatgcacgtttggggcatgtgaatttccaagcgatgaagctgttggtggataaagacatggcagtgggcgtacaggccatcgtccacccgaattagctttgtcaggcgtgcttggtggcgaagcaaatcagggcgtccttccttgtggtggtgaactacagggcggaggaaccactggagctcattcacattgatctgtgcgggccgatctcgccggcgacgatggctggtaacaagtattttgttttaatcgttgatgacttcacacggtggatgtgggtgtttgtgattaaatccaaggatcaagcagtggaggccttcacaaagttcaaacccttggccgagaatgtggccgggcggcgcatcaagacgctgaggtcggatcgcggcggcaagttcctgtccggcgagtttgcacaagtgtgcgaatcggctggcatccagcggcatctcactgcgccgtactcgccgcagcagaacggggtggtggagcgccggaacagatcagtgatggtgatggcgcgctccctcttgaaggggatgagtgtaccaggcagactttggggggaggcggtgcgccacgcggtgtacatcctcaatcggctgccaaccaaggcgatgggcaatcgtactccgtacgaggcatggacggggaagaagccacatttggcacacttgcgtgtgttcgggtgtactgcacatgcgaagatcacaacgccacatcttaagaagctggacgaccggagtgcaccgtatgtgtacttgggggtggaagaaggaagcaaggcgcaccggctgttcgatccacgtcgcggtcgcatccacgtaagtcgtgatgtcatatttgaagaaaatgctgtttggcagtggcttggagatgcaggcgagcaagtctccgttgaatttgatgttgaagaaatcgttgagtcaccagccggctcggcgacatcgttgccaggcgcggtaccgaggtaccaggcgccatcacccggcaggcgtctaggcaaggagccggtggtggtagaagaggaagcttcctctccggcaggcacggcggaggcgtcaccgtcactgccgaccactcctgccacgcctatcggtgaacagagcacaccacactctgctggcgaaattgacaccgacggtgctcctgttcggtacaggcacattgctgatattttgagagatgcgcccagggtggatttggttgatgatgaacaagatggtgaggcattgcttgcagagacggaggagccgtcagcttaccgtgaagcagccggtcactcggcgtgggaggacgccatggctatggagatggatgccattgagcggaacgggacgtgggagctcaccacgttgccagctggccacagggcaattgggcttaagtgggtttataaactcaagaagaacactgcgggagaagtgatcaaacacaaggctcggttggtggcaaaaggatatgtgcagagacagggagtcgatttcgatgaagtctttgcaccggtggcaagacttgatacagtaagagttagggaaactattttaatagctcgagtggacgtccatccgtttattgcatgtcatctaaatggttatgaaaaaaattaaaaaaaatataaataagatagatcaacatgttatatatcagtccacaaacatgcaagttgaaattcaacttctacaagttgtaacaagaaataacaaacaaaacttaaattactatatgtaaatttacaattaaatttgttatttttgttacaacttgtagaagttgaatttgaacttgcatgtttgtggagtgatatattatatattgatatatcttgttaatttttttgaaaatttttcgtaaccatctagttgacatgcaataaacgggtggacatccactcgagctattagaatccatctccgtaagagttgttcttgctctagcagctgatcgccggtggcaggtccaccaccttgatgtcaagtcagcctttctgaatggcgagctagaagaggaggtatatgttgcacaaccagaaggttttgtcaagcaaggtagagagcatctcgtgctcaggttgaacaaggcattatatggactctggcaggcgccgcgagcctagaacattcgcctagatagatgtctgaaacagctcggttttgagcggtgcacgcaggagcaggctgtgtatacttggggcataggcagtggtggtgtcatcgttggcgtctatgtcgacgatctgattgtgactggtgaaaatcctgttgaattgaagatgttcaaggaacagatgatgggggagttcgagatgagtgatctcggtctgctctcgttctacctcgggattgaagttgatcagggagaaaatggaaccacgctcaagcaaactgcctatgccagaaaagtgctttctcagttcgggatgctggagtgtaattcaacctcaattccgattgatccaaggatgcagctgaacaaagatgcagatggtcacccggtgggatgtaactgagtatcggcgagtgatcggctgtcttcgatatctgttacacacaaggccagatctttcctttgctgttggagtggcaagcagatttatggagcggccaactcttatgcacttcaaagcagtgacacaaattctcagatatctgaaaggtacaattgattgcggccttgtgtatgcagcttgaaatggtgatatgcagattactgggtatacagacagcgacccgctggggatgttgatgaccgccggagcacgggtggtatggcgttctacatcaatggcagtttggttgcttggagctcgcagaaacaaaagaccgtggcactgtcgtcgtgtgaagctgagtttatggcggccacgacagcagcttgtcatgcgctttggctaagagcactgctggttgagattgttggaggaccggcgaaggtggttaagctatttgtggataacaaattagcgattgctcttatgaagaatccagtgtttcatgggagaagcaagcatattgatacacgatatcacttcattcgtgagtgtgttgatggagggaaagtggttattgagtttgtccggactgaggaacagcaggcagacgctctgacaaaaggtttgccggcggcgaagctggcaacggctcggcaccttcttggtgttcgttttcttgggccacagcagaattaagggggagattgttgagtttgttatttcagctgtggccccaacgtgttcctggtgattgcagttgcaacggttgaaggaataagtctgcgtttgttagcagatgcaaatgatgcggtgatcgagtcagaagaagaccgcgtcggtagcgttcgtgtgcgtgagtttagcgcgggtgcgtgagtcgtcgaattcagagaaaagcggatcgtgggatggcacgatttgagcctcggattctttcttttgtgtggaatttaagtaggagtttttgtactgttattctagttgcatgttactctgttcagtgaatgaaaaccacagaaaattagccccacaaatttcctatctgctattgttttctgaaacttctcaatttcctgtgttcttgttctgctctgtattcctctgaatctcgttcgttgccgtgccggattgctgcagtacgcacgcaaggtgttcgatcgagggtctagcactaacacctacggcgtgcgcgtcgtcgccctgcacgccgacacggcggcggccaggacgatcgatctgccaccggggtgcgtcgacaggatgctgggctgcagcaacgccaagagcatgagcgagctcatgctggtcatgtcgcggggcggggcggtgttgagccttgtcatggcggagcgcgaggtgatctcggtgtggacgttgaagagaaagcagcggcggtggagaggtggagccgccaggtggtgatcgcgagggtggcgattgatcggagtgtggaagcacggagattgtaccagaccgtcttcttcgaggggttcggggagagaagcggcaccgtgctgatgaggatcgtcaacgtcgggctcgtgcagctcgccgtagcaacgaagaaggcgatcgttgtgcgggacagcggcgccggtaaatggtggggcaggtccatgtccagggcgtgcttgcacgagatgaatttgtactctttgctccaaagcatgaaacccttttgatctactatttaggttagaatactttttagcattgtccatatttattaacatatatatgaatgtgggcaatactaagaaagtcttatgatatgaaacgaaggaagtagcttgagcgcctaagagaaaaaaaagaatgaattcgattctgttattcgccttaagaatgattttttttaatttctgattagttattaataccgctccttcggaaatcccttgaacattactcgtcaaaaatattcctacatgttctggtggtagactggtaagtggtaaccaccaagtagagaggtacttactatacttttgtctcgtgtgatcttttatctgcgattgggttgttagattctgaaacttcaactataaaagctgatcaaacctaacaagaaatttccagttcaaagttaaacaaacctccaacttcctaatacaaactttccaaattaaaaagtaggagaagaatggaattccacctcgactgggagtctggggctcttccatagatggggattgctagttggcacgcgtcagctgctcccgggccttcggcccatcagcccatttttcctttttttttcacgatttgttttttctttatcttttgcgatttttttcggttttttctgattacctttttttaatctttagcacacttattttttttttcaaaatgttttgagttgaaagtttaaatcttaacttgaaaatttttaaatctgatttgaaagtattcaaatctcgagttgaaagttttcgaatctgagtccaaatttttcgaatctgagtcgaaagttttcaaatctcaagttgaaagtttttaaatctgagtcgaaagttttcatattttttcaaatctgtacttgaaagttttcaaatattgagttgaaagttttcaaatctgagttgaaaatttttaaatatgagttgaaagttttcaaaatttgtcttacacatttaaatttcgagttgaaaattttcaaattgagttttgaaagtttttaaaatttgacttcaaaagttttcaaatctaacttgaaagtttttaatcggttagtagaaaaaatctttcagaaaaaagaaaattatatcttaattaccgtcattatatatctactaatcacttagttaattagactaaactattggaaacgctcgccgccaacgaaacgcgttagcttttccgcccatagattcccttttcccggcccaattccagcagattggttctcatattgggccacatgggcctccacctccgcatgcacgagaggcggcccacgagtagtcgatccagccctctccagaagcatctcctgcgctgaaaaaaaaaatacaaaaataaaatcaagaaacgaattcgtcctcgactcgtcttcgtcttcgcctcgtcgtccccttcttcaagaagaaggcaacgaaaccgacctcgcgccgcctcccaccttcccgtttcttctttcttgcgccgcaagaacgcgaatagctttatctaccgccgctctcttccactccggctcgccgcgcgtcgcctgcctcgctcccaccgtttccgtctcgccggaatcctcccccctccgcccgcggatacagttgtccccggtcggtgtcgatatggtacgcctcctcctcctcctcctcctcctcctcctcttctctccctcatcatccgaggaatttccagcctcggtgtcccgcacggtctggtccccgggccgggtgttcatcaatgcgaggcacaaagttttccagacctgtcaccagtgtagaatcgagaggcgctgtacaatacgatgatattagttagtagcgtgtgttcgagaatcgagaggaggtgctgtacaatacgatgataaaaacgttgggggattttttttttctgccatggttgtctccgcgcgtccttttgcgatgtggagaggtctctgacttggggagctaggaggaatcgggcattaagtcccgggtggtgtttgtgtggtcaggggaagagcagcagacgccggactgcactgccttgcacctgcggtttatattcttttattggttcatgtgctgaaatctccaattgagttgttcacctttgttgtaatgtcgttgattagtcaggaagtcatgtctagttgctcctttttttggttgaaccaaactgtcctttttatacagaaaagtaaactatgttagtgtggttagtgatcttcaaatgcaaagatgttaaattgttcagatcagatttttagtacgttttgtttgattaaacctgcatcagcagcttatcgttaaagtaaagtttaagaatacgagtctcatgaccggtttcagggtgattgtgggtaacataatgaattccactgtaggggtttggttatattcaatcgtgcttcctaaaaaagtagtcatgtcgcaaattgctcatttagattgttgtgcgactgtaagggatatgatctgagaactgtatcgccttgctcatatagtttgttgttatgtaaggtgttcagtctgagaactgcatcgccttgcatctccagaacaaaaaaagaggtgcatgtttgtcctagcaatatgagcttcagttttttcaattctgcaaattgaagtccgtaccaaatattactgtgacttgagtattgcatctgatcaccatcttggaacattatgtgttgccaacaggctactcccttggtagctgggttgtcagtagctgctgctgcaatgggaagcagatatatgctccaggcatggcaagccttccggacccgtgcagcaatgccacgagtgcggcggttctaccctggtggattcgagagagaaatgacaagaagagaggcggcactgatccttggcgtaaggtgggttttcttctcaattctttgcacctgtagactgtatcctgtgtgatgttttttaaatctcttgttaagcttaatgatcttcagttgttttggtgttaaagagtgttttgccactgtctttggtacttatagaaaccattttcttgtatcagagaacgtgctgcattcgataagatcaaggaggctcacaagagggtaatggtagccaatcaccctgatgctggtgggagccattacatcgcttcgaagataaatgaggcaaaggacatgctgatggggaaaggaaaatctggttccatgttttaatctgtctaaaaggaaacagaattttgtttttgccatgaccatgatgacttgtagtggttcatgttaatcgaccttaacatgctgtgctgattgtaccatagatctgaaccaaaaaacaaatgcaagttactggattgagtaactcaatatcctgctaaagtatattgttcagagcctccagtctgcgttttttttaagcttaggttgaagccattttgaattctttcttgctagatgatggaattgtaacttaggctgtatgtgtttagttccacgtcaaaattgaaagtttaaagaaattggaatgatgtgacggaaaagttggaagtttgtgtgtgtaggaaagtttgatgtgacaaaaaagttggaagtttgaagaaaaaagttggaatctaaacagggccttacttaatgatggcctg

SEQ ID NO: 76672 - DNA, 627 bp, Oryza sativa
tagcctagtatcagttatggaattgagtgaaacctaactgcacaagactgacaattcaaggcatagtccattgttcagttgtggtcaggtgtagctccttttctaggtgaaagttcaacttaacagtcttcaccgaaacactggtatataaaagctgctatggaatagagagcattctcatgagccttgaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaaagaattggtaacttatatcaattagtcctaattgatggatggttgatggttgtgtagtggaggatggttcatggctagttgatgacaattagttgctctattcctcttcctattccattggtaacttacatcaattactcttaattgattggtggttgatggttgtgtagtggaggatggttcatggctagttgatgacaattagttgctccattcctcttcctatttcatgactcttactcttcatctttcaatcctcttataaaaagggaatgg

SEQ ID NO: 76673 - DNA, 76304 bp, Oryza sativa
  unsure (1)..(76304): unsure at all n locations
gtcttacattgtgaaacggagggagtaacacgcagtggcatgattaaaggtgctcagtaacttccatgcaagcagataataaatttagaagaaagtaacctatagcacctcaaaaatatatcggtgtaatcacaaactaaccatgccaaataaaagaagtgcagcgtattatcaccagtagacttaataaactaattgggtattagagaagtgcagcgtattatcaccagtagacttaataaactaattgtgtattatcacgtagttaacagtagggaacaataaaagcttttctgaacatgtttctataacaagtttgaaactacagaagaaactcaagtagttccaggagaaagtaatatcacatggtatggttctattggaccagattcagactagaattgagaacatggaaaaggctcaactaaatgaagtcatcaatgttaagttatacttgtatgtagttatgtagtgtacagtaagtgctatctacccttttcacaaaaccatgcttatggagactacattaggtaaaatcgccactcactcttggcaagattatgtgctaaaaacagaggtaccacccaaaagaaaatcgattttcaaaatcactgaacaaaggtaagccgaggtcaccaagcatggtaaaacaatcccaaaagacaaacaacatcagcaatttaaaacgacaagctttcatttcctcagcctatgttcatatcccagtgaatcattcgaacaaaccattcctatagatgaatgaaatagtgtacataaatgttctaacactgcctatcgaacaccctaagacaagggcaacactaaactcaaacaaaatatgagcatacactaggagttaaacccacgagcacgactacccaacaatgtctctgttctatggatcaagaaaatttactgattacatatcgtaccttaattgcaatactgtaaaaccatgttgtgtacagactgcacgagttaaaaaatagttgccctaaaattactacaatcaagaccttacgacaagtaaaccctactttatctccccaaaccaccccccaagaatccagccaccaaaccctagctaaatcaaccaaagccatcaccaaatcatcccccatcccaccaaccaattcgactcccaagcgcatcacaaacccacacagccctcccaatcaacaaaccctaagcccaaagcgggcagatcgggggccgcgattcggccgggacttacagctcgcagatcttggagtggtcgcgcgtgaggatgttgtatccgacggaaaggcgggtatcggcggccaccacgcagtagtccgcgccggcgatggccacgcacgttctgcaggcacacacacaccaacaacaacccgcggccgtcgtcagcgagagccggaggaaaccacggcggcgggcggggatcgagtatgggggcttacccgccgttgttctcgtagacccagtcgccgcgcctcgacatggccgcgatcggggagctaggtcgtcggcggcggcggcttgcttgctcgggatgcggcggaggagtcgccggagtggaggaggaggaggagagagagtattggaaaggacacgcctcgctgcgttgcgcttttctccacccttgatccgactcccacgaggccatgggccttggcccaacttcgtattgggtctggatatggatcgggcatgggccggcccgtggtttttaatgggctttttagcgagcccgctttccatggtgacggttgcgattgcatttatatcgtcttgggttgaaatgcgagcccccccccccccccaccccaccccgcgtttgaaacgaggaaattcagtttgggattcgatacaaaggccggcggtttgggagagcaccgaaatttggtcgatgaaattcgagtgaaatttaaccctgatgcatggtacatgtatggccctgtttagttccacaccaaactttctccaaacttccaaatttccatcacattacatcacatccaaaattttcctactcacataaactctaactttttttccaaactactttctccgtttcacaatgtaagtcattctagcatttctcatatttatattgatgttatctacttagattcattaacatcaatataaatatgagaaatgctagaatgacttacattgtgaaatgggggaatatcaactttcctcaaactttttctcaattttaggaactaaatacagcctatgccattgagtttggctctactctttcgagggctgctatacgtacgatatgttttgtacaatagttgtacgatgaaacacttctccagtgtttaactgctgtatatttagtcccacatggatagatttaccttgtgtcgctccgcccacatgcatactaaaataaattgcaaagcgaagtagtttatgatgacatgttttgcaaagcaaagtttatattaaaatactaatataaaaaaatacaagagctaaatacatggtcttactcttagacattgcacggaaaaaaaaaagcgactagcgtaacaaagaatatgtttgtgatgcccaaataagatggattaagatggacatacctctttgcatgcagtctagattagtatcgttgtagattagatcagactgtcagtttagatattaacttaggtttatacagcataaataagaaaacaggtaaaagagggcaaagagtttgtaaactttgtatatgggcttctgggccatgaaggacttgtattctcatcatgtatccatgtttccgtgccgtctgtttggttgccgtatgttcgggcatagtcagcgccgtttttttgacaaattgacccttttggaaaacttatttcgaaactaacccctgccaaaaacttcaaccaaaaataggccgtcgcctcagcgccaaacacattggcgctgacgttggccgtgtcaacgccaacgggactggcgctgacattgtgccaccgtggcggccgggccgatccccagctgacgtggcagctacctcagcgccaaccggactggcgctgaggtgggacttggccgcaacccccaaggcccagaccagcaagccttctggatggcttgcgggctaggacctcagcgccagccataatggcgctgaccatgggacactcagtgccagcccacctggcgctgaggtgggacttggccgcaacccccaaggcccagaccagcaagcctgctggatggcttgcgggctgggacctcagcgccagccataatggcgctgatagtgggacactcagcgccagcccacctggcgctgaggtgggacttggccgcaacccccaaggcctagaccagcaagcctgctggatggcttgcgggctgggacctcagcgccagtcataatggcgctgactgttggaaactcagcgccagcccacctggcgctgaggtgggacttggccgtttcggccgtggcccagcccagcaagccttctggatggctgggctgggacctcagcgccaggtgcactggcgctgagtttggacatgtcagcgccatttagcatggcgctgacgtcccagccctgctaaactttagcaaaactttgcacacaacagaggcaaacatcaaatcacagaaatttacaggcagtaatatatccagagaaccatacaaaacatacatccatccatcaatcccaacatcattccatacatccatagaatccatcaatacatccatatatgaagtccatatatataagaaataaaaacatcccatcgatcctcgtctatacatccagtcgagtccatacatccagtccatacatccatcgaaccatgcatcaagtccatccatctatccatccatccattgaaccatgcactcacctcttcctacctctagtgcgaggacgaggcacgtcgggggtgtacctccagtcctgcgaaggagcccgccggcgtcatggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacattgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtactccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggatttagttctagctcgagcacttcctgtgcctgatatggcatccacaccacctgcagcaacaaaaataaaacacattgaagcacatttagtactatatagtaagaaaccatcttcatgtgtgatagaaccccgaatagcttacatgttctggctgtaggtagtccatctcgtttgtgtagtggtagtacgccaaattcctgcggcctactactggagatgggaccgattcccacaggtgagctacagtgggacgtcggtctgcatcctggtgcggccaagcctgatgggtcctccacatgggccgaccaactggaagcctcatccacatccaaacctgcgtcacatacgttagcttccaacatgttagcaagaaattgaaatgttatgaaacataacatgcgtgaacttacctgtagcaaccaaacacagcctgctaggttcgcgtccccgccttgccttcggcaagcatcacagagttgccgatacaaccaggctagggcagccgacccccagctgaaggtacccgcctcatcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggtgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccagtcgtcgaacagtatgtgcgccgtgtgacctctgactcgaagggtcttcaagcgctgcatcaatagacaaacataataacataaagttagcgacaatatatcatatacaagggttgtggaaaatacatcatgcaactaggaactttaattttgggattgagcaagaaaactgaaaagaagatctgtgtgtttacatgctctgctttgaggctcctgaactttgatttgagatatctctatgatggatgatctatctgtacaaactaaaatcaaagaagaaaaaataaattcgatcataaaaaaaatggaatattgttgatgctaacctctccgctggcaatctgtggggcccggtgcttctcctcgtagaaatcctccaaccccggaaagtgctccatcctgcaaatgaaaatggaatcattagtaattgaaaaaatgccagggtgtctatcagaaattatacacacttctctattaggaccgatcaacttgtttctcaacatgttgatgaaccactcccagttggatgtattctccttctctaccagagcaaacgctaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcctggacttctcgggatgagcctcaacacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccgatagtgccatatttgctcaactgcctcgacaatcgctgctggagataaagttggttcagctcgcacaaatgcctgtaacctgtttccaataaaccttgaagtaagttgcaaatgcttgccggttacttccgcactacagcatgtgtggtcttcgcccaccctagtcacccgccacctatctcctccactcttccttgcattaatctgccatttgcaatggcgatcgagacaagccacagtatacttactgacgcattagattccttcacatggtacggccggtggacacggatagaataactctgtagccatattttcagatcatccatcgatcgaaactccaaccccttctttggttcatcacacattggtcgaaaggcnccgtcatattgtggatccccatcagcaattgctagcccagatctggtaagatcctcgaattgtgttatttcggggtttctacccaccagtttcgcaaacacagtcctttcatgctctgacatcttacgcactggacgatcatcatcggagtcggaagcggactcatccaattcatcctctgtatcatactccaaccagcctgggttcaatccactgcgtatcatagcctcctcacactcctctcgggtatagaatttcagcctagccaactcccttaggcccatacttacattcttaccattcgcttcttcctcaggcaactccacatcatctcctacctcccgaccatcctcaacatctccttcctctcttaccggcacattctcctccacattaacttcctcccttaacggcacattgtcctctgcatgtacttcttcccttaacggcacattctcctctgcatgtacttcctcccttaccgggtcattctcttccctgacctccacatccgccatatcatttactccctcgcccccctccacgtcttcctcaatcaattcttccttcctactacacctctccgacagttcgtgacagctaatgggtgattctataagttctttcttccctatcctaccatctttcttccatgcaaacacctcaagagatttgaaatgtgaccccaatactatatctatatatgtttgccattcgatctctccattcaagtctaacataaatttatgtgacatgacaccgccgcccacatcgtatctcccttgcataccaaccgactcatcattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaattttaaacccatgcataaacattaattacttgaaaataatatgtaattaccattgcaataccaatacttcaaaagctaacaacatgtctaatttttccaataaataagtacattactcaaatactacacattatttataaaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccattccaaatatattttgtcaaatgtatcaataacaaccaaatagataaagatatgccacttccacacttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgtcgcacaaatcaccttcgattagagaggtttttgggggagattgggcgaggagaacacggtggcgaccgaaccctaggcgggcggctggggaaaaaacggaggaagaactggctggggcggcctcggccgggctctaagtagccaaggtcagcgccaacttacttggcgctgaggttgggcacctcagcgccgaagcggttggcgctgaggtagctgccacgtcagctaggggatcggcccggccgccacggtggcacaatgtcagcgccagtcccgttggcgctgacacggccaacctcagcgccaatgcgcttggcgctgagccgacggcctagttttggttgaagttttcggcaggggttagtttcgaattaagtttttgaaaagggtcaatttgtcaaaaaaacggtagtcagcgctcgtttttggtataaattgttatactaatctattagcatattagataataatagtttagaataatgatggtagtagataaggttttattttttctgtgagatttttttaactaacaaattaaaaagaaatatacatatgaagtcatagtttcaaaattttaaatccagatttgaaaactttcaactcgaaatttattttttttaagtaaaatttgaaaaactttcaactcaactttaaaaactttcaacccagatttgaaaactttcaactcaagatttgaaaactttcaactcggatttaaaaactttcaactcgggattaaaaactttcaactcggatttaaaaactttcaactcaaaatttgaaaactttcaactcgagatttgaaaatttttaaattaagattttaaaaattttcaagtcaagattttaaaactttcaacaaaaaaaattgaaaacacttactgctggaagattaaaatgtaatcataaaaaaacgcaaaaaaaaagaaacagaaaaaaaatcacggaaaaaaagaaagtgaaaaaaaaaagaaaacggtggtaggttagagaagaaaaaatcacgcgcgtgcgccgcgtgggccatatgagtcgggagtgcgtgctgccggtgtccgtgtgcgaattaggattctcgcgtccgttcgtactaatttcataagtgagaatcgtacgtgaagcctactatttcccccggccaaaaaggtgacattgcaagtattgataaaaataacatgcaccccaaattatctacgtgcacttaaaaacttgggtagtcatctgtggtctagttggtatagtgttgtggaacgagatcctctgactttgtgaagtcagagaagcacagtaccttggctttgatccattctcacccgtagcgagattaatcgatacagtactgctgtttttcgcgtcaacaagtacgctacagtatcagtgaatagtgaattagcacaatggtttttactgttttgtattgttgctacagccaaaacttcaaaacactgttatgtaccatagcaccaggcttattttactgtgtttatctgccgttcgcttgcaaagtcaaagagccggatccgtaggtgttgtacatccacgatttcacgtcatgaaccaactaaactctgcttttgatacaattgatcggtatatatactacacgccaaaaatctccctgcagtttttagtaagcgatgccattaacttttaaacatatatttaatcgtgtaaataagtcatacttgaaatatatatcttccatgataaaccaagttaaaaaaaactgataactacataacttttttaaaaaaaaaagaataatctacatattaaaaatcatctattaaaaacctaaggaacttggtcaaaactccggttttcgaaagctgctaatttaattcaagcattgggaacagtggaacacactgcctatgaatcgtactgtacattgatttgcttgtaccttgtattgatttctgcatgattccttggtttctttttttacacatttacttttccttcaccagatggaataatacacaggaatactagcctaagggcctatttaaatagcaggaatgaaaaaaaaaattgaaggaatagaaaaatcacataactctaacaagaatggaagtgattgaagtgtaaaatagataattgtaaaacacagaaccgtttgattgaatcgtggaaaaaaaacataagaatcggatgagaaaaatatacttaaagggaagtttcatccaaaatctctatagaattgtccatttcatatgaattttttttacggaagttccatatgaattttaaaggattggatcatttaattcgaaggcatttataggaattttttcaataaaattaaaatccttcaaaatttctattttttttctccgaattaaaggagcctaactttttttttctccatgcatgatgcatccaccaccttcctgacctctccctctatatacacaggcgccaccaacaaaaggcacaccaaaaaaaaatctcactactgatcatcacattcatcagtggagtgcagctagctagctagagctaagccaatcgagatgatcgggtggggcgacgtgtacaaggtagtggcggccatggcgccgctctacttcgcgctgggcctcggctacggctccgtgcggtggtggcgcctcttcaccgccgaccagtgcgacgccgtgaaccgcctcgtcgcctgcttcgccgtccccttcttcgccttcgacttcgccgcccgcatcgaccccttcgccctcagctaccgcgtcctcgccgccgacgcgctctccaagctcgccgtcgcgctcgccctcgccgcctgcgccgccgccgcctccacccgctgctgcggctccggcggaggcaagcgcggcggcggcggcgggttctcgtggtgcatcactgggttctcgctggcgacgctgaacaacacgctcgtcgtcggcgtgccgctgctggacgccatgtacgggaagtgggcgcgcgacctcatcgtgcagatctccgtggtgcagaccatcgtctacttcccgctgctgctgctcgcgttcgaggtgaggcgcgccaccacggcggcggcggcgccgccgccgccgccgacggggaccgacgacgacgacgtggaggacggcgccgccgcggcggcgacggcggcggcggcgaggcggtcgctgtggccgctggtgagagcggtgtggctcaaggtggcgcgcaacccgaacgtctacgcgggcgttcttggcgtcgcgtgggcgtgcgtcacaaacaggtgtgcctacgtaagcgactgcatgcatgcagaaattctcgttttgtccgagtctctcattttactaggtgattcccgcgctttgctgcggaagttccgaagtaacttttaatatgtttttaacagggatggatccagcgtaggtgctgtgggactcgagtccccctaccccgcttaatcgcattagtaattttatgaatttgtagtagtaataaaccaacatcattatcaaaacaaaatcagtttgctggaaatgtaagattctctagtcaaaatgttagtaaaaaaacacattaaacaggccataggaaaatgtttatatatagcctactaactgagctttctttattaattagtactctataaaagggacaatcaaagtggatcggaacaaatacaaccattgttagtggaacggctgacatgaacttgtaaaccatatttttgttaattaaagtaacttgatttgactacaagcatctctcatgtttgccccatattaatcaagaattgaatacaagtaaagcaacacactacttgaatatgtattggacgacagtccaatcaggcacatatatatggagaacaactttggcaatttgccataaagttgtctgattcaaatcaggagagaatgtttgctgcaaatgatcagatatgtacctttaatcaaccccccccccccctgaaaaacttgcatattacgcttgtttaggctatggcagattattccaagatcctgttcccaaatcaaacgatgaattctcgagagatttgcagggaattatctttatttgtggcttgatttattgtgactgtcgttcttgctttgcaggtggcatgtcgaaacgccaagcatcatagaggggtcagtgctgatcatgtccaagaccggggttggactctccatgtttagcatgggtacgtaattaaccaattaataatcagctatcacacgacttgatcattcctaacttcttttataataaatatgcagattaaattttttacgtaaaatgatgtggtattaacgtatgattgattgagttttaattattacaaactaaaaaaataaattaatataatattttagagcaactttcatatataaagttttcgcacgaaacacaccgtttagcggtttgaaaagcgtgtcacgaaaatttttatcttcatccaactcttgttggagaaatgaacgggacctaaggactaatgaacaagaaaacgctgtactctcctaactgaaatctgcatttgatttgtttgtgtttgtactctcctgtactgtgcaggtttgttcatggcgttgcaggacaagatcatcgtctgcggcgccggcctgaccgtgctgggcatggcgctgcggtttgtcgccggcccggccgccaccgccgtcggcgccttcgccctcggcctccgcggcgacctcctgcgtcttgccatcatacaggcatacacacatttacacgaaattcattcgccaagttctttttttcttctttcacctgaaatttgtctgaattcaaacggatgcatgcatgacacaagtcctcacgatgaaactgctcgtgatgaacaggctgcgcttcctcaatccatcacgacgttcgtgttcgcaaaggagtacggcctgcacgccgaaatactcagcacagcgtaagtagacaatcttatatacggtttaactggatttcactgaacttctttagtttgatctgcttcagtaccttctgtcaaatttatcttccagggttatattcgggacactggcgtcattaccggtgttgatcgtgtactacattgttctaggcttcatacgatgatcggattaagtttttttttttgtttttgttttttggcacgtcagaatcagagtgcaatgcaaagtagcatggcatgccatcaagctttgtatcactattgatcgagctatgtacttacagaatctgtacttctgatcttaggtaaataatattaagcactatttactcgatgaatgatgcaaaaaaaaaatctgatgcagcaactgcaaatcaaagtacaatagtacccaaatcaatagctagatacagtatatgtgctctacagtggaagaagagttcagaacttcagagttcagatacgaacgccatctcttcaacctctgacatactcctaatggacatggtaggtagcatctgataattaatgccaattaagcagcaccaaaaattgttcggattccatatattgatcatctgatactgcaaaattttgtgcgagtggtttaacgagcattgagtaagcttgcactcatgcatgtttcttcagattcgtgttccattttgtgaagtgcctctgaatttttgtggcattaattattctggttgtcccagagcatcgatcaagctagctacttctgccattgttggccatcatcgattctcttctcgaccaagaataatacttatcactttccacaaatttgctttcgcttggccttaggacaaatgcgttttttttttgtctgtcaggacgtcatgaattgacatgatgccatttgatttgaatgttgaaatgctacaagaatgacctgtttggaggagctttaaattctgaaaagcagctgtttggtaaccaacttctgagaatttggaaaagctctgaaacccagattctcagaagctgtagactgtttggggcagattctagcagaagagctttttggaaaaagctgcagctaggacaagctctcccaaacagggccaattggcttctactccatcactaagcctcaaattgatttgaatgttgaaatgcctcaaattcattgttgacgaatccttgtttgtttggggtcagacgaggccccgacaaaattccaaaatcatctggtaaaacattggtacaattcaaggttcacggtgccatgtaatggatctgactccaataatatccttcgctgctagcttcatccctgatatatgataaatgaataaattacatattggatcactttttataatagttttaatttgaactatcttgaactaagttttcactttttttagaacaaagtttttactttggaccggataatattttcttctttgttacgcctatttccctttggaccggataatatttcctttccgttacaccctgggccacccacatagttctcctttcacctcccctcgcgtgcctctatcattgttgcttaaccagtggaactgcatcttagtggggataattaagggctgctatgttccatttattgtatatcccgagtgatttctccactaagatggaaaatggaaatggattgttaacccgacaaaaaaagatatgaactactttaggaaagcaaaaggagtggtgattatgcaaaacttggtgtaatttcacatcaacgtagaaactgcattgacgaagccacctaatttagttattatatatatagtgcgacattgggtggctttatccattctaggcagcaacttccaattaggagtgttattgctaattaatttgctataggcacaagtgggtgtgggctttttgtttatgctgtagaccaggcccagaatagcccagagtaattaagcccatggtggctaaaacccggctccaagagcccaagacaggttgcccgcaagagagatatgaatctaaatatttttttatattgaaatttaaatcttgagttattattttcaatagtttgtcggctatgggaaatcctgatgccaatattttcaatagtacatgtcaatatttaaaatttagggaaggatcgataatatagcggtaaggttatggatgcatgattatacccgtcaagatttaaatcatagcgctcatgaatattacgaacacattggtacatttttaataagatttaatattaatcttgtattttccatgtgtgttaagggtattcacaaatgtgagtgtggtgtgcatacgcagtgtgcaccagtgtatgcgcactatttataatcaagaaaaactagaattgattgttttttttgttatatatagtcatattacttgttttttacatgtattcgtatgcttcaaattaattaccgttacagatttattgtaagtcaaacatttcagcctcttatcattattttatacaaatttaacattataagatttttatttttacattcgttatcagaaaaactttcatgatgtataattcacttgttgtcaaactgtatggattattaaaattaatgataacgaattagagatagacatgattgatatagtacgcacaataacaataaaaagtttgaaacgaatggaatatttaacttctctagactcccttgttttctcagacgagatgacaaaaaactgtccggaaaatatcctgcaggggcgtaatattcggccatttactacagtggttaataatacaccaacaagtcaacaacaaaatgcagttagcagacagctgcgcaattacgttgcgtgtttgcatacaaaccgataattgattaacaaagttaatgatgcaagcacaggcgttagctgcaaccgtaagttgacttaaatgagaaagaatttgagatcgaatcgtttagtcgctgtcagcatgtgtaccacacctctcccgtactgccggcgtgctcagctaatgctcgaagcctcgaaatcagcaaaaaggattaataaaataccatttactaaataaactacaccatgtaagcaaataactagtaataaaatgccgtctgaattggtttgattggtggggaaaaatattaaaattatgtaagatttggatcatattagaaaatttctcctatttggtgctttaaaataaagctccaagaatcctatgaaatgctcaagaaaaaaaaaagataattcgaaggaaagttagcatgacgttgaactgtatgaaaaccttttctttttgagtctttttattcattctttaagagtgttcataattatattattcctcttatattttctctctacaacttatatgaaactaaaaattcttttagttttcatatactcattttttttgcgggaaagtttttttttaatatactctcttcctacaaatcgaatgatacttatataaattaattattaaaaatccaaatccttttttttaaaacggaataaacccttaccgtatcatacggttaaaaggaccctcaaacatttaggatatttaactatttattaccactcttatatatgataattaaccatttatcacttagatccacatgttacttatgcataaggccccacatatcattgacacatggttgccaaatggttaaacgccaaatctaagagttaaaataaaaagttaaatgccccccaattttagagcggaaatgctactaggagagccctcgcccgcccagagcgatcagatttcccaccccctcccttcacctggttttcttttttagcatcgtattacttttctattttagtaaatttatgtacctaaagtttatatacctcaagtttacacatctaaagtttagagaccaaaagtttataaatcaaaagtttatatatccgattcaaatttgaatttgaattcaaatattttttatatatagtatttctatacatctaaagtttatacacctaaagtttatataactaaagtttatatatccgattcaaatttgaatttgaattcaaatatttttcacatatagtatttctatacatctaaagtttatacacctaaagtttatagacctaaagtttatatacccggttcaaatttgaatttaaattatatccgattcaaatttaaatttgaattcaaatattttctatatatagtatttctatacatataaagtttatacacctaaagtttatagatccaaagtttataagtcaaaagtttacatacccgattcaaatttaaatttgaatttaaattttttatacataaatttttctaactttttattttttaaaaacttttttatggtgtactgtagtaggaagagaagaaagggggaggaaggggagaagtgggaggagtgcctacagcggagtggggggatccaatcgcctggcgatcgatcgcgcgttaggccccccattttagaggcgttttctagtcagtttgatgaaatttgagcaaaaaaacgccgtagcctgacagcctcccctccccttcgcctcgttcctatcgcctctagtgcccaccaccaccccccaacgcccccgccgctctcctgatatccactagtggccacgccgcgccaccccctacccctcgccacgccgcgccacgccacgcctcgcccatctcctccctataaacccccccgcgcccccagctgctcgggcggcggcggcggcggcgcgaactcgaatctcttctgtccccttccaccaccgtccccccacaggagatgctgcgctgccacacgccgccgcaatgccgcctcggcgcgggcggcgcgggcgcgggggtgctgctgaggcagcggagcgaggtggcggtgcggtgccgcgcgcagcaggtgtccggggtcgaggcggcggcggggacaccggcggcgcgggcggcggtggagggtggggagaggacgagcctggcggagcggctgcggctggggagcctgctggaggacgggctgtcgtacaaggagagcttcatcgtgcggtgctacgaggtgggcatcaacaagacggccaccgtcgagaccatcgccaacctcctccaggtgcgccccccaccacccatgccgggattcctccccgtctcccaaagctactcttcgctggtcagattcgtgctctccgtggctcgatttggggtggagtcctctcggattgcgaaatgtgctgcggccacggtttgtgttgggggggagtggaagcatcgtcttcgttcttgttcttgatagattcggtggtttggatctgaatttagacagctccaatttctccgtacaattataatccgacctcatttgctgtgatgtgacaagatttagtaatactaactttcctcaaatccgtgggctatcatttgcgtagattgagctagagctttgataaagtcaggttgttctagtcttattctagtcgatgtcttttttgcttttatttatattttctggcaattaacaaatcctgagccggcgaaatcgcccatcgaaatttcatgggcatatgcttgcattcctaggtggtatcacactcctttctaatgctgattttcttgtccatgtgtaaatataataaagctataattcctgaattattatgcttaaatacctgataagtacttccaataggggttgtgtatcatgtcagtttaggtagttctgttctgtgtgtctggatgaatgtgcgtggctgttaaaaaaatattgaaattctgatttttgagttctactttggcatcaaatcatgcaaacaagtcaaaatatgactgggcgtatatcgagctagttctggtggaatatagtggattgaatataatcttgatttaaaaactaaggcagtatcaaatggaatgcttttttttcctgaaaacttctgatcattgaatttgaaaaattgataaccagtggtaacaatacgtgtttccgcgttccagaaaaacaataagtgtttctgcttctattagcatttttcttagctatcagtgttggctttatttatatgaagaacactgttgagaagcatctcattattttgtttgtactatgagcttttaatggtaagatttcttgtaaatgcaggaggtagggtgtaaccatgcacaaagtgttgggttctccactgatggttttgccacaactaccacaatgagaaaacttggtctaatttgggtgaccaaccgaatgcacattgagatctacaagtacccagcatggtaagttttcaggattgcatcgaacattgctcccacccttgtttttttagcaagatctagttctgactggtggttctgctctggtcaggggtgatgttgtggagattgaaacttggtgccaagaagatggaaagatcggtactcgtcgtgattggatccttaaggatctggctaatggtgaagttatcggcagagctaccaggtacttattgctcaagtataagagtattcataattacattattttgaaagtggttgcctgatgtgcattcactcaaccatgttgtgcatgctgggattctgaataggtattgagggggtccactggtgatgtcttacatgttttaacttaatatttctcacctctttacttttctccccaccttatttccacttattacacctacacttctccaaatgaattcaaccaaggtaagcctgtaaaataggaaaactcaggtactagattttagcaatctcaaaagagagcgtgaatcgaaacactggaattttttttaatgcccaatgatcttggtgcttgtcttatgcttgaatgttcttacacttgctggctggcaattgtagcagccttaattattcgttcttaatgagtgagacctgctaatgattaattggaacttagtagtttgtactgaacgaaccgttctcttttggtggaaaacaacaaacattttcattatttagtgtttacagtgtaacacagccatatcttcttgtttgtccagcaagtgggtcatgatgaaccaaaatacacgcagacttcaaagagtgagtgatgacgtgagggatgaggtttttgtacactgtccaaagactccaaggtaaacctcctcttgtactcatttagccacagttttcttgcacatgcacatttttgttgctttgatgcatctctgtttttactcttcaattgagccacagattccctttctttaacttggctctgttaaacacacttggatacatattcagtggttttgaattactcgagaatcagaagaatatgttttctttgtattcgtagttgcaaataattcattggtagcttgactgaagattgtacatgtattttctcaaatgactgttatggtataataattattgtaacaagctaccattgtgcagattagcattccccgaggaaaataatggcagtttgaaaaagattccagttcttactgatcctgcacagcactcaagactaggcctagtggttagttctcgtctcagaatgcggttcttttgctctgtccctaaacaattctgtgctgacatatattaatttctgtattgcagccaagaagagctgatctggacatgaaccaacatgtcaataatgtcacttacattggttgggtacttgaagtaagttttccattatctcagttttgctaccagttaactgttcttgcttcatgtgacaggctgacagccctctcctggctgtaatcttactttgagcagttatcatccttgttgatttgtgatgatttctgatctctttctttttccttctaaatggcagagtatacctcaagatattattgatacacatgagttacaaacaatcactcttgactacagaagagagtgccaacatgatgacatagtagattcacttacttatatcgaggaaggagaggagaagagttccaatggatccgcatttgctgcaccgcacccagaagagcagcgacagttcttgcactgcttaagatttgctgggaacgggaacgagatcaaccgtgggcgcaccgtgtggaggaagctagctagatgaattccctagttttgatcatacagtcatatgtattctgatccttccatttgttccatcattttgctcttggtgtctggcatagccctttcagagaatcggttgtaccccaaattttgtgttaatttgttacctttgtaatgtaccgtggtaacaattacagtttgtgacattcgtcttacctgaagttgtgcgttgctgtatactttgtactagtagaatcagtgtttatgaatcttcaaataattctatcggcaacagatagcaatggcatgccaagtttggttcttcctgtatagaatacccagctgctttcactattactatgatatctcagtgataaaaatgtctgttttatataatattataataataaaacgtgtgcatgatatgttggatttagaaatgttatgcagcttttattgtttatcatgtcataagttttgccatttaatttttgcaagtctctatgaacaattattcaaataatagatttataaattactctatttgcaagtgaacctttgctcctcatttgtggattatatgacaccgcagtcaacttgttagctgttatttgtatattgtgtttagttatgcccctagatctttgagggatttccttagattggattaatggtgagttgcttcgagctgaacttattactgattcttcttttcttcaggtcggtgttttcttattcttcctccattttacaatataagacaatctagacatatgcatgtgtttagattcattaacatctaaataaatgtgagcaatgctagaaagtcttacattgtgaaacggaggaagtagcctgtaaataaaaggcataggcaagatacctagcactactaaaactttgtaaatcaaaataggagtaacagctttcatagtttttcctgttgcaacgcacgtgcaatcatatgcacaaaactgctgcaaaaactacgaaatcttcaaaacatccaacggtgcatagaacaagcacaaatattagctcaggaaacggaccatcaattaatcccaaattcaggttctctttgagaacacacaaacagtaccatcaccacaagggaccatcaaccaatcccaaattcaggttctctttaagaacacacaaacagtaccatcaccacatgggaccatcaactaatgccaagttcaggttctttttaagaacacacaaacagtaccatcaccataaagagtacagacgcctaaagaaacacacaaacaggtttacaagacaacatgaaagctctcatactacaggagctggggatatatacagtctccaattctcttaaccatggagtaatgtttgatctgagcaacctccaaggcgaaaaactccctgatatgttgctgtatgtttcatgaagcttccctctcctgcaatttcatcaacaaggccacaaggagttcagcgtaacatacaccgatgttgcctgccctcctcatcacatgatgaattcatgacagtaaagcgttctgggtacttccttagtaggtacatcagcttgagccacggtttgcattctgttccagctgctgaagagccagcctctggtgccaggtgcatctggacctggcgctggggccatgttgcactgtaacacgcaacgagctgcaaataatcacagatcagttttcgcgttcatgggtgcagcaataatgcgaaataatgtacttcccccatcttaatgaattcggtcgccgttccttcggccgacccggcaaaaaaaaaatcataataatgtaacaatgtcttgttcaagtttctattaatggcagctgaagtatctaactaattgggaggatagtgacaatggtacaattggcaggcaccactaacttgtaatatgctgagtagtcacttaatttagtataccactcatgtaaaatgattgatttaaatagcaattcgccaattccttagtggaagctcacaatcctagggtcagtaccacctctcaagttgacaaagacacaaagtatttccaaactagtgagtaatgagagacactggatatttccaaaaggtcgcgagcttatttcatgacttccacaacatgttaatctgaggatacggtagggcatatcaggtaggtgaacatttcacaactaaattggacattgcatgctaaagagagtttataaaaaggttatttctgcatgcatgcaaaaggcagaaattgacattgattaccagatacagcaaggttttactttaggctatttttagacctgtgagtttatgcataacttctggcacaagtgatgcgaccaggggtatcatggccacatcaacaaggctatcgaaggatcattgaacttctaagaatgaggacacatgaatgtagttacccaaatatttctgttcaatgtggaactaaggacagtgcaactgatgaatatacttggtccttcagtgcaaagcgtagcctgatgacatatggaaatgaaagtaaatgcctttttctgtatatggatgctagggaattgtttctttttttttctttgagtagaggaattgtctattagttaacaaattattatttctcaaaaatgctgatactttagtgcaacatgtacgaaaggaaaattaaagtgctggataacacaacccacattcctgcacaaaacatatctggaggtggttacactaactttctgaaataaagagacactggacagaaatgagtactcttccacaacaaacctctgaatggagtttttcaataggaatcatctttttaagaccacataggtcagatatcacgattccaatagatgcgagaacatattcctcttcctttagaaggacctcctgctggtctttattattgtctgctggtcttattgctaaattattgactgcataaagaaaaataagctagttaggcatatctacaaataaaataagaaatgtagtaaaaactgatttcttgcatatctgaagagcataatgttaacaaaaaaaataatacaagtgaattggcatagcatgtaccatttagtctagaattatgtttcagtgtatccacaattttgcagaaaaaggaaaacaaaaacttgtagtatcccatatttgttctgttaatattttttttaacactttgcacaactctgtattgaaaaaacaagcagtgaaaaatttaattattccaagagatcaggatcaactaaattttgttataacaagggatatcataagacaggttcacataatcacatgatatgacaattggaaaatcagaaagatagcattgagaaggctagtagtcttggacagttctgtgcatggacctctatttgtccatctctaaccattagtttctgtaatcatgagagctaattgtttatcctctactacagtgggatgcaacgtaaaaatcaatataggccaaagaagtgatagtattattaagaagtaatatgatgccatttcaacctgataagaacaggggaatgtgtgccaacgactgccacaaattttttttggcatgcatgcctaaggatatgcgaacaaaatctgcgccactttggcaagcaaaggacatacttgccacattttttttgcatcaatgacacatgggacctaggtgttaaaaaaatcttgccactagtgtggcaataaccaaaaaatgcctaaatcagtgaaatttgtctaattgaagtgtgccaatatgtggctataaataaaacaggcccataaattttattgtctgtatgagttggttgcatacactttgcagcagaaaaccaaaatttgaactacataaggaatagaaaataagccaaacaaatcctcatgcatgcctgattatttgctttacgattcatctgaacagtttttctgagaagtatgatttccagttttacgtttcctatttgaaattgggtatcatgccaggtaagtaacaaaagataattcacggaatcaggcatatttatcagcatacatatgccatgaatgtgtatactactgctacataagcccatgaatgtgtatactacatattccataaatgtgtatactacatatgccatgaatgtgtatgttgcatatgccatgaatgtgtatattacatattccataaaagatcctaattacaaacagactgattatacacattcaaacttatgcagatacaccaaggtggcactaccatcaccaccaggtgtcattcataaaagtaaatacataaataaagtaagataggaaggaatcaggtctagcagaagaatgtgtcaaagacataccaggctgaccgccaggtgctaatgttggctcaattgtgatgtggtggctgctgcatgtatccaattcaccaaaaggcatcttgttttgattcatgaattcctcttgtgtttcaatgccagctatattttcattttcagcattgttctggatatgagcaggaggaagagtgacgatgccaatttgaccaggttgagcagtgccaatatgaggaggaggagcggcggtgccaatatgagcaggctgagcagcagcacttgcagtgagattatgctcatcagcagcggtgccattgttagcaggctgaaaagcagcagaggcactagggccatgctgattagaggaggtgccgaagatagatcgagttggcaggagaaagtagaatttcttatgtccaatctgaaggaggtcttgggagtccagtttaataggactaccacctggaaggtgaaggacaccttcaacagtgcatccacatttaccaaggactagaagggaaaaccgcttgcattcaaaatcatagaatatgtgtgcgtgatggcgggaaatagtaagatctccaccagagatgtcaagatctaccttttctctcttgctatcgcgtcccaagatgattgaataagtttgcatgaagtactcgaaatcttcaccttgaagctttgcaaatcctacgccacgattgcgaccagcagatgccataacagaaatagaggaagccatcttcaatattcctggtagtagcagtacactgagtgctactgcctttcagtttcttctacaaagtaaaagcaaggcggatgcattaaaatcctttcatgttataaaaatgaaatggttcaaaagatgctaatatactagacaaatgggtactatcggttctttttattgtattactagctaaatgcctgtgctttgctatccatagaaggaaaaaaatatcataatattttctaaaataaataaaagcatattttccatgaaatatgttacccacattttcctatagggaaggctcacattaatttaattttataatgtggcatgtttgtttggcatactcaaattgtcaaagcttgccatacttttttagctaacagcctaacatgcggctaccaaaattgaagccacactttagttcgaagagagcaaccttgccacacttttatgtgccaatgacatctgggacccatgtgatgatgaaggaatcttactacaagcgtggcacgaaccaaacagacacctaactcagtcaaacctgcctaacttgaggcaaattgtggtagtgaaccaaaaaatcagaactacaaggcacattacatgcaaaggtttggtagactcaaactgtgacaatgcacattgacactaaaaatgagaaataatcaaagtgtgcaaaaactaggcacatattttagtgacatatgcttgtctaaccaacctttctacctcttagtatgtggttttaagtaaacatagcggtgtactatagaatggcattgactggtatgaataaaggatagctatgatacatcatgtggatatttttcacaactaaatggactcaataccctatgagcttcaagaggtaatagattaatgaagcagtaaaacattatcacacaaaactgacattgtttcaaccaacgaaatctaggaactgcaatgaatttttatttgtttacttcttcagcaatgtatgatggtaaagttctacataggatgtattcagagaagccctcaaaaggctataattatttcatgaaattgatccaagtactcaaaaaaatgcttccatgtgcagccaattataaatgatcaccaaaacagtccaactcctctttggacataatgggcatagatcaagttaatcaatggacacataatggccttgtgtatcaccttttaggggtgtgtgtgtgtgtgtgtgtgtgtgtgtgtgtgtgtgtgtgttgtgtgtgtgtatgttgtgtgtgtgcgtgtgtgcgcgcacgcacgtgtgttctgtggggaggacagttttgttactctcctttgtaattattttccttttttgtttcttcttaatgaaatgaagtgtagttctcctacgttttcgagaaaaaaaaagttatcaatattgagattgcagaaaatatacactaccagatagattaatgcactgtcacaaactagtgcgatgaaacatacatttcaataaaacaaatgtgtgtgttgctctcatgtgcagtcaactataaatgatcaccaaaatagtccaactccactttggacataatggcatagatcaagtttatcaatattgagaatttttttttgcggggatcaatattgagaatttgagattgcagaaattatacactaccagatagatcaatgccctgtcacagactagtgtgatgaaacatatatttcattaaaagaaaatgtgtgtgtgtgtgtagctatgcccttgttcttaattcttctacctcacttgctgagttcttgcccttctgaagttcttagcgaagatcacacccattaccactaccacataaaaccaattggaagaatcaagaatattcctcaagcaagcactacagtagatgccaatctatgacgaatatttggaattattttcaagacgcagctaaagaaaaaacacggtgcaagagctagatgaaggtgaaagagatatacttagccaagctctcgcgattcctccggagagcgcaaagatcaccagtcgctgcccgagatgagtcagcggctgagcgagagaggaggatgtggaggcctccccaaatctggctcaaaaccctaaggatgaactcctttccactcctcgatgctgcatttaaatccaaaaatttcagttacaattttctcaccaccttcatgatgatttgcgtgttctactccgcccacaggaaaacccctaaaaaaaaacccaagaaaaccatgagatggccttgactggtatgcataaaggataactataatatagcatgtggatattttccacaactaaaaggactcaataccctatgagcttcaagatggtcatagaataatgaagtagcaaaaacattatcacacacacaactgacattttttcaatcaacgaaacctaggaactgcaatggatttttgtttatttacttcttcagcaaagtatgatggtaaagctctaaatatgatttattcagaaaagctctcaataggctataattatttcacgaaatcgatccaaagtactgcaaaaattgctttcatgtgcagtcaactataagtgatcatcaattcagtccaacttcactttggacataatgggtatagatcaagtttaccaatattgagattgcagaaaatatacactaccagatagatcaatgccctgtcacagactagtgtgatgattgatgaaacatatatttcattttaaaaaaatgtgtttgcagctatgctctcgttcttaattattccatctcacttgttgagttattgctcttctgagaaaagaccacacccagtaccaaaacctcgcaagactaattggaagaatcttcctcacgcaagtactgcagtagaagccactctatgccgaacaattcagaatataattttttcaatacacaactaaagaaacaacagacatggaagagctagaggaagaggaaagagatatactttgtcttaatgcattaaagaagaaagagagaaaagtttaagtgcagttacaaggcgcattacatgcaaaggtttggtagactcaaattgtgacggtgtacattgaaaccataaaaagaaatgatcaaagtgtgcgaaaactaggcacacattttatggcatatgctcatctcaccaacctttctagggaatataccagaactgtcacttaaagcaaagacaataatattgatgcagtatccatcgaattcacctcttagtatgtgattttaagtagacatagtagtgtggtactatagaatagccttgactggtgtgaatacagcatgtggatattttccagaactaaaaggacgcaataccccatgagcttcaagatggtcatagattaatgaagtagcaaaacattatcacgcacaaaatgacattgtttcaaccaaagaaatctaggagcttcaatggatttttatctgttaggctataattatttcatgaaattgatccaagtacaacaaaaattgctttcatgtgcagtctactacaaatgatcaccaaaacggtccaacttcactttggacataaatggcggcatagatcaagtttatcaatattgagattgcagcagcaaatatactgcacggtccctagcagatagatcaatgccctgtgacagactagtgtgctgaagcatatacattttcatcgtaaaaataaataaataaataaataaaagaggacatatgtagctatgcccttgttcttagttcttctacctatcctttcaaaacaaaaatagtctgcctcacttgctgagttcttgctcttctgagcgaagatcacacccattacctctaacacgcaaaactaattggaagaatcttccacaagcaagaactacagcagacaccccaactctatgccgaatgattcgaaattattttcaacacgcagctaaagaaacgacacgatgcaagagctagaggaaggtgaaagagatatactcagccaagctctcgtgattcctccgaagagcacaagatcacccgtcgtcgggcgtcgtcgtcggcggcggcggaggatgtgagaggcctccccaaatctggctcgaaaccctaacgatgagctcctttcccctcctcgctgctgcatttaaatccaagaaatttccgttgcaattttgtcaccaccttcctcatgatttgcgtgttctactccgcccacaggaccccataaaaaaaaaaaaaccaccccccggattgctgcaaccttcatccaatcgcaggcgcggagcggcggcgagggaacgccgccgccaccgccgctccggcgccccgctcccccagctcgcccatctcccaccttcagccgcgcgcctggccgcgcgcgcgctgctctcgccgagcccgacctggagcgagcgcccatttgcggcgagctcgcgcggcggaggcggcgcatgcgaggtgctcggcggcggaagcggaggcgttcgcgcgttcgcggagagttttttttttcctttttgatgatttttttttcgaaggggagaaggctgcagctgtgtggctctgtagagagagtctgcccggtggggccatggagtcagtgagatgaagattcttcgtggctatcgtcgtcttcgcagccagcgaggttcggcgagaaagccttcggcaatggcgaagctcgccgttgctcgtgggatgatcaggggcggaggtaaaacaaaacgaagagggtttcactcgttttctttactctaatttagatataatttagtttgatacaaatgtttaagtttggatgacaggtacatataccgtgaaattagataaaatatattaaaaaaagttatgaaccgggttcttgtacaccccatgagacggtggcgtgagaagaaattgagtgcacaaacacacctgaacttagaagaaatcctagcttgtaatgtatcatgtggatcggtcctatttttttcgcttgtgtttattcatatcttattaccagctaaaaataacttgagaaacttagcaattgaaaaacaaaccatgtaaaatagtctacgataaaaactataaaatcaatttcaaaattaagttttaaaatattcaattttggcttaaaagtataaatataaacaaacatatgagcctctagatagattacaaatggagtaggactaaaccataaacgaacaaatcagccttagatagattacaaatggaggagggctaaaccattaagaataaaaaaaagggctacataattgtttttgttaattttgtttgaggaacataaagacggcctagcattgtttaagaattgtcggatcatgcatgtaatttgggaagaggtcaacaaggagatatactatagtagacaaaattaggactatatttgtcgaaaatctttaattgattgttgggggaaaggtacaggccaaggaggaaaaaatatcaaagggaatgaaatcgatgttcattcttattacacgggaaaaagccagagtggatgtaataggatggttttcaagatgccaagaagttggttgcggagagctgctcggtagaataactgatgagctcagatcattgagtttgcgtggagcaaaaggtgatgtgattttttttcttcctatattttcactataaaccgatgtacataaattgatacatcttcttactataacatcaacaccctattggcttggttttagaaaagagagctggtttatcatctattttctaaaatatttatgtacttgaaggattagctggtcaaaattcatacgagtatgatacccaattcgaccaagcgttctttattttattttatgttcgacgaaagaagagggatggattaggttaaaaattaaagcatttataaattgtaagggattgcaagcgaatttttggtcgtgaacgtatttataacaatggcaacgtagattctttattgtcaatttttttcattgtttgttataagtagtttatgtaaaaatgtttagctatgagagcgggaattatgtgacagttagatcatattattatgttattatagagttcttttccgcttaattttatatgcatattacttgtaatcaatagtgttatgttacctcggcttaaattgagtctttactaactaatccaaccatacagtcatgggtttaatatatattcattgctaactttaaaaacctaatttcacccgttggttaatacacatatcgtcatggtatcgaaagaactagatacaaccatgcactttgtagcgatatttatagttaagaatggttgaaaaattgtcaaactatagcgtcatccaatattagtagcttgtgaggtggattaaggagaaagaaagacgtgtgagtctatatgggcccaacctccagtttgggatttgttaagatgcgaagatctaacgatggctaaaaataagtgatggcatgactcaaccaacatgtagccttttataccagttatttttgttggtggccctacttagcatgatagtttgtagcagaatggccattaaggttctctttggcacaactatgtacctaagatattttggagctaggcatttctagttctacaaattcatagatctagatctacggttactttgataacatttagataaataattttgttctcattttagataaaaattaaaatgttaaaccaatataatttaacatacaaattaaaatctaccatagatctgagatatatatttgtgtcaaatatgacctaaggggcacttttaatgtggaaccttggtccatgcgtggatggaccaggctcttctcccacctgctttggcccatgctcaagtctaaatttcatgtaatcagtagcaactttctttgattctcgtcaactacttctgatgaaccctgagttcctctcgacattcaaggctgttgttggcccgatctttcggtgagttgtgataactacgatttgggataaacgttgacgatccgactacaaccgtacgagacgttgtgttgcgccttagcgatcgatacacctctccgtgggttgttgatcttgcctgacggagcgtgggggctcctcaccgggagaccgcgcaggcctccctttgccggttcggccgggggccctgggtgaggttctaagctcctagcctgtggaaagttcacgagagtggaaacacacaagacacgggcgatgtatacaggttcgggccgctgagaagcgtaataccctactcctgtgttttggtggatctgtgtatgaagaagctacaaagtgcgagccagcccccgatcgttctgggatcgtttcccctcctctctaagtgggcaaggtcctccttttatatctcaaggggataccacatgcaccatctctccctctctttcttttgtgtggggactcatcctctcttccctccaacttgacttctcttcattaatggacggagatttgtatggctgccgtccgaatgaccttctgatgggacggcccatacctacctccacttccgccggaagcaggcgcgacgtgggaacatagctgtctgctgacgacatgaccattgtcagaccggtcacaaatcggtcattcttgtccaccacgtgtcagtttaacaatctgcatgttcgcccctcttcatacaatgtcttgcttgtaatggttaggatgaagcctggtatatatctgaccgggaccaacgtgccatctccaggaggtaacacgccggctccggctagggacgagtgcttggaggctctcatcctgatgggatggggcgaggcgtgcgtcagaccgcctgtctccacctaacccacgatctgatcggtctgtgactggtcacagaccggataaacgagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgactcctcggggagacaaagagaagggcggccgtatcaccctcgggcccgaccctcccccgagggggttaggccacgtgggtgatcgtgtctgcctcaagtctctaagtcatgatactcccggtcccatgtcaccgacattgccggtgcagaacaaccctatttctgcaagcaaatcgaagaaacaagcaagaacaagataaaagcaatctgatattgcaaataggaatttaatacaaatgataagttggggttccgaagaacaagcggacggacggtctagccgacacgcgcgctgcaagcaagtagcaatggctaaactttaatctatcaaaacccgagaaacccttaaggggtacctagctatttaaggaggtgggaggacgaccaagagggtcctagggtcgtgctccaccagcttgggccgcaccccacatgggccccacctgggccggggtcccaaatgaagttacaagcccacaggcccattataggtgacgcagcaccttgttcctgtgattccggccacacgagatggaattcggagaagaagctggatccgttggaaagagggctccgagagctttccatcaagtactcacgggctgaaaacggaggtcgtatgcagattcggcggccgtttgaagtcagcagtgtagtaggtggccgaatcggattccagcactgggaggacttgatctcgatatcttcttgttcatccatgatgtgagtaatggttacatccgtggtagccatggtcacatcaacttcaaataagctcatgtttaaatgccatcaaacaatttatgattttagcccaaaaatatttagttcaaaagccatgaataaagaagacggtgtaagagatacacatgtaataatgtcgtgctaccatggtacttcctcgttccaaaacgaaattgtttctagcacatactttgtttcgaatcgaaacaatttctccacctacccctcctctcgactgataacaaatattctccatctcattttttcacatactatcttttatcaatcaatcacaacatttatcaaacatttccatctactttattagtatcgtactaatctaaaaatatttatattttgggatggaggtagtacgaaattgaacggcccaaactgtccaaccaacccatttacccaacccaaattaatcaggccctgttactgaatcgaacagcccaaacggcccaacccaacccagcccagcccaaattgaccaggccctgttacgtctcgtgctccccttcatctccccatctcattggcagcggctgccggataaaataaaataaaaataaaaacttattttttttcctcccccactctccccgacctccaccctctgccaccccggccgcctcaccgccgcgccgtcctcctgcacggcggcgccgccgccgccaaagctgagcctgctctcttgccgaccgggcgcccaactcccagcctcggcctccacccttccggtaaagctcgccattcttttttttctttctttctttctttcttttctgtttgggttcttgacactggttgtccggcttggtttcttgcttagtcttgatctctccgattcggaaggggatttctgttggtgtagggtttgtacacggttcgtgcccggagtttctgcgcggtcgtgggttttttttcccccttaagcttgacaagatttgctcgtgtagttcgtgattgggttttgtttctctagggtttcttgagatactcacgatatggattacatttcagattcttgcgtctcggcatcggaagcgatggggaagagggtgaaggcgaaggccaagaatccgaggaaagcacagcaacaacaggagccgacggcagcggcgccctctgatgctggatctggggatgcggcggcggcggcggcgcaggactcggggaattcgacggaggaagctgctgctgctgctgctgctgccgcgtcggccagcggcagggagcagtgcggacactacggcggcgacagcgcccgcttggacaaggtcctcttggagatcatgacgtccaagcatttcgcgtcgtgcgagcattgccgggatgatgcccctaggaagaaagggggtggcaaggagaaagggggtaagcagcagcagaagaagaaaggaggtggaacgaaaggttccgcggccaaggcgaaggtggagaagagtgacatgtgggtgtgcttggactgcggtcggcatttctgcgggggtgaggttgatgtgaccaagccgtacggccatgcccgaaggcatgccaagcaggaccggcattggtgggctgcacggtttgatgatccgactgttgcgttttgtttgtcgtgtgagaaggaggtgtcgatcgagatgcctagaatagagacagttgccgcagtgccaacagaggtggctggtgcagctgacagagatctaggtttggttaactctcatggtagtgtaatcagagggctgccaaatcttgggaacacatgcttcttcaatgcagtgatgcagagcctcctcgcgcttgataggttgcgcagtaagatgttgggaccagatgttccaacgggggctcttttgatgtcattgaagaaactcttcatggagacaagtgcttcaaatgatgtaggaggtgcgctgagtccaaagaatctcttctcaaatatttgctcaaagtacccgcagttcaggggcttccagatgcaggacagccatgaattactccgctgttttcttgatggtctgcacacggaggaaaatgaagcacggaagctagcggatgaagcttcaagtgcaaccattcctacaattgtcgattccatctttgggggtcagctgtctagtacagtgtccagcacagaatgcacacacagttctgttaaacatgaccaattccttgatctgtcactaccagttccatccaggaggcctccagccaagagtgtgtcatcaccaccagcaaagaggaacaaacaatccctaagagataggaataaaaatcggagatatgggaagatttcgacccgagtgactcctacaatagaggtgagcaacaaagaaaagattcaaacagttgctgaaggcaataattccctgattcctggttcagagtcaggacaggttgtcagtgagaaagagcctgagccttctgaatgcagtgagtcatgtgcttctgtgcctaatctagaacaaacaggtacttcaaatgtggaggatggcacttgctggttggattacattgatgatgcagatgaagcaaaatcagagattcttgattctgcagattctattgaagcgggacagatctgggaagacaagggtgttacttatggtccatttcttccacaggatgatgccttatcgaaagagcaggtcttgggttctgaacactctggtgaaaaccctattgatgatgcaacatcttcacagcctgttatcttgcttccttacaaagaatttggttccactgccaatgaaatggatggaaccacagaaaattcacagaaaccagaagatgcagttgctcctccagctgtttctcccttgccagaagataatgcacaacctgcatctgttggcgatggggatcaagatgactatgttggtcttggtgatatgttcaatgagcctgaagttacttctgaagtcaagaaagaaataggtacagttgaagatattgatgtgatggcctggagtagcaacagtgctgaagacgaggtggatgatagtaatgctcccgtatcagttgagggctgcttggctttgtttactgaaccggagttgctctctgaaccatggcactgtgagctctgctctgactctattgcatgcccaaacaccaatgatggcaaagatgatgagatggcgactagtgtcaatgaaagaaaggatggtgaggagatgatggcaggtggtgatgaaacacaagacggtgataagttgatcgctaactgcaccgaaaaggagggcattgatcagattatggcaactgacggttgctcagataatttaaatagtgatatgaacagtaaagaaggtggttgtgcaaattcttctttggttggtgctgacaactcagttgatgctaactttccagaaaatgggaaagttgctttactgaaaacaggttcgtcacttgttgacacaactgaacaggcagacagcaaagcatatcgtcgagagattagggatttgaacaactcagcagtggaatatacatcttcgagtaagcaacctcatgattctgcccagcataaggatgaacataatgtggatgtagcctctgaagaaacaactgcaccagagtgttcttgtgacaacgaatctgcctcttgcagcacaaccaataagaatgaagctgaatgtggtgttggtgctgaagaaattgttactagtagccttccatctgagacgcaaagaatcttaccaggtgaaaaagacaatgaagatgttgtcacgcggaatcatggcagaaggaagcgaatgaagatggttggcaaggcacatcaagggcaagataaccaaaatgaacagaaagagaatggaaaaaaggttttcagatctgcaatgagaaggatccttattagcaaggcgccacctgtattgacaattaatttgaacagattcagtcaggactcgcatggtcggttcaagaaattgaaagggcatgtgcactttaaggagacacttgatgtgcggccattcatggacccaaggtattgaactttttttttcagttagaagtactgatgttttttatcaacctgtcagctttctgattagctgtgaccatctgccattagtctattcgcatttgctactaagaggtcccactgtccatgcatagccattgacatttaaatatttacactacaaattacctcacaagtggttttcaactatgtagctgatattactcctgcaaggaaattgtcgtagacacatagttaggatagatagcgaatgtttagcttccaggtaattttggttcctcatccctagcgattggccaatgttgtttgagaagataaattgctgcactatttgtcatgctttttaagaagaaatgtagatcagatttttgttacattgagagtgcattgcattatcgtattcaactccaccatgtccttatcgtcgtataaacagtaatatacctgaaaacatttcatagtcaatgtgaatttggaggtctgggttaatttagcagtgcaacacgatttagactacaaggtagtaagcagatcaatatgtctcttttgtttacctggaaatgtgtttgtatttacggatgctatgtctatgattaataaatgggttgcttctttgaactttctaattcctaaataatcagttatatctattgaaagagaacaacatcatgtggatacaaattggttagcttttagaagctgcagcaaattgttattcaccatttatatgctgattgaaacactttgacttgagcaatggttctgaaatttcccatcggcttcataattttgggatcatgtctagatgttgaccatgtagtacaatagtatacacaacccagtgcatgtacattcttgcccatgatttttcagaaaggatggccagtccaaaagattgtaaaagaacagtcctaaaccagctagtgcctagtgatatgggcatatggtagtgattagcagaaaacaagacctggtttcctcttgccctctctcttctgctggttacacacgaaattaggtagatgaaagttcaatccaatctttcagctgttctttaatttcaagagttggtgttaaaagtcatcccatagatgtcccaaagaaaaggcatttacttttaatagcttgtaccatctacacatgatgacttctcaagtgtatataacagtatgccttcccatctgtacaagaataggggaaaaatgtgcttccagcttccaatcttgaattgaactaagaaacgttgtagatgtgcatgtatcacatctgatttgcacgcgagatatcagtattttcggtttcaatgttattaacttgatattgagcccttttgttgttgcatatttcaactgaatggtcttaaacttggtgtcttcaatttgtaatttatgaatactgcagccttagagttgatctgctcatcacctattctctgtaatctgcaggtctaaggagaatgacaatacaacttatcgtctcgttggcgttgttgagcacttgggaaccatggcagctgggcattatgttgcatatgtgagaactggcaagattgggggtcggcagcagaggagcaccggctccaagtcatggttttatgcaagtgatgcacaagtcagagaagcctctctggaggaagttcttaactgcgaggcttacatactgttttacgaaagggtgggagactaagaaaattatgtctgccatccagcaacatcaatcagtctctatcagggcatgttcaaatggcaagcaatagataagaaacgtcattttttggaaaatcagaggctcagttagtcttcatactaattactatccatcaagtccattttgtttctttgattgagtccagttggccttgttaccatttgtctactcagtcaaagagatttttcacaagtggacttgagcagttaatctgttcatactgcctacagcctttttgtcttttgaagcatattttggaggtgtgcaaatgttcagaattggcgagctgctcatacatatcttggcaagggctctgtggagaagcccatagatattgttttacaaccaaacaaacaatgttcaccttagtactacatattttttgattattatgtctccagtctccacccctaaattttgagtgatgggggtgtatactgtaacgtgccttaggtccatttaaaagtggtaattacatacttttacctctgtcatctgggatggaaaaaaatgctccttttattgagaatttttctgtttcatcagaatgtagtgttcgtgctgttgtttgccctggagcttgtgttgaaatgcagtgttttttttcttttttgccctttctgatactgatatctgaatatctgatggtcacacaagccagcaaaaaaccaagatgataattgttaacacatccagttctaactttacttttgcactcaaacctttttctttaagaaacaatttggttacaatctggatccatcctaatgctagtgtgctagtgccgatgctacgttggaaaccaactatggtgagcagactactcaacaacgccgcgtacagcttgtttggatgcaactggaccaagcaaagctcaccgcagatagcgtgcggattgatggcgattcactacgtactggcacacaaaacctgcaggtttctggtttagcacatctcttgttgccagcacaaaaacgtaagaatagtctcggacaaaaaagatgggggggggggggggggggtaggatcgtaagatctaagtagcgaaggtgacacgtttagccttcctgtattagcttaagctttagatcgaactgattgattcgtataactcaatataggttttttggatgaactgatcaacacatacaactcaatatacgcaatagtctctaaatccatttgtttctcttattcatatgcttatccgaatagcttattagctaataaaaattatttgtgagcgaagcttttcattagcgactaaaaatataaactacgataataaaaagattaaaaataaaattcaaaattaagtttaaaatttaagctttgtcttataagcataatagcgtgcggatcttaaaaataaaacaatgaagccttcagtaccgttccaatttttcccaaacatccaaagggacttcacacagtatggtcttcttgggacttcttgtgcttccagagaataacgctttgatttgtccgtttgacaaaagcacccagccgcccggcgcccaattcctgcatttctacctccttcggtgacccgcgccaacaaccaacgccaaccatccatccatccatccatccatcacaatccggtcactgaaaaatccaccagaaaaaacggcttcggaaacctgcccgccgcttcgtcggaccgcggctcgtagccgactagtccgtccgttgttccgtcacggtcacgccccgcgaaatcacccgccggtcgctgcaaaaacggggcgaaatcgcctagatcgtcttgctcgcgtggccgcggctaaactaactcgagtttttcaccttttgagttttttttttaagaattacacaatacaacacatacactcacccctataaatacacgcacgcaaaccctatccttatgagcatcattgaagactaggccggcaacactcacctctataaatgcacacacgtaaatcctatccctatgagcatcatcgaatactaggccggcaaatccattctggagattgacgaagttactacaggcgccttcctgttgatgggtacgttgcctaccactgaaagcacaaaaccgttaaatcctgaaaaattcgctccttactctaaattattttctaaattctatgactacaatttattgtaatctaaaaaaattaaattgtttggtagagtttctgattttaggaggagcttgttgctccgtcaccggacacggtcagagtccgcgaaatcacgcttcggacgctgcaaaaacggggcgaaatcgtcgtaaccccaccccgaccggcgcccgtgccgctcgcccgcgcgcaccgcgcccgtgggtcgccatgtggtggtcgcgcagcgcggccctcgcgagagccgcatcatcggccatccgccacgtccacactaacggacacacacacgcaaaaaaaaaaaaaaaaagaagaagaagaagagtaaaaccggcgagaccatctgcaagagaggataacacaacacaacacgctgacgctgctgatgcgagtgagataacgagatgcttatgtatttttaggctcttctcgtgaagctgtgtccaaataggcgtaggcttctgcttctccttctccttctccaggtgagtgaggagagaatggaggcgcgggcgatgccgccgccgacgcggacgcggcgaggcgtcacgctcgccgagcagatggccgcgtcgtccaacctccgcgacctcctcaagctccgcgacaacgacgacgacgacgacgacggcggcgggcaaggtggtcgccgccagccgcggccgctgcccgacgcggtggtggtggcggcggggcggcgacgcacgctgctcgacgtcatccgcggcgtcgacgacgacgatggccacgaccacccgcccaccggcgtccttgagggacaccgccccgcgacgtcgacgaggacggcggcggcggggggagcgcggggcgggagggtgtcgctgatggcgctgctggagcaggcggagcggcagtggacgacggccgccgccggggacgccagccggaggcgcgtagcggacgaccacgcggcggcggcggaggcgggcacgaacaagggcttcgccggcgccgccgccggcgtgggagggcggtgctgcgtgtgcatggcgcgcggcaaggccgcggcgttcatcccctgcggccacaccttctgccgcgcctgcgcccgcgagctccgagtcggccgcggccgctgcccgctctgcaacgccgccatccacgacgtcctcaacctcttctgatgtcaccatctccgccgccggcgacgacgccgccaccattaattccgtcgacccaatacaccattgctgtaatgtacttgtagataaaaaaaaggttctactacttcttggcttcttggcaactgcaaatcatatcaaagaattctcagagcatcacctgttcatcaatcacccacccgtgctacacaaccaatcgcgcgattcttggatcgatcgaataaccctctgttcctccatggcagcaacgatccgcagatcccggcacaagtgctttgctgctgattagtaattacgtttgcagccacgcgagtgattgaagattaagttggcgcatgtaattagcacataattaattaaattttaattattataaacttgataaatgagtgtatttgatttttttaaagcaacttctatatagaaagtttttacacggaatatattatttagtagtttaaaaaaaatgctaatgaaaatcgagatataatctacccactctgttttataatgtaagttattttagatttattaatatttatataaatacggacaatattagaatgatttatattatgaaagcaaatcttaatgagaaaataacaggttgctcggtttcagtgcatcgcagtcaccgttgaactccacccgtttgctcggtttcagatcaacgcattagttaaaataaatcaattgttttttcagacgatgcgatcatgtgatgtcatggctggaggagagaagattagatagggatgagttgaaccgtgagcccatctgaccaacggtactccaaacctgacaccttcgttctgatgatgttgacttccctgaagaaatgatcaaattaatttatttcagactaagatcacaccaattgacggcctctgcatgatccggagttccggacagtccacttaaacggctaaaccctgaactgacaaaaatttactgtactataaaatggtttcagaggagatactaaaaatgtggcacctttaggatcgtaaaatcactcttgaactgaaaacgtagaggatacgtacatcattgcttattgcatatgaatatgatatcttgtatacttgtgttgaggctatcaaggccagcactacagtgccaatcactttaatcacacttgtactaccatatttgttagttaagtactagattgagccaatggggcactaacacacactaacatatgcaaccatgcaagcaatgggcactgaaagtgtactttgtaacattggatatattatatcatgttgggtaagctaacttttaccatcaatccatcatgcagaagcacgggttcagagtttcagagcaaaaaacaccccaatcttaaatctaaatctatccctctctagcctgtgattgcgtgcattcgtcgccgttagcctgtctttgcgagcggcgacaccgggaatgatggcgacgccctgcatctgcatgcaaatatgcaatgcaaagcgctagggaccgggaaatggttagctgaattcgctgaaatggcaggagagaagaactggacctttttggagatttgcaagggttcagacaaagcgcattagctggggtggaattgccgtttagcgagcaggaatcgtgtagggctcatgcagtggctgatgacttgtgacagcctacaggaatggggtacccaccactgtactggtacttcgcctgtaatggatcgagagaataattgtacactcagatcttgttgcttaatactttaattccttctggaattacagtcccatcgatcatcgttttgtctccaactaattgtaacccgtgagaccataaaaaactaatatgtaggtaaactttttatatatgtgttcttagctatttaaaaattaatgctgaaaaataaactacgatgagaaaaattatcaaaaacaactctaaaattaaattctaacattaaaatttgcatgcgagcgatggccaataagcatattttacaaactttacaaaaaaatatcttgtgatagattttagcgcaaatcagtctctgtaaaacatggcatgggtagctagctctggtcgccaataattgatctcctcatgaggggacacaatgacctaagcttaattaggagtttaggacagtgattcagtgaacaccgttggttgatgctgtcctagatcgcggtggttgagctgccccgtccgtctgcatggacgcagtcacactatcacaaattcacacaccatctggcattctctgcttcgatggagatagcttgcgaggaagaggaagatgaacagtggcgtcgcacagtttctgatcccaatttttatccattgccacctcagcatggctccccacaataggactatatataaatctttgcctgcctgtcgatctctgtatcttgaattcttgatgtgttcatcggacatgcattgattgattgattgcatgggactccaatccatccactgtttggattggatcgaccgtttttttttttgtggttggcactgggaggaatgtttgtcagaggccggccggatgattagttaaccaaacgtacgatgagaaagaaaattaacaatgcagctagctttagctcatggttgcgaacttgggatggcgaactgtgcatggtccagacaccatacacaaatttcagaggagacgatatacgtcgtgatcatgtactccctccgttacatattgtaaggcattttagtattatcttaaatcaatttttagtgctgattaaatttatagataaatatatgcaacgcttataataacgggcgtattgtttatccgtcgagagcttaacacaaaaaactttactggttgcccatatttcctaataaaccaaacgacttattagggaataaaaattaatttataggtaaaatcattatatatttattcgtaactacttaaaagacaatgataaaaagaaataacgttgaaaatatcttaaaattaacttcacattcaaattcaaaaattcaaattatgcctttttgttttgacttattaggccaatcaatggggctccaagatccatttaggttggaggagatgggagactacggagacaaagagaaagtagccaagtaggatcagaaaagaagcctttcgccttcccatcaacgagtattcctcagttgaggtccttgagccctgaggacgccagcttaggggcctcatgcctcctccgtccagtgtcctgctcgataacgtgcttgtccatgcgattccatgtaacatgcgctgtagccatcagctatgctatgcaacagttgcaggctctacaggttagcacctaacagggatctcctcttagatgctagcacagtttgttatgtttcaagatcaatgtaaatatttttttagaaacacgttacaatcacataagctcacaacgcgtgccctacccctataaacattttcggaagattaggtcaatatatatcttgagattaatgaagtcaccacggccgtatctaactatagtacttaatccgggtgggttggttccaccacaaggaacctaactagttgagctacactcacttcgcaagatcaatgtaaatattaccacgttaaatctagaaatcttctattatatactaaaagtccattaaacttcctacaaacgctctcaagttgccacatggcgctctaataaattagagaaaaccctagaaaatctgagaaaaaaagcaaaacatccgtacattgattttcattaaaattggtgggtccaatattataaaccgttatattagatttgtcttaaagctaaccgcaactacaactatggtcccaccagcctctcacctccccataggtacgtacatgatgtacgtatgtatcgcaacaaaaaaaaacacgccgctctccttccttttgtatctttttttcccttgtatatagtttctttggaatataaatgcatacatatatatgtcgtatttttggattggtactttgtaaagaggagaagggttaatgcaaaatataagtacactgtaaccatgtaaggtaattattatgtctatattcgcggacaactagctactaagctcataactaaaatatcacaccagcgttaaatctaggtctttacagacatatataaattttatcatcatatcgctctttccaaatatacatacctaaattagaaatgcaatattttaaaataaagtttacacccattatatatatagccatttattatctatctattatatactaaaagtccattaaatttctagcaaacattctcaagctgccacgtgggactcctataatcattcctaagacgccacatgacactctaataaattaaagaaaatcatataaattttgggccacatgggacttctataatcgctcctaaaccatatcacgtgaccctctaataaattagagaaaatcatataaattttgagaaaaaaacatatgtaacgtttattttaacttaaattggtaggtccaatattataaactcttagattaaattaatcttacaacaacctagacattagaaattagaagtacatatggtcacacctgtacgtacgttacgtgcatatactctctcccacccactagcccacattgcaagtacatatatacatagtacgtatatgtttcttccttcctctaatcatccctccctcctacttatataatcctattctatagctaataaaatttgaagggtagaatccaatacgcttccggtccgtcacagtatatcaattcattcattttcacttaaatgggtggttccaatattttataccattagattagatctattattaaaaaaaagtaacaccttcctcatatatccatatacatgaggacaaatatattattgtggacctgggcaaaaaaatacttcttacgtacgtatgattgaagaaagaaataaagtaattattacttactactgttcgccacaagaaaaataaaccataagcacatatatacttataataaatcatgataaaggaaaaaacatatgtacgtactacgtgtacagttaggaaaaaaggtcgacgtgttctaaaataatatttctacaatttaaagataaacaacttacacagctgaacttgatctatatataattcaaatataatatatccaatcaatgttctttaaatgttctatattttaaattattttaaaattacatatctactttattatttatatttatgtaattaaataaactactaatatctatggtcctaaatacatcgcaatacatggagccgactgttataataatttttaaataattttacatcatattttagtttagggtgtcagataccactagaggaatatataacactaatttaaatctgcatatgtgaaaataaaaataaaaataacataatttagttgtttttaagtagatatgatttaattttaatttgacaaaaaattggaattttttaagactatttgattggtatttgagaagtgagagaataaatacaacataggtgtgaaaataattatcaaaaatatttccagcctatgatcttgctatatataatacaactccttaatccatcttgatatttatggtcattatgtatgttttttctttgctatatagttttgataacaaataaataatcaagtaacatgtgcgtaacaaacttgacgttacactatagatatttgtcaaaatataaacaataatatagtgcttaggagattatcttggtagtattctttaaaaaaatgactttgtcccggttacatataaattcctcttttgttttgggataaaatttgactcatcgaaattatgtgacgaagggagtataagcaatataagtctatctttaattagataaagtagtctattagctacgttttaacgaaaaataatttcattaatatataataaatccataaagtcatctatagcacacaataaaaaatgttagtaaaattttggaaactgaaatgctaaattctaaaaacgaatcacatatagtacaaatatatatgaaccaactccatcattgtgacacaattttttcttggttgtacagtttcaaataattttagtatagagtttatacgttgcaaggataatcagaagaaaaacataaccaatgtccaaacctattattaaccaaaatatgtttaaaatggactcaaaaaaatatttcaacaatatcatcctaacatttgtaataaaaactaaagcaacattaaataaggtgtctgcgcgtatgcgcgggctactttcctagttttctataaaacctatatataaaaatgtaatccatgtctttgagcaacggtgctgaaaaaaatgtgaaaatgtggtgacaccggtataagataatagcagcgcattgccatagtgagttttgttcggtctctaaaaaattcagctttgaacgtttgagatagctgaaattgatggattaatagatagtctgacttttctgataactatttaagggtatccacgaattaattctctctttcaaagttgttgcataaaaacatttcaaggaaaaaattatatagtttttttacacaaaacgtatgatttagtagattggaaagcatacagatgaaaaatccaaaattcataatcagaaaaagaagtacgtgaaaaaacaaactagcaatgggccaccaaggcccatctcaacattgccaatttctatatgggccgcaagtaaaaccaccgggatatacgaccgccgccgccgccgccgtgctctcgctcgcagggcgcatcggcgagccgccatggcggagcggaaggaaggggaagggaaggtggtggtggtggaggaggaggaggaggagcggcggctgcggggggcgctgcggagcctgcagcaggaggccggggtgctggagcggctggtgtacaagcaccggaaccagcaccgcggcgccgcctacttccagtacctcctcaaggtgaggcgcgacgtgaggctgctcctcgccgccggcctcggggacgtcctcaccgccgtcttccccgtcctcgcctcccgcaagccggccaacaccatcctcgccgtcaacaggtcaagcttcattcctatgcccccccttggaacttgaatcaacgctgataaaattttgtcgtagcgaggcgtagaattagacgaagccgctctaggattatggcttgattgtgttttttttctttaggcagagtaagaagaagcctggtgcaaaccattgtcaccatgagaggcttttgggtgtcgcacgcttgttatcagaggtgagtgttatactgttattcttttttaccccattgggattcaacacttagcttaagtgtttagagaagttggaagttggaaacactaatggtagtttggacttaataatgtgatgtcaactgacatttttttttcttttctgctactatccagctaattatgacatagatgcaaattattgtgattatctgtaacttatttaggatggcactcttcaccggcccaatgaaaattattgtgattgtccttgcatatttcaaagtcctaaaggaaattttaggtcatatgcaaatccatttatttcctctatggtatatgcggaaaattaagtgacaagctttgtatgctatattcaccattcttgatatgcttctggacagctctagctgatgatagctttacccaaagagaaacttatattttctctgttatgtgcagatggctgaacctgttatgatgggagcagtgtatcctttgcctttttttttgtttctttgttccttgtattctcttgtgcatagaaatattttttttgactggatgcataatatattaaactgtacacttacaactggtttgtcttgtgcaacgcgtgcctcatatttgtactagtatctttgcccattcttttactttcatatagttcaaatagatatgttcatttccctgttttggtaacaatcgatagttccttaacctgcggtatagtcagatctcgtttttacttgcaagatcattttttgttgatctttgcacagcgattcttgctttgctagcaagagtgagggctctggttcaacaggtgagagcagctgcagaattacctacagccaagactgtgttgctatagttatagtaggaaatatatatagtggaagcatatgttggctagtaaggttctttccctcttttcactgaccctatattgtgtgcagatgctacttgatgttgtctcagtttacaacaaggcttctgatcttattgataggaagcaatctgttaagattagtattggtggagcgcaggtgagtttgcttccagagtagcactctgcatgcataactgtcaaatgtcaagcatgatgaaactatactacgtcaaatcatgtttggattggcagaaaactatatttattcaccacataaatcattcatgtcacctttttttttaaaaaaaaaaatccctacaggctttcagagagtactatccctcaagcaatgatgcccgtacttttctggaatgtgtttgggtgaaagataaatttgttttgcatgaaaatacaaaaggtaactgtgagaaaacccaagctgaggatcaaaagtcatgtgcttccgaatcagcagtcctgtatgaaactcttggacaagtttctgaaggttgggatgcaatattttctgttcttcatgatatatttattaatactttggtttcttggtcgcattcttggaatatttacaaatgtccatggcatgttgttttgcatggtatcatgatgtatattagtatggcatttaacttctgattgttgtatcgttaccaccagataatttgattgtgataggtgatatggtgctggctagtatgttttgcaaatttcttcaattgcaatgattacttcatggaataaaatgaaaatgttttcattaccaatagttatgtactccctccatccacaaaagttacacatattacttttgacaccaagaccaaggggaaattaaatcaccttggatgttacaaaatcaagtagtgttgcaaacatgcaacaaatgagtatttagatgactccttaagttctaataaaacatttaatttatctcttcatttaagtcttgaatacataaagactacaaataggaacaacttatttggaaaaactcaaatgtgaaataggtgtaacttttgtggatggagggagtatttaatatgagagggcactacttttatttatggtttgatagcgtcaaactttaaaaggaagtttcagataattctagtgcttctgacatttttttcagatatggaaaatgctgaaggattgaactctcccatgaagctaccagatgccaccttagcaaaccagccagagaaaacccattgccatcgtgatgaagattctcaaagtaggaggcaattggtgaatgacaacaattctaattctctttcagatgcagttgctactcatgtgcattcaactccatgccctgatgtcaagcctgagacaaagaagagagttgcattcattgcagttggaaatccgaaagccactgctagttcgattggaacaactttaactaagaagcagagactagatgtgattccacgcgccactgcagaacctgaagatctatatgtcaagcctgagacaaagaagagagttgcattcatcgcagtaggaaatccgaaagccactgctagttcgagtggaacaactttaactaagaagcagagactagaggtgattccacgcgccactgcagaacctgaagatctatatggcaaattttctgaggatacagacaagtccatattttagattgttttgcactgcagctgaccagtgatcactgaaatacttctcagctttctaacatgaaaagaacaatcaatacaaaagagggctcggtgtagctcaagatatggttaaattttgaagcaacttttgctgtagcatctaggaggttgcttggtttatctcgctaaatcattagtatagccttcattgtattctgggatgcaatattattttgtcatccatttttcaggtgtaattttgcacaaagatgaattttagttcgtcccatctgatgttcaatgtaatatgcattcattctttgatttgacgctgactgcattacgtttgtggagtggccttaagaactcgaaaattcaggagtctggaacgaagtgtatcttgaacttgggttctaaagcatcagattatgcattactgtcgaaaaatcatatgcagacaaaacatggtaataattcctctgaaaaatcctccgtaagtgttaatgctgatctgaagttatacaagaacaccagaattgcatctaataccaagtgatgtacgtcacaagatcagaagcagaaaaaactaacagtaacagattctcctgctgctatctcatcagggcaaactagggagagcagctttgttggaggagaggaagctgacccgtccgttgtcaacatggcaaaatttcagaggaatgccctcaaacttgttttcaacggtttctagttcttcccttgatggtggtttgttgctgcaccaaattgaaaagcaatacatcaaaggtaggaacaacaatcgaagtacacgcaaataacccaaaagtcatgaaccatacgtcgttctcaattttattgcatgtaatgtgacctcttgcgcatttctttacctaccttatgacttgtatggtattttcgttacttctcagtattctttaggggaagttggtgaacaaaaagagtaagtcaaaatagatggagtcaatgataaaatataaaagaaatcatatgattgggtatgcaatttgatgagatggcaaccaactggaacttcggtgctaagcttgaatcgcattcatataattaacatagaagccactttgagtggatataccaggatgacaaacagatctatgactacgtagtacatgaatagcacgtcatagatacatcacgcatgacaaaatacaaaagcttcataccatatatgttactaaatttatatcaagaaaccacaaaaaatgatcatttatgaattgacaatggacggtcaatgcagtaattcaaatatagcactagtgaagatgaactttgtgatcaaaataaaacacaaaccatgatgagatgaaactagagcacgtttctaggtctggatggatgacattcaagtgaccggaaaaggcaacagtaccttaataggcataggacgaaactagggtctcctggggatgtcttcttaaatttgctattcggtagatacacttcaaaggatggatgcatatcatctatgcacatttccttgagcaatttagttatgtcattggaggcaccaccgactctatttaagctctgaatctgatcagtttcaaccacacttgtggaggcatcagtgacgctgtaagtatggctacgcttaactgtccagggaacgccatatcgtccaataatatagccgagcaacttcaagtgcttgtaagcttggaaggcatcccaggagcacccatatttccctccagcaatctttccgtagatttcctccattccaattgtttcaccctcgtaatcaagaagaaccaatgcccctctttctgccaagaacctgcacggtttggtcagctgacaagcctcaaattgagaacgaagcgaaaatccaaggcgtgagaatcatctataatctaaaagcagtgcagcagcgctagtgtagcattgtaaacagagtgcaaactttgggaatgtgaccgaagcaagtgcaatcaagtgtacaaggaatccgagtagcgcaggcatttcatcgaacaggtggcgtacccaatctcctcgacattgtagtacagcttgccgtcccggttgacaccggtggtcagccagagcttgcccttgctgtccacaacctccgccgcaccagcctcctccagccacaccgcgcgcgacgccaccttcctgctcccccgctacacaacccgatgagctaacacgaagcaaaggaaaaaaaaaaaaagacagcacctgaactggactctcgacgaagacgacgacggggcggcgtccaagaacggattgagatggtgctcctcgccatcatcctccgcggcaacggcgacggcggcgatcgccggagctcgcccgctcctccgccgccggtggtcgacggcgcgcgtgggcttcggcatggccacttccgtaatttttcccaccaaatttacccttttacctttttaccccccaaccactgccactaaaccaacgggcccacgcgccgggccggcccaccagccggcttctcagccacatgggccacggcaggtggggcccacccgcaagaggtcgaagcccactccgcctcgtcctctaccccctcctcgtctcccttttaaacaggaggagaagaatgggaaacgacctctcctcttcttctctcttcactcgtgttgaaattgaaataaatcgcggtcaagataaaaaaaaaagaaaaaaaaagaagaaaaaaatcgcggtctcctcctcatcgagccgcgcggctggatcgaggattcgagcaggtgcggaatctccaatccctcccgcttctgttcgtttcgatttcgcgtgggtgggattggctcgggtttgggaggcgttagcgatttcgcgtgcggatcgacggggagtttaggtttgatggttccgattcgtgggggggggggggggggtgttaggtttggatttgatcggggaattttggtttgggtggattgattcggtggagatctcttcttcttcttgggggaggttaggatttgggagcccgtgaactacgtgttctagtttacttcttcagtttctggattgttcgtgtggattaaccggggttgatggctacttgtacgattggtggtagggggttggtgggttggtaggttttttggtgataaggctattggatttggcaagtcgagaggttaatttcccaattctgttaaactgttcgcgattttcatttcctagtaagtgtgtatgttgtttcaagattcgtaaatttgtgttctgaattttagaagtatgaaatcctaataaattcaacagttagtttgaattgaaagacgcgaatattagggaaggacctaatatcaaataattagatatttagatggggcgaggcttcgaacacaggtcatttagcccaccaccttgtggagctagccggaagacccctaggtgtttctcaacagttagtttgaattgaatcatataagttcgtaaccccttgaatttcaggttgatttcagagttgagtgccactgattcagctccaaagttagcatgagtactgtcagcggcactcggcgtgccccaaggaggcaatcacaagatggtcctggtgataaagtcgttgtgaacctggacgcgatctcctccccagtggttggaagccgtcgcgcggtgccgacctccactggtgcgcgcgcctcccccattgatgtggaagctctggatgatgaagtgcagacattgtccgcttcgcaagtgcctcctccggtatgtcactttttgttatcttgaactgaaagtattagttcagtcttgattatattctgtactattatctgtagttattgttatatgattgggttcataatgatgtttaagtcttttaccagggtttatgtactactccctatgtttctcaggcacactagatgttcctgttaagaacgaactggtgactttgtctccatgaaaaaaatgatgcatcccttgcccacatttgttgaactgtcttgcattttgcagagaaggaaccggagaactaggaggcagcctgtggcagtagttgatctggaagtagatgctagccgggaaggttagttcatttatacaaagattgcattaatctgtcctaattcataaattagtaatcacgggaaacatgggaatatgctatctattcctatgtttgccattcatcaatctgtcctaagtcataacttaataatctgtcctatgtcacaacaataatcatgtattaagtcaagtgtgttttgtgatgataatacacagggaacaaacgtcaaagggttgcacctgttatacactgcctctctccagaaaggggagaagggtccagcttgaaggtatcctataatactatacaattgatccccacttagtttattttcatactccctccgggctggttttatttgtcgttggagctaagttagctgtggatgagaaaatttgttgttcgagtgtttttctcacgtatgggacgagattgcccttgtgcattgatgttgttattcttcccagatcaactcctccttaactccttgaatgcttcgttcccatatcacttaatgatggcatgcatgcatgcagcaaatgtggtataaatacatgcgtaatgtgtggcaaattagcgcggcaaaaagcgtgcgtaagcaaaaacgagattttctagcggcaaaacgcgcgcataagcacaaagtataattggttggtttaattttcgtatgaccttgcacgctggctgcaccgaagctgcatgcatggtgccatgcataatcgccaagacaaaaaaaatgcgcatatccgagaatcgaactcaggtccccacgcaccaagacagatgcactaagccaactgagagtaattagttgcttgtttggatgatacacccagccgtatttaataaggacaaaacaggaaataggaactttacttagtgacttcttggtttttgagattgtgtccgaaacgacaaataaaaccagcccagagggagtaatttccaagtcttcaacttttcagctttaagggcctggttggttattgattacttgtcgtcgctctttattttcttctatgtaaaaagtagctggtactgctgtgcgctcaatattgactcttttggcctccctatagagtttacaagttggcctttcagtggagtgagttatttgttttaagttgaaacttgtaggcatttttcttggtccattatgtcatagaatactcatgcttgtagtattatgtatttatgatgatctggtagagagctattaaaattgttcttgacagccactggtagttaagattcttgcttgtcacaaacaattaggattttgctaaatttcaagcattgtcttatgcattctagtgtaaaagtatctattacatgcatttgatacttgtggctgatggcttattgcgttatgcatttagcttaacactgattgcatttcctgttttggaacaatgctgtgaagactagcaatgagcctcctaaggcaaaggaaccggtttttaactgtccggtgtgttggaacaagttggaggagccctccacaacaatttgcggccatatcttctgcacgacatgcatcaagcaagccatccagattcagaagaaatgccctacttgcagaaagagtctgagggcgaacaatttccaccgtatttaccttccaaactctgatagttaaggtgagtcgtttacctatcaattgccttctcttgtatacctggcactctagtgaacttctgatttcatcaaatcgattgccttctcttgtatacctggcactctagtgaacttctgatttcatcaaatgcaggctcattggatgtaccaaaggaacttctggcagcagcagcagcatcctccaatctaatatattcagaggaacaggagttctcccataacgtgtaccattttgctgtggaattgtgtcacggcaaaatgaccacctagacccgcatgttcatccaaggctactgttgtttgtatgtagatgcatcaccaggagctcatcagctgcaggtgacaactctggtttaggctaccgaatggcctctctgcctccaaaggatacacaacaaaactaactatagtccccattggttagatttatctagtttgtgtactgttgtatttaccatgcgtttggccatgtaccttaccttctctccatagttgttgacgtagccttgaatcagcttgaaatcgtgatgatgttaacgcattacatgtttactcttgcttgtactcgtttgctgttctgtcttctgtgtcttcaagtttgccttctgtggcagagttgcagccaccaagtcggcacaagtgcagctacatttgtgttagaagtgatgttttttttttcagatgaaatggcccgtgatgaacgaactcggaataacaggagggttgaaggatgcaatcatgcaggtcgaacgaatttgacaggcacttcaacgagcaaacgagcagagacaccgcaagaatttttcaggatttcatttgctatagaaactaaatagtaccaaagccatgtttttttttacacatcaaaaacacatacagatacagaccattcccaacccgttgggatcttcattgtaaatgatttgcctcgcaagctgctgcaacaggaacagctgtatatagttcggaattctgaattaaatcgttcgttaggggcaattctgaattctgatactatatatatatatggctttgaaatataaagttctccaaggaaggtgacacatatttcctgttgtacgagcataaggtgatttgacgctcagactgataacaactgaactagggctcagtctgctttaggcctttgaaggcagtttgttcatcacaggggctattttgtcctctgggagccctctttgaggatcaatcttgtaggtgtcatagaagtccaaaatttccatcgagatattcttgacctgagaattgatgaaaatacaatcaatcattaatggatgaaaatagcaagagaatcaaacgatgggagccagggcaagatcaagtgatcaacaggcacacttacaatgttcatgtcaacacggagctcttcaaaccacagagttatgtccttgtctttaagaacgcttgcaatgtagatgcaggctaatgctatcatatatggtgggtgtatgagaataagatccatcttgtaagtatcattgacaattcccctgcaagtaacagcagatgataagcataggaaaaggtatagttgaaaattttgcgtgcattatgttcactaatcataataaagacaattcaattcatttgtttatttctcatgtgattccagataaaagctactagatcttattgtactctatcacactgaaatgattaaaagtggtaagagtccttcaaaggatattcaatatgacaataataaatggaaatactctcttcaaatctaaaaataaatgtcaacaaattatccatgtggtaattaaaaagggttagacttggaccaccaaatgccagaaagcatctaaaacagcttttctgcataaaacaaaactcaaaacagacttcacagatacaaaaatgcaaattgttataagaagagtaccaggcaaattgtgtcagatctgttatgccagcatcctgcaataacctaaaatcaaagcatctgttaataccattgcagctctgatgttcatttaaagtatatataagggcttcggtaattccggtgaaagataatgttgtttcatcgcatgatagtggaaaaagaatcttactgtaaaagaggacgatatgggtggtaaacaactaaataatagtcaagtgcctccaggagcttcatttccatttcaaggatatccttgatttcaaaccggtacttctcatcagaagctacattttgcggggggagagcacatgtttagttttaggttagtgcagttcttcccgataaatatgtgtccatttatgattatgagccttaccacacatcttttttatgtaaaagacaagaagtcttgcttgcactgtgctctcttccacctttgatgccaaatacaaacaggttggtgctaccagacgaggatcatattcagtcatgctctttctgtaaacatatccagcatcagaacaaaattctaatagcttgatgttccactgcaacaaagaattaaatgttctggaatgaaatattagaaagcactgtgcactgtgccactgtgtactctagttcttatcgaagaaagtagagaatcacatcaacatagtagagaatcacatcaacattttgcaagccccccacataccataattcttagggcattaattagctagagaaaggaaaatgatagccttattaggaagttagaaagtatattgtttatagattataaggtagtcaccttaatgggaaagtaaggccatctacagtgtgaattcgcaccaaacaagctataaagcagtctcgcagcttagcattgttagctctagtgtgttactcatctcctaattaacatttggaacccataatcaagtcactctcctctccacctctctcttgtatatcagggaatatatttattgtgcaccaaattgagaagttctattttacttacatgagagatggctttactttcccattaaggtggcaaccctataatcttaaaaatacgctttctaatttcctaataaggttatcattttcccttctctagctagttaaattgacagtcaaattcatatggatatcttaggcactctttctcctcgatgaatagaaggcaactgcctttcccatgtatccttaaagagaatcataccttgtgtatacacgcctgaaataagtaacagcagtagctatcaccctgaaaatacaaatgacataagatcagtatcttcaaaaacttgaggtcggtatctcaaggtaataatggataagtctggtggaaaatggacaaaattagtagatatagagtaaacattatgagttacagttaaccttgtgagaacgttgaaatgcccttatggttgacagatactacagtaaagggaaaaatataaaagtataactaacatgttcgtttttctcttaaagaaattatatctcagtctttaaggccaagcagacagcagaaatgttacagcaaaaatgaatcttgacgagggaaacattaaaacaaaaccaaagtatttatgtctctaaagtaatgagccagcaatttatacactataacatatatttccacaggcttgaaagtaatccttcagaaaagtaactgccaaatttgttgcaagtagaaaggaagcagaatccccttcttaaaataattaccctaaaaaagtcacccttggtaacatttttagaaatagtctacagcgcatagagtgtacaaggaaagcctgctaactaagtcccaatgcaaaatgacaactttggttgttcgataagggcatcctataacaaatggtacaggccagaaagtggagagaaggtttaacctttgtctaactttcacctgttgtgccaatcgccagatatctgaaatcatcaaatgatttgccttaatttgtaggactaacacaaaagtacaaaacatgaacatcgagcaatcttaagtgagacgctacagcttctataaatggaacgaaatactatgcgctcctatccattttcatacctacggtagttatgctacacctttgtcgatttatggaaacaatgctagcatagcttgcagtgaccccactataaccgaataagaatacaaatctgtatgttcgagaattttccatacgaagatgcataacattgcgcaagggcatgactacacatcctatgacaacttgattcattgcaattacagcaaaaatctgtgcatattaatggctaaaagttccctttcttaaccaccgaatgaccaaacaacacatgccgtgagctgaaaatgctttgcatacaacaattatacactacaagcatactacacaaatttctaattgccttgtaactatagccaattcctttgatcaacacaacccaattaaaacgtactagtatgcatgtgacacaaagttgtatatactgactaccgaattcatctagaacgagcccactaacgctcgcatactagttcctaaaatcattctcaaatccgtttatgctaagtagcagtatctccccaattccagaaaccaggcaatcacaccgagcccggagctgagaacaaattcgcgtcaacgaaagcatcacaggaaagctaaagggaggagaagctcacggaaggacatgtggatcttgacgaggcggaactcctccagcgtgatgccccggtcgctgtccgcctgggggaccttgtccacgtcctcctggtccagcagctgcttgctgccctcgctcgccgcgggatcacacacgaacgaacaccccccaaatcagcagcagctcagctcacggattcgcagcccaagaaaccgaatcgagagggggggaaacgtgggggaggttggacgcttaccagtgcgacgacgtccagaagttggcggccatcgtgggcagggcggaggcgactccggcgagcctctccggccgaatcggcggcgctcaccgggaagagctcggagttcgccggaggggaggggggaaggggaggggacccaccggcgtcggggatggattaggaggtggttttatcaggctcgagttttgggccgtttgggctttgggctcttcgaggcttactcggcccagaccaaatgatgggccgattcactatttcgctagtattttgcctcctaaagttcaaaattacaggagcctctctggggaatgttaagattgtaagaaataattggttggtaaccagtttttgataatgaaaaaaaaataggtttttcaacttctaattttcagttcatttttttagtctacaactatagattcttagaatctggacgaaaagctctgggagaagcgggaggtgatagaaactcttcaaatagggccttgaactgtttggtgtttggtatgttacccaaatcaatcatgataaatcaaattatgtaattcctctattttgttgttgcgtcagcaaaaatgtaattctgaattgtgacaaaaaaggaacttgtatggtagaggtatgtgaatgcggatgtgatagtatttttggtttgatgccttccaagatgtggtacctcgtattacatttttggtatagtggggtacttaggtttgtttggattgctaccttccagaaatttgctatggttggtttgggcaaacataccaaacactttgttttcacaagcaaattggagctcttttttaaggagggaaatataattaaaaaccaaccatgaattatattagctttttttctaaaaggtgaaaaagtataacaaccatgaattcaaaagtgctacatcatcaacattgatttaaataaacaaagggtaggagtaacctttcatacctgtcttgtaacatgaggattgctgtggataaaatgcctatttaccccccaaaagtgctcattcccttatttatccctcgttctctcaataacactcgagcccatattccacatgtcaaaactaagacatctatacattctatatagttataacccactaagtttaaaactcaacatacaaatatactagctcatcattcactaacaataattacatataaaaactcatacaagtattcaacattatttacaattcattgaattctacaaatcaacatgcaaagcatatgtgattatcacaccttacatcatttccataatattttaacatatctattcatcattatattacttaatatatatttatccggataacatttattgattgctcccagcgaaaaacatttagtccttatttggttaatccttacgagggaggaattggaggggatttattgtggtgtggaattattccccctcaatcccctctaaaccgaacatggccttaatcattgccaaccggggctccccttttcccattaaattggaagtcatcgggaaatacatttcaccgagggccctggcaaatgacactgtagctagctctggtaggccttctttggctggtatgacaagtgccctcacatgtaggtcgttgtgcagtgtcatatattgtacagtactacatatgagtacttgacaggaggaaaaaaaaaagaaatctctttaaggtggtcgctcagtcgtctactcaccatgtaagaacaaacagttgctgctcccaaacattcacatgctgtcctctcccaagtctgaacatgcatattcagaccaaaaaaaaacatcagtataactaacagtccaatatgtactcgtgctatgtcatttgctctctcctgtatcgtaggatcagccgcagctaaaatctataattttaaaacttaattttagagttgattttaaatttttttcgtaatttatttattaacactagttttgaagtaactataaacacatcttacaagttatattttttaaattgctaataattaactgtggacgaaacgcgatggaatcatactgttcatcttcgaagaacagatgtcggtttgcacgtccttcttggcgcaattcaatacgattcaggcttgatgtcgacgacgacctgtcatggaatgataccagaattaatggatggggaacacccagcatgttgacgtctcagcaaccaatccaagtgaattatgatctaactagctactgaaaattcctttatccagtgctaaccaatcagctctaacgatgaaactgtcagggaaaaggttggagtgaatatccatgaaaacgaccgggttttctgaagaacattcagggagacgaaatgcttggatggatacatacatacatacatacatacatacatatatatgtatgtgtgtgtatatatatatatatatatatatatatatatacatatatatatatatatatatatatatatatatatatatacatatatatatatatatatatatacatatatatatatatatatatatatatatatatatatatgatggatggttagtttctgcattgggtctcattcatgagatgggctgtctagcttatccttcagtttcagattcttgctaagttctagttccttctgtttggctgaaaatttgtagagtgctgtttatctatctcccactgtctgaaactctgaattacagttcactagtatgagtatgtttgtttcagtctttcagaatcatgtaaattatactgttttcagtaattattgcccatatgtctagcactcaactccagtgattcctcaacttttgcatctctggctggattgctgtccattgaaaacacccattgaaaacacttgttttcagaatgttccaaagtttctttaaccaaatactgccatgtgtgtatacctgtttcagaatattccaaagttttttgactaaatattgccaagtgtggcatactcatttcagaatcttccaaagtttttttgaactaaaatattgccaactttgcatctctctatggattagatttcactaaagatattttcatcatgcagccacccatatgatccttgtacttacgcaggccgtagggtcccttggcttcaaaaaagtcaaggaatccaacctcaaatcagataaactttagtgcagcgattggaacagatgccacattggatctgattggacttgtctggataggattatcaatttatcatggccaaaacatccgtcatgtcatgtgcatacgcctgttcgtccattgccagctaaatattcagaacctaacactgaactttttccacactgatcagaaattaagaatgccaaacacaactagctcctgatcaatcaagcgacattacaatctgcaactgcaagtgagtagatgcatgtgtactgtagtataatcgcattcaaaacgaggagtactacattgcaatgaagaatttgtttcgccaagattgatcaacctgacatggcagctccttcgcaattgcagcattgcctgcccttctcctgaaagtgccataagtcttcctgtacctgaagaacataaattcttgcaacaccgaacagatcaccaataaatcatggtacttttgaaggacatatgttcgtcagatctatgcatattcagacacaatacttatcagggcaaatacttatcgttggaatcagctagcaattaactccatgaagtttcagctatacatatacatattcgatgcaagaattaatcaatacggttatacggagatcgacagacataattgcatctagcttgacgccttaatctgtctgacctacactcgtgtctctcgtagtactactactaaatatcaggattatatatgtcaatggcatcatttccattctctgcattcaatccaagaacctttcaggctttcagtgacaaccaaacggtccccctttgcaagcctgcaactgccatggattggagagcatgcttcgtcataaagtggcatgctctccatcgaaaatgacatgcgtgtgcttgatgcttcgatcgatcttgatttggtggtctcatgacaaattacgaattggggttgcacaaacatgtcgacattttctttcaggattttgccggtgccaacatgatcaatggacttattaatagcagcagcattagcagcatgttcaaccacatgtatcatgtacaagtacaactgcaactcacttaatctggaacatgcgtaattaaagaagggacatggattacagactcgtgtgtatagctgaaatagtgaaattaaactgtactctaccctgttaatcatttacgtttcagttttttgctacctaatactcgtcaaaaatatttgacgagatttcgttaaaaatttaaagttccgaccatcaataatttctttaaatttgctgcctgttactatagaaaatatttagggcgagattcagttaaaattttagaattccaaccatgaataatttatcaaatgcttagtttttttaagaaataataaacatggatttgtctcaaaagtagtatcataaccatgatatcgtaaacttattggatatcataaacttattctaataaaaagttggtttttagaatttaaaagtttgatagaattttatcctaaacattaaatatttataaccgcgcgtgggactaccaaattacgtgaaacatagtactaggtcagttcaacccaaacaaataacatggaatgtaaaaaaaaacacaaatattagataataaatagaagtgtgagccttcgaatctaggccggctagtctaccaccctatggagttagccgaaaaacgctgggcgtttctcaacagtgaaatatataacaatcaaattaaagaatcatgcatcatatccaattatatggtcgagcttaaccaaatgattagaggggagaagggagcacagacgttgctctcagctcgctctgtcactacccagtgagccactctgtcatgcacgttgcctcgattgctcagtaacgcactccctccgtcccacgatataagggattttgagtttttgataacaacgtttgactactcatcttaatcaattttttttaaaatataaaaaacaaaaagttgtgcttaagatactgtagataataaagtaagtcacaaataaaataaataatagttttaaatttttttgaataagacaagtggtcaaccgttgcaagtaaaaactcaaaatcccttatattatgggacggagggagtagttactagagtaatacccatgcttttctaaagataaaacaaaatatattatgatattatctaaaataattcttttataaatatattatctgtcttttttctaaggggaatattcatcttaacttagttttatatgtgtttatcatttagatttggatagtttgtaaaatttatatgtgtttatcacttagatttggatagtttgtaaaatttataatagaaagatgaagtggtagattactatcaagtaccgacatataattaagctggattgaccaagcatgcaatgatataagttactaagaacatccatgtgaaataaatatatattccttccgttttttaatagataacattatttactttcaaacacatatttaaccattcattttattaaaataatattatgcatatgtataagatataaatcatacttaaaatatttgaagtgataaaacaactcacaacaaaataaattataattatgtatttttttaataatacgaacgatcaaatgtgcgataaaaagttaactacgttatctataaaaaaaatgaggtctatggcattgctctcactctcagctagccaccgacacatccagaaacgcgtgcagacgccggccatggctgatggcttaggtacaggtacatgccctaacattgtctgcatttgcatgtactcctatatgaatgcgagaacgacgacgaccgtacgacagtaccggcttttgtatcttacgatgggagctgggcactgtgctgctgtctaacgctgataataataatactagtaatcaattaagtcatacccttgctgctggacctgtctgtcatgtggaagatacgactgcacccccccatggtctgctactcatatgctagctgactgatcagtgatccagttgtagtttttcgtttcctttcagctatctttatgataataagctgtaggtgtagggaccaaagaggatttttttttatttatttttgaacttttctatttttaatcttaaaaataaacactttcaaaacttatttacttataagatctgaatcttttggttatgtcatgattggcatggcaaaataacattgtcacgccgatctggctggcgtggcagcgttatttggccacaccatcctcactggcatggcgggataaaactgttatgctcgctgtgtgtgacgtgtcagtattgtttcgaaaataagttttgaaagattggcatggccaaaggttcaaattctgaaaacaagttttgaaatggtctacttttaaaataaaatataaaaaaataaaaaaataaaaaaatcaccaatgcgtggttctttaaccttttgagatcaatcttgcaaactcgtgcttgttttgcaccctatattcatcggatttttctcgcctattagagcaagtttaatagtactctttccgggttgataatacttgtcgttttggataagggtgaggtcaaactttagaatctttgattatcaatcatttttaaaatatttctctttcaaatatggtgactatatgtatagattggtcttaaaaaatactttaataagatcatatatttgtttaacacttttatatatattatagtagaaaataatggttaaagttgttttttggagaccgtgcctttgtccaaaacgacaagtattatcaacccggagggagtataaccaactactagctctaattcatctatagtcaatctaatagttcattcatacaatagttacctatagacatatactaatccattaatatatggtctcacctctcatacacatacaacgtattggagtccgtgccgcagctagctataaatctgtagtctgctttccttctctctcttcttttctcttctctacatgtgtttgtagctgacttatagcctgccattgtactcgctcttactcgctccacgcttgtaagattatacgatttctcaaaaagctttcatctaatgcattggttaaaccattatttcagatgttaacgaacttgccgtacacattttgcttggactttttttctttaatttcgggttgagatggctcagttgttttcagttttcagttggcagatcattaagtcgattcggatcggagtttccgacaggtacattggttaattaattaagacacaactgagaatacaaagataatgcacccggtttttttcaagctacactatcgaattatttccgcgggttttttttatttactatacgtcttgaaaaatatgtttcctcaaaaggatttctcaactttttttaaaaaaaaaccattcctccaaattgtcgacgggggatacccatagactggatatagagggtattggggtacgctagtacgaggatctacgtagtacaacatcaagcaaacaagagacagagattatactggttcagaccccttagtaggtaatagccctaattcagttgatatgggattatacgatgggaatcacagattacaaagggaatagtggaacttgataccaacgagattgtagtcgagttggttcgactagatcacccggtgacttggctcatgtaggctccggcttcgtaggctgtggtggatgtgttggcggtaagattccatgccttaggtcctcccaggggtcccttttataccgcaggtcaattggtctccaagtagaacttggagatgtcggaccccatacgatacagtaacgatccagttctgtccgagtagtactccttccatctgtggactccgtgatgaatttccttaacgtgtacatggaacatccgtatacgtgcaggtataccatatcagtacacgacgtatatccaagggtagagggtataccttatccgtaactctgacacaaatctttgttaaatttattttatgaagtttataaaatatttaattcatcacgataatcaagtagataaataatctaaggtaataatgcgcaataacctgttttcagacagcctcgctggtgacggttgagcgctagcaaacagctcgcgcatgctgcccatgcagagagtcaatggatcaatccatgtatgcgctcgccggcggccgctgctcctcactgtgcgccataaattccaccttcggattggatctgaatatctatcatctatttttagttcgatccgtttaatttaatttgcccccaattttcactggttgatctgacctctccatcgactgattgatcgatcgatcgagccctactagctgtacatgaacaatgaacaattacatcgtgatctcttaattgaatgcatcttaattctgcatgaattcatgcatgctcttctcgatcgatcgtgttcttgaagcgatcgaggacggacgacactgtgtacttggacgtgaccgatatgcatgagagctttgtaatggtagcgttccaacgctaattaaatacaagcaaattaatcaaggtcatgtcctaatttatgcatgactaaattatgtatgagacagtattgcagcttgcaggtatgccatgatgatgttaacagtcctgcttctggtatccttgacaatgaacgatcgatcgatcgatcgatcaaattaaaggacattagctacgcacagtactgatcaccagcaaaacacatggtcagttgttaatctaatcaacctcctttaatttactccgatcgatcgatccaggtgctaaatagctgttcattaaattcgcagaggcatcagatcaccgttacattcatccattaatccagaatttcaggtactatttcactgcctgcgactgcagtatttgcttctgtgctagtaagagtacttcttttctgaagaatctgttactgctgctgtgctcatacccaactcgatcaatcacccatgggtttagtatcctctatcttcgaagctactacataattttatcactggtatatgggtccgatagaccctaggactcacatgtgagacatagttacaatcggtgttgggcctatatatggccgccgctttctcttccttcctcagggcaagcggcgtcccgcatgctcaccacacctcgaggctgattcattgctagggatgcggttatgcttgcggcatcttaacatgggcaaaggtcattacccacaagaagtggcggctcatcgtccttatagatagagttggtcctcttagtgcggcatggcctcacatgatcttttggctaaaacaactacggtggcgtcaccatgacggtgacaacaacgactgggttagaggtgaactcgagttaggatggactagttatgtccgcacgatccgaagactgccacaatcagaacggtatctttagtggcgattgatgagtgtaaccggtaacgtcagaaatgacggtcggtgcgtcgtcattggcgagctggcttcgatagccatggtagtggcaagatccgacaagtgactgttttacacttcaattactcttcagtgatatttttcgctttggcttgacatcaatcatcggcgctgatgtgcacaaaaattgatttgaataatgatcggacgctgattttgagattctatattccgttttgtaatttgatttatatcgacggtgttatctatttctttagactaatgttctagctagttttcttattagctatcaagttatgatttgtaatccgcggatgcccgatctataaattctataataattaagtttagcttctttaaatgcttcggtccaacgaaaaatatctcgaggtaccgatatctcacggtaccaaatcgttttcgatcgttagatctaacaatatctatcctgtctagttagattcaatgattgaaaatgatttgacaccatgaggtaccgatatctcgagatactttttgcagtactggagtatatctcttattaaacaaactaattgtctcaaaatcctcacgaggaagaggaatccgacgttatggcccgtgagaaagatggcatcaatgcgcaccccccgcatcgcctcatgggctcccctcccctctcgctacacccccggaagcaccgacccatcgacccccagcacgtcacatgcgctttgacaacgatctgagatcgatcgatgtgccgccgcccgccggcggccgcaaccgcttgccggcgacaaaaaaaaccggcgatccccttttgaccttgccagtctccacatgtgcaggcaagtccgtgtgtgtgtataaactagttcagcacggaacgaactcacagcacagcacaatgtgtcattctgcctgctttttttagaatgatattttttatccggtctctacatccaaccatatatatatatatacaactcttttaaattgaaaacttaatctctcaaacaacctaatctaaaaattcactcatatgaagatttgaactcagaatcataagatgctacttagtcagtgcaaaattactatattttgatcaaagttaaaacgtctttgtaatctggaacggagggagtagaatatatgtgtcattctgcctgcctagcttgctagctccactgccgtgcggtgcatgcgaggtcggaccactcccactaccgcgtttcgcccaagttgcgacgagccgaacgaccaaacacaaacgctggatgctgcgattctaccgaattttcgcctgctttctcccgtgcgatctcacccgaattcctctctctctcgtctcgtccccgtttttttttacccgtctccacgaaccaaaaagaattcgaaaccaaaaaaaaaaaaaaaccgcagcgcgcgtcctctctctttataaccttcaagtgttcgtccactccctcctcagctagcagcagctctagcttattactaccaccaccactgtactaccccgcacgacacggcgcgacacggcgcgacgcgacgcgaggaggtgagcgcggatgccggcggacgcggcggcgaaggggatgaagctggagaggtacgcgagcggcgcgggcgcgatgctgctgctgcggcgggcggcgagcgggaaggtcgtgtcggcgtcgtcgcacctgctgttccgcgccaccgtgctcgccacgatggcgctcgtgttcctcttcacgttccactacccgtcgctgctgtcgcgctccttcacgctctcctccggcgccggcgccggcgaggggggagccgcggcgcacgcctcgcaccggagcttgctcatgtcgtcgtcgtcggcgtcggcgtcggcggcgtcggtgtacgggggcgcggcgtgggagaaggaggtgaggcggagcgcgaagccgaggaaggacggggggatagccgtgctggtgaccggc

SEQ ID NO: 76674 - DNA, 598 bp, Oryza sativa
attccttattttaaatttcgaatttcaattatttttaaattgtattcctacttagactcttaatttttttctattttcagattttattttatttttattctgaatttcgattaatctcatattgggttcctatatggagttttctttcaatattacttatttttaattccgaattcagctatttttaaattgtatttctatttggactctccttttctttttctccgattaatgtgggaatttctagcccccacggcggcaaagtggtgccttcatttaaggctgttttaataatataatagattatgcagaagtataagatataaatcatgtttaaagtattttgagggataaaataactcacaacaaaataaattataattacgtatttttgaataagacggatggtcaaacgtgtggcagaaaattaacgacgtcatctattaaaaaagcagaggtagtattaatttagactaaaataattcaccaaacacttcaccggttcaccctttgtcctattccgttctgcagagaaaacagtgcttgaggttcagagttagtagaagctgcaactctcagctttgctagctagctagaa

SEQ ID NO: 76675 - DNA, 751 bp, Oryza sativa
tgttctgtaaagatttaaaaagttatatataattgtcagaactatcattacttagtacttttagctttctgctgaagttttatacatgagtgtatatagttggaaccagcattcaagtaggagaattggaacccagatgtgcaatagtttattttttaaacacaatgtctgttgtgagttccatccgatggttaaacgaaaataaacgttaattcaaatttagagaatgttggttgggtgcttgcaggtaaggatgatgatgttaaaggttatagcgaggactattgggctgcatcacttggttttgttgaacttctatccatatcttcaaagatacgttcaggtatgttcttaacttggcatgtgttcttcttgtagcaaccttatggtagatataatgtttatctatactctatactaatataaaagatggtagtggtggtggacccacggactgtgagttgcgtatctcttagcccccacatgccatagatcccgtcgaaaggaaaatatgacaatagaatattatgaaaattttcatctttacgaaatgacagcaaaattagcataatgataatataatagacaattagaaaaaaaaaccgttgcacctcacgtgcattatactagttcatactagttttgataataagttttctacctttctgtgatgcagcctcatcaacgagatgtaacaactttacttgctgcagcagtacaggcttgccatgatatggttgaaacacttttg

SEQ ID NO: 76676 - DNA, 742 bp, Oryza sativa
atttcagaactggagacttagagagcatatatatatatatatatatatatatatcatcagagatgagacaacacaacatgcagtggtgtcgattagagaaagcgcgctaattagctagctgttcacctcaggattctgtgactggaaattcaccggagcggcgacgaggaaggcgtaatcgcagccggcaacggcatcgtcgaagctgccttcttcgtccatgtcagcgcggaagacctccaaggggcctagtgcttccaagtccttgagatgggaagtcttcttcatgtcatctgaatacacaagagtaggatcttcagaggcagaactgaactctggaaactcgtagtagcgtcgtcttgagaattgagatcataacgatttgcatcctttccagcatatttcactatatgaattaggtgcgactatcggtttgaacatgtaaatattttctacattatctaaaaaaaatattttctacatggtgcaggtaagagtggcatttggcatttgctaagtagaagggaaaattctattcatcctcaggaccctggtgctctggtctcttggcagccgtggaaggaacggaacttctgggttttgactcggtgctctcttcagtccctgtggtcctggaatccatcctctcggagggtcatctgtggtgccacttttggggattttttgggagtgtagcgtggctatgccccttcccgctgttaggagttgcgtttagccgccg

SEQ ID NO: 76677 - DNA, 13048 bp, Oryza sativa
agacacaacctgagaagaaaagagatcttgtagcctcagatgtatcatcgtcatctcaatcattaccaacagtaactgaagctaatgccccaaacgaagtagcatctatggtgactgaggcaaatgattcttcctccaatgatgatgaaagagatgcaggagaggatgctcaagaacagatgtctagtggaggcgaaaatgagaaatcttcaccatctgaaagtgaaaagaatgattcaccaggtgccaaagagacggccagtaagctttctgctgctgctgctccattcaatccctccactgttccagcttttgggtcaatggccattccaggtttcagagaacatggaggattgctgccatcaccagccaatgtacccccgatgttgtcgatccctcttcgtaaacaccctcaccaatctgcaaccgcaagagtcccttatggtccacggttggctggaggctacaacagatcaggtcaccgtggccctcgtaacaagtctgccttgccaagcagtgaaggccttaccgaagcaaacacatttgccactagggtgatgaaccctaacgcagccgagtttgtgccaggtcaatctcggagtcctaatggcaacccagcatctccaaacggacctctagcatcaccaggtggcactgaagcttcacctcatggccttccttctccctcagacagtatagtagaatcacctgcaactgcatctccacaagtttctgaaattagccagaccagtcctgaaggaaatgatacaaccagtggggtcgatactgaaaatgggagtgaaaaacaggacactgatggcaagaaccatgtggaaagtaaagacggcgaaggggagcctgagcaaaccgaagcttccaaaggtgatggagatggtgcaattaccccggaagatggttcagccgtgactgaaaatccaaagtcctgggcagactacagtgatggagaagctgaggctgttgaggttgcaagctgagaaaagataaaccttctcagtacacacagaaaattttacctcttttacagatgagactttttcttctggacagcatacaaatgcaaaaccggcacactgctattttgtgtagagaattagttcctttcctgatccatctcatggtatgtagcatctacacgtgcttctgcagttccaatggccttgaaaggttatgcaatggcagagaactttgaagatctcttcctgagagtgatcgatgagccctttttttcagcttgctttgcatttgctccaaagaaacttgggaagagcaagcacacgagagattggttagcgcatatataccatagttcatagtcttccctttttgcctatcattttgttcaacttgttattatgtactggaccatctgtcgacataacacatgtgaacttatttttactctgaattttgatatattagaattgttgaaccatgtaaattgtaaagaaagtggtgcctatttggcctcttgcttgatgtgaattttacccaagatgaaatccgggattcaaagtgcatggcagaaatggaaacctggaggatacatctaatctacctagtgagttaaccgtccgtgctgatcagattatgtaatcggtcttggctttaatgaagagtacttttttttttggttttttttcagctcaatcttcttaattaaatactttagcgaattgctttagttaattaggaacaccgtcacatactcacataatccctccgtccccaaaagacggttcttttagagagtcaaagtcattccaagcaaaacattagaagactattatgctcttcgttaatacagagagaaatgaggggagaatgaatgaggagactattggttcaatggcaaaaaaaaaaaaagagaaaaggattcaataatattaaagagggctaataaatcattaagaagacagtcttcgtgggacaaattttgagctaaaaaacacagcaagcgcaaaattcaatagtgtagcacaccgaggtagagtcgtagagatcagtcatcatgcacgtgaaatcatgttgttagaaaaaaaaaagatgacccgttaaaactattatgcaatattattgttgcatttgggttctcaggccattcccaacccaagacactaaatatagttttcataaattctacattatcaaaaaaaatcagtactagacactactctttcaatgctaacaccacttttatatacttaaatttaatgttttgtcttggatattgtgtagaaacaatatatctttcctcatttattcacttgccacatcatcttttatactagggagaaaattgacattgtgccattgtcacgatggggtttcgctcaaatgccactgtacagatgggattcgataatacgccactttcaacccgtgcatctacgctcaaatgccatttactccatctcttcccaattaaaatcatctttccctgttttctatttgtttctgaccaaaataccctagctggtatcattcgtggggagaaagagatgggtgtcgggcgaggcggactggaggagaagcttcgccgcggaagcggccggcatggggcagagtaaagcttaaagaagcttgtgttctctcctagttcaagcctgcacaaacaagcaagttgctgcttaccaggatgacaggaagtccagatcaatggctgcttcttggatctgggcagctgctccatcgtcacaagtgatgggattgccgctggcggtggtgaagacaggcgtcgacgacattgatgaagaaggccacagcaacggttgtgatggtggagaagtaggcgcggcgctgcgaccggcgaaacaggaatgcggtgatgacgacgagccgcgaagaggcttggtgcctcggtgagccgatctgcgacgatcgacagacggtgggggacgacgagaagaactgcggtgaggtcggccgggcggcggcttgctgcttggagatggctgatcgaggatgaacacgatggctcacggcagcagctcgctgccggtacgccgacaccattgctgtccatgttgaacagggaaaacaaggggaaaacaatgtgaaaacaggggtgttttggtcaacacacaagataaaatagggcaaaatgattttaattggaaagaaacgatgcaaatggcatttgagcgtagacacacgggttgaaagtgacattttattgaatcccatctgtgtaatggcatttcagcgaaatcccatcgtgacaatggcacaatgtcaattttctctatactagatgacagcttatttaatgttagagcaggtacaataggaagctataagtcaactataaacatattttaaagaaataaagaaagatagagaagagcagctggctacagatctatagccagctgcaacacgaactctaagacgtaatgtgtgtatgataggtagaaccaagtatttatagtatagtaagcaattattgtatgaactgactattatattgactatagatgatttggagctagtagtgagctatactattgaacttgctcttatagacaccatcctagttattgggttgggaattgccttatggctgatctcttcatgttaccggtggtagcgctacgatttgttcttttcttctttccggagcattgaaaaaaatcgaacatagtatggattgaccatttgtttgtcatgctccctttttggctttttttgttctctgtgataagtgcttagcagttagcacttggtgatgttttcgattaatttcaaaatataagcattttaggttgtttagtaaatagtaacattaaaattttagtaatttcagttgttaaagtttgaattttcaattgcttatatccccttctaagtacctgattgttgagaaattatggattttcatgcattagaattagtgtctcaaaatacttatattgtgctataatcttcgaatactataaaaatccttggactttagaatagtgggagtatgaccgtgtgcatacttaactactttagaggatatgaattcatggttacaatccatattttatcctttcggaccacttgatcagttagttatgtatttggttcatgggaagaaaggatgggatggccacaaagggaatattacacatttacaccttccttcagtgaagctcgctctactgagcaaacccttagaaattagcttagcttcactcaaacttacctctgtgactcgcgcgacgaactttttgcatttagtgtcgatatttgctcatgtgtgtgcgatggttttcaccagaacaaaataattcaaaaaacaccaaagcatgagtattggacatattgaagcggattgggtgcttctgtttaaaaaaatctctccgtgactcgtgcgactaaattttgttcatttagtgcagacattagctcacatcctccacgtgtgacacctagccgactaggtggagaaccacctagagtaataagcgcgatgatgatgacctgacatcggcccaagctaggtgctcctccaagaactataactcccaagctcacaagatccaaaactccctcgctcacaagatttttggctcaagaactaagtggagaaggctaggagccctagagaagctaagggatatgtccaaaagatgtgctatccagacaatcaaaatggggatgggtagggttaaatactagcccatccccacaactaacagttaccaattcaaactctggaagttcaagtgtggaagatcggaacttcaggtcaacacttcaactagcaactaagatagggactggaatctcctttccaaaagacttgaaccttaagtccgaggttgttatactggtccagagaaatgacctgaacttccggtcagccttccagcgccgaacaatgaattctgacctaacgtttcggtgcaatttatcaaaatttttggtcaaagttcaaggaccgccaattttccttttgtatgtgtggtgcattgtgtctctctctacaaaattaagggtgatactagggcacttagacacaacgcataccattgatgccagcccctcttaatagtgtagtgtagttttcctatgactcaaattcaaaccgaaaataaatttaaatcgccttgagccaatcaccgattcgcatcaatttgtggggtcggggtctccatctttttagattattaagcacataggatgaatacctacactaatctcattcaacatgatatatcctctaattacattgtcatttatcatcaaaacctactaaggatctagaagcacttcacaatgtattagaggtgtggatggaagtcacctccacgcaaaatatgccaaagaaagccctcaagtcgataactattctagttgcatgggaactgtggaaggagagaaactcaagaatcttcaaaaatctgggaaacactccaacctccatcatggcaaaaataaagtaaaggaggaagcgcatatatgggtaatggcggggtgagttgcctaactgagatttactggttgtgtgagtagtcatcttcctttccttggtccggaatgaccctaactcccaattcctttgtacctatgaactcttcttctctatcaatatataagacaaacttcttgccttcttttcaaaaaaacaaaaaaaaacaacgtattagaggtagctagcagttgagtagttgaccttgcatacacagataaccaataggactaatttcacgcttccttcacactgaggtgaccacttacaccactaaacaacaaacgggaaataaccatgattagacattaaacaaagacatgcggatgcagtgagccatgtgtaacgctcaccttgatatcgaccatttcccaacttcttcgaggatttcattatattaattaatgtcaacagcggagagcttttgcgttgctaaccgttgatcatattatgcctctccctttcacattacaagtgattactgtacccccttaattacttctaggcgacttttgtgccaaccactttggatttgactatgcatcagagctcttaatttgttgagctacaagttaaatgagccagaaacaattgatcaagctcagcagctacagtatttcaagctctctcttaaccatgatagagatctagagaagtaaatttacattaaggtggcaattgaactaaaggcaaaactaattacagagagccctccaagcctcgaaaccggctggcatttaggcccttatatggttctaataatccctgtacttcaacactaacgaaacacacaatattttttttaggcccttgtgacatactagggtggtaaagaacagcaacagaggctcaaagaggaggcacaatattttttttttcttctcttttggtttgaacatagcacagcagtagcagcagcactctctcacaagtctctcatgaaccattcaacaacaacaagaagaaaaagaacctaagggctccattggagaatagcaactctgcacaatctaattaagcatttgcaacacaaaatagctcttggaatcttggcaacaatcaccggtcgaggggctcggtttggtccttgacaaccaggcgttcagaaacctctgcaagagatttcaggttgcatttcagcagggcctccacgaagtagcatgtctcatccttggtgttcccctccgggacgtcgacgacgaacgactcgatcaccagcgtcccgggccggccgtcgatcacctccgggtggacggtcaggatggaggagtaattctgtggaaagaaggaaaaaagaaatgacaataagatcagtttattcagctcacaagttcagtgtccttgagctaacaccaagaggcagagataaggttctccctcggattcggacaagtggtttccattatccagatgcagtgcatgtgaggccatttgtgccagcatcgccgctgagcaaagcaaacggataatggaccatgagtccatgccaaaacaagtgacagatcctttttttttaaaaaaaatgttttggaacaagtgacagatcctctcatttttttattttgttttaattttgagaaagtccaaaaaaataccattgacaagcatccaatttcaagaaatgtctactagttccatgaaatatcatcgtacaaacgattttgtcccagaaataccatcgccgttaaggttccgttaacggcgtgggatggatggaaccctaacgacaatggtatttctaggacaaaatcgcttgtacgatggcattttatagaactcgcactcattgatggcatttcttggatttgggtgtttatcaatggcatttcttggattttctatttaatttttgttttgaaacaagtgacagatcctcatgcaacgaattcggcaggtaaggtcaaagaaatggccagtcagggccatgctgttagttcatatggccaagggaatacaatacaaccaatagcttgttttgtggttagacgacaaaagttcgttgaagatgtgacaattgaaaaattcaggttgcgcagaccagcaggaaatatctcccccacagtccattatcatggccagtggggaggcatgaattagagcactaataaaataacaaattacggattaacctcatcattgtaagcgcattagcgtgcatgttccttgttgtcaataactgaacaggacatgagcagaacagatgacaaaaaagtacacctgtctattgtttcaagtgtgctctgtttgctagtccagggacagtgtatccagcaaaaaccttttctttttcaaagcaagagagtctattactctaatcagtggaatcaacccgtcatgtgcatacggtttgactatgcaaagcactgagatagtaaaatggtttaagatgacagatcatgcagaatatgttgcagcaccaagctgcagataaggttctagtaaccaatggttaaagtatactccctccgtttcgaaatgtttgacgccgttgactttttatcacatgtttgaccgttcgtcttattcaaaaaatttaagtaattattaattcttttcctatcatttgattcattgttaaatatatttttatataggcatataattttacatatctcataaaagtttttgaataagacgaatggtcaaacatgtgctaaaaagtcaacggtgtcaaacatttcgaaacggagggagtactaatttggcataaaaaaatgcagcagctgctgcaagggtatgaaatgctctaattgtcaacaaaatctgaaaattcaggaagctgctgtagctgataaaatctctagtgcccatctgaagttcagttagaaggtactatgtgaatcttgattagaaatctggagaacagatgattactgcttccttagtaatcaaggaagtttcaatcctaaacagaaaaaggaaaatcgaaaaatgcacaatagtcacatgtaagatatcagttattaacatgtctgatccatagtaacatgtaacatctgaacagcaaattaattacaagattattaacggttgatcaacatggaaacataccttgagcctatgatcacctcccacgaacctgacactgagtatgtgctcattgtcatctaacagctccagcctctcagtgcttcttgtggcaggcaggccagacttaacattaacctcccttacactgccaatctcaatgttccctttcatctcacaccggctcacaaatggcttgaaaagctgtggctgatcaaaacgcctcaccagagaccaaacctgcaggtttggttgccacaaattcaattagctgcagtttggttgactacacaaaagtatattaggcaaaaaaaatatgtagaaattaataatctttcaacaaacagggcagttgatattaaatgttcttgcataaagatcccaactgtgctagatcattcaggctgtcctatcaatgaacagttgaaagaaaaaacagaaattaactgaagaggctggcaaggatggtgcaaaagtttcattcaagacagattgaataggacagctcttttaatcagagacacacaatttctaaatggagaatttctaaatggagaaacagaggctagactctagagaatgccaatgatctctatagaaatatactcctatttggagttggaattaggcatcctttaagaatatgctgattattactgttgctggtaattgacaaaaatgataactttatatcatttgattaactctcagtgtcacaggcatcacatgattctgcaaaaaaaaaaaaaaacaaaaaaacaaaacaaaacgcaaaaaagaaagctaaatttcaacccaatcttcttagaaccactcaatagatatcgaaaggagtggaatccaactcaagggtatctctaccatttctttgcaggagtattacttattaagagaataaaggtacaactaagaaaaaggttaataaagtagtaagtagaaaccaatgcaagaacatccagaaatccaaaaataatcaaacaaaaaacaaatcagataaagccgggatctcgaggtggggggaagcatcttcccacgtgagatggcggtacgaaaggcagaattaaaaatccgtgcgattttcgtactagccatcatatcattgcgatcaatcatctgcgcattcttcttcctgcagagcaaatccagcaaagtagcatgcccaatccaagaacagctccacgattgttgcaagaaacagaaatcaatcgcaagcatcgcgtatataaaactgtttcgatcaattgccgcacactaatcagaaaggggaacaagaagaaaaaaaagaaaagcagaacaagaaagcctccaaattaagcttttcgatttgttggcatccttcctgatcgagaaattaaagaagagagccccaagaataaacaaaccaagaaaccgaagcagcgatggattcaggggaagctgcagaaggtcaccaggtggacgggggccttgatgtgcttggcgacggcggaggagcactggtggtcgcggggctcgtggcggtggaaccgcctcacgtactccgtctccgccgcgcgcagtcgcacctctcgtccgccagccgccacctcctccccgccgccgtctccgccgctcctcctcccacctccaccatcctcaagaaccccccctccctccgccccggcaatggacgcgacagcgacgcgcgcaggcggcgaagaccaggaggaggagaggagttttggtttgcctctggctttggtggtgcgtcgacgacgaggtgatcgacgacgacgacgacgacctatcgatggcagtgaggccgcgggctcagggtgtggtggtggttgttattcgatcgggggagtttttcggatacagccctgtgaggttcttgaaattgtagattggtccctcctctcttttttccttggatattattatttggcttgtgacttctgaattgatggatggatgggccccaagacatgagaggtgatgacattgttatctcttagaaatagctttttttttcttgttttgtttggtatatactctcttttttaaaaaataataataataattctaagtatgaatctggacatgcgtccaatggagggtacacgatggacactatgccccttttcttctgctccctctttttcaaaaatgatgggacatattttactactatgaatctagacggtttccctgattagattcgtagtaatacaatgtgtctcatcttatcttaatttcttatatttttagacggaggtagtaatactaaagatgggtgcaatgtcccaaaaaaaactactagtaatttagaaaatatgggggcaattcttttatgagaaaaaggaacataagtggcaaaagagaataatgataggttagttcacacttcataagtagactagactagcaaagttgcccgaatttttgtcatactatgaaactattccaaggatgccaacataatacttacaagtttatatttttattggggaaaaaacgtgtcatacgagatattgtgcatcataacaaaaaatcttgaggatcgatcaaatttgaccttgagccacgcaaaatatatcacacatcatacaagatattgtacatcgtaccaaaaaaattgatcaattttgaccttaagccacatggaatatatcgcatgcaagccaataatatgtacacgattttattgatttatttctcgatgaatagaacttaaagatataaaccctcatgctcgaatatcttgttgacaatatcaacaagtgcaatttagcctttgagttcttttattaagattactatatatacacaaataaccctctagatataaggtataacatatacatttaacctttttcaaaattataggatcaatgttttcttttctcctccaaagataggtataatgtattgcatagtagtaataaaagttgatataaaattctatttagttgttggtcatataccaaagtagtattagctagtgaacccctctcatgggcataaatagttaagataaattacaaaatagatacactcaagccaaaatattttatagacattcaagccaaaataaaagtggcaaaagagaacaatcataagttagttcagacttcacaagtagattagactagcaaagttgctcgaatttttgtcatactagggaaccttttccttaataaggatgccagcactatacttgcacgattatatttttcttgggggaaaaacatgtcatacgagatattgtacgtcataacaacaacctcgaggattgatcaaatttgaccttgagtcacgcaaaatacatcacatgtcatacgagatattgtacatcatacaaaaaaaaatcttgtggatagatcaaatttgacctcgagccatgcgaaatatatcacacgtcatacaagatattgtacatcataccaaaaatgttgtcaatcgatcaaatttgaccttgagccacgtggaatatatcacatgcaacccgataatatgtacacaattttattgatttatttcttggtgagttgcacttaaagatataaatactcatgattgaatatctattgacaaaaattgtgaggcttgcaagtgcaatttagcctttgaattcttttgctgagattaatatgcacagataaccctctagatataaggtatcacatatccatttaccccttttcaaaattataggttcaatgttttcctttctcctctaaaaacaggtataatatattttatataagtaacaaaagtagaaataaaatgttactagtagtggttggttgtatgaaagaagtattagctagtgaaccatctcatgggcataaatagttaacacaaattaagaaatagatatagtcaagccaaaatatcttatagacagtcaagccaaaataaaagtggaaaaatagaaaattgataggttagttcagttttttgaagtagactagactagcaaagttgcccgaattttgtcatacctgtgaactctctcctaaataaggatgacaacttcatagttacacgtgtgttgttttatgaaaaaaatacatatcctacaaaatattgtacatcataccaaaataagtcttgtcgatcgatcaaatttgaccttgagccacacaaaatatatcacgtgtcatacaatatattgtacattgtacccaatcttctttgtcgatctatcaaatttgaccttgagccacgcgaaatatatcacatgcaacccaataatatgtacacaattttttatttcttgttgagtttcaattaaatatatataaacccttatgctcaaaactgtaggttcagtgttttcctttttccactaaagataggtataatgtatttttatagtagaaataaaatgttatttagtagttgatggaatgaaagtagtattagtgagcccctcttatgggcataaatagtcataagacaaattacagaaagtagatatgatcaagtcaaattatcttaaagataacacataagctgatgaaaaactccggttaaagttcccctagtggaacactaccataataaatgagttgacatcat

SEQ ID NO: 76678 - DNA, 551 bp, Oryza sativa
tcgagccacacacgacgcccacgtcctgtttacttggccgcaacttcacaagtactgagtcctcgccgacgtcgttgcttgcaccaaccaactaacctgcatgcatgcaaactgaccacttcctactcctaatcttgtgcaagactcggctaatcactagcccacaattatgcatggctaactaactaagctacatacatgtgctctcatctcctggctctttattggctcactactccctgccaaccactactcactaagccatgcagcacccacgtacatatagctagctcgccaggccatgcaatacacacatgcatatagataaacatgctgaaattaagaaacaacaagattaatttctaacaagggagccgtcggcgcgcgcgacatgtgggtctgtctctcccggcatgcggcgggaaccagcggcggcagaagcgggagtggcggcgatagccgtgagcttcgtggatgcctccataaatgacgacgacgacggggtctgccggcaacttctgcgacgaggcttcaccgatgagatggccccc

SEQ ID NO: 76679 - DNA, 1630 bp, Oryza sativa
cgatcacgatgactggagaacttgatccaaactttctgttgatgccacttgaacttctggtctaacctctcaactaggcaaagagctctagccagaactttcggtcactattactggaacatttttcctacgtgagtgtggtgcattgtgtctcacttaagataaggctagagtaaattctatgtgtactcctgaaaactcactcaatcccttttgtacctctgaaatttacccaatcccttctatacccctaaaatttcaatttgatctcttccatgcccctaccattatattttccatcatttcactattacatttggttgcaaatgtctttttttgcccttgatgctttaggtttgaatataagcttaaaaaatgattaaaattttgtttgagtgcgcagtatctgcaatttatgaaactaatggatctaaataattagtgcataaaattttgacataattaaaatttttatttgaaattttaataggacaatagattttttttatcgggagcattcataaaaaaaattattgtgaacattggtcctatctttgtatgaatgctcctaatttttatgaatttttttataaaaaataaatacattttttatttcattatataaaaatattttttgggataaataatacatcgcacaacaaattcataactataatagtctcatgcgagaagcttttacatttttaataatgttcataaatttctatgttcatccaaagggtaaaatggttatttttatagaaattagacgatcaactgacgggaggggtatggaagggatcaaaatcaaattttaagggtatataaggaagtaagcaaaattcaggggtatagaagggattagctaaaattctaaaggtatacaagagattttctctcaaagatactatgaatacttgggctgaaatccaggccttatacatgaaccactcttaataatacagattttctaagactcaaattaaaattaaaaataatttgcgaaagggcctgtagcttagtggttataagagcctcagtagcattttaggtcctgggttcgactcccataggagcgaatttttcaggatttaactgtattgtgcttttcagtggtaggcgatgtacccatcgacaacgaggtgtctgtggtgactttgtcaatctctagccggtccagtattcgaagatgctcatagggatagggtttgcgtgcgtatgttcatagggtcagtggcggatctagaaaaatgattcattggtgtcataacgtgtctatcggtgttatagtatgctaattatacttagactatagtgttataatatatggataagcaggttttgccaaaagttgtcggtgtcttctgacaccgatgttaacactgtagatccgcccctgcatagggtgagtgtttgtgcattgtgagtgtatgtgttgtactgtgtaattctaaaaaaaaattaaaccatcttgagtccttatgccacttgctttaaatttgagcatttgaattatttttaatttaaattattgtcactaccgcagaaaacgttaaaggtgccggttgggaaaccacctttatgtcagttttcccaaccggcgttttcccaaccggcaccatggaagcgg

SEQ ID NO: 76680 - DNA, 10853 bp, Oryza sativa
aatgcagcagcatttagtaaaatcttgaattaggtttctaaccaaagtaccatatgagtcccgatactcaattccgtgagcacggctattcgaatagattcaggtttactttactacagtaaatgtacgctttacccgcaatccatgacatgctaatattcattagcttagtcatggcaaagcttttcagttactaacatcagtggcacctgttccatgaactctcatcctcatgcgctctgaacataacattgtcagcagcgcgaggagttctggcgttcccgaggtttttagagagagaactggttgagagacccccgtcatctcaaccaggttttcacaattatatatatacttgagctcaataaatcatttacctgcgcctcggtaaacgtcacatttgcccttcgcggcatataattgcctcctgcgcgaggacttacaatagaaccactgtacagaggtaccacctttgctagataacttactttgcaaggtctgtccccattctagaattgcggtcgtactcgttcgtttgacataagtacttggtaataactatatcgactgagacagtactagccacccggaaatcaaccaattcctacgtactgtcccaatctaagttcattatatttttatacggactaactaggcagggctaagcaaagctagcatatctggtttgctatgttcaggttatgcattcaaaatcatgtatgactaatgcatagaatagagatataagaatatgggataattatgctcaaaggggaggaataataacttgccttgctccaacgcgaataaatcaaggtaggcaacctgattatccgatgctcgaaataccacaggttgccatccagaatataatagactctactagagaagaggaagaaccaatttcaataaaatccataaaataacaagaaaacgataaacaactaaaagggctagggtttagggtataacctatctcctttatagggtgtagggattactgggctaatatgtgtaggttctaaagggttggaggctagaggggattaagtaataattgtcacttatattttatgtgtggtttttggtttcttggagaataggggatataccgaataatctaactggttaagtggatatgtggctagcattggtcgaggttgggctttggtagaagaatggctaggatttagttgttctcgagtcgatgctgaaataggatagcatatcagctcgtatttcatgcataggctatgggtagtagaagggtaaatggttggtatggagttcggatagcaagctgattgaggtaggataaatattagctagggtttaggtgtttgctagttgctgctagagttggacagtataacgactagaactggtatcttttctagccggtatcaacggatagtttaatggctagagggataggaggtttgtgtgggtttagtggggcggaagtgttactccgacaaccgtgagtggcggcggaacagctaggatcacacagagcccaatagctaactgtgcagcgtgctgtggaggtcgagggaatagtgtagctccgaccactataggcatcgaggcgtggggtgccagtagcagcacttcgaccttaggtttggttttgccgggctttacaaccaacggcctgatgtcggggatagtaaaccgcgagcgtccccatggaaggtgtaaagttccaactggcggctttttagtggctaaagggtattttgggacaaaaagaaaatatttaaaaaggcaaatataaattcaaactatatttgaataaattcaaataaaattataaaatagcaaattttgtgtcaaaagatagggtttgaatttagataaatttaggtccaagtttcactgaaatcggatctacggtttaggagatatgggcttctaaagaataggatttgaattaaatagggaaaatacaaaatgttactgtgcaggggcccacctgtcagtctttctttttctttttctcttctttcttcttcttcctcccgtcatcttcctcctctccttcttcccgtgtaacaacagagagagagagagaaggggcgctggggctccagtggccggggatcggcgacgtcggcggcgacttgtgttcccggacgacgcgcacccggggaagtcggtggctggccgagagagaggggaagttggccggaacggcaagtagaagagcttctcttcggctgcaaaggaggtgttgtggtggttgctatggggtgggggagaagggggaaacgggaaaaatgggttcgccggagggaggcaaagccgatggtgcaaggaaactaggagggaagctataggggaggagatcgaccgatggcggcgtcggccggacttggcaggagagagagagctcgaggagctcggctatggggaaggaaacggggtctctccggctatatataagcgaggaaaggcggtggttagaggcggtttcggaggaggagacgaaggggatcacggcaacggcgacgtgaggaagagaatgacggcgccggcttcgttctcctattggctgatgaaggcggtttggtgcagtggctggcgtcagcagggtgaggtggcggttgacgtcagcggcggatgcttagcggcgaaggaaagacggcggcgacggctcaaagttgcgggcggcggcggcaaagccgcgaacggcagcagtggtgacgtgggcgccatgaatacggtggcggcgctcacagggaggaggagggaatcggtttggctgggaggggtagctgggccggcttgggccgtgcaagagagaaggggaattcggcccaatctaaataggaagaaagtctaattttcatagaggtttaatttagaggagagtttgtaattggaagcaatttggatggctaagttttacaaggaattcgaattcggagaatatttgaataataaggtttgaaaggaaattatatccaaatataatttccagaagagatattttctgatttatttgagtgcgatatctttagaggtgaagtttgagggaatttatttggaagcactcaaataggaaataggaatattcaacactataaataatatggctctagatttaaatatttttgagtatgtggagggaatatggaaggagtagaataaatataattttagcccaaaatatatggcatggattctagagaagtatttgaggctaaaaaggaaatttggatcgagaattaaggataggtttaagatcaaagggatggtttaacaattattggaggtttaggttcaaaggaggattttcttggaccaattcataaaagtataaaggattttcaaactaaatttaaataaaggaaatatttggtcgaaagaaggtttaagatgcaaaatcaaatcaaagagaatacctcaatttaacgagaccaatttttagaataaaaccacgaaagattttaaataccaaaaagggattttatgcatgttaattttaggaggtccctctaattgtaatttcttaggtttaggaaggttattaagaacataagaatcggcatgatgcatatttagaaaatagcatatttttagtatgttacaaacaatcaatggacttgttaaaattcacataaaggcacacatgttaaaattcatgattgaaagcatggaaaaaaaatcagcgcactacatagcttgcaaccatcatatttggacttgctggtggatgcaaaaaacgtccacttgcaaccctcctctgctcgcctacactttgccctaaacctatccttgttttttttaacagtttggaaagcataatcatttaagattgcatggcaggttactgctgatttgcactcatcaacatcgcgaaacagcacatctacatcaatgcatggatcattaacatcatatgaaaaatcatgaatatcatcacaatcatcatcatcatcatcatcaacaatttcatcatcaggttcatagctgttgtcggagtcagagcattcagaatcatagcaatcagaatcagatgatgcagccaagtcagtgtcatagctactatcacttagtgccaccaatgattcagtttcggaatatgagccctcctcatcaactccgactgtctcatcactgacccttttccttgtggctcttttggtatgcttagactttgaaataggtggctctaccactttagctgtgggtagggttagatcagcaggaggacacaaagaaatatgtggagcactttcaatttgcagctgcacactatttctgaaatttggatggacccttctttttgtgggagagcattgcaatgggcctttaaattcatcaacatcggcttcaatattggctacttcatgagctatgttcagcgataaccactcatgcaattgctcatcactactaatctcaacccaagcatcatcacaaatacgccagaaagtaatgtattgtttagaacctcacacaattttagagccgatgaaatcaactaactgcagcaatttgaagctagctatgtccacatctgttgtaaaatgcctacttgtgaaataggtctttgggcccccatctggcaaactaaaatgtgaccttactctaacatcaagaatcaaattacatggaacaggcctacaaataggagcaacacaagataaagaacaactttcagtaaaatttttaggtgcttgtaggaatggagacaacatacaacatataaaccctaggttagattagcaatggagacaccaagttcaattagagtaagacacaacatctaaaccctaaattagcactggacacaacatctataccctaaatttgcatggtattgcatctgttcctataacctagcagggtcacaaccacaagcatgcacaggttcacaggatcacaaccacagggtcactgaaagagaatagagggaaaatacctttctatggtaggaataccttgcatggttgagggagcgtcgatgtcggctacctccgagcgctggccctcctaccgtcaccgcgtgtagcacccgtcgccgccccgcaccccacagctcgctgtcgtcgcccccacagcaagccgttgccgcgccaccacagcaagccgtcgccgcgccccacagctcgccgccgccaccctctcagatcggcgccgccccgcgccccatcaaaccgccgccgccctccacctccacaagcgggcgccagcggggctgtacatcacgccgccgccgcctcctcagctcgccgccgcctccccacacagatcggcgccgccgcccccctcagatcggcgtcgacccggaccggacgtgccgccgccactgccctccaccacaacgagcgggcgccggcgggtctgtgcttgacgccgccgccgccccctcagctcgccgccgccgccgcccccttaggccgccgccgccgcacgcgtactcgccgccgccgccgcacgcacgagtgagagagaggtgagaccgtgaggaatgcacgagtgagagagagagagagtcataatagggtttgggctttggagggtattttcgccattaggaactctgtaaagattttcttttttaaaaaattgaaccctaacggagttagcgaaagagggtcagtcggaagcttcgtactcgaaaaggagggtcaaataagcaaagttcaaaaagtagggtcaaatcggcaattacaattcaaaacagggtcaaataagcaattgcccctttaagaaacgttcaaaacatgtcaagattattcccaaacggaagtatcttcttgcctagacagaatattagtgagctgtagtgacatttctttgttgaaaagttgaaatgttcttatgagagcggaaagtgctgccatttcaaaagcagggaatgtgtgactttgcgtccttttcagccaatacactatcattggcacgctttctgtgcttctaaacagttctccctccattttatattataaattgctttgtttttttcaaatttatttaagtttgaccaactttagtaaaaaaaatatagtaacattttcgatataaaacaaacatattatcaaaatatattcaatgttaaatttaataaaagtaatttggtgtttcagatgttgttaattttttctataaatttggttaaacttaaaaacattgactaggaaaaatgttaaaacgactcataatacaaactggaggaagtatgatttttataaaaaagaacttttttatcaatatttctattaaaaaaacaaacttttcaactttctaatgtttagtttactcatttctgcactcaaaaaattgtcataaatccatcagatataaagaacaggctgaaatcgtcatttaaagatagcagatatggtacttattaacataatagcttggctttctcttaaagtcttaatagtatatacttatatacagtagtatacataaatggctttctcttaatatataccgtttttatctcttgtgagtatcatgtttctgtggctttaaaatcacaatgactattatatagcatctcttttacaatgtatatagcaatgagggagtgttcggctaggccccaccttgaagagagagggagaatagagtagcaggggagagatatagggcctgtttggtatagctccaactcctaaatttaactccaagagttgagtctggagtggagttgtgaagctgcctaaacccagctccacaactctagttcattttgtgagagagttccacccagctccactcccagttttggtggagccgaaattgttcggctgagctccaactccagaaggggtgaagctggagctggagctgtgccaaacaggcccataaacaatgggctattttattccttgtgatagtttttatggctaacggtggatcatccaaaatagatctataaggaccatcttcacaacatcttcacaatatacagggacggttgcttgagaggattaagaccccctctaagatgtgtttagttcacgtcaaaattggaagtttgattgaaattagaacgatgtgacagtaaagttgaaagtttgtgtgtgtaggaaagtttttatgtgatggtaaagttggaagtttgaagaaaaagttgggaactaaaccaggccctatttctacatttgtgaacgtcctaagtcaacgtgggtatagccaatcaaacaatatgcataaactaaacattgttttgtggtaaaaacaccaattcagacaacacgcataaactagacagtgttttgtgtaatggtagttgtaggaatattagggcccggtttagttccacagtttgaacccccaaaacgtcacatcgaacttttctacacacacaaacttccagcttttccgtcacatcgttccaatttcaatcaaacctccaattttggcgtggaactaaacacaccttaggatatgatcagtggcgacactagaataaatcggaggggggtgcaccacctcaaccgtacatgtagtggcacacggaattttgaagacatgctatacaagataacaatagtcgatagactatcaaatgttaaacatcatactagatgatggctaagtgtatgatgaaaatgtaattagaaattcctactttataaaatgtaaagtgaagggggcacaataaaaaagatactcaatattgcaagacacatttaagcattgaatagatacgtttgagaggacatgaaagaagagattgagaagatacgcaaaataaggtaagttattaacgtactgattaactgagtattagttatttcaaactgaaaatagattaatatgaatttcaaagcagtttttttatagatttttttttagaaaaacacaatgtttagcagctcagggggagcttgcgtatgaaaaacgagggatttttgtctcccttatgcatcaaactaacgcacctagactagttaagtgggagtactatatattggtgtgtgataaaatttaaaagtcaaggagctagtgccataactcttcaaattgaaatattagtacttaggattgatctgcaatattactccactttccttaatcccagttcaacagtataattatttaaatcctaaaatactgtctagaaacattaaaaataaaaactaaaattgaattttatatctaaactttaagatttgatgtgaagaaatcagacaaactaaagaaataagatgacgaagttatatgcccttgcctctatccaatcaactggcgatagacatgatcagtaaaacgaaaaaacaaaataacaaaatagtaggctcgtgcgaccaagtggccatgcggccgtgcggtcgtcccgccgcactctggccaggcattggggttgcgctttggccaggcattgggggtgcacgtaaccgagctgaggggggtgtacatgtagcaaaaacagaacatcaagtactgaaaacagaaatacagggttgtgcaccccctcagcctgtatagcttcgccccatagaaaagatttgattagaatcttttcttatctctaatacctttcaattctctatccgtgtaagagcatcaccaagagtatcctaatatttcattcccaaaactatttttataggaatcctaaacaaaatttgatgtgctaaaatattgatccctccaagagattgtctaaaattgacttcctaaaactaaaaggtgggccctctacaaaaccactaactgaaatttatttccgtctctccctctgtgagatcactctcgcgaactcctgatcgcggcctcgacaacagcacatcaacagcagcaccagctgcaaaattcaggaaaaacagtagagaacaatagcacgagaaccagcaagcagcaacagataccttaatcttcagcaagtgagtttgagcaatggtgcaagagcagagattgggatcattcacttgcatcgctgaatgaatcaccaacggcaaactgcttcgacggatgaactcatcttcatgagagaccaatcccagcaaaaggaatgagcaactccggccgagtcatggatgatgggagccgatgcaggcgggctgatttgcgtcgtatcgaggcggtggctcaaatggaggcagcgaaggtggttgggggatagacgaggaagttcaccggctgcagtgcagatggggccgctgccgctgccaaagcacaagctgccaacaccggaaaagctttggggagcggcgcatgatttctagccggccgcggcccgcgggggagatggggctgcctgcaggacaccacgatgaggcgacgaatgacctcgcggcgaaccccgggtgagaaaatttcatgtggcgcgggaattcgctcgggagagggagaatgggagctagcgcctctccccacttgtggagaacgaagaatccgggcttgggaattccaaccggtgggagcttggctagggattctgttggactgggtttttgaacgaaaatccccaaatttcaggattggaaaccatatacagatactgttggtgatgctctaactataatccctatatataccagcctaggaatgaattggtatgcttgttgcttttcttttttttttatttttgttgagacgcaaacttttgttaaatttgcagatgacagcaaacatgtgcagcaactacaaggtacacaacggccaaagaagtggttaaacatgaagcgatgcataccatgtttatccaaaaatgatgggagggtttaataacatcatacattgcattcagggggaaagaagtctatcatacatacaacgccctcgtgatcagttacatttacaaggtcttccatttcaaggattccccagaggcaggagtacaagaatacaatgtggaagtggaatgcttataatacatgcattccatgtacaacacaaatattacatgtatagatgaagatccaacggtaaatcgaattatcttatataaaccaaaaggcttggaaccaaatggtctatctatgtacagaattcaatcatatactgaaaaatggtatatcagcaggggagagagaacttttaccagctgaagcatcaatttctgcatgtagcaaagtatggacattactgatcttcagcgaaaaagttcggttctgcaggcttctgtaataaccttgcaggcactctttcctgcaaacgggcctttcgagtggcatttctccgtaagatccgcatcatattaccagcaaaacgtgaagcatatagcgccgcaccaagactgagcgaactcgaaccatcactgacaattgccgcttgcaacctcttctccttctcaaacaaagtatcctccagtttctttctgcagtatctatgccaagctgcctgtataaaacaagctgcccaggttctccattgctgtgaatagaatctaaatgtatgctggagttgtttgctgtggagtctcctgaattgggtggctacaaacttcaagtcatcagccctcaaagcaaaagcttcgacttcagacagcgttttcacagtcctggttgagctgggaaggtttgaagctgaagtagggtcaagtgcccatgtgagaagctcttcaccacaaaaatctccacctttgataatattggagttgaaaaagccagtctgtccaccatttgtcgtcatactctcaagatttcctctcatgatgaagagcatttcattcactgggtctccttcgcgaatgatgcagctgccttctgtgtacagcatgggctttagacgatcacacatggcatccaagagcttctcatccatgttttcaaacattggaacctgcaaatggtgagaaaaagaatgaagggattaattaactaaagggatagccggtaattatcagctaactaggaatctttgtattaagccatcaatga

SEQ ID NO: 76681 - DNA, 1529 bp, Oryza sativa
taaagtatacttagtagggatctgttgcaatgcacggttgtgatgctaattaaacagaaaaatgatagggaaggtttctgcagtcagctctgtgttgcagagttactaaagttggagctctgtggcaggaatccaggatagagagtagagtacaagtcttgaaaggctgaaaccagttttgcatatcaactttaagaattggtgttgccgtaagcatactagagcaaactcctttctccatgcttcacagagaggaactccagtgttgaaagtgatacgatcccattgtttccaagtttgtctagaaagttaggatggtttattttcctagaagtagcatagcggaatgctgagatatgtcttttgcagaatactggtcagtggtccattagaaagatatgttccatattacatgcaaaacccaccagcacactaaaggagcagccaaagcagtgaaccagtcatgaatttgcactttgatatggcaacaggatttccaaagcaatatgaacagtcatagaacctccctattgttgatgatcatattgtagactggtttatagttgaattgacaagtattcagaagctgacaatacaaattttctaaaaattcatatggcgctttatagaatacatggagaaggaaacaaacaatagggtaattgtctggtttgttcagatagattagactcaatagaggacaacaacgagtggctgactttgctgaatagttcgtggtaaaacaatgtccaagaggtaagctggaaatgaggcgacttacaagggatggatctttcagtcaactggtacagtcctggcctacatttgtaaaacaatgcccacgaattgttcattccataatacatgattgcaatctcccattgtcttccttcagtaaattagaatggatgctctaaatggtatgactatgctacttaagtgtacacacaaccaagaccaactcaacacagacacagtccaaagcactaaatgttcctatcttattgaaatttggtcggtcagtctttcagccggcctggcagaaaaaacactaaatgttggactgtcaaaaatagtactttagtactccctctgtcccaaaaagattgcaattttaggagtgaggggggcaaattagtagggaagggaaatgacctagattgatgaaacaaagttatactataggattgcatttttttttgggacagaatttgaatgctagaattgcaatctttttgcaatggagggtgtagactttaattggctatactaaaccagattactgattagacttcaggaactgccagacttacactatgacccagaagaggaaaggtctgacacaaaaccagaaagtccagaactaacatctgacaaaaccagtacagatgcagctattcaaaataagcaagaaacttggaatttacaaaccacatgcaaattgtttttatgtaacaatctaactaatggtccttgggaaatagaaggcaagaaatcaatcctcaacatatgatttggcatgacatgca

SEQ ID NO: 76682 - DNA, 13978 bp, Oryza sativa
  unsure (1)..(13978): unsure at all n locations
catgacatgcagttgggcttagtgttgatcgtggaagatgcatgttgtctcaagatgaaggtatgaaagattgtgcgagtctcaagaataacccttttcatatacacccagatgggacaagaatcaggattctctcaaaacatagtagcaaattatgcaaaggtatgagaaaataccctcatgagaagcgacaggcaaagatgcctctttatctctctcctaagattcttaggaagatttgaaagaaggccctcttcatcaacccctcttgtttcttgccacctatattgttcatgacgcagtattcgctccttgaggttatcaggaagtaatcgatgtgccatccattgctctgtgtcacgccgtttcactctcatttcttctatacgcacagaggcagattgtagataggtctgcaaaatacatgcaatagaaaattacgaaaggaagaaatcgagccgcttacacatttaattgtcatcccgattacaccttaaacaacagagttgttttcattacatgtaatataagtaaatagcattgcaaaaaaggagctgtttaaccctttaatttttaaggagaaaaaatgatacataaagagaatatgaattggctatataactcgttaattgtggcttctattgaaaagacaatatgcatgccagagaatagataaagagaacatgcatgtcagagaaacacatctacagtgtactattttcattaaaaaagatactccacacaagttgcatatataaaaaatattaactacttaatccaattatgatcataataaaaatatgacagttgatatattccatacctgcacattaccaataaggagtgcaaacaaaactagacctgatgtcgagacgaaaacagcaaatagattctcccatgtatacgtgcttgtcttaagattttgaccaagagaactgcaacaaataaaaaactatatagaaacaatattgaagtatgtgttcttcaagggaaaataaaacgaaggttatttctacagaccttagattttgcagaccccaccaaaagcaataaaacaatttttcaaagaaactcgttgattgtgaaacattttgaagagctggaagataaattccgaaagttggatctgcattgtcagttccatttgtcgggcaaaaatcttgtaagaaactgttatttctagctgcattactcccacaaaataaagatcccgaatcacagccatcatgtctactacatgcatctttccaacaggtgtcttctcgttgaatggaaagaaggtaccaaagagctccaaggacctgcaagcatttaaagcatcagttagtaatatcttgaccatgaataacaaaatatgtgcaaactgactagcctcttatgaagaactgaatggcgtatcacaggcatgcatcttttattttattttattttattgcagtatatctacaggtaccagatgcttttgcagacattttggatatgccttgttttttctgaaagttataatggagcaattaagtgactgtcatggggattgggctgagaggtcaaggccccagggcagcccacctgtcaagagaatgatatcgccgcctcgtacacgcctacatgatatggtattggttggttagagtctgttggataggattagactggcccttccttccatctatgtaaggatggatgtaacatcgtttggatcagcaatgaattcagaatcagtctccctcaacctaagtcctctctcacccctagcagccatcgctgccccgctatcctcctggcagtgtttatccctatgaaccctggcccataacagagacaatcagttcttcagacatcaacatggtgtccaatatacttgcccatgcagaaagggtaatgttggatgccctctataaacccaggggacaggctgcaagttctaaccccagtgcggggcaggctgtacatgcacatcgcaacttggtttttggctgtcgcttatccagaagaattaaaatgggcctgcactcatgctatagaccctgaagcatcataatatcatttgatacaatttcatgtatcaaccccatgcagtaacaaagtggccctaaacttaggctaacttaagctaaacacagtgttaccacaaagccaacatgcgtcaaacccaactcggattcatatgtctgattcgacatgagaaatactactcgggatcggacatgggtgtagaatccaactcagactctgggcatccaattcagcaaacagttccattgattgctaagaggatatgtccaagatatgatcagctcatccacatatacagatagccagatattgtatgtatggcatgcctcactgtgacaacacattttattgtttctactacgaaatacgatatatagttgcctcagacaatatagagcagattgttaaactaaaaacatggttgatactggatagtggatattactatggtactattgtgctgaaaaatctacattaaacatgttgatctttatttcaatgatgtgacaaagctgaagctaacaagcataaattcttcatggacacgcatctatgagaaaaaaagaatccccatatgacattttttttaatctttgtagatctatgtcccaaaaactaaatactaaagttcattcaggtagaatctttcacgaccacaagcaaagaactattgtcaaacaatattcactgaattatcaccaagaatgaaaattaggcagaagatataaaatggcccaaattagcatgccatgtaatttgtgatgtagaagacttacatgactagcaagcatataaattaaaaggttaaatgcagcaccagcccatgctgtctctgtaattataccagccgatctggtgatttgaaggtacaatggtattattcgaatcaaccgaggtacatattgacaaataactataaccattaatatattttttgccgtcataactgaggagccttgcagacggggtagaactaccaatacgagcacctgataacaaaaataaatactgttacaacttaaacaaaagagatccttaggaatgatacatcaagtcaaccacataacacttgaatgtttgttctacctttgcaactcaaaacaacccgcacatgaaaaaggaacaaaataattcatagaatgcatattcccaatttgttcccatccttacttgtctaaaaacttattgcatgcatgattgagtcaaacatgtatatgtttcatgcataataaaaaccaaacatatcttcagtgcctatattttattatcttctggtttgtattatccattcaattgaatcccccacctatgatacaacagctctatccaatttggccactagaaagcatggaagttcatcaaaccatggtgtagtggcacgatcagtagctgcagatcaatcataaatacatgtcgttttgcacattgacatgataccttaaaattgaactttgaccataactaatttctattgtattatatttaagacctggtaaatttgaaatatatggaagtatttctcaagaaaaatctatacacattatcttcaaatgtccagtctgaatatgtaagtccaaaggtttgtgacaggagggggtagggtacaccagagccaagacaatagttcttcaaagtttttttgaagtgtccagtatatctaacagctacatttaactgattactattgcgttccttaaaatcgtacatgagtaaagtagtacaaaagtgaatgcatattaatatactatgcaaagaacctttatgaccctaacaaacaccagacttataagtagctcattgttttaagtgctcagatctaaaagattaatgaagtaaattgcagatgtacctgaggaaggggcagaacagctaagaaatcaatcagaaaatatgttgatagataccgctttgctattgcaaaggtgtcctcaaccaagacacctcgaccaaacactctagaggaaggagcaataaagcctgtcctgaactgaaaaattatatggagtaaatagaatatatctgtaaaaaatcgcaggacacttgctatgatttccaactttttgtccagatataagcagatattgtcaccatcaatcactggaatatagaagaataacgggtccacagaaactgcaataaggcatgatataacaaatatcttgttccatctctgcaagaatggcccttgaggatcaagaactcttgttttggacttcttttcctcagaagctggtttgttgagggtttcaggatgtgaggaattccctaggaatgaaaaggctcctacagttctatccattagcgagtcaaacacattatgccttccttctaaaactgtcttttcggaaccaacagaatgttctgatctccagtcatgaaatctgcacataaaaaaatagcaggtcaaagtactcctcggaataatgtgcatggcagctatttatattgcaacattttttcagtgtagtagaataagaaatttctgtaagccataaaatgaaccaaattgttagtcatgtggagtaggccttcatgaaatctgaacgaaataaaaattttgtttcagacaccaacacactcttggatgttggtacaaggagtgcacagaagctgacctcacatatttgtcctctcggaaagccatggattccaccaaacaccagcatgcaaaacgagaccaacaaggcagcagaaagggatcaaatcttcaatgtcgcattgcagtatcaactccctgacggtcaccaaccataaatcagtagcatccctcaaaatgcaaagatagcaagtacaataaactggacaaaaattgtgtggcccaaagaccaaggaaagaaatatcaagtccaataacgcgacaaaatgtagataaatcgctagtttcaatagaaaaattatcagtcacaagtgaaatgacagctgtgcagcttgtaattaggcaacagcgataagataagttactccaccaaaacaagtaatggccacataaagtatagatcgagtggtaacgttagcattcaacaattcggttacaagtgagctgaaagtggagctgcaatttcctgctcagcttcaacaactaccgaaaacataaccggtttgtgcgcttgttgggaagaaacagccaaaacaaagaactctcgcggagcagagaacagtaactagtacatgacgagaacccggtgccctgaatccgaatcagttcatggatattcacactacgggccaccagggccaccaattccactagtgaatcgcgcagggacgatggggatcattcccaaatcctgagatgctggagcctagcttcccacctaaccaaaatccgcgaaacctaccccgactgattaagatctgagcgagaagcggcgagcagacgaagtagatcggggggggggggggggggggctaancnggagctatccccacggtggagggagggagggagggagggaagaaggaggaggagcaaaagcttaccggaggggcgcagggcgctggcacggcggcggaggaggtggtggtggtggagaggctactgcaagctgctgctacgaggaacaggcggcggaaaaggccgagagacgcgaggggagagcagagagagagagagagagagagaggctactgcaagctgctgctacgaggaagcggcggcggagaaggccgcgagacgcgaggggagaggagagagagagagagagagagagagagaggagaggagaggcggagttcaatgctggcgccgcatgatgcgggtggtggcggtgattgccgtacgccgtagggaggggacgggaggtggactccagctcgaccttgcctatcgtgagacggtctcgcttcgcaaccagccgttcccccgttccgtctagccactccggtgtttgcttggtaagccagtcgcttttctagttccatacatttaaattttatgcagcgaaaccaactgtatcgtgtacttattattattaacactataactgatatcgataaaatttttttagactatcaaactaagagttcataaaataaattataaacttcttatacattaaccaatacataataatcgataataattgaacatatattcatgaacgaactaaaatcgctgaacacacgtgactactccaaaatccacaggctattgtctctttttccatcgcttctctcccttatctttctctatctatctaaactgcatcatgttctcaaaagaagagaagacgaaggtgtgtcttggatctggattagtgtggcttaactacacatttacgaggaagcgttggtaaaggtgggtaggcgaaaaacaccatgacacaaagaggcggaattcaatgctaacttatgacgtggaatgacgcattaatcgtcatacaatataaggagaggggaggtgaacccagctcaaccaaatcatcaggagccctaatacgatcatgcaaccaaacaaccaaaatattccatattgctcgattcacaccattggtatgcttgtcacgagctcatctctagatatgtcactgtaccatcttccatcttccagtatacgtctttattacgacaacctccaaccatttcaaatacatgccactacatctggttaatcgctaaaaaatcatattagaactagatagtgatagatttgtgagccatatcatttaatttacgagacaacgttttcagttatcactactactttttctaagtattataactaccgtgaataaagttttattttacatatcttctatggtgcataaaattttttcaataataaaaaaaatatttgtgtggcaaccaattgtcgacgtttgatatcgcgactatggtattttgcatagtatggagatcattggtacaagggtatatgcgagattgaggtaaaacagatggagacaaggatttttatacaggtccaggccccttatttgacaggtaatagccctactactgttggttgaagccggtgtttcttatttatcataatcacaccggtacaataattgagataacttatctagctattgtcgacttaacggcatggataaccaactcgtagtcgacgacagggtaatcttcttcctcgagtccatactcggcgagatcagagatagcgctagatctctcttgttggcctccgcagatactatattgggtttgtctaggcttatctctgatatcgatatccggcggcttgtcttgacgtgtgttggcttgtattgatctatgttgatatgttgtgtcttgtggcttccctcctctcctcctagggaggcttgtatttatacccatagatgcccccttatccaagtggaactagagagaccaatatggatataatccgggtagtccttgtcgtttccatatagaactctattcgtccttcaatatacgaggtatgattccgtataagacatggtacatggtggaccatgccgagcttagtcaactaatattaggtatgtggtatccataaccatgacaccaatatagtagatattgcttggatagacatccgagtgaactaaaatctttggaccccacaaccactctatagtttattgagctatcggccattttccctcgttgcttctctctttgactctcttattgtttatatatttccatgaaacctccgtcactatcaacatctattcataactctttatatttccttccatatccttaaaatggatggaacgatagccgttggttgcactttgggtgagtgttgaccttgcgacaaccaagatatgatcgtgcgatgcaataatgggatcagcatggctcaatggtaaggaagtttgtgaccatccctcctctaggttaatatgtacaagctaactggaataatttttctctatctattattttctcgtaaactgtgtacttctataaagattgaatcaacttataaaaataataactatagagtatagaataagatacattgtttattagctaatatttaaaacaataaaatagtcagagcttttcttttaaatagtgtacttgtatatgttagacaagcatttcaagaaggaaaatctgagttcatgttccatttattttaccaaccaggtcttccatatcattttttttatgaaaatgaaaggattttgatacttgtcatgaggtacttgtggatgtatcacgacttatcgatcgtcataggtatataaacgtaaattgcgtcaatgttctacctaaaaatttagaataaccgtactacatattctacgtaataagagtaaggaggaacaaactaccattgcaacacctcgtgcagttctaaactatcccaatttcttttaaaggattgtgtaatccacactcttattaactttggaccattttgttttaaaagtggctccaacagatataatacattgtgacaaaaatcttatattgggatcatggttgttaagtcgtaaagttgagatcgagatacccctagactgacctgtcaaattggttgactagtcaattacttggtcatgcaaaaacagggatgcaatatatagtctttaccactgttatactatgctaagcaatacatgtagtattactgtagagtagaatgcaagatgataagttgataagaaataaaactgaagtactaaacacaataagccaattggtgaattggtgattttctacgactaatctatgactaaccatgactaatcgcatgacttgttatttggtcgagtcgtggttctctagtcgacttgcttgatcgactttactattaatcgcaactagctgggtgacttgataacaatggttgggatgtatggagatttctctatttgacccaatcaaaccaagttcagcttataatggaagatactatggtatgtgtgatggagccaacgacacaccattgagcccagttaactaatatcatttcccataattgattacttttttcatacatcaataataaacaatagagaaccggtagcaaaaaaaatgtaaggatgtaatccgagcggccatccgacctagcaggaggtggctccgccactagtattagaaaaacagaagagtttatttttattttttgtgcacattgaattcaattttattccatatccctgcatagttaagggtgtgtttggatggatattatggcggcttgtattttgtgggtgatggtgggtgggagtgggatagggcggcccagagagaaatattccccttagataccgtatggagggatccggacgatttgcccagacgcagccaactgagcgccctaacggatggagggatctttctgtttttctccctttcccccttttatgtgcgtgtgatttttttatttctctttagaattttgtttgtttgtaatagattggtacttttgtcggccttgtgaatttgaagggggtatactcaccacctgtattcaattgcaaccattcatctatcatactctctctaaccaaaacaaatggatcaccgaaccgaccttcattcttacaagtaaaaaaaaaatcttagatagccatcttcactcaactaaaaaaataaggccgccatattccttttcagttaaatgcatgttacatttgtcggtaatatgtgagccgaagtcacgtaacttcgactgcagatgatcctgattcgaaccagacgtgccctaaactcctgaataatcattattataagaaaagaaaaaaaagaattcctagaaaccggggccatttctagcggagaggaggcagggtccccggggtccacccatacgccacaggggaatctgcccacacccacaccaccgtccccttcctccttcaccccgcccccgccgcttcctcctcccctccaccgccccacgcccccccagatcccccaaccccattattaacccaccgccccccgcgcgcgccactggatctcgcctcgatcgccgcggtggcggtggggaggggagcgcaccgcctgcccagccatgagatggtatgcttcgctagcctgaggagggctctgcctctgctgctgcgcgccaccaccaccaccaccccccgcttccttctccccagggccctctccggcggcgttggcggcggggcggcggtggatgcgcgcgcgcttctccgtgggcacagcgggtggcgcgggctccgggtggccgccaggatgatgctcgactcctccgactccgccgccgctgcggggcagatgcagccgcagcagcgtgcggcgggggccgtcgcctgcagcgcgcaggacggtggtgccgcagggtacgccagcggcgggtgggcgaggtaataatgataataataataataataatgaataatgcgtgtctttacactttcatggttattatagctctatgtatctgtttcgatcctaaaccatctcgttttcgcctctagtgtgaaatgaaccgtgttggcatttgaatgtggtcctttgcgctggggaattggtttggtttgttcagttgtcctgtggtggtagccaattagcatgaagaaacctgctaggccccaaatatgaaggatgcaaatgtagcagatattctgattgctattaatggcttagtggattggttctgcatgatattattcgcgcctgtacaattttgtgaaatagttaatgcgtgaaaagcttatcgtaaaacagtaatgctctaaaaggtggtaattgcgtgctcagcactattctttgcttatagataacaatcttccatttttgtggcaatgtgccgatgcgtatggatgatttttatgtagataccggaagtagtatatacatatgcaatgagttaggggctgtttgattttaagccctaagctgacaaaccaaagtttggcaatgcacatgcttttttgtcctccatttggctggtgaccacaatttgtgtgccctctctatttggcaaaggtaggcaataatttgtgtgctctctctatttggcaaaggtaggcaatagacttaccaaacttttggggacaaaatttgaatggcaatatctgaccaaattttggtggcttagcctatctccatgcccatataaaaaaaatattggtaaaaccaaaacatgtttttttgctacttttttctctaggcacacatttagtcacggttattagatttcaattggacttatagatgatatatatataattatagaagaccttagttttgtatgatgcacaacaagggcgaggtatgaacccatgatggcataaaaatccattgcctagtaagatttaagaatgtgccagcttttgaatttatgattataaagatttaagtacaagagaggaggccctattggacatatgagcttagttccaagaagatcgttatgagtggatttttacagcggatgaagaaacatggtatttgccatactaaagtttataaaccgaagagtatcccaatcacccaaacaaccaaacaatacttgtttgaatatccaccataaaaagtttggttcactttcatgccacaaaaaatgttgaagccatctcagatcagacatatcactttgttcccttccatccaaactcctgactcactaatgttgactcatgcctaggccatgttccatctagtctactacctaaacccagtcgttctgtgctcctttggtccttccccagaattctgttcctgcatcatcttcacagttaatgtcctgcaggtatgatgtttgtgtacccactcaaaattataaggacataattactcctaagagaccaaatataggactacatacatgattaaatagctaatacacgatcttcctcataatatcgcctgctgcattcatcagccaaaatgagcaaagctcactgaaatccttagctcctgtctttaacatactcaaactgggaagttagtggccatggcagcatgactggagcgataggttgtgcctcttacatatggttgcgatggagtcactatctcagcatggaagagcacagtgagggtgaaatcatttgatatgacactgattctcacttagcagggagggcgcagtgatgtgcttgtagatggacatggcattttggagattgcggggtactaggagtaagaaagtaggtaatgcagtggctcaagagacaagcggagcttcagtgaagaaagagtgtagggaggagcaggtctggttgagccattaaatatgatgggggcctggtgataagttgccatcagagactttggatggaagataccatagtggtatcagagagttgcgaagctttggttgtttttggtgaactagactttttatggtatttatgaaaaacaaaaacatttcgggctccttggaagttgaatgctgaaatttcacaggagtttcatagaggcagtttacatccaacaggaatcaggaaaaaaaattccatgttcaaaggagaccttaggttatatacttgatgttctccttaaaaagccatgcaaatagggatggataatgagcaagtttggctcgttagacttggctggtcaggttcattatgataaggagccaacttggatcagctcattaaccttaccgagctaaaagactggctcggcttattttgctaacttgagctggctcgttagcaagctagaaatgttcaaacatgtcatgtacaatttaatatttaccaatttatcatatattagcaaaatagtagcaccaagttatcatatattagtaaaatatttattaaatataaaaggatatgaagtaattctgacattaagtaatacaaatagaatggtcttttatacaaacatgcttaatgagtagcttgcaaactggctggcttggtattggctgattaagctaacgagctaaacagccagtttggcttggcttgtttagaacatgagttcaagctgaactggtccacgagctttgagcgttttgttcacccctacatgggaactccaaaaagggtacatatgcaacatgcccttaggggcatgctattgtacaagtaggtcaattgattagtgttgtcaagaaaagtaggctcctatttacatgattgcatcacagccatatggtactagtggcgctcaaatatatgttttcttaactttggatatacattgagcaccaaaagaggtgtaagcaagttacttttgaccaaactatgcaccttttttaggaaactgtcagtcatacatttcaagcaaaccagtactttatgccataatttatgtgattcccatacttttgtattgaccttttctttctcaattttggtaaagaatttgagcacttgacctagtcctgcattaataagaagactgaattgtgcgatggatcccattccttggaatatgaagtagttctataagtctgtgcttacacaatcatgatggcctcttattctagttttttcctgcatcctattttgactgccttaaaggcttaaacataccatgtttgttcaacatgcaatcatgaccgaatatatcagagtttacaatgtgatctcttttgctggaatatgggacaattaattttatctccaatgtttaaatttccatctctttacaagaatcattcattctctttggactcattatttgacatgctaccttggttaacgtaatgtccgaaaaatttgtgacagagaagatggtaaactgaaatgtggatattcaagttttagagggaagagagccaccatggaggatttctatgatgtaaagttaactgaaatcgatggacaggctgttagcctatttggtgtatttgatggtatggtttccatctttccttgtctactttcgtgattccgtgcccaccatgtttttcttttgaagatttggtgcattaggtcatggaggaccacgtgctgctgagtatttgaaggaaaatttgttcgaaaatcttctgaaacaccctgagttcctgacagatacaaagcttgccataagtaatttttctctttgattcttacctttccagttctctgtt

SEQ ID NO: 76683 - DNA, 7323 bp, Oryza sativa
tgctaacgattatttcctgtaccataatttaaggctagtgacaagggttgcttattttctagacattctggatctgatatctaggtgggatctgaattggtaacttaattactgaactcttgaaagaactaagtttacctgcatggtgctgtttctaatttgcttgggcatgtttggtttcccttcccaacctggctagccttggttcactctacaaaagtgcacatgggagtccggtttcaatactttctagtttttttattcagtttatatttgtcttccccacccatccattaacacctaaagtgcccatgggactcctgtttcaatattttctagttttttttattcagtttatatttgtcttccatacccatccattaacacctaaagattttcacttattcgttttttctagctatggcactgtcagaagatcacaaacctaacaggagtgatgagcggaagagaattgaaaatgcaggaggagttgtcatttgggctggtaagctaaatcttcattcttggatgcactgggcatagtttgcctttgtaagctcacatggacaaggcaggttgcacaaggcttgtccatttggtgccttctgatctccttgtagtttatgttaggttctctatgtcatacctgggttgtttagcattgcagccttatttacctaaaatcatgccatctctgtatatatttttctgtttgttttttaaaagtgagtttattcccaggtacttggagggtaggaggtgtactggcaatgtcgcgtgcatttggcaatcgtctactgaagccatttgtggtggcagagcctgaaattcaggtatcttattgcacttaatcatgctatgatttgtaggcctcattttatgtagtttaacctactctagttaaaggcttagcctagtctagatgaaagtcagaataggaggtatttgcagttcaacttgtctctttgtatgactcctctgctgtataattctgatcatgaccatatagcttgtgtgtgaagcttgattaatgtcttaagaaattacaggaagaacttgtcaatgaagacttggaatgcctcgttcttgctagcgatggactttgggatgtcgtggaaaatgaggtaataaaccaccaagcacattatctcaacctgaaaacgattcgaatttctcaatgaaaccactgctgcttatgtagcattgaacaaagcatcactttattgtcttctctgtctgatctgggtatacatttttaatgattgctaaattctctgataattctgttaccaaaataggaagctgtttcccttgcgaaaacagaagacctgcctgagtcggtggctaggaaactcacggaaatagcctattctcgaggcagcgctgacaacattacatgcatcgtggtgcaatttcaccatgataaaactgaataataagatgggactagagctgatgaaaggttgaaggtttttctacttcaagctactttccagcagtccaaccacagagggggttccccaggagatgttgctcctgtagcatttgctaaggattgtttcgttgattcttttccttgtgtaggaatcattttttgttttcagaggtgttacgaacagaaaattttatttcgagtgtaacacacagttttaattggatggatactaataaatcaattgcttgtttacctaattacctgccattacgggcatggcatataattctcgatgatatatagttcttttttggcaatagtagggtacataggtctgtttaatgttttgcatggtccgaatttcaacaagcttaatgttgattctgggccgaacttgtgtggatcatttggtccatttaacgttagtgacgggccaaatttaactatgctcatatgcataataacttatcaatagccgaagcaaagcgatacaacaattgcggtttagcgtacaccccaatgataaaatggtgagattaggcccgcaaacaacattatttggcctaagcttgttgtaactaaatttagcccaccctcacattaacgggtagaattaagcactgttaacacaggccggatttactcattaaacaatctgaagctggttaaaacaggccctaaaactgctaaatcagacggacaaatgacgattaccgtcctagttaaacatgccgaatttagctaacttcggcttaatcgtaagtttactgggccgcttaatcgtaagtttactgggccagagacaccagtcaccttagagcactgatcacacgcatgaacacaatgatttcagagaaaaaaaacctttcagtacaggcaagatttcagagaagcttgtgtatcagatacaaactgtcatactctggaccatatcttctccggtcgagaggatagctatgtaggagtaactccaaaatcaagatgcaatagtctacagaaagaacagtccaacgaaggattacaatctttttctttaacaattggcattttctagtgctctgagctgtatcttttatgcgttattgcatttcctgttggccatgaacaaaagcaacaacactcaaaagtacaaaaaaaaaaaaagagttcagtgataacacacaggagaacaaggccagacataacaagacaggaaaacaatgttacttctcaatgaaaataaccaagcacttgcccgcccacattctgcttaattgcttcctcatgatccagtacaccatttggagttgtgatcacgacatagccccactgcatgacaaacagcgcactgagtcagcaataatacactatgtaaaataaggggtgtagaagtgataatgaattgagttacgacgataactcaatcacaaaaacgctaggtaacaccaattagttgcttaatattaatgaaagtgggcaaaaaaaaccatgtttttgcgagaaatcaaatttgccaatgtggcctatcaccctgaagggatagccaatggtccatggatcttatcatttgctttgttttctgaaagggactttgcatcagtgacacttaacaaacatgctagttataattcttctcatcatccatattctatcaattcagctccttaaaaatatttttcaaaatggattttacactgccatgttgaaagagtttgctgtgtcagaaaataattgcaacaaagaagatacagtacgatcgtgttaactacaaacatcaattatgaagttttctaaggaattaaatgttcatgatactaagatattgtaggctactgtctgatctagttaaatattttgttgctcctatacatgatttactttacatgattgacattacatacattccgttactttcaacaagagagtacataaaatatctagcatttaaaaccaagaacttataggaacttcagcttcttaattctccaagacactatttgcagtgtaaaaaaggataagaagaatagtccaacaactaactaaatatttcaatggtcacaaattagtagatggaatacctgccgtgttggaagcatccgaactctgtattgttctatttccttggctctaatatcctgcctataagtaagagccttacaatctttaatccttccatgaagctctacattgatttttccaactctatggggatcgatgacctcaaactttttaatgtaccctgtaaaatattaaaagcccaaatgtcagaaaaaaactagacaggcaacatatgtgggctaaacaaatggagggcaccgagcaatatcagaatatttccttttgtttttcgcatgaagaagccaaaatacaaggagaaaacaggcgagtcagtatgccaagtatcattttgttttccttgggtctgttatcggtttattgcggtgcataatttcaagtgaccggtgcaatgcaaacactcttgtgttagatgaaatgggtataagaagctcaagcacagaacgatctagggaatagcaaacaaatgcccgacctgacctgaccgattgaagagataaaaggatagtaggatatagcaaagcctaaacatcaagctaccaataaaacaaaaatctagcatcttaagaatatgcacactcgccttcattttccgatagcaatccacagtttcccacaataagaaatgacaatgctaactctaactcatcacatttcgtccatccagatgacgcaaatataagacacaaaaacaagtcaattatctaatctagccgtctaggtaccgaaagatcccaaaaatcgttcttagcatgaccatctcacttcgtgttcgtttctgtagtttcctccgtaaaacccaaaacccccaaaagtaaagcatcatccctcacaactaatccaaacatttgctatgctcggtgggtgggattacttgagtaaagactagtaaatcgcacattgaacccaacagactcctcccccgcccccacatgaatgaaaccctcgtgttcgacagtagtagaacagctcaagcagcagcagcagcaagcagtgcagactacgcgggcggaagcagtaggggcgctccgaaatgaagaggaagcccacctcggtgcttcatgatgttgaggaaggagaccatgacgccggagatgggctgcagcagcgccgtcgccttccccctccgctccgcgttcaccatcgtccgcagcgcgtcgttcaggatccgccgccccatcctctctctcctcgcctcgccgccgccgccgccgccgccgccggagcagatggagttctgcacccgcagcaagggcaacgcacgcacgcacacggccgcacgagtcgcgggctggaaaggaggtgttattcggcctaatgggccttgggcctttggggttacagatgagccttctagggttgctggtgggctttgtgttttctttgtttggaccttcggttatcttgtacttcctccgtcgtagaaaaagattaatttccgattataatgaaaaacatggtatatatccgaaattcgtagtttgtattttcctttttcgaaagcgttgcatgtagtgagtgatttttgatttttgatattcacaggtggaactcataatgcgtctcgttcttagaaacaatctcggtctaagatggaaaaattgccactctcaaactcgtttgaggttagtcaatctcgaggtcacatgtagggataaagtggacaatcccataaaccgtataaaaattcgtttactagtttatttttttatatggtagtataaattttagagaaaaagaattaaataaaaaatgggataagcgggataaaaaatcttgcttgcccgtgccgcttgcatccctaatcacatgtgttgacagaagcacgattgcttagggtagctccacggattgcacttgatagagttaactgagtatcattctcggttcaagccatcaatcaatagtgataactacgctccaagctgatcagttcatttaaaaatgaagatcactttcaatgcttgaactctacctcttaactgcctgaaaagtccccattttttctctcatccccctagatctcctcctcccattcattttgtagtttctctaaattttctccactaaaaaaaggaagcatgcatattatgggttctcccaagatacaatactatggcaatcgctattggttgatggcttgaaccatggtaagagaatgtaaatgttttggtaatgcaaacgtaaatgttttcccatcactctgtgaatggaaacagaacaagcgttaccgtgctttgtttggattcgagcagaagatcacttaccgtaatgttttccgaaaacacttgatatcggacggtaacgagtttgtattgggtccatatcgcttcccatggtacccgatcccgtcgtatgcaaagcaaggcccggtcctgccaatttagtggcccggagcgaagctagaaagatgagccctttaatacaactctgataatataatgatgtttctaataaatgcaaacaagttatatatctttctcctgtgctttctaaatctaagttcatatggtctatggacttctatatctatagcatacatatatgttgtgaggctccttaacttcgagggcctagtgcgatggcatagctcgacccccctagggctgggccttaagcaaacacataataacttgatcagattgcagtgcgaatagattgtggaagaaaactctccaaccaaacagcacctgagtaaaaccttttgcgcgaagtaaggtcgaacacataaggcattgctacgattgcgtaacctagcttattccataaaggtgcttgccttttagcgaaaacaactagtacatacacatgacatagcaaaatcatgctctctcaccaatgttaacaattatttttggagggaagatcatcaccaatgttaatatcaacatatcttaacactgaaagggacctaacacacacagtacaccggcctggttgaaagttcgaaggatgctgttccagctaccaactactatacctcgcattgggtgacatgaatatacatctctacaaggcacaaggtgattactagctcacaaggtgatcatcatcattctgtcccatcatgcctgttttctctctagccatcttgtggaatgctctttatttcactgtcaggccgtccttttcccccacaaaaagaaaataatgctggtggctccaccttttgtcatcactgatcagctctggtttctgttttattttgagcttttgataattgagtaggtgcaccctatgatggctggtttctgggacatgccaaattttgcatgcctcatcattattcacctcttttggtcattaaattagtcctcctctgtggtaaaagaaaaactactcccatatgtctgtcttatgtgcattattatcaggaagagaatatggaaaggttgttcttgataagtactctcctcattcctaaatataagaacctaatactcgatgggattgtctatatttgcagtattatgatatgtcccatctaatattatgttttttatatcttgggacgaagaaaatactaggtaaggagaaacttttgactctaaccatatatgtgtgacctgcgaccacacaatattgttaccatcaggaaaaaattagtatcatgtatatatggagaacattaatttatatgaatacatcttccctatgtctactctttgctaggaatgaccatttcaacttatctattgccaaagtgcaatcatccttaagtccaagcaacccatcgaatatcagaaaacccaacaacaaagaaacatattgattaagtattaacattgctaatgggactcaaaactgtggcaataaactgcacatatctatat

SEQ ID NO: 76684 - DNA, 12160 bp, Oryza sativa
atcatttgtctcacaagaagaaatatttcagtccaagaagctatagaggatttgcaaagaaagtaacatgcataacccttttttatatggagatcatcattttaatggcatggagcatttagacctcaaggaacaacaagatattcagaaacacaaccccttcgactcaagtttgcaaagatatataagttcagaatagagtttgccttggtcacccatatatattttttagagaaggttttttttttacccagcctctatatccaatcgaatatatgcagcattttttttaaaaaccggaacttagctattccccttccttcccattccaaatctcatgtataaaagacgctccttgaccaatctttacctacttaaaacattggtagagtttttgtcttccatcaatcgaataatcatgatccttcatccaatagatctaacagcaagatccctactcctcgactcctgcccctcgctttccgtctccgccccccgcttcttcagttagttgatgagcataaaagaagccatatcggacatggagagagaaagaggagaactgatttgttgatgatcggactccaatcaccctaaacaaaatcagtattaccaaaggaaaaggaagagattgatcgattaatttcataggttgagttgatttgaacgcgatgggccgaggtcctgcaacgtgcggtggcaagagagctcttggttggtgccgactgctttgtgaggaggcaattgaggggaggtccggcagcggattcctatattgtcgatggatcttatcgatgttttgcatctttacaatgataagctatctaatgtgattattattattattgttgtaaaaacctgagataatatgtggtttaatatatttgtcttcacccattgcaacgcgcaggtattcttgctagtcgagtgtacggaagaagagaacaaaaatattaaaccaagttcaccatatcgtatcctgttgcaacgcacccagcagctagtttcttggaaaaaggtaagtgggtccggtgcaattgtgcaaatccccctccctctgtccctcaccggtgtgtggcctcgcttcccattggctccggcgccctcgattcgtacggtgaacggcaaggcacaccgcggcttaaacacagcgtttgctcggttgcaccggaaacctcacctcactctcctcagctagctgcttaattacttgcagctagctcagctgcccggaatggtggagatggacgccggcggccggccggagccaagtccaccgtcgggccagtgctcctccgccgtcaccatgcgcatcaacgcgcccgtccacctcgtaagtgctcaggctcacccatctgatctctccagtagcgccaaacctgtcaatctttcgatcggccggttaattaatttctcttctctgaaatttggttcttgcattgatttttgagacttcttgatcttggatgtgtgtttcttgggtctctctttgttttcactgataatgatgttgtatatgctagctcttgctggcagtttaccagcacacgctgaaacttcactgaaaacgaagattttccacgaaaaaaaatgaaataagtacacaagtggaagagaacaggttgcagaagttcagaagaactgaacctaaaaaaataagtgttttttcccctcgagagttagctgaatttttacaaatttaaatgaagccctctgttttagatatactcttctagtagctaatggacaacaacaatggaaaatggatcaagtgtatgcgtatctgcaggtaattaaggtcttccagctgctatatatacattacgttgtaggttgttagatgcatcttgaagaaaaaacaagattcaaacaaatatgtgaaacaggctcgtcctttgtttgttcaaaagtttgatgagcctctgcattcaatgacaaattgataatagcaagaagaatatatgttttgtatgctaacagacctagagggatgtctgttaccatcctgttgctctttcttcgcaaaatccatattattataaagggaaagttttaagtgttttaatgagtatcattatagacaaagcacattgaaaagaacatcagctagaagtaattggtaagacaagaatcttactttttccttttttggcatgcacttatgtttcattaattgtagggacaagctagtccctctgtttcatccatatttcttgaatttacttatatatattatagagaaaatcccctgtgtatccctgaaagttcacctaatcccttctgtacctttgaattttgctcaatcccttaaatatccctgaattttagtttggatcctttccatgccctttccgctagttgactgttaaattcttatgaaaaagtccattttaccctttggtataaagaagcatataaattaatagagtatattgttgaagcatagaaatttgttatatgagactattatgtttatgagatagttatgcaccatattatttgcgataaatatacttttagatgtgatataaaaaattaatacttatttattagttattaatagatttttttagcatatgtgttctgatagtaataaataaatctgttgtattactatgaaaacacatatgctacataaaagaacttttaataactaataaataagtattaactttttatatcatatgtaaaagtaaatttgtcacaaataatatggtgcatcacatactcataaatataatagtctcatccaataaatttttacattctaacaatatacttcattaatttattatgtttcttcatagcaaagggcaaaatggactttttcaaaagaatttaacggtcaactaacagtcaactagcggaaagggcatggaagggatccaaactaaaattcaagggtatgtaagagattgagcaaaattcagggatatagaagggattaggtgaactttcatgggtacataggggattttctctatattatataatgcaatcagtcttacttttttttatcctgttgttttattaaaacgagatacaattagatatcggtattttttttaataaaacaagtataacttccaaactcgtgtaccaactagagctttaaaaatcatattaatccatatcaacatttgaattttagtgggttgagttatgcatccacaacttctgtaggaatgactgtaaattgtagatgattttgatcacttattctctagtccggtggccttagtctgatgtggttcttgtagatagacttaaatcatagaactaaatcaaaatgttagggatgaaacacttttttggtgtagtgcagttgtaggtgtatgattctgcccactacagttttactctccgtgctcatatttacacacacaagatcttgcgcttaataagtatgtaggaatcttgtttatttcactgttttatgtttgatttttatctttcagtttgttttagaggggtgcatttatgtgcatgtacagtggtgtagatgtgcgtcttcagtgtaataaagaaaataatcttacatcatatacccattgtaaggaaagggccttactcttgtaaactgccagatgtccatttttcatcaacaacatactgaaaaactatctaatttcacctcacaattatcaaaatatgtaatcagttgtaaataagattatattgtaccagacatcaaaataagaagtggaaggatgagaaaaagatattactgagctttgtcaaattgtaactaaagatggtcttcttccccaaaagtgaaattttctcttatcagttaaatgaatttgattcactaaaaaaattactgaatttaaatgtaccagtttgataccaacattttttttaactctgcttccaagattcctctgttggcagtttacgccatggtttcatatctcctcttcctaaccggccaaataaatcagattgcatctctagtcaatgccttccagctgctatgcatactgtgaaagttttctgaatccatctgaagccaaacatgtttgtaatgttatgcagttgtttcagctgctagcctgctaccatcctaatttgtctatttgaacggcagaattattcaacaaatgtgtcaagcaggcatatcgatcccgatgttccacttttctgaacattagctaaagcagaaaggacagtctgtgttttcgtttatttccacttcattgaataccttataatggataacctggctgctgcgtcaaagacgcacaaagcatagcatgacacatatcattacaataattccacaccaagaagaataatatgcatgaccccactaacttgtttctgatgatagtttaggtgtttcatttttggcaaattctaatagcccaccaagaagaataacttgcatgagcccaccaagttgtttctatcttcataaccagatgcatgagaatcttacttttatttctttctttttggaaatgtttttatctttcattcattaattaagctttgaacataccagctggtgggtctaccaatattttgcagtagaaattagtagtcaaagttacatctcaaatcaataccggtggatgttcaaaacaacatctttaaccacaagagtacctatctgactgaaaaaaaatactacatctgtcccattataagtgcagttgtgggtttacgtgtccaattttgattgtctgtcttatttaaaaatttatgaaaaataaaaaaaatattagtcatatataaaatactattcatgttttatcatctaataacaataaaaatactatcataaaaaaatttcaaataagacagacggtcaaatgttgaatataaacagtgtaaaaccataatttttctaggatggaggtagtaagttatcgtctgcactagagcactaggagggagtttttaagagggattgaaagtttagaggaatgagactattaagtgttttgtttggttgggagacatagaaattttggtgggataaggatggggaattgagaaggaactctctccttttcaatacctgtgtaggggcatccgggcatgtaattgggagggaattcctcctttactttgtctaagcaaatctcagccatccgtttttattgatgacctaatcaccaactaaactccctgtcaatttctatcacctccaccaaacaagatattgaaattaaaaataaaatgtccatcttaatctcatcatcaattccctcgttgaaacttccaattcccttcactcgagttaccaaacaagccgtagaatttcctggcggattgaagtttttttttttggcttccggtcacttgcaggtttggtccatagtgagaagatttgaagagccacacatcttccagcccttcgtgcgcggctgcacgatgcgagggagtactagtctcgccgttggttgtgtgcgagaggttgatttcaagtcgggcttccctgccaagagcagtgtagaaaggcttgagatccttgacgacaaggagcacgtcttcggtgtcaggatcattggaggtgaccataggctcaaggtatgctcgttcatatctcagaggcctgtttgatttgtcactaaacgaattctacaaccaagatttgacgttattgacttttggtaagtttgctaaatatttcgtattaccaaaatttatgtttttactttttttttctttcccccccgatgtaagactctcctttttccttctaatataaccagcaattctcttaccatctactataaattttttttttgttgaagtaacgttcggtttaaagcctcattaaattttggtgtggttttaaattccacctactttctaaggatctgtttggttgagctcgtagaagctacagcttctccaagaatcaaaagttcttccaaatactttagatttttatctagattttaaaaagtagttatagaatcaagaaaataaactagaagccagaagctggttttccgacttctccttattctcactagttgcttatctgaatccaaagctctctatacagggccttaacatctgtgtatattttaggctggaggcagtacatattttgtctggtgtatatcaaaatttggtaggttgaatttatcaacaaaccaagctgtctccatattttttgatgacatagaaaattaatcagtttgatcatggatggccaacctaaagcaaaaaaaaaaggagtagctaggtagtattccctccgttccatatgataagtggtttgacctttttttctagtcaaactttgttaagattgatcaagtttatggaaaaatttagcaatatataaaatattagattaatttcattagatctaacattgaatatatttttttaatagtttgttttgcgttgaaaacactactatattttttgaaaacttattcaaatttgaagaggtttgactaaaaaaaagtaaataacttataatatgaaatggatggagtaatatttgttacagaaatggttcaaactaacaaatagaatccgacagacacatttgcggagtagaatttgtgttctaaaaatgggcgaacatgttcactaatattcatggtaaacatgttcatccctttagtcctacataataagacatactccatccattaaaaaaaattaattctatatgtgtccagatttatctttaaatgaattttttttggacggagggagtactttttttcctcacattgaaaaatattacacatacaaaaaatcttgcaccccacaagctcacccaattaagcgtataatttccactttcaagtttcaatatgactcacaccatagtgaaaaatattacacaatgttgcagtacagtaattcttctcggtttttttttttgtgacaagagtcaaagtaatgtggaaatcctcgaaaaaaaaatagtaacgtggaaatctcctagaaaagcctgatcagtatatgaaaagatagaacgaatgctttcccatcctggtgttgtcgtgcttgtgtaggttaggccaactactgtctactggctggctgaccacaaacataaattaattaattaactgatgatcccatgcttaattaattttttaatagttaaaaaggtttgtatctccaatctctgcttttgagactatttatattctgcagaattactcgtcagtgttgacggccaagcccgaggccatcgacggcgagccggcgacgctggtgtcggagtccttcgtcgtcgacgtccccgaagggaacaccgccgacgagacgcgccacttcgtcgagttcctcatccggtgcaacctcaggtcactcgcgatggtttctcaacgtctcctgcttgcccagggggatctcgccgagcctcctgcacaatgactggattttagacaagacattaattggagggtttttttttttttgcattgttggcttgttgccatttgcatagcagcagcaaaattggggtaatcccagaagtatacatattcttttacgtgatgctaggtgaggaaggttactactgtaataccgtcgtcgagatatatgttagagtgcgtgacccaatccaccaatcatgggtcattaaggtcacattagactggcaacatcacatgttcaaccagaaccataactttactttataggtttacacaactcgaaaaactagacttgtagatatggatcaggctactcctatttaaattaccaaaatgaaactaaacttaacaatctcctctttcacacatcaggtccaacaatctactcatttacatcaactcatatgatcacaaagacttgtctgtgagctatgcttaacaatccctctcgtcatatcagagcccatacgaccctaattaaagacttgttaatatcattccctatcatatcaacccatatgacatcgaaaatttatttacgcgccatgcctaccatcaatctatcatattgtataagagctcatacaaccccagagacttgttctgagctcccccataacctcgtgaccctaggaaattgatccacgtttctaaactccagttctgataccacttgttttattgcaaagctcgttccactaaatgtggtccttccaaatcacattgggtctaatacaccaataaatctaaccacatgcacaactttagatcatatatttacacaacccaaaaggttattatgaggtgtgagaatttataatttccaccttttaagttatgctttctcatcatcaaatacttatataagaataaatctaacaaaatatagttataatcctttatattttaccaaacttgggtatagaacgatatatgaaacatgtttagattgctaccttgacatgccaaaatttagcataaggtgtgtttagtttttttgtgtaaagtttttgaagtatacagacacacatttgatgtattaaacgtagactaataacaaaacaaattacatatttcgcctgtaaactgcgagacgaatttattaagcctaattaatccatcattagcaaatgtttactgtagcatcacattgtcaaattatgacgtaattaggcttaaaagattcgtctcgcaatttacatgcaaactgtgcaattggttttttcccccacatttaataccccatgtatgtgtccaaatatttgatgtgacgtttttgaccaatttttttttaggatctaaacaatgcctaactggaaagatcgtagcggatcaaacagcaacatctatccctgacagtgtccccatgcatgcataatacgacataaatataattaatgcaccatttgactgtgcattgcgtaaataaattactttgtataattattttaagttctatattgtcaaccaatcgctctatatatataccttaatttgcgatagtcaactcgattgcgatgcccgtggtgtggtaccagcgtggtcactacattggattggacaacactttaggtccatgaattattactgtgaaagtgttttgacaaacagtaataagtcattagttttgtcaaatgggatgaaatgaagccatttattgcatagtccaaattaggcccacacttctacgttaaatgggctgaaattaggtcgacccgatcgaatgtaaaatagaaaaagtatactttgactccctcaagtatcgcccgagtattattcatgtcctccgaccataaaaccgggtatatcgactcttctaactatcaaaaccggtgcaaacaatacccctcagtggttttggaggacgtggcgcctacatggcggtcttgactaagtctttgtccaacgtggcgcttacgtggcactagaataaaaccaaaaataaaaaatatgtgggacccatacgtcattcacacgaagaagtacggtggaaccactgacatgtgggacccacatgtcatcctccctctcctctcctctctccgttatctctccccccccggcctttctgttcactgcggcggggacgacagtggggagcggcggtcgggacaacagcggtggggagcgggcggtggtggcggtggggacgaggcggtggggaacggttgcggcgacggtcagttgctgcggcagcggcggtagcggtggggagcggcggcggcgacggtcggctgcggcagcagcggtggcggtggggagcgacggcagcgacggtcggcggcggcagcggtggcggcgacggtcggcggcagcggcggttgcggtggggacgaggcggtggggagcggcggcggcgacagtcagctgcggcagtggcagtggcggtggggagcggctgcggtggcggtggggacgatggtggcggggagcggcggcagctgttgcggtggggagtggcagctttgctcgcgccctcgcccgcacagaacgttaggcagccgctctgctccagccgccgcgccatctcctccggcatcatcatcgccgccgtctcctcatccggcacgcattccacatagccgagatcggtgttgtccctgctcacctctaacatggccgcggtcttcttggggctcgggtactccgcggagcttgggcgccgccgtttcttgccctttttcattgcaatcatggcgcaaagaagcacggccatgaacgatccggcggtagccgcaccgaatgaatccaactagctgatgttgtcacgttgcagtccgtcgccggtggccgcggcactctgcatcgggggagcggtggagctgttcttgccaggtccgtgaaagaagaggaggtgggacccctggcacttgcggtggagaacctcgccccagagctctggattgcgaacgcggcggcgcccatctgcgccatgacgggggtgatcgacacaatactctttcttttaatgacatatgggtcccacattttttaaaaattttattctaatgacacgtaagcgccacgtaggacaaagacttgtcaagaccgccacatcagccaaaaccatctccaaaaccacagagggatattgtttgcaccggttttgatagttggaggagtggatttacccggttttatggttggaggatatgaatcatacttgggtgatagttgagggagtcaaagtatactttttccatgtaaaattaattaagcctcccacgagataaaatgggtcgtaaattgacaaattaattaggcccatttcaaagttccaacgattaataagctggatttaggcctattgatgggctaaattagaccactcaaatcgcgcaagtttcaactttcagttcagaaagggctttgtgttcaacatgcgcggtcgcccactcccacggtcatctacatctaagcatgtggatctccctccactcgttttctgcgtgcataattcccaaactgccgatgtgttctttaaaaaagtttctatacgaaagttacttaaaaaaatcatattattctatttttttaaaaaaatagataatatttaattaatcacgcaccaatagaccgttttattttccgtgtgcaattcgcttatcggtaaccagctccaacaaacacacactaaacaattaaacatgggagtccctattgcgaatttcctgcagtttacaaatccgttggatcgttttttcttaacaaaactcggaataaaaaaatggatgggattagtttacccaatcttttgatgatgatgctctttactataccgtagtaaaaaaatcaacagcgaaagcaacgagtgagagaaaggtgggtggtgcgccgcaagtgcatgcgccgcccaaaccggcctattggattggattttggcccggtcgtgctggaacaccaacacatactttgctttatacttggccggctgatctagtgtccacagcattttgcacctgtcatgcgtacggtatatctttatgtttgtctccatggtggattccactcaaatatatactgtctagctaggacgagattgtgatattttctaatacaacaaacttaaaattaaaagagaggggtatatctagattcattttattagaaaatatcatatccgatccgttgattttttataggacggagaaagtatgtactaccacttgaaaaaacaactttgtacatttttatactccaacactgattaattaccgtgcgacttagtaattcacaactaaatattatatatatatattttgttttcctttggaagcaccaattgtaattaaggtgtggtggagtcgtgttggtgggtacatacatgattttaaccattacgattattttttctatttttgtaagtattatacattcgataattaagattataacgaagcacagacaaatattatagtcgcacgtacgaatacgttttcggtggaatccgttttcggtggaatcctgatgtagtcgggtatctgatgacgctagtctctttaaccatatcttaggagatgcattgatcatgtccgatgcgcgcactcgtagaattaaaaaataaatctcttgttttaagaaaagatgaatttgcaggagaggggttgacattattcaaaaagaaaaagactcaattattctcgaacttgttgaatagttaaattggtcgaacaacaaccttttatccctgcacagcttatccggagtatcgtaccttatcatgtatccagcatgtgtccctacttatctcgcatggatgcggtttctcatgcggagataagggtaccaaaggaaaa

SEQ ID NO: 76685 - DNA, 729 bp, Oryza sativa
ttccgctccgcccgcagttctagtcgtagtcgttgtcccggggtgagccgaggaccgccgttcgccttcccccttcccctcctctctgtcgggtgccgctcccccgcgccggtggtcgccggcggtgaccatcggggcgcgggcgcgtccccctcccttcggccgcgccggcgaggccgccttcgggcgcgccccgcggctgccaggtggggcccggccgtcagccgcccgcgcccgcgggtgcggctgacgcgtgggacccacggcgccgaccgccgccagccgcgtgcgcccggtccaccgtggaccgtggggctgacgcgtgggccccacttcccgtggacccggtccgcgcgcccgctccctcggctgacgcaataaataggatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagtttagtagtgtaaaagcccttttcttttccgttggtcgtgtagacgctgcagcttcggaagatccgctcttcgtggaagccgaagccgtcatttgggaaagcgagcaaggcaagtcacatcatccttgaacatattgaatcccagtttgtaaaattattttgatttaa

SEQ ID NO: 76686 - DNA, 763 bp, Oryza sativa
tcgtagtcgtgacggtccgtcgagtaatggtagcctcgagctgctcggcgctgtatgattgtgtcgcgaagatcgatgggccgccgacgaggtggtgagcaagaccgttccactcggcgctccctatgaaggtcggaaggtgagtgaacagaccgctcgtcgtgacccctgctcctgcggttggatcctgcgccggtgatgctgaggcttggatgacggtagtcatgagatcgaaagtggggaactcggctgccagtcggcgtgtgaacgctttcggagttaactgggaccgaagccgcaatcatggtcttcgtctggttcaagatgttgacgacgtggtcggattgattgagctcgttttggttgaggagggtgtcgagaagggtgatcgcggcaaccgcattctgttgaggggtgcggaaaaccggtgtcccttcgacatcttgctggccgatgagatcacgcgctcggcgccctgcttccaaagctcgctgacgtcgatcctgtcacaccccgaagttttcctccctagccaaaatcgtaattttcaaatgaccccaagaaaatgcaggtgaaatcaggagaaaaccctaagaaagtaatgcaaataataatcggacttgacatgtggaatttttcttaagttctacatgtcaaaattcattaacaggatttttagtggaattttcagagctctagaaataattttaaccaattaaaattgagcaagcaatattttattccagggaaaatcctttttcct

SEQ ID NO: 76687 - DNA, 836 bp, Oryza sativa
cgatcgatgcgcttacaaatcatgatgctaattaagagtgtataaggtcatttccaacctatgacactagacatagttttcataaacttcacatcatcaagaaactagtactagtactagacactactcttccaatacaaacaccactattctatacttagatttaatgctacttatttcacatgatgtcttgaatattgtgtaaaaaccatgttccatgcaggacatggtttttttttctcatttatttatttgtcacgttatttttcatcctagttgacagtttatttaatgctataaacatcatcctagttattgggttagaaatggtctaatcatgagatgtacgatactaaacgtctgttcgcgttccgcgaacgttcacgtattagcctcacccgctgctcgggcggtgctgcgagaccgcatctgtctcgtgccaacagaccgcaaacagcgtctctctcgtgccgatgttgtggcgttgcggggccgtaacaacgtcacccatttcgcaccacgacaccgcccatgtcatgactccgtcacgcgagcaggacggagctagaactagacagagagatgctgctagcttaatttattttacttaatattgagtttaaactgacatagatacttatatttatattgagagggtgcatatatagcgaaaatagataagatatagttataatttttttttcaccgggttactaggaaccccctaattactctacctccaccctgcacgcgagaccgcacacgaattcagcacgtggtcattattttcacgcaacggtcgagcaatatcgtgtcatgccctttcactcagcgac

SEQ ID NO: 76688 - DNA, 666 bp, Oryza sativa
tatggccattttatttcatggcctgatagtttctgtggtaatccgtaatcgccaggggtggggcgtgtgttgagtgactttgttgtgtacattcattctgattttcatctatattgatatgttgcaggaaattactagagcacttgttgctgacggtgtgccaaaagatagaatcttaacaaacttctgactgcccctagcccactagaacacaattatcagccttctagatgttgtatccttattactcattacagtgattattctttacagcaagcgcgatggaaactcgcaacagagaaacagttttgtactacttacatataggggcttctttttccaattttcctgcacgatgcaacatgctgcgctgtaatctggattttgccagcctgatgtatcaatatcaacacttggtgggcattttcgcatttgaaccgaaaggccctagttcatacagttttgtacctcctgaaacaatacccccttggaaggtgttgatatactccaaattacaaaagctagctcaataaaaggggtagagatgagtggcctcatgtatttgccttataaaagaggtagagatgagtggcctcatgtatttgccttcagttataatttgtcttcagttataatttgtgtattatttccccgcaaaaaaaataa

SEQ ID NO: 76689 - DNA, 11335 bp, Oryza sativa
  unsure (1)..(11335): unsure at all n locations
cgttcatggcgcgcacgttgtccgccacgttagttggtgcccaaaattcaaaattaaactgcacttgcagtattagacatggcgttgattttaattaattcctcggtttgaaattaatcacgtacgtgacgtcaccgtttgctccggcgtgcgagctggctcgccggcgtcctgcagcttcaccggaagctgctgctgattcttctcctccactgtaaaagaagaagaaacacgattttttctcttgagaaaattaaatttcaacggaatttggaattctgcaataatttgactgcgtgcaggtgtgtgatgggtacatggctggtcgggacgagcagtggtttcttccacggcggccgtggtcttcacggcgttgtcctcgtcggcgactggcaggtgggttcaatttagaggtcagattttctccatgaaagctacaggcgagtcaaaaaccagtcctttgcgaaagttgcagttgcgtcgtatacctgcaggtgcagcctcgtcgccggaatctgccgcgacacgctccgccgcctcctccgcctcttccgatctctcgccggcgacctcctggattatcaccgtgtctttcacccctaccaattaattcagtataagttcataagaaaaacgaactaaatctatggacagaataatgaatgattatgggttacatatatacattctgtcttttcagcggtttgatcgacgctctgctgcatatgagcatgtctctctccctgctgcggcaggatgtcgacatggaaatcccgggtgaggccgccggacgatgatcggtgcagcatcttcatcgccggcatgcgtgcgtcttccaacgactccctggggctcactgcatatgcaatgcagttcagacttttgctgcttaatttgcaccgagtgcatatgcatgatgcaacggagatcgagatcgatgataagaaagaaagtgagaggaggaagaagaagaagaagaagaagaagagatgaagaagaacatacgggtggagaagacggtggcgtcggggcgggaggagaggaggaaggtgagggagatgaggaagcagccgacgacgatggtcagcagcctgaacctctgcgactcgaaccgcagggcgtgcagccgcccgctgctcccccccggcttcatggcttcagctaccttcttcttcttcttcttcttcctctcttgctaatggcggcttagctctgcatgcctcctctcgtcgtcaggctaagctagcaagctagaaagtggaagcttctgtgcacaagcaaaatggaaggcagagacgatcgggttatattcttctctctctctctttcagttccctgcttgcttgtctgtcagatcgactatgcctgtgccgttgggttggtgcagtgcagtgcacctccgatattgtcaagcaaattcgagcttcttctcgtgcgtgaattggacaactgaacctggcactcgctctctgcgacgtatatgaattgaaagagctagctttgatgtgctagcattaccgaaccatgcatacttactatactgatctacttacattggatgacctccttcggtcatcccccccaaaaaaaaaaaactatactgatctactacttctttctgccttacttttttttccctagttcttttaacgaatttgccgggtcatgcaagtttgtaggacgtgtttgtggaggtccatgttcttcaattcaccgtgcgatatattccatctcctagatattcttgaattttctaattcatgcagctgatgggggtgtgctgtacgtggatggcacgcaaaaaagaagaagattggtcttattcagattcagaaccattaattttgagtttttgactactcagactccattgcaaaactagtactgatgattgatttcttcagcatcagactccatgcatgttaccttggtcaagtgattgatgggtgtatatacatgtacatactgagatatataatcaatgtgcagcacggcatggacagttggagatcaacagcgaatcatagggtcgtctacagaaacatatgctactatcattgaagaatatggagttcaataatggattcaagttaatgactcctacctatataggagtatctattgtaactgtgctttgtcccatgtgattaatttttctcaactaatactagcagtggtatgatactgtagtatatcattccctccaccaactccctagcgctgtttctttcagacgatcgagcttatatcattcgttcacggatggatgatgccaccaaatacatgcatttcatatggttcacggcaattttgtattgaacaaagtaacacaaagttgaattgatcacaaattaaatcgatggtctattcatgtagtatatgttattcaagaaactctgtacacgtttcttgcactattctttgtctgaaggatcctgaaacatttgtagttttgcaagcacctttgtactgactgaaaatgggatactgctagtttttttttttttccaatgcgcaaaataattacacttcaatacattaaaaaggaaaaaaaggaaaaaagagttttttttacacaacgcaatcagccaaacaggcctatactaggggaaggaagaaaaagcaaaccaaaaaccgtaactaggaaaaaagaaaaactactacgggagctaaacacaactccgataagtgggaggaggggaagagccacactacactccaaaaaaaaccccaaaaacagcaacgccagcaaaagactatagacagccatccgagaggatagactatagaaccacgggcaccgaagagagcatcgagtttcgttccttacacaactgccaagagatcaggggtactgctagttagcacagtgctatatcagtatggcataacttcagatagatataattaaggtttcacttgctagtaaaaatcacaaagaagagaattaacgggaggcaacaaggagacatccgaagcttccaatacatccaaatctaacagaaaaaaaaaagaaaaagaaaaggggcatacaaagaactctgatgaaaagaagattccaaaacgtccacagatgatggtttggcatatcaagaaaaagtccagagagcgtcaggacaggcacgtttcagggttgacatgctcccacatgacatgatccgtcgatcctgcagccacggaattaattaatcataaaatgcccggaaatgcaaccataaactaattattaaagctaaatatttgagaacttttacggtacaatatactaacagtatatactgcaagtatttacaagggtattataggaatatgctaaaaaaatgtaagggcaatttagtaattctcttttcagatcaatccctatctgttgatgccgtcgtgcgagtgagagggagagatgagccctaccggcggcagaattcctcggtgtccctcttcccgccatctccctgtggtggcatggccacatgcagtcccgcatactggcggcaagccagccggcaacgcagtgccctctgccgagccggagttagaattaaacaccatgcgcactctacaagcatacgccctgatctgtgcataaaaatgcatacatgtgcagtctacagatgtctgttatttactctttaccctcttcttcgttcatgcaatctgcaagaggggtcatgttgttacaaatactctatgccattttaatctgaagatggcaatggtatagggagtgggggagctagccagctaggtccggcaacccgagctcggtgctcgggctgtaccgtctaccaacatacagcaatcttaagcagggtagccgcatgtactacttaatcaccattaattcctttaattaatacgcttaatctacatcttccaaacatccaatgaacatcatatcaacaatgcaaactaggaaattaatcaatatctgacagcctcacaccggtgcacctttgcctgggtgaatgacgggcatggggaatcactattggatcttgcgaggaacacctagtagtgtgcttgtctgctggaattaacggaattgccccagcgcaataaaatagaaagacaaatatgccatttttaattttatactgtaagtggtaagtggtaagtaaatcaatctacaccgttagatcatttatattggcagtatatactagtagtatattgtaccgtaaaagttctcaaatattttccagggagcgtagctacctgcatcttaatcagctgcagttcagtcgagttcatgcctaagtttttttttatggatcaactaattaatttccagaacagaacaaagcctagcttaatatgctggttttgccattttcatgctaaaaaaaatgcctatgacacatgccttgccgtgaccgattgacaatacttaattgcctttgccttgccatgagtgattgacaatgattctttcttgtacagcagcgatggatagtgacggagcactaacctgtaaacactattacatagtgctagtctgcaaataagaacagggagcacaacttcacttctacgcagcagatatgcatatatgtatactgattgatgaacctttgcccatagaaatatagaatacatgcatacagcacaagaatctcccaaatactgttgtctgatttgtattgagcggttggaggcatatgcagacagatgatgtgctagccatttatgcagcaccactaatgaattctacatttctactacttttgatactctcttccaacttataattgtcatcttttgtcccactacaaattattttcttgtacacgtacgtatgcaaccattctttaatttacatcaatcacatataagcagccatggcatgtgtgtaataatatcacctccgattacgaagcatgcatgcatgttgtcctagaatgcatagagacgaaaattgttggttaaatatattgtcacggaaatggatccacatataacgtcacaagttttctaattagtatttcaataattatatatatgtactgcatcaattgtccaaagcaatgccttactgatttgggggagaaaccacaactattttcattaaattaattgggtatgaaattaacaactactatatcattaccctttttttagaaactatatatattcttattactgttgatatcatctggtatcacacatataaaattgggattggacattaacaaactatatattgactgactgatcaatgcaaggagatgagaatccaaaaaccagaatttggaaagtgtttggtgggacattccattgatcaatcatttgcaacggttgatacgtactacgtacccgtggcgctacagtggctccatatattttttttttggcagattcgttggttgcaattgcatgcacaacgtgccggacacaatatactctctccatttcaaattgtttggcaccgttgactttttagcatatgtttgaccgttcgtcttattcaaaaaaaatttgtgaaatatgtaaaactatatgtatacatgaaagtatatttaacaatgaatcaaatgatatgaaaagaataaataattacttaaattttttaaataagacgaatggtcaaacacgtactgaaaagtcaacggtgtcaaatattttgaaacggatggagtatatttgtatcgttctgtgctgtacgtatctgtctaaaataacccattgacctcacaaccgatatggtgtgtgtgtataacaatcctgtatgttacttctagtatacctcaccatgcatgcatatattgtgtttcctagctatacattatttcactaaacaatgcaggccaggtacgtatgcctgttcaaatgctgtaatttatttttaaatatttataaaagtatatttgagttttcaagttttatgtttctatactcgataacgccctttaggatggttttttatattaaaaaagcaccatctaaaatgcattttttttcatgtggaaaacactagttagtcgcgccaatgggcatgcagcaattttgcatgcagtccccttatcactctccgagagggtgtttttttcgacccgactaagggatcgtttgatttggcgctcgataaactcaccccatgttatcagttccaacacatgagaacatgaagaggccacgtttaatgaagtcgttccaattctttcatgacagagataatttgcaatcaataaactcatctcagtttatcagattgaacacatgggaacatgaagaagtcgcacttaatgaagttgttcggctatatttgcgcacatgtttcatccaacgagttgggacagcttcactcagcatgactctttgttcccatgtgttcgatctgataaaatgagatgagtttatccagcgctaaatctaacaactctctagcctggtaaagaaacacccccttagaggcaacagtagggttgcttgcaaaattgccatccgcccagcggtcaccccgttagcacgagctgatgatcgtttgccacatcataaaaaaaatccctccggtaggttgtctttttttttaaaaaaaaacacctaggcagtttttgaataatgggaaaggaaaatgattttccacccaacaaaagacatctttaaatcctaaccgttcattatctctcttccatttaatcctatcccttcatttattttttaatcccaatccttcccccgttttccattatccaaacacactggaaggcgttgagggcatagatttattgaatttgaaaaccagactataatggccgcacaaaatccaatcgtaatcctgttatggccgcccaaccaacatgggtcgcacgtaagtcgatatcccgtttcggcccaactataatgggccgaacgtaattcatattccccttcttgggacgcacgggatcgcaagcccgttaactcccaactactatagggggggcctaatacgcgactagtcgcgcgccccccaggcgcgcgatcagtagtactagtactactactagtccagtactagtactattactatactactattactacactattgttgttatactactactagtattactactataaaaaatatatatatttttgatgtataaaaaaatatacacgtatacaaactttgtatacgatgtgtacaaactttatatacgatgtatacaaactttgtatatgatgtgtataaactttgtataggatatatacaaactttatatacgtacgtattaaaaaaataaaaacgcgaaaatacatcgcatatacaaagtttgtataggcgtatacaaactttacatacgcgtatacaaactttacatacgcatatacaaactttgcatacatacgaatacaaacttatatattcatgcatctttaaaaataaacgggaaaacaaccactgaagagaaaccggaaaaaaaaagaaaaaacaaaccgaaaagaaacgagaaaaagggagaaaaaaaaaggggaaaaaaagaaaccaaacaaccgaacagaaacgacaaaaaaaaaacggaaaactcgctactccctcctcctctcgcgcggcgcgtccgccgcccctctccgcgcgtgacacgtgggcgcgcgcgactgatcgccgaatagctttttcgactactatagacatcatgtaagttacataggcccaacacaaatgggacccaggagcccagtatcctggttgtagttgggcctccaagatgggcccaatgagacaaaccgacgacctatcgtgtttgggccgttgggtgtttctggcccaactcgcttcccgctggaatgaagaaatactcttccacttcttttcaagaatcagaaaaaaaaatgagcgacgttgtaattgatctccactagtccactacaatcatcaggaacaaaagcatatgtgtatcttccactgacgccatgcagctctgtacaaggtagtacaaattacaaaagtacagagtgtatatgtatcccagtatatataagaactaaacttatatatgtcaggtaaaaaaatgaattaatcagcaaagaatgagctactatatatgtatagacccctaaaaaaagggaatncaagaatgaaaaaagaaaaaaaatgttcagtataactagtatagcgagctagtcttgaagaagatcaagcacacgcagaagcgtaggcctgaaccttcgcaggttgagcttgacatcgtgcgtcatgacgatgtcagcgagcgccttccacccctggccatggatggccatggggtccctgaacacggcgtgctccctcgggtacctcctcgccaggttgctctcctccgccgccacgtggtactccacgtacatgagctccatggccgccgccggcgcgccgtagaagttggtcgccatccactccatcctcccccacggcacgatctgcaccaccacgccgccccgggggaggaacgcctggttcgtcagcccggcgccgtggacgcccaccagcacgtcgcacgagttcaccgccgacgcgaacctcttcacgccgccgctgccgccgccgacgccggcctcggagaccaccacctcgaatcccagctccctcgccatggccgccacctgccgtaggttcagcagcttcctcgtccgccgccgcgatatgatcagcatcctcggcttcttgccgctcgtctcgccgagcaccatgggcttgtccctcttcagcccgtacgcgtggcgcaagaacctcgtgaagtcgaccatggtgtaccccttggggttcctcgtcggatgctgcccaaggatcaggtccctgtctctcaccaagcccacgatcacatgatcgaagcaatggacatcgccgtcggagtcgaaatcgacgacggctcgatgcgaaagccgccggagcaccggcttgtacttctgaatccaccattgcttgtagtttgcaacgaacagctgtaccttccctttgaaatggaaggtggtgaggtacagaggcaccagcacgtctgccatgtcatggaagaagttgccggtgtagccgccgatggagaagatgaccgcggggacgccatggctgacattgcagctgggagcatcgccttcacttgcagctgatgtgatggccacttctctgacaagaggtagcaggaagtcgtcccggcgtgcatatggcctgatgcgccgcgccgctgcctccccttgctgcaatggcatggtcagggtaaccgaggaggtcgccggagaaactcgaacgtcgccggacaggtggcagacgattggccttgcataagggaagccttcatctttactcttatcatcacaacttatcttactcttaggctttggaacttcactctctgaaactgctggaacagaagggaaaaaaattcagagatagaattggccagtatacttctatggctgattttactggggatttaatcatgtactaggaactattgagtgtatcaagaaatctctgaaactgctggaaaagaggggggaaaacagaaatgaatttggccagttttctatgctgattttactgagaaattaattaactaggcataaaataagtgcatcaagaaatcttttgtattattgttgttaactctaacctgtctgtggtgattttgtcaaagattcttcctttccaggagggggatcattctctgtagagattgcaacctgtctctctgatcttgatttattctctgaatctgtcccattcttaaaattttcatttttaaacacggaacctgcagagcattttgaatttgtaaagatttttttaaataaaatacaacctctccctcacctcaactaaaaaacaatgcaagaatcctttattggcaccctaatcattaactgaaagaaaatttagcagattgtcactaacacatgctaacaagtagtaataagcagcattttgaaaagatcgttgatgatacatatgttgatgcttctacaagaatctacaagctgtttcacacttttcagataatggaagcaaaacaaagttgttcacttgcatgatgattgtggaatatgttcttgcactttgccatcatattctagtctttaaattgttgtaggatgttcgctcagtacatcgcactagtacattggtacatatttttatgaatttccactcatctagaacacaaagaacaagaatcattagctcatcacctagaacaagaagggaacagataattatcttattaccttgtttccccttcaaaattagcattgggtaagacaacggtttccagtgacaaaacccaaggcctttgcaagtttcaacaagaaaagtaactactctagaaacagcaagtacaaagacaattactactcctaaatatcattgaaatgagccaactaattgcatgcataattgagggccatccatatatgatcaaatcaattatagaactgcaaggggacccaatcagaaaatcccaaacctagaaaaagcacaatgtggtagtagtactagtacagtagtactttggcttgcattgcccctgaacctgatgcaactggactagtgttggcgtggtccaggacactgatgccactcacaaaacatgcagtgatctggatgaacagtgcaaatggggggggggatgcatgcatcagctggagcacgagatagatgattcttgttccagctcatttgctcacctaattccggcgatcttgtcgaaatatcttcatcgaccctgcccataatcagaggagcaacaggaattcgaggtacattcgtactggcgctgccttcccaagaactcaccatcctgctcctggttccaatccctgaatatatatatacaattcagaaaaaaagaacagcaaagtaagatcaaattggagcgaaatggaagagcagaattcgagaaatccaagaaagaactgaagagagcagcagtcttttagtctccttacttacgctgggattgagacgagagagaggagaagaacttgacgacgcagaggcagataagcagggcgaggaggcacgccggaaaaagcctgacgacggcgaggtgcctgccgggctcgaccttgctcaggttcttggcagccgccgccgcggccctcccgttgctgtgcctcggcttcctctccctcgccgccgccttcatggcgacggctctgccgccaccgtgctgctgcgccacgaaggctctggccgcgcgctcctgcagctcagctgcggcgtggtctggtctgattcagttgaagaggagacagtggagtcgtcaggaggagtggagtgtggcgctgcagctggtgcgacatgtgaggggagtagactaggttgcagtgcagggtggaaagtggccattattagcatttgctttgctgcattagtttcattaat

SEQ ID NO: 76690 - DNA, 6369 bp, Oryza sativa
ctagactactagtacatgaagagagaattgctgctatcattggtgaatggtgatgtctgatctatggcttattcggaccggaggaatttcacggggaattttgatggaaccgaactgtttcatgtaaaattcctgcatttcaagaagctcttaggtgttctttctgttggattaggactattatgaaatgatggttatgcaacttggacatgcgaatggatcatacagtatgctgcgacgagtcattagtgtcagtgaatccagcaggataggagtacttcgatcgcaggacgtcgagtgggactactcccaaatactgtagggcttcgtcactgaaatcaaaatcgattttctctgaatccagagacctaccaccgacacgccgacgccggtgagacgagtaaattcagacaaggattagttacttgtaacagcttcaatttaataagcttggatttgcacgtacagttgaaaggcaactgcacagtggccacccatgtggcagttgggcaacatgaacacgagattgagcttcttcaacaattaatattataaaccctttttgacttttaacctattcaaatattttaattttttaaagatttaattaagtttataaaaaaatatagtagcatttttaacacaaaacaaatatatcatcaaaatatatttaatggtaaatttaataaaattaatttagtatttttgctaaattattctataaacttgatcaaattcaataaaatttgactttgaaaaaattgaagtaaaacggaggaagtagtgagtattataccgaagcttctctcttcatttgtactcctactttactattctcttccatgttcacaatcacaagcttgctgaaagccgccgctgtatttgatttgaagaaggtgtgttctatgggcgcatgtgagatgctggatgatactgttgctgctgcatcggtatacaagacgagagcaaaattccaaatgcatcttccttcctactaccatcatcctatcctatccctacattttactagtaccttaccttctcccctccctccctgacaaactgaaaagctagcctctatacattcagaccgttgttcacggggacgagaccagccagtggttggtgtacgccactctctctctatctctctgcatatctgccaacaaatctgtacagctgtggttataaaacttaaaaactgttcatccaagaaaattgctccccttcaagatggaaaaccataaggagggagtacatttgagaatttcaatactgatcatatataaaccactcaccttacataacaatctgcaagaaaatgttcttttgcctaattgccagcagatgaacatgcatgatttgtactgcattctgaatatgcactccagttgggtatatgatatatccaatcagtacatatcatcatataatatattttttagataatgagagatcaccatatgatagaaactagtattaagtataagagtcggtttcaattttgaagtagagttggatttattaatggcaccggcggtttctgcaagttcccgccgtttgcatcgttgtcatgttcctgtttgccaatgttgccttgcttgcttgcacgtatctgctactactcacctgccattccggctggccttgcatcgctccatcacattacaacctgttcgttcctcctctcgttgttgacatcacaggtcaaagttggcgacggctactcctctcctaccggcccaagaacaatcccatgtgggcccaatcatacgtgggcttgttgtctcggcccatggattgaatattactatattgtttttttatggaattattaatatattgtttatattgtttagaggaaacctggcattttgtgtgttagtgacaggtgagaaggaggcggcggttagttgcgcaactgaaccgacgactcatcagtttctgttggacaaccaaactctaccaacctctgctacttgtttacaacaacaacacactcaatgcaaatctgtcatctctaacaacgacatgtgcatatgtgctacacaatgtacttgtacaatttctagtagttgttgggtattctaattgtactttttttaaaaaaaaaatgaacacttatttgatcgagttgaaactagagatcaccaaatgcgaacacaattcagtgctaataatgaatcgatttcgttccattccatcctccattatgtgcatcaaagggaatacaaagagaagtagtataatgtaactgtaatcctgatcaaataatcgatcgatttcttttttctgtgaaagaactcgaaagaatagaaagcaaaaaaaaaaaagcatagagaacgaaaatgaaaatgttgcagctaggcattcaaaaaaaaaaaaatgttgcagctagtagctaattacagtagtctttgtggatggagctcgcctctactggtgtttgaggtaatccatggcgtcgcggaggaggggctcgaagcgggcgagatcgaggcggatgtcctgcttgccgaggtagtactcggcgaccttcccccacccgctccggtggaccgactccgggtcgcgcaccgccgggtggtcgcgccccagcgtctccaccagcgtgctctcctccacgccggcggagtacgccatgtacttgagcctcatgtcctccgccggatcgccgaagtccaccttcccgatgtgctccatcttcccgtacggcaccacctggatcagcaccgcccccgtcggcaggaacaccgagttcgtcagccccgcgccatggacgcccatcagcacgtccgcgcggttcacctccttggcgaactcgccgacgtccacgttgaacggcgggtcgccgatcaccacctcgaacccgatccgctccgccgcccgcaccacctcctccacgttcatcagcttccgcgggtgccgccgcgagatgatcatcaaccgcggcctcaccgccgcggcattgtcgacgaggctcaccggcgcgtcgcgcggcaacgagaaggtgtcgcggaggaacttggtgaactccggcatggagtggcccgtgggatcccgcgccgggtcgatgctgaactccttgtgcatccggatgccgaccaccgcgccggggaagcaccggaccttgtcgtccctgtccatgtcgacgatgtcgtggcgcgacagccggtccaggacgcgcttgtacttgcccacgtaccacatctggatgttctccacaacgagctgcacctcgccgtcgaaccgccgcgcctgcaggtacagcgggatgagcacgtcggagaagtcgtgccagtagttgcccgtcagcccgcccatggcgaacaccagcgccggcaccggcgaccgcacgtcgcacgccggcgcctccgccgccgacgccacctcccgcaccgccacctccttgagcccgcccatgtgcttccgcgagtagggcacgacgcgccactcccgcgggttcgggttgctgccgccgccctcgatcggcggcgggatcacgacgtcgtgcgccgcgccgtggatgcgcacgtcgccgtcgatgctgcacacgtcggacgcccatggcccctggatgtcgcacgccggcttcttcgccggcgcgctctcctccaccgtggtggtgacgtcatctgcatcgaccaaggaaaaaaaaaacaacaattgctttaactttttatatttcttttgttctgattctcacaaggcaaaatatgcatcgaacacgtctctgctgctttccatttcagaaaaagattgaaggaatgaactttaggttggattttgcacaaaactaatcaaagatttgtactttatatttcataaatgattcgcaagtagggggagaaaagtaccagtgggcttctccttggtgtggtcctcttctgtttctttctgtatctctatctcttcagctgacggggtcttctcctgtaccaccgctgcatgctcatgctctgcctttggtgcttgccgctgctctgctccatgcaaaaggataaaaaagtgttagagatttagaagcgaaattcggatggattttggttgaattagtaagggaaatttgattttggtttgatgaaaatgattggaataatcacaggttaattaattagttggttggatgatcgatcagtttacctatgatagggggcagctgtggcctcttctcttccacaggcggggggatcgtcggggaggcgtgtcccggtgatgttttccgaattgctgcatcatgtgcagttcaatttgatcagtttcagtgtttaaatttcttttaaaaagtctgaatattgtaaggtgatgcactgaaaataagttgggagcttggattcaggatggtgatcggtgccctgattttgcggttacgtgcagaaacaagcaaacgcgtgcttagaatcccgacgaattccgcatgtattacatactcgtttgattcagaattattcaaaaaaaaatcctcgaaaaagtgatcccgattaaccatgtaatcaaaaagttttggtctgaatcatgcaggaagaatcaaaagaaaacctataaaactgcaccataattcagaattcagaaaacttgcaaatttttttttgctgaattatgctcaatcatgaaccaaatgaaactcaccgttgggtgcagcgatcgcgaactgctcggagacggtgaagtatgtgaggagaacaaggaagaagccgagcaagaagccgacgccgagatacttctgagctgcacccttcaagctcttcatgagcttcccatgatcgcctcccatctctcctccctctcctctctctctgaatgtctgaatccttcctactctttgcagctctactctttctcgtgataaatatgtgtgtgtgattgcctgcctatgcaggtatcctagagacaccaactccctgacatgggagatggagaaccttccaagaactcttctcttctcttctcctcaatagaccagttcttgatgatgtcctttatgcctggctgctctcaggaggacttagccaaactccaactctccctcgtgattgctacctctaatttactatattttccctgtataatgacgacaattatcatgcagtagttagcttaaacgtgcatcgtttgtaaggtgcaatttttttttttttggaatacacctttttttgactagctattggaggctaatttcgggaataaaaaattatagttatttggagtagttggcagaaggatttgtaaaatcctagttaagttttgtgtacatgattgggtaggaggtggcatgtgagagaaaaagaacaagtcttatgtgagctaggaatgaatgattgatggattatggatgtaaggtgtagaactaactaggtcaaatgcatggaatatttggttggaattggatgttccagtagaactcatgagctgtcagagcatgtcatcaagggccccataccttgcctaattcagaacctacattgcatttttcttgtgtacacactctctatttctttttttttgtttgggtataattcacatttacttataaatacaagttccttttggtttatactccctccatccaaaaatgtttgacgccattgacttttttaaaaatgtttggccgtttgtcttattcaaaaaatttaagtaattattaattcttttcctatcatttgatttattgttaaatatacttttatgtatacatatcgttttatacatttcacaaaaggtttttgaataagacgaatggtcaaacatgtttaaaaaaaccaacggcgtcaaacatttaggaaatgatcgagggagtagtagattatcaattatcgctcgtatgcttctgatgctcctaaacggtatgatatatctgaaaactttcttcatcgatatttgttagagaactttttaaaatcaaccattcaactttgtaatattttaactctttcgtttgttctctccaataattgtcataaactagtgagaatttgatgaatttaagtcggtcggtgtagacacgtacgtacggtatggttgtcaaatgtcaatcctattttcttgtgcctgttctgaaagcaacaagtgtcctgacaaactcgtcactcttgcatagttgcattttcttctttctcttggttaaaaaaaggtcgcattttatcttgaaaattgataaggatatatattgttatattttttttctctatcacaaaatatcactttcagccatgagagcgacggtgctatttgattgctaatttctccagggaagcagatgcaatgtcaccgattatttcattgctcatgataagtgactatggcctactgcaagtatatatatactccctaaaatacatggataatcaacacctttttagatcgagattc

SEQ ID NO: 76691 - DNA, 2749 bp, Oryza sativa
ttgtcataaactagtgagaatttgatgaatttaagtcggtcggtgtagacacgtacgtacggtatggttgtcaaatgtcaatcctattttcttgtgcctgttctgaaagcaacaagtgtcctgacaaactcgtcactcttgcatagttgcattttcttctttctcttggttaaaaaaaggtcgcattttatcttgaaaattgataaggatatatattgttatattttttttctctatcacaaaatatcactttcagccatgagagcgacggtgctatttgattgctaatttctccagggaagcagatgcaatgtcaccgattatttcattgctcatgataggtgactatggcctactgcaagtatatatatactccctaaaatacatggataatcaacacctttttagatcgagattcctcttgatgataatcatgatcaatgaactgaacactacgctgaaatggagttgcctgcattgatgggcctcccattctctgaattctggtgcttatttttttcaagaactttctatgatgcttgttaaggagtagctctcaatgaactgttccgatcttctcggtgcaatgcagtacaactacagtgcatgcacggcagctctcaatattaatttgtgctactgtttagattttattctctgatcaagcaccgtcagttcagaagcgatggatacctgcattggccatcctggactccaatatttttcatgcagcaggtcattttcaggcctgcatccttaatgcaatacggctgccatttgacctgcaactacgcattacaatgggcttctgaactgaacagaaactgatcaggaattctccctggaaattgagagcacaatgcgagtatactatactgcaaaatggccaggagacgtaaacgaaacagagacgacgtgctggcttctttctgtccttgactagtttgccagtaacatgatttcgtccggacacggttatacacaacagtgtataatgtatactattttgtattaattagtggctaattaattataactagcaactacatatactatgtgctacagcctacagattacacgtagtaaagatcatgttagtgtagaacagagtggatgaggtgcgaccaacgactaagacgacgtggctgcagtacatgcgtagctacctaattgactcacctcgctcataaggagtatacatatttcatattaagggtgttgggaacccatctcccatacacggaaaacggaacggtccattaacacgtgattaattaagtattagctatttttttttcagaaatggatcaatatgaatttttttaacaatttttgtatagaaactttttgcaaaaaaacgcatcatttagcagtttgaaaagcgtgcacgcggaaaacgagagggtagcgttggaaacttgctcttgcacacacacccttaaggtggtttggcaacaacttataaacaacaagttctgcatcaacgctttgaagaacaacctcagcaagcttctaatctttccaaatctatttataccgatttttattggaattgaacactcaaattaggatcctgcattgattggtaaaaaacatctaaatgaacctaagccttgatgaatatccatgctttaagtttatgtggaaagaactcagaagggcgaaatctctggacgaaccttgcggaggaaaccctgggttttcgaggcattggattcttaccgatgttttgttactcaagcagacattctcacatccgcttcatcgaccctacttttgtggtggcttccctctaaggtggaacactcccctaccttgcagttgcttccctctaaggcttttgttactccagccaacattctcacttccactttgtcgaccctgcttttgcggttgcttccttttaaggcagaacactcaccaaccgatgtatattgagctattatgtactccctctgttttatattacaagtcgtttgattattttttcctagtcaaacttctccaaatttaaccaagtttataaaaaaagatatagttaaatagatatatttaatatgagatttaatgaaactaatttaatattttatatatggctaatttttttataaacttggtcaaacttaataaagtttgtctaggaaaaaaaatcaaacgacttataatatgaaatggagaaaaataaatatattatcaaaatatatttaatgtgagatttaatgaaactaaattaatattttatttgttgctgactttttttataaacttggtcaaacttaattaaatttgactaggaaaaaagtcaaacaacttaccctccaaaacctcgtagcttagcctagccgacgagcacttatacacactactccacttacactttcattctcgattcttgtaaataaaagggttaatccggaagtgatatggttggagggacaaacccttataaattagttccactcttgctaaactaacgagatggtactacacatgagcacacaaaaaacatgtcctcgtatgaaaacaagctttggttactcggtcagttggtgaaatggtgaatgctgcattgcacaggttacacattgcaggagctctactaacatgaattcggtgacatacatgtactctaccaaatcaatacaatcaatgtgcatgttcatacgctccaccaatgatgatggatatactgagccaaaacaaaaacaaaaaaggatgggttggacattctgtaccaaattgcgaccaa

SEQ ID NO: 76692 - DNA, 33167 bp, Oryza sativa
atatgagatttaatgaaactaatttaatattttatatatggctaatttttttataaacttggtcaaacttaataaagttggtctaggaaaaaaaatcaaacgacttataatatgaaatggagaaaaataaatatattatcaaaatatatttaatgtgagatttaatgaaactaaattaatattttatttggtgctgactttttttataaacttgggcaaacttaattaaatttgactaggaaaaaagagaaacaacttacccttcaaaacctcgcaagttagcctagccgacgagcacttatacacactactccacttacactttcattctcgattcttgtaaataaaagggttaatccggaagtgatatggttggagggacaaacccttataaattagttccactcttgctaaactaacgagatggtactacacatgagcacacaaaaaacatgtcctcgtatgaaaacaagctttggttactcggtcagttggtgaaatggtgaatgctgcattgcacaggttacacattgcaggagctctactaacatgaattcggtgacatacatgtactctaccaaatcaatacaatcaatgtgcatgttcatacgctccaccaatgatgatggatatactgagccaaaacaaaaacaaaaaaggatgggttgaacattctgtaccaaattgcgaccaatgaggtggtgtatcatatctatcagcaactgtaacatctgtgtcactcactcactcactcactagctatgtgatggtcgaaggtgatcgaagccgccggcgagcgtggcggcaaaccgggcgacgttgatgcggacgtcctgcttgccgaggtagtactcggcgaccttgtcccagccgctccggtgaaccgcctccgggtccttcaccacctggtgctccggccccagcatctccagcagcgtgctctcgtcggcggcgacgctgtactccatgtaccggagccccatgtccgccaccggctcgccgaagtccgccctcgccatccgctccagccgcccgtacggcaccacctggatcaccaccgcccccgccggcaggaacaccgcgttcgtcagcccggcgccgtgcacgcccaccatcgcgtcgaacgcgttcaccttcctcgccacctcctccaccggctcgtcgaaccgcggcgacatcaccgccgcctcgaaccccgccgcctccgccgcgcgcaccacctcgtccatgttcacgatcttccggtagtgcgcgcgccggatcaccaccagccgcggccgcctcgcgcccgccgccgcggcgcgggggagcgcgtaggtgtcgcggaggaacgcggcgaagtccgccatcgtcagccgctgcccgcccggcgccagctccggcttcacgctgaactccttgtgcatgcggagcccgacggcgacgcggcggaagcaccggacctccgtgtcgcggtcgaggtcgacggcgtcgtaccgcgacagccgccgcacgacggcctcgtacttgcccagccaccatggctggatgttgctgaccaggaactggacctcgccgccgtaccgccgcgacgccacgaacagcggcaccagcacgtcgctgaagtcgtgccagtagttgccggtcaggccgccgagcgcgaacacgacgccgggcacgccgtgggtcaccgtgcacgccggcgcggcggcccggtcctgctgccgcgtcacggtcacctccgcgatgccggacacggtcctgcgcgggtacggctggatcttccactcgcggcggcgctccgaccggcggctcgccggaacaagggtcacggagagagccgtgccgttgatccggacgtcgccgtcgacgtcgcaggtgtcggagtagaacccgttcgagccgcacactaccttgccgttctctgttgcaccaaaaacagaaaaaaaattgattcatcgaggtttattagctcatttattaattaatcagttaaacgatcattaatttgcaaacagagagtaattagttcaactcatttattgctcattgatctaattaagtagagtattcatgtttgggtccaattggtctgtttttagatgatctttctaatggaaagtgaaaagcatggctttgcctttaatttgacagtaacattacaatgctagtaaaacccatgaatagtactagtaagtacagaagctatttggaatatagttgggcccacatgtcaacggcagtcaagagtagtattctgagaacatccatcatgttaatgcacaaatttgtaattttgtaaagaaaacaacaaacgttcatgcaaaattccaaatactagtactttcccaaacgtcctccaaagcttataatccaataaagtcatactctcaacataaatgaatgaatgcagttcgttgaaaaaaaatgaatggatgtactatattcacataaataaataaatgaaagcaattataatcagaaaccaacaaaatgtcactttgatctctaaataagaacataaaatcactttgtttttgggaacaaatattttgtgcttaccaatcggtttggcatttgtcgagtctcttttggagaactcttctgctgagacggcaccagacgtgtcctttggccgctgccactcctgctccctcttcttctctgcatttgccgaaagaattcacgtcagaaatgaatcggaacaccaatgtgaaaataatactagcatgcaaaatttgcaaacaaacagaagtaagtaaacgtttgtgcttggactgatcgatgcaatctgttagtaaaattggctgatcatgatcagtattaacaaagtatatcactgtattgatcagaagcttcttgaggtttcgtctcgatcttttcccagatttaattgatcgtcttccatccctaagtgtaccatgatccgatcgaacgaaattaaatactcctagtcccatcggagacacggttcgctcctcccaacatgttgacttcgatctcatccatgatccatcatctccgtttcttcttctcacgatgacttttgtgttcttagactgatgaagcagtcaagaaaaacacgatcaagatgacagaaatcctgtgctttctcacctgtttcaacgcgagccttggtcaccgactcattctcgtcaatcctcggcgccctgctagtgacagctgcaggagaaacattcagcaagaagcaagaacagatcagttcatggacaaaatgatgatgaccgacgacgacaacaacagaacagaatgatctttgtgcaaagaaagaagcttcttgcaatggaagagtacgtgatgatggttaggttacctgtgggagtttccatggcgaactgctgcgagacgatgacgtaggtgaggaggacgaggaggaagccggcgaagaagccggcgttgaggtgtcgccggaggccaagcttcgccggcttcacctcgctgcccatctctcctctctatctatctctgtctcctctactattcactcgtgctagtgtatatatattctgaacccaactctgaatctctctgaagaaggattgaattgttcaaggttttgggtcgttcgagaattgcaccgagctgcctccttttcctctcttttcttgcttgtttacatggagcatgaagaaaactatgcaaaaagaaagcgagagaaagagagagaaatggagtggtgtacttggatttctccaagcttagccagctcgcttttgtagagtttgcatatcagcatcaacttgctgttttgttaagcatactaatccatccatcagattctgattttgcagttacaccccccttcacatggtacgaaattccttttttttttttgctcgtgttgggtgcagatcagggtggactagcatgttaaactagtgttagtaacactaatcaactaattatctatagtaattaagtaattattaagtgtgcaaatggtggttgaccagtgactctctctgagagttctgattgggcctgataatcagaagacagcaggctggcattatttcattaactgaatgaaacagggtgaatttatttaacctttttattttgtttttcgcctaatctgacgccgatggatcgagttcgttcacatgcacgttgtttggtccgcgtaacatcccctttgattaacaagccccaaaaggtatcacagtttttttaaggactggctgctaatcaaggctcaatgtggaactgatgtttttcagatatgcattatagaatgtgtacaattaaaattttaaaatttcaaagataatgcaaatattaatatctgtcacatatagccacttcatgatgtattctgatgtggagctcttaatttccacaagttaaatacaattaaaaacagtcatgagccttgctagcatccagctaagaacacatgaacacccaagtctactagctagcttacccataagcaagccatatgcgtgttgccgttttgaacaagacgtggtatcacaatcaagtcgatttcgtgtcaggttgtcctcatcagggcaaacagaccaagttcttcatcgatttgtacagatcatgcacgcatgcaatggtttcttcaattcatcttttagatcaaccacccaacacccggtcgatctatttaattagctatacatttctagaatcattaacttctaacgtgaacacctctcacaaggcatgttctccccccatgtctaatcatttcttcatatagctccaaccaacatggtggcaactatcttgatcatcattgttgcaaacaaagtctgatcagctttttggaaaccatgtgtatactgtattacctagaagaaagcgattgtaatcgaaaaaaataaaaataggggggggggggggggtgtgtcatttctgcatttgactctgatatatttatatctgagtgtactgtctgaaaagtaacagaaattcagaaagaggcaaattataagctgcagattattattttgtgtctctcttcctgcattctccataaggtgataattaagggtttgaatgtgatttcaacaatgcaaggtgcatttctgcagaagcacatcacatcctaatcctcaagtgatcagtttcagacttcagtacagtacatgcatcccatgattgcatgattgtgagcgcatccaatctgtagtttattggttaatcatctctgtaggcctgggtggtagctagcccatggatccaactgttcaagtttaaacacatctggagactactagctagggaccagttccttaattgcaatcagtaaaataattaatcctaattgagtttcctttttattactgcttggatggaatcatggcacgtatagtggcagtactgcagcagtagaatattatggtcactgagtggtcaacaccaccggcagaagctcggctttaacattgaccatttttagtttcttctcaccctagcaatgttgttactctctcatgtttcctaattaattatactatcaggctgcagcattgttggcgatggaattgcatccttctgatctgttttgtctggatgcatggctcacgtgagagttcagagttcctcattttattttggatggcagaggtataaataagttgtgttaaaacaccgatggcattctgtctgccaaagaaaagtaaacaagatttgtcagttaaatgtacagtaaacagacttgttttatctccataaaagtactcatgatgatctcaaattcacaagtgctgctgaatcacacttgattttcttaattttggtatgtgtacaaaaaaaatacagtacagtttggtctcttttttttttttgacataagaaggtagagccagctttaccttatagccatttcattgatataaatggacggttacaaagttacatgacgagtagaaaaaagagagggagagaaaaaaggaaaaggagaaagaatttggtcttgttgatatctagctcgtgatctgtttttttttttcgggaatacacaataaacacatctttgtattaagagaagtaaagtttatttacagtgtagcctttaaatggaaaaaaggggaaggggacagggtacaggatcggacctagagaactaaggcctaatctcccactagattttgcgaccgccaagccatgctaggcagaggtagttcaggcactgtgagatgtagctcgtgatctgtgagatggcaaagaagactcacacgttgctagctagagtagcttggggacttgtggtagctaaatgctagtactccagcgagccaatctagtgactaatatcagagttcagactaaagacaaaggtacaaagctcatggggttattggttaagagtagtagtataagcaaatttgtgaaacgaagtcgagatccgagccgcagtggagcacctgattcagatgtacattacttgaaaaagaaaaaatgcagtcatgaacggtctctggatgctgtgaccgatccagattggagttaacttactgcaacttgcaatatggagcagtagtaattaaaggttagccctgaagagagtcaactccactcagtaataaattgttggtaattggaagctactgctaattagcttcttctgtgcaaaggccatatggatcggcttgtgagttgtgacatggacagaaagagaaaaagagcacataggtaccaacttggaacacctgagtaactgggctgagcatagagctgagtcgttgaccaatgcatggatctcatcttgttttccaaatactagtaggtagtgcaaactccactggcgacaggattaggacatgctgggtgaacagtttggcagcctaattatgaaatgaatggggactgactgcaatttactctcttagattagtcagtgcggagatggagagaaactcagaaaaggaagcccatgagtgaaaactaaaaaagtgagaagttagaattactagtatagctttatttccttatttttagatgttagtgaatttctatactgccgcatactactgtactggtatatctgaatttctgaagaccggtatacgaacgtaacgaacctctgaacttccaagttggacggagcacctgaatacggagactggatgggcccagtctagatcgtattcagtgttggaacccagtagcttacatgggccggactggatctataacgagcagggcaattgcgttggacggatcgggccactagaacgagaccttattactgtgggctgaatatgattgtttgcgtgtgatccatataattgctgggccttatctcttaaataagaaaaaaaagagaaaaacctatggtgggcctaatacctagatgcagcccatttaggaatggccagtcccgtccgtactagttcagcacgtttgagaattgaacagatagaaaaaagaacatcgtttttcatgcgcacgattcttgattttttcataaaaaaaagtctatagagaagttgctttaaaaatcatatattaatctatttttttaggtttaaataattaatacttaattagttatgtattaatagtttatctcgtttaatgtttgttctcaatcatccctattcttcttttctcaaacacagaggacgtaggagtgagtattccaggtacgccgctgtaggcggcacggcaggcagcgtcaccacctgcaccattgtttttcaagtactccccacaaaaataaagattaaatacggacatgtaaaagaattatgattatttaagttttaattattttaaatatagttatctaatattttaaagcaacttttatgttgaaagttcttattgtttagcaatttgaaatatgtgttaatgacaactgagataaaatatgtatcttcataaaaaaacgaacataacctcaagcaatacgtagcaaaataagtttgtcttagtttactactatatagtgctccctctatcccaaattgtagaacgtctttttttaaaaaaaatcaaacttggtaacttttgactaataatatggtgctaattttatattagttaggaatataatatataataaattattggtcaaaatatgtcattgaaaacctttaaaaaatatagttttataatttgagacgaagtactgcttttgttcttagctttttcgatcttgagatgaaaattacacaagctgaccaactccaccaaagcctcctaggacgcgagccggttgacccgatcaaattcgtggcgtgatttgctcccattctcgcgccgcgcaacatggatgcaacccatcaactttcaagacgtgcgtgcagcaacgtcatcaattttagcgtttagtttggcagttacaatgccgaccgcccgtttattaatttcttcttccacctccgatcctccccgctgaatgatacggatccatcaaaacggacaaaccgacgcacccgacctactccctccattctaaagaaactccttctaatacaataaatctggacgaaatgcatttatcatccattgtgcatgcatcaaataaaaaaaaccaagatttggaggaagagacattcctccaaacattttcgaagaataaattgtgagcgcgttggagattgaacacggaatcttggggttaaaactacacgtctcttaatgcagcactgtcaagagcaacaaatcaaaatgattaacgaacctcctcatatgttgctgtttggcatagtaatacgcgattgttggagaggaacaaaaatttccacgcggccaagactgttgtgctcatatctgaccctgataagctaccaaactcgatcttgacaggccgacatactactatactagtgtgtttatgtctgtgatgatcagccactacaaagtcagacagccatggacacacacaaacacaagcattggtcagagtttggtatccaagaggatcaattctaccaagaaaccaagctgcatgttcctcgggtctgacaatcaaaatgcaccagtctacaaacaaaattcggtagcgttcggcaatgcaaaaaactcatctcaatcaccaatccttcttcttattattattcttcttttagagtttgtagcatgcatgaatcatggcctagtttaactgggtcaaaccgcggcctaacttcactcaacatttgcataattgtgcaggtttattccaagcagcttctgcggcttcaattcacacacatgacttgcagggttggttggttcggatcctgactttctacaactacagtgttccacagtgatggggatggaccagcccaaccccaacacaaaaccgaaccgacactcgattcaattcacacacatggcagatatatggtgatcaacaattggaagcaaagaacaacaagctaatgctcctaagagcaggtacagtagcaggctataagccaggtgcaaacatattttaagtagataaatcaggagagagaagagcagcgggctacagatttgtagccagctatagcacggactccaagacgcagtgtgtctatgacaggtggggctaggtattaatagtgtagtatgtaactattgtatgaataagctattagattggctatagatgaattggagctagtagttggctatactattaaacttgctctaagaaggaagaatctggatggaaaggctggaaagcagacggtccatgctactctgcctgattgccattgcctgcctctctcttctcaattctcatcgctttgcagctccagtccgtccacagattaactttccaagtagtatcaaccttttactatattttactggtcatcacactcactgatcactactcacaatgctagctatagattccttgattgatggccccatgatccctttcaactattttctagcctttcttttgcctgccacctcactctcttcctctacatggctccagcctgccaaatgctgttcagtttaactcttgcacatggaacctcaagattgtcatgctactaggttataagccagcacaaaattaaaagttatcaaccaccttgttacgagtagtaaattgggagtatctgacacgcaaacagattatgcacatttggctgtttgtccatgtgtaggtatcttgcaacaaaggaagatcgtttatgaaagcatggatgcttaaactatttttacagtcgtcgacaaagagcagattccctgcagatcgacagacacgtagtttgcgagatatacttgttaatgcagtgattatctcagtgagatcaaaaactccatacacatggtactgatcctactctatgtactcatcgcacacagattgaaattggcttgtactgggaggaacacatcatcactcttcctatgaaattgtcggtgacaaatctccgattattgatcaaaaaaccaatcagtgaatgaatgaatgactgactgaatatgacggtagcaattgctagctcgatatatcaccatcagctgggccccaaatcgcacatgttgaaaatggccggatgattactgattcgaggacctgtctgactatcttgtttaccagtattactcatgcaacagcctgacagagagtgacagtctcaagtgatcatgcagtagtagtagcactgatactgtatagtattagcaacaaaggtgtatacatatactactattcaaaatcgatcgattcaacaccaatcgatttcgtatgcttgatcaaatgaatgaaataattggtggtccaaagctagcacgcagacatagcgtgagatcatatcgatccccattacacgggccataccatatggtccttagcctgtactaacaattagtactactccagtgtaccagtacaatactgtaatggtatagcgatattgctagtactagatagtagtatcagtcatcttacaatttcttgctattgctattgcttcaccaaccatttggtcgtctgctcctgaacactagtacattaggtgcttagtactaattgctactatgatctgattagcaaaaaccagtacattcgttatggttatcatcagtagtactaactgcaatcttcaattcgtactttggaggtttaagaccattaattattgagtgatctgtaatctttttttttcagatgcattttgcaggtccattagtacgtcttactctgattttttttttttggcaatttggaactcgaggactagctcagcagcaacgtgcaagctgcaactgtgttggagctcacgttcctggtccatggagatggaggccaccgacgattcataccttcaccgttgcttcattgtttgcacgatctcacatgcctttctcaggtttattttatacaatttttcccagcagaaacctagcttggcaggagcatgtgcttggttaaattttagttaagaatgcatgcattaagcatgctgattgctggactagtcctcactgaacagtgaaccctgctccatagattcatcccattgattgatttttaattactatagcagcagtagcaagtggcaagatggtaaacctgacatgtttacatggagcagttcaccaatccatgcaatagaaatgcgagcttaaagaaactttattgtggagtacaaagttttttttttattagaggatgaacaaccataattgaccatccaagaccagttatgaagttactgtagtgttgtccttgcttaattgtccgagcagctaattacatttcgatagaatgagccatctgaattacagtaggagtgtacaactatctatgtacatatgtccttgattctcgtataccatatcatcatgtaatttattaataaagtatcttttttgaccgtacataaataattctatgctgtactataaaagaaaaaaagaagcaaagaacagttgttacattatgagatctggggaaacaaaccataatctaattaagcctcgtacacttttttgggttttggctactataggagtatacatgatcaactcaactaccactcatgaaactcatcttccaatcgagataaaaaaaaaacaaagagatgaatatagtattgctgctgatctcctcctctgaaatatcatacatttggtcgatctgctagctgctacagtctacttttacttactagtgaaaagatagtaaaagaagaagaaaagattaaaagatcaagaagatggtgtacattgatgcatccatggcgatcgatcgaagaaaaattcgaaatggctagttgtgtgtggtgttattgttgccgctgttcttgcggaggtgagcaatggccttcttgaggattggtcggaacctcttcatgtcgagacgaacatcctgcttgtcgaggtaggcttccttgagagaattccagcctttggacttgacgccatcggggtcggtgaagatggggtggtctcgcgggtactgatcgatcagcgtgctctcctccggcgtgatccggtactccaggtaccggagccccatgtccctggacggcccgcggaagtagccggcgacgaactccagcccgcccagcggcaccacctggatcaccacgccgccggtggggaggaacaccatgttcgtcagccccgcgccgtgcacgcccaccatggcgtcgcacgtgttggcgagctccgcgaacggcgccacctcgtgctcgccctccgacaccaccacctcgaacccggcgcgctccgcgcctcgcacgatctcgtcggcgttcacgaaccgccgcgtgcgggcgcgcgcgatcaccaggagacgcggccgccatggccgccgcggctgctgctcgccggacgccgggaacggcgcgtcgcggggcaggcggtaggtggcgcgcatgaagcgggtgaagtccaccatggagtagccgttgggcgcgcgcgacgggtcgatgctgaagtcggcgtggcatgtcaggccgacctggacgtggcggaagcagtggacgcggcggtcgtcgtcgaggttgatgaggtcgtagttggagacggccttgaacaccggcaagaacttgccgagccaccacatctggaagtcggacaccagcagcttcacctcgccggagtactgcctcgccgtcaggaacagcggcaggatgacgtcggtgtacgcgtggaagtagttgccggtgtacccgcggtcggagaacacaagcccggggacgtcgtgccgctccgtgcacgccggcgccgccgcgctcgccgccggggcgggcagcgactgcaccgtcagcacgcggacgtggcgcatggcgttcgggtcggccttgcgcgggtacggcttgatgtgccacgactcggcgcggaacgtgcgctcgtcggcgggccccggcggcgccaccagggagacggtgccgttggcgccggcgacgcggacgtcgccgtcgagctcgcaccagtcgatgcggcggttcgaccagagatcgcacagcggcttccactccttccgccgcggcgccgcctctgaatcttgggaggaccatcaatcaatcaaaccacgttgcatgttaattatgacccagaaatgcagcaagaaagattgtagattcgcaaccaaattaagaacacaaaaaacaatgttgttgtagaccctacgagatgagaaatggtgagatgataatcaaatgaaagacactagaaaatgggggctatcaataagctaaggccatgggatgatgatgctttattactcttaaattgctctcctctcaagaaaggtgaacaaggcacaggatgaaaacaaaaaaaggtggtccagaacagaacagcaagaagaacgttgggccttgcgttgggataggcaagacatcaaaaatgtgtgtccaaaaactagtctccacaatccacattttgcaactactccatgtacatgcctttgctacttgcaacgagaatttgtgctcaaaatctcaaatgtgttctactgtaggtttcaaatgtgtagctaaaaagaccagcagtatgccagtagtacttggcattttcgcaaataaaaaaggcatctttttttagcacaaggaaaacacaaggaaaagtaaggaggaactagatacctgtcttaaccactggaaatgttggaatctgctgaacaggaggaactttggcctctggaacagctggaatttgctgagcaggaggatcctttgcctcttgagtaggaggaatctgctgaacagggagagtagcagggtcggatggaaccacagagggggagctgccattgttgctgctcttctccggagaaggattagtagtagcaggagcagtctcctggactttcagctcctcatcctcaagaactgaccaagaagaagaagaacaaaaaaacagcttgttaaaaatcctgcatttcccatttctgacagaaatgaagaggggggaaaacatctcatcctggttacttcagagaagttcaattggttgtgttttttttttttttacctgaatcctgtgtgatgtttgtgggttcctctgatgacaagggaggaagaacagcaccgacaattgcgtcatcatccttggcaagagcctcatctgtggaagcagacacgcttgcatcaccgctatccttagcaaaagtctcatctttcttcttcccctccaacgctgatgcattgtggcccaaatctaaaggggaaaagaacgaaagaaagaaaacaaatctttttcagattgtctgaactttgcgtgtgagccagtagaagtaccaaagcaacacaccaaattcgaattcgatccatgcgcaagcaaaatgatctgcaaatgattgcgagttggagttgtttacctggccccaaagaggaaatcttgtcgtcgccgtctgtgtcgagcacctgagccttgctcccttccctggacattgcatctcggtccaaatctaagcagggaggagagatgaacaagagacagttcgtcaactcctcgattagtacagcgagtgaacctgtcgggacgaatgaatcgccgcttgctcacctagctgctgctgattggagccgtcagaagaagcgttcataaacccagctgcattcttggctggagagcttactgcaagaatccatggcgacaagagtgagatacacaggtaggcatggagatgcgtgaggaggaggaggaggagatgggcgggcgtactcatggcgatgtggatggcgtcgaacttggcggtggagaagtaggcgcaggtgacgatgaggaacccggcgacgaggccgaggccgaaccggcggggctccacccggctgaggttcttgagcagcttggcgtcctggtggtggtggtggccgccatagctgtaccccgccttgccaccgccctccatggccgccgccgccaccgctctcgacctctcttggcaaacagcacggcacactctctctatatagtaaaactagagctcatgtgtgtgagcgtgagagtgcagcggtgaaggattaactcaccggagcttaagtagagtagataattggagtgctcgtgagcttgcttgcttgggcttggcggtgatggctgaggtggggggagctaggagggtgtcagcatgtgagtgtgaagaagagaaacagaggaggaggtcgtggaggccacctccatttattatttctccttaactcgtggctttctgttcttttccgttttttttctcctctccttttcttttttttcttttcttctcgtcatcttgttttctggcctactccctccgtccaaaaaaaaaaagacaaaccctgggtttccgtgtccaactttgactgtccgtcttatatgaattttttttataatttgtatttttattgttgttagatgataaaacatgattaatattttatgcatgacttgtctttttaattttttttataattttttcaaataagacggacggtcaaacgttagacacagaaaggatttgtcttttttttttacagagggagcaagtacttccgttttttcagtgtgtaaaggatggagaaggctgacttttttttttttgtagtgaacgaaaccgtttcatctcgccggcacacgctttcaaaacctctaatatagagtagcaattaaagatgaaattagccctaatttagtaagtacgaatcagcctgttatttgacctaacctaatgatatgaatttggacaagttaatacgtagtaatctggataggtaatcaatctcatcctagataattacctgcctagtttgtgatagtgttatcccatccttaattgctactacaattctgggatagatgaagtatgtcttaattcttgtagaaactttatatataatattgatttctcataaaattattttaaatctattattaactttatattatttaattaatgtatttgtaccatcaactatttattacaggccatatattcagctattcatccatttagagagaaaaaaataacgcatataaatagtaagggcccctttgaattgcaggattgagaaaacgtaggattttgatagaaatgtaagtgtaaaatagatgattgtaaaacgtagaaaaaacataggaatgaccatttgattgaaccgtaggaaaaacacaggaattagatgagagagatagactcaaagaaaatttagtaagaggttgaagctattcagaccatatattcaactattacagaccatatattcagctattcatccattcagagaaaaaaaaaagaacacacaatagtataaatcaataatgtactgacgaagtaatatgaagtaggggatgcagcgcgcaacttgtggctctgactggatgcatagtttctgcacggcgtgattgattggcaattggcaccgacgagagcatagcagccggatctcacacgcacagtcaagatctgcaactctgagcttctgatgaagttctgaactgatgaattaagattataacaggggaatctctctgctaactagtactgtagttcccatctaatggcctggttgatctctctattaggagtatctgaggatgatgctagtaccatctttccagtgatgagtgattgaatgattggttagtacacatacgcgcccatctgatctgatacggccagcagaatctgcttctgtactgaaatgctgctggtactggttacagattgattacagataattgtcagtgtattgcctcccatagatgactatagtaaattgcagctaatcgtgtgactcatcggtttcactgaaaaagctcataggaaactggctgtctgaaaggcaatgatcagttagttaacacatgcgtgttgcattagtctttgttgggctgatccatccatccacagattacggcggctgaagatgctaaaggaaggagaggctgcctccaaagctgctgcttccttccgtgctttctgtgtccgtttccacatgggtccaactccaacgtaagggaccagatggatcagtcagaggcagcaccacacacaaaaggaagcccatatcttgtgttcttcatcgtcttgcacctcactcaacatcgcccagtgaattcagtatttgagtgatacgataatagctgaattacatgcagattttacaaagttgtgagcaaaattcagttgtaacaagtctgaaatattcttctatctttgtgatgcagtttgttgtttggtccaaattcgtaggagatcgcttctgaatctcagaatctgcattggtgttctcctttcgtggttagcagttgctgtcttatcaacatttccttgctttgcgatgtggtcatcaaaactattctaggaaggagttgatgcatggttctgcaccccgtgaagtcatcactgtccactaaccgttcgttcggttctttgttttcagaagcaacttgtccgaattcagtctgtaaaattttcacaagcagtttgtctgaattcagtatgtgcaacttccctacaaccaatgggcacctacctacccctgtcaacactggcaaagtgctcaaccagctcactagtagattaatccaattacatacagttacagtagtcgttttgcttgcagatttactcaacagctagctttcctggataattaaaaacttgatgtgtcaggagatgacaagcagcaacaagaacaaagaggtataatactgcacagtactgtatactactggtactcatactagtatcatacagtgccattcttggtattcaggcttggtgaatcagagaaaaacaatggaatcaaatcagactagctaggagaagatgattgtgtcactagatatggtaagtaagtacaatagacaagaacaataaatgctgcaaatcgtagcgattcaggaagtggttgctacgtccattcatgaatgatccggtcgcacttgcacatcgccaacatgttgaatcgaatggcatcttgcttgacacttccctttcgttgatctctgaaggactgaaacaagcttgtattaagggcccaatgcataaacaatcgaggcttagtcactaatcaaatcatggcgagaaaaacacattcgcggcgtgccaaaaccacaccaacgacgaaaatgaaggaattggggccaacagctatgcctgaactatgcatggctgctggctggtttatcgggcacaagagaacaagtgtttttttatcttaataggaagaaaacaagaacaagtgttaggttggtgcaagaagaagaaaaagaaaaaaaggttcagaactttaggctgttcaaatgtaacgacatcttcaatacagtacacggcctaataacggaatctaatgaggttgatttgtttgttgtgatccaatcggcatcagcatttacatgaggttaggtacaataagcgctaacttgttcagtttaaaaaaatgagcgctatttggttggaatgtctcataaatacaaaacctcctgctaggctgctacaatataactgacctgcaatctgaagtttctgtgctcaaaatgtacaataagaggctaggaacttgggcagattagtcatgtaaatctcttggatgattggaatttagaaattatatatagcggcatggtacaacagacatactacaggagaggagtgccatgtagtggtagtggtactgtcggcagaggcagcagccatacatacagcacagagagtggctagcaagtggtgagtggggccacttgtcagagagagcataatttgcgtcgaaatggcgcctaaccctgcctaaattcgccagtggatggaccatctcgttctcgttcacgttcagtcagacaacctacgaacaagatgcatctactggaaattggtaacgaggtgaattgggtttgggcttttctttcaccgcacttatctgggctggccgggatgctatcacatttttttaggaacagttccttcctctaagaatagaagttcagagagattcctataaaatcttaaattcatcggctcagacttcagaagttcagagctacacactgaatctgttataccataactaccggttaccattcagtttaattgctattagaataagatcttctagttaacctaaacacatttaaccttacatctcacaggagaggtaagcaaaacaaagcgacacatgataaacagctagtgttaaccacacatgataaatttacagtacaggattcagtcctccaactgctgctcatccttggcgcttgcttctcctctcttcacaaaaaacaaaacaaaagatgtagtctgtcaaacattgtgatttaaaactgatctcagtgttgtatatctaggacaaagctagaattaatcatattgtttgaataacacttttaataacatgatgtaacgaacaatattgtccatggatcaataaatctaaatcgaagtactagtatataacattacagttaagataaaactagtaaagttataccgtgtggtcctgtaggtatgagctgaagtcagtagcaatgagatagggtgtaagccaccgcaattcgccgtgttgagatatcttcgtgaaagacaggaccttgttctgcagaatgtcaaagcggatcatataattggctttggccaccagtcgatccccaagaacttggccgaattcattaacgtgatcaggtattggctcctgaaagatatcattcagaacggcatacatgatcccatcttcgttcacgctaagaataggaatcggcataacatgtggcaacccaatctcgttgaagctctcgctcgcccagctgtctccgacagtcaatgtcgtttcctccttccagtgcttgaaatctggggagagtgaccatgtcttgagcttcacctcgttggcgggacaagaagcttcttcgcagtagccgatcaaggcgacgaacttgatggcaccagagacgcagccgatggaacggtgctcattcgggctgaagcaatggcggggtttgccgtggacgtcgcggcagtggggcagcgggacgaacactagctcggggccttccggcgacgagacgtggtcgcaaatcaagatgcccttgaggagatcaacccagaagatgctgccttggaaggagaaggccgtgtcgacgtggaagaagtaggtcgggccacagagatgtggagggagagggagacgaaccggcggcgtctcggcccactccgacgacgacgagcacacgaagagcttcgcgtcggggagccctgtggtggaggaggtgacaatgtcggcgaggatgtaatcatcatcatcatcgccggcggtgacgacgacggcggtgcggccgaggggaaggaaggtgggagagcatagggaatcggggagtgggggcatagcggtaaggtggttgttggaggcgtcgtagagaaggtagtatcgatgggcgtagatgacgacgatgccattgtggatgctggagatctcgccgatcccagccagatgcgagtactccggcggcagcagcatctgcaggctgcttacttaaggtgggtcggcgagaaagggaacgggtttcatgtccggcgccatccgccactccatctcctccaccatctgcactctactccaactccacccaccgatggttaactctttcccttcgacgaaaagcactatgcgatcgagcaacacgcaaggaggcctcgggttcgccatgagattgttgcttgacctagcttgacgcgcggctagggtttgctttgcttgaacaacaaagagaaggaaggaattggggaattgaattaaggggctctctctctctctctctctatatatatatatatatatatatatatatatatatatatatatatatatatatatatatatatatatatatctgtgtgtgtgtatgtgtatatatatatatacatatatatatacatatacgtatctactactacttaaaaaataagaggtgcttccatcgtccgtcaaaaaaaccgggtgaaaaaaaaccggaacgaatccgattcgtcaacgcggtaaaagaatatgtccgattccacaaaaataggaaacaaactcccatctgttttcgtttgagctgattaggactttgtttctgtttgggcgaataggacttggtttgaattataccaagtcctattcggttagcatcaccaggagaacaagtgcatatatacatacatagtataaaaaatcatagcacataacaaagaatcacatgcagccttatagcactttgcaaaaaaacaaaaaattagatcgaagggggtcgccgccagcacacatatatccaaataaaaacaaaaaattagatcgaagggggtcgccgccgctgccgccgtcgccgtcgccgtcgttgccgaaccgccgccgtcgccgtcgctgtggatccggtggaggggagagcaccgccgccgccgcctcccctcccgctagatccgccggcggcggcggcagagggcactctccggtggtgggggagagcgccgccgccaccgtcggtggtgggggaggactccaccgccgccgccgctcgcgggaggaggggcgccgtcgccgccgctcgcggggcgcctccccacccgctagatccgccgctggtggtgggggagggtgctgccgccgccgctcgcgggaggaggggcgccgtcgccgtcgccgccgctcgcggggcgcctcccctcccgctagatccgccgccggtggtgggggaggatgccgccgacaccgccgtgggtggtgggggtgccgccgccgccgccatcggtggtgggggaggggcgccgtcgtcaccgccgccgctcgggggcgcggaggagaggccggtgaagtgagatggcagggagggaaatgggctagggttccgcggctgagagggagtgggttttgtttccccactattgacgctcggccgtccgatcaaaaccctagagatcggacggccggtgtcgtccgggccgaaatcggcccaagagggatcgagagtgaggcctcttttccggcccaagcccaggttgcggcctgggggaggaaaagtgcgcccgcgcatgcgcaagaggccgtgggccgaccggcataggtcggaaataagtctattgttggtccctcgagccgaaaaaaagagaataagtacatttttagtgctcattttttcagaagcattacaattatagttctattgaatatgtttatttcgaagcaaacctataaaaaagtattttctttctttttccaattaaataattgttaaatgatgtttgtattaataaaattagcaattaagctctgaaaattccaataaaattccaaagagcgtaactaattatggagaatttaataaaattaaatttaaccatgtcattttatttaaccatggagaatggagaattttacttgtaaatttatttaattatacacatacctacttaaaaataccaaatatttcagcgagtttgtattttaattaattgcatatttttctgatctgtaaacttcccggtgcaacgcacgggcacttttgctaaaccaaacaacacttttggtcaatatacacactctgtaatcacccagtgcaacgcacgggcacttttgctagtatatatatatatatatatatatatatatatatatatatatatgtatatacatatatatcttgtgatagaaaatcacagctcctatcattcgaattttagactattggatatgctttaagatttgtgcagacccatttaaccctaagtcatctcctcctccctcgttcagatcgcgccgccaccactccgcctcccgtccccgcgcgattcccaccgccaccgccccatcgcgccaccgcaggcctcgccggctggccgaaaggagtcaacagtgctagcgagccccctcccccttccccctctctttctcctcgaggcggcgacgatgaggtgcccccgccccgccgtcttccccgtctccggtggctccccgccgccggatccacagccaccgcccccgtcgtcgacgccggcccaccgccctcctccatccccgttgcttcggcggcaccgttgccgccttgccgcccgctgaagaccaccgcccaccgccggtcctctgccgcccacggccatccctctaagccccgaggaaacactgaccccaaccctaacctaacccgtatgttccctactagagttggggtgtcaccggcaccggagaagaaggggagcccgccggagttggaggagagaaatcgatgcacgaaacttggtatggatctaatggtcaaaaatctaatatgtaagatttcatccccaaatttcattcgaatgacatatagcaatctcgttgaattaatttccttgttgtcgatgagaaaaatcatgggctcctatatatggcccatgtattaactgctgcaaaggaaaagcccatgtgttgagtggggccggttgttagagagagtataatttgccatggaatgacgcctaacccgaattttttttatttttgtttttttaaaatatttacagaaataatctatcgtcagaaaaatttacaaaaatagaccctgccgctctagtggaggacggtaagctgacgtggcagacggcggctcgacggcgccgtgtgcgcattttacgctttggtccggtaaggggtgaaatgcaatttgtccagctgaatagaagcattaggctggtattttttttttgcatctaggccataatgcttctatccagctctgttgataatggcccttcccggactggcttttttacatggaggcccctagccgccctggcagtgggcggcatgggtgttaatgcaaaaagttcaactttttcaatcggccgtcaccgcccgttttttcacatggtcagttgtatgtcgcattgtcaatgggtgtgtaaggcaaatgacaaggattttggcacagccgaagaaagaaagtagaccccatagagaagatcactaggaatatcgtgtataaagacgttcttgactagtgagcaaaggtaggctcgcatgatcaaaattaatttgaaaacataatatagaaaataataaattgctgatcggagtattaatcaccaacatcctcttgttttgtacaacatgccatcatcattcaagtagtatattgtgtgattatcttctccataccatctcgtgttacatgcgtcagtttgcatcgggctgataacaatactatatgttaacacgcgtgtctctctaaatatgcacttttgccatcaacaaattttagtagttgtgccacgtagatcatggaagaagacgttaatgagatgatcaacaattgctatcttgttatacattgtgaaactattaatttggcatctgcttcaaatgaaattgttatttgggtttatattcacattctcgtgctacgtgctcaatgggcagtggccggcgtgtgctttgtgtgacaaatagaaaaaaagatttttttttctaagtgcataggccaaatgaaaaaaaatgaatggaattgacctaaaggaacatccaaattcacgacatgcagaaattatattttcttgtactctatataatgtaattgcactaatatactttgttttctatgtattatacttgtgagagattatggtacacctgaataatgaaaattgatgttattttttttgaggtagtattgtatagtgttttatttataaattttatttgaggtcaaatatcaataaggttgtgttcgtttctttgaggtttccaacctccactatatcgtttcccgacggcgaccacgacggctctcggtgacgacaatcacgacgcgcagctccgccgcttccccttctcccctccccgccgctttgtgggccctgcgtcagatgcatgcagtttcaggcgagactctcgttgccaaaatgagacaaaggaagcaaacaatggtcacggcctcatctacattttcgtccaccgcagcgagtatcctatttggctgggcgagtctatacatcacgtaggagcgtggtgaatggccttagggtgtgttcggcaacacaggttcccaactcctccccctcgtgtaccgtgcgcacgctttttaaactgttaaacacagtgtgttttttttaaaaaaaaattctatacgaaaattgtttaaaaaaatcatatggatctattttttttaaaaaaattaatacttaattaatcacacgctaatagatcgcttcatttttcatgcgtacgagattagttcccatctcctttatccaaactcagccttagaacgctgggttgtgtggcaatccatcgatcaatctaaaaaaatatcctagctggagctggagggggttggaaatagccaatgtgcacctggtccaggaagaccttgtgcacgggtgtgtgtgttgagggttggcgtccgtgtccagatctacagacgccaagaaggaagtaattccccaaaccttagatcgcctcttcttcttcttctaatcttgctgttggacccgacgaagcaaaccctagcctcctcctggagtaggcagcaatcatggcagaccaccccaggcctcctccctgtgtgttgctggaacgcgtggtgcgtttcgtggaagcagcagggttaaccagcggtggcgccagcagagacccagatgttgcggccataatcgaggtcggcggatggagctggagcacagtgcaaatgatgggttccgtggaggagatggagcggctgatggcgccgtccgtgaaacccgtcgccttcctcggcgacccacctcaagtaagcagcctgcacatgctgctgccgccgccggcgagcctggatctgcttgggatcggcgagatctccagcacccacaagggcatcgtcgttatctacgccgataaatgctacctcctctatgatgcctccaacaaccaccttaccggtatccccccaattcccgattcggtgacctctgcccccatcttccttcccctcggtcgcggcgctgtcctcgtctctgccgccggcgccgatgatgatgattacatcttcgccgacatcgtcacctccccctccactagagggatcaaccccgcgctccccaaagccaccatcttcgcgagggtgaagaacggcggcgagtggatccagtcatcgattcctcccctccctctccctccacatctctgtggcccgacctacttcttccacatcgacacggccttctccttcgccggcaccatcttctgggttgatcccctcaagggcatcttgatttgcgacgacatcttgtcatcaccgcaaggccccaggctagcgttcgtcccgttgccccactgcatcgacgcccacgacaaaccccgccattgcttcagcccaaatgaacaccgttccatcggccgcgtctctggtgccatcaagttcctcgccttgatcggctactgcgaagcttcttgtcccgagaacgaggtgaagctcaagacatggtcactgtccccagatttcaagcactggaaagaggaaaccaccttgactgtcggagacatctgggcgagcgagagcttcaaccagatggggttgccacatgttctgcccttctcccctgtcctcagcgtcaacgaagatggcatcatgtatgccgttctgaatgatgtcaagaaggaaccaataccgcgactcaatgagttcggggacagtcttgggatgcagctggttcctaaagcaaattatatgatccgcttcgacatgctgcaaaacaaggtcctgtcctccaccaagatttctaaaaaggccacttcgcggtggcttacaaataccttccttgctaccgacttcagtgcatacctacaagaccgccaggtactttactagtaactgctaccccactctacttctctggcttcatcccaatcgtttgttttactgctttactttgtttcagactcaattgatgcttatatttgtcacatcaagttagtttcacttgtacaactaactagtaaaaaatattgacatcttaatttggccaaccattaattaacattcaagtattgaacaccgcttagtgtgtcatatgtgcaccagcttcccttcatgaaccaatgagcattacaagtctcatgttaaactttgctagtaatattttttaaattaagaattggtatcagcctaagttcattcgatgatttactagtatgcagtatgcagaggctcaaatttaaactgaaattgaaaaaaaaaatcagcaacttccgtagccttccgttgttatttttgacaaaaagtacaatacccttatcaattatcccatttgcgtttatggctcactgttttggcgcaatactatttttaattgacctttcttactttatagccctgtgctatgatgctttcaacatattccaatctgagacaagcttaagatatccatgcttccggaacgctttcttttctagaaaattatttttacagtcttctaagtttcacttcttcaatacaaacctgagtgaattgtctaattagttacttaatgaatctagagttttcaaaatcaatttccgaatgtatacacggttggtgttatgttttctttggtgtagaattatttcatagtggtttcacttatccaatacaagcttcctttcttttgtcttaaccaatgaaaattacctggctcttgttgaactttgatagttgtaactttcaaattaagaattattttcagagtccctcagtttagtattattttcagagtctccctgagtgaattgcctaattaatgaatatagagaggttttgaaatcaattaccgaatgcattattggtacaagcctaagtagattctaaaagatgcagcattctgaagtgcaagactaaaaccaacagtggtcttaactgctgctggcaacagtaacaacctataaccacgtatattgatgccatggctactaacctcattagcaacatgccttgaagtactgctgactggacactacccctcttcttaagtgttgaagaattataattcaagctttggcatagataaaactagggtcagatttaaatcataatgtttaattgacagtcatcttcattttgttttggcagaatgctgaagcagcaggcaaggttggagcaagcgccaagggcaagcgtaagcggatgagcagcaggcaagctggtaggagcaagtgccaagggcaagcgtaagcggatcgaggagtgctgaatggtactccctcagttaaaaaaaaaaaacaatcctgagtatgaacctggacacgtgtgtgggctcatacccaggatttgttcttttctttttaggacggagagagtagtatatttctgttgcttatcatgtgcgcctagcatgtcgcttttttggcttacatcctgtgagatgtaatgttagcatgtgtttggtttcgggactaagtgggatgggatgaaaccatccctgattttggagttgggatgattccactcacatgtttggtttgtaggatgggacaattctaattttttgtttggttgaaaggatgagggagaaatgggatggacgccgtttgccatcaccgtcaacgaccgtcgcctgcgccacctgcatccacgcgtggaacaaccggatcaagcacagcggcagcagcaggacggccaccaccgccggagcacccaacccgctggcccaccgtcgtcgccgcggctggatcgggagatcccctgcgccggatccgccgccgccgctctccctacctccaagtttcgccgccgccgagtcccccttctctggatccgccgccgccgccctccctacctccaagcttcgccgccactcgagcccgccgcgtcgacatcaccgcagctgccgcaaccgctctcgtcgagcatcacgatgagcggcgggatggcgccgagcatctcgctcgcggcggcaaccggtgttaaggcaaggggtcgtggaggagcgccggcggtcgcagaggtggtggcaggcggtcgtggcggagcgccggcggtcacggaggaggcggcgggcacgggcgcggacgagcgcctgcggtcgccgaggagacgccgtgtgctccgtccaagtgggacgagctcgtccggccgattttgccggatggatttgtcccggatctaggaggaatattcctctctagggaccaacccatcccactcgcccctcaaccaaacacctctaaaagtgggtttgtcccatcccatcccatcccatcccaccaaccaaacactaccttaaatgtgtttaggttaaccatcagaccttattttagtcactatcagactttattttaatgatatcagcctagcagttaaaactgaatggtaaccaatatatgatgtatgatcatcgtggatttatatcatcatatgctatgtggccaaaggtttggtcgtggtgctccgtggactatcagccccatcgtttggcctaaacagccaaagaataagccaaaatttgaaattttgaatttaattttgaagttgattttgaaatgcttttaacgtaatttttgttaattttggcttttaagtcgctacgaataaatctacaaaagttttacttataaactaattttaattttctaataagccaaataagccattttaggtaaaatggcaaccgatgggatcctatctatctgtgactgtgagtgactcggaatggctttttattggtttcttgtactttggtacaagttccactatctaatactagtagtaatttacctgtgctaacacgaaaacaatatttggtaatgcaatcaataaactaaagacaacgcatgttttggcaattaagcatataattagataaatttaaaattcacacaaatattaaaaaaataaagtaattttattgttaaatttataagatgtgtgcaaaatagcatcgctttttatatctttgaaactatctaattcttggtgcactaagaaattattttataactgcgtgaatattattttccgaatgatgcgcaaaataataactgcaagctactcttatggaaaatgttccatgatgagtcattgctatgtaggtaatggatccacatgccatttaaaggcaaatagtgattttatcccattatatttgaatatgtaaataatcaaaattgcattatcattcagaaataaaataagttaggtaaaaggaaacgtaaaaataaacacaatatccatccatcaaggtgtgactgcaagaccaaccgaagaaaaaaatacattatgtccgggtttagcaatggtgacgatccgacatcggcggcacacgaaggaaatcggtgacgttgagcagtgccgaggaggaggttgccggagcagcttctatcgatgtagggtcggtggccggggttcgccgcagatttggatctggccggcgagtcaggtgcacagccacgagatggcagggtgttggttgcgtcacggttggcgtgatggagctggagcctagagggaggtgagcagcgaggacgacatgatggtgaactggggcgacgaggagagggaggacatgattttggggattggcggtggagagcgacactgtgtgacgtcgaatgtaactcatcagatctgaatcgttgtatgtgtcacaaaatgaataagtaataaaacaagttgttgaactataccgtgggctaactcaggtccatggacaccaaggccctgggtccgccacacgctatgcctcttggcgcccctctgttgatcgcttctcggccacacacgcattaatggcttgatgacgaaattaatttacaggccagttgattgcaagagagattggttttggcttataccatgtactgatttatgggtgatagtcaccctctcggttcattggtcagacggtccaaccgtgaacctagaggctgaagcgcggttcactaatgtacttactccgtcccataaaaaaataatttagtattagatgtgacatatcatagtcctacgaatctggatatatttctgtttagatttattgtattagaatatatcatttcgtttttttaggatggagagagtatatatcaggtactccatacttaacacacatccggatggtacgatggctacaggagttgacttgcaaccgcgcaccttttagttggatatttgaaaaaaaaagaggctgcgagctagtgtggcccaaaaaatgagcctacgaactaacacggccatcatgtggcccattcattcattgacttgacttagagcagatataatagcagactataagccagctataaacatattttaaagagatactcccttcgtactcgtaaagaaagtcgtttaggacaatgtttaagtcaaaccttgggaatataaatcatgaatagctcttaagttgttgagtttgaaaatgtaaaaattatatgaatagatttgccttgaaaaacattttcataaaagtataaatatatcactttttaataaatatctttatagaaataagaagtcaaaattatgttttggagaccgtgtcgctgtccaaaacgacttcctttatgagtatggagggagtactcccttcatctacttttgatagtcatatttccaaatctgaaaattttatttttgataggcatatttcagttcaacaacctatcatcttaatgactttctcggatttaatgcatgattctccattcttccacacaacattggctacattggcttgtttacgaggaatgactagtagcatatttaaatgaatgataagtagaattacttatccttggtctatgtgccaagatgaaatatgactatcaaaagtagatgaagggagtaaaagaagagagagaagagcagcgggccacagatctgtagtcagctatatcatggactccaaaacgtaatgtgtgtattacaggtaggaccatatattaatagtatagtgtcgacgtttgatgtcgcgattccggtatttgcacagtatggggatcgttggtactaggatatacgcgagactgaggtaaaagagacggagacagggatttttatacaggttcgggcccctgaattgtcaggtaataaccctacatcctattgggcgaagccggtattgctcttattcaccataatcacaccagtacaatatttggggtagcccatctaactgctgtcgatatgacggtctgaagttctgactcgtagtcaacaacagggtagttttccttctcgaatccgcatccggcgagatcagagacaacgctatgtctctcctgacggtagccataggtatcgtaggggactagccatgcctatctctgaagtcgatatctggtatcttgtcttggcgtatgttggcttatatgttgatcttgcgtcttgatctattgttccgtgtcccctctcctcctagggggccttgtatttataaccataggtgtccccttgtctaagtagaactagggaaaccaatatggatacaatccgagtagtccttgtcgtttccatgtagaactctagtcatgcttccttatgtggaactcctcctatatccgaaagttgtttccgtataagacatggtatatggtgggtcctgtcgagatttagtcaactactattaggtatgtggtatccacaaccctgacatatagtaagtaactattgtatgaattgactattacattggctatagatgatttggaggtagtagttgactatactattatacttgctcttagtacggtccgaccgaaggcaatttgtgactcatgagacaacgaacccaactgtttacttggtcgaaatagctaataggcgatcagtcgccgcgcgaggagaggggagcgcgggcagcatgcggtttctttttt

SEQ ID NO: 76693 - DNA, 1078 bp, Oryza sativa
gatttgaaggcaatttgaggatgattgttttgggattttggggacgggatagggttagggtgaaatcaatatattaaaaataataaagagaagaaaataataaagaagcaaccggatctgtctcaaccgggactaaagataaacaccaaccgggactaaaaatcgatttttactcccggttatctcacccgggactaaagatcgctatctttagtcccggattcgtagtctcggttggaaaaccaggactatataggggttatgaaccgggagtaaaatccacttctccaccagtgacacgttttaggtacaaaaggaaatctgctgcattcacgtgtggcgcgcccgcgcatgccaacctgttcgagccattcgcgggtacgggttaacgcgaacgttcacgtattaggtatttcgtagaaggaacgaacaaacggtcatgctgcccctaacgtgcgatcagtcgcgcttcccacgagccgcgcggtcagtttctgaccatatagtctctctcctctactagatgtatatatatatataaagtttatatgtatgtatataaagtttatatgtatatatatatatacatatgtatattttctaatatgtatatacacatataaaatgtttgtatacgtcatatacaaagtttgtatgcgacgtatataaaagtttatatatgtatgtatacaaaatatatgtcacgcccagaaatttagccctaaatttccagactattttgtgtattaaatccctgtccaggaccagccaggatacacaaaacgataagtaatatacagttccaaacgtaaataaagcgtaaaccatgcacccacagcccacgctggcttgtggtaagtacgaggaattcttgcagggtttcccgcgaaccggtccttaattgccatgggtgcgactagcaaaaccatgcacccacagcccaccattcagtcgcattttagttggataattacgaccatgaagcatggccagatgtctcgagcacgcagctcattcagatactaaaaaggtctaatactgcaattatcccatcaactgagctagtggcaattaagca

SEQ ID NO: 76694 - DNA, 1142 bp, Oryza sativa
aggtggaaaccatccagcgacatgggggcggcatcaaggggcggagtgaaggtggctcggtgccgtttttctcgggggaagtgggggaagagggggaggacgagggcggcgaccgcgcccacgtatgcgcgggaaaggggggtcgcgcggaaggggcggcaacgtgggcgtatcgggcggccatggcagttgccggcccaagctggaggaaggggaaggagctgacatgtggggccgggtcccacatgtcggccggagagagaagagctggggggggttttgtggactttcaagggagaggaggcaaatgggccaacggcccctgtaaggggggggaaggagcggtctgaaggaggggaaggagaggcttgggccgagcccaaagagaggatggagagatttatttggttttctttttacttaattgattaaatgaactttgtggcattaaaattatttattgagctccgaaaattcacgggaaatttcagagaatatattagggcacaaagaatattacaaaatattctcagccaatgatttttatggggaaattttaattctctcattatttcacttgattaaattgctttaaattttatttaatttttagaaaatgcattatttaatgatttttaatcccgaacgaaaatcggggcgtcacaatataccatctttatatacgtgtgtgtgtgtgtgtatatatataatttgtacgcctatatataaaaatttatacacacaaaatttgtatacaaactttgtatatgtatgtattaaaaaaacaaaaaacaagaaaaagatacggaaagaaaaaaaacagaaaaaaaacgcgcgccacacaaaaagtaacgatactgaaggaagaaaagaaaaaaaaaagaaaaccgcacgcataagggcaagttttatagtggaggtgagtgtcacatctaatttacatcatatcatcttctcattaattaagtggtaacaagtacaacatgtcacttctagtacacaaaccccagtattagtttactctcatatcatcttatatttttcttggagattgtgtggaggttgccccttgcatatggggtggttcattctctctctcctaacttctctcctccaactcatcatctaatcctatatgtcaa

SEQ ID NO: 76695 - DNA, 576 bp, Oryza sativa
aaccgtatcagtttcgttgcaatccgatcacccgttgtcgcgaccctaattttagccctagggtacgccgttcaccgaaattccaaaaatccctaaaattatttctttaaatccttttcacccattgttgcagtttgtgatactattttcttttggttatctttgcttttctgttatttattatggtgatgattgttgcgtaaatagaaagcactgacgttggtccggtagtcggagcaagtgaaatctccgcgccaggaggagacggtttgtacgactacatcgagcccgaaggttgcaagacatgcaccctcccttgaacaatttaatcccagtagttagagagttattttggtagcgtactcgtcctttggagtacgatagactgcacgaattcttttaaattaattatattactattattgcattatattttctgttgttgttataaacaccttaatgagccttagagtataacaaacttaggataaaatttgagaaacacctaaacaaatggttaattatttaacatgctattgatttaatatggatattattactgcatatgaaaacatg

SEQ ID NO: 76696 - DNA, 35389 bp, Oryza sativa
catcctagttattgggttagaaatggtctaatcatgagatgtacgatactaaacgtctgttcgcgttccgcgaacgttcacgtattagcctcacccgctgctcgggcggtgctgcgagaccgcatctgtctcgtgccaacagaccgcaaacagcgtctctctcgtgccgatgttgtggcgttgcggggccgtaacaacgtcacccatttcgcaccacgacaccgcccatgtcatgactccgtcacgcgagcaggacggagctagaactagacagagagatgctgctagcttaatttattttacttaatattgagtttaaactgacatagatacttatatttatattgagagggtgcatatatagcgaaaatagataagatatagttataatttttttttcaccgggttactaggaaccccctaattactctacctccaccctgcacgcgagaccgcacacgaattcagcacgtggtcattattttcacgcaacggtcgagcaatatcgtgtcatgcccttccactcagcgacgacggggtgtttagatccacgggtgtaaagttttggcgtgttacatcggatattatataggttattgtatgtgttgttcggtcacttaataaaaaactaattacagaatctatcagtaaactgcaagacgaatttattaagcctaattaatcctcattagtaaatatttactgtagcatcacattgtcaaatcatgaaacaattaggcttaaaagattcgtctcgcaaattagttacaatccgtgcaattagttattttttactctatatttaatactttatacagatatttaaatgttcgatgtgacagggtggggttctaaagaggacagacgacatggaaaaaatgcatcctagatatttctgataaaaaaataaatgaactgtatagtttcaaatagatgcatgcctcaccctatcaccagcgtagcacgtccttgaggccgagtttgcttccaaaatttttcttcaaatttccaattttttcatcgtatcgaaatttttctacacacgtgaactttcaaatttttcgtcacatcgtattaattttaaccaaatttacaatttagcgttaactatgctttcctgttgcacgtaaaagcaaaagcaaaagcaaaaccaaaccacaaggcatcacagcacatcacatcaggagtagccgtgctaggaatagctacagctgctactccaccagtacatcgatcccctccaccagtacatcaatccagcctgcgccctgcggctctgcgctgcgagatggtggtttggtatggtggtgttacgcgcgcgcccttcaaacccaaccaaaactcagcagcttttttttctctcttttttattttgatcttgaaaacaacagcaactaggtgctttcccctgttcgtgcaagcgaggtgaagacgtgaagtccattttatgtgtatggcctgtcccctttcccatcaaactttattctgcgtcctccatttggcggcccaacgcgggagcagctgaagccgtccgatcgaatggctggtccagattaatcctgacctaaataaatacacctaaaacctaaccctaactttagaattcattccccccattgcccccgatctcccccaagcgatggagccccctccccccccccccccaaagcataggggtgggcacatttagaccgaattgaagaaccaaatcgaaaaaaccgaggccgaaaaatttagtttcctgttcggtcccaaccatcgaaagactgaatttatttcggtcaattgggttattgggctcggttaaccgaattaaccgaaaatgaccgaaattttggcccaacagacgaagcccaataagcccagtagttatctaaccctagaagtgataccataggcgcacagcagtcccagtcacgccgcattccccatcctctcggcctctgcctccaccgcgcgtgtcagggttatggataccacatacctaataatagtcgactaaatctcgacagggcccaccacataccatgtcttatatggaaactgacctcggatatgggaggagttccggataaggatagacaaccagagttctacatggaaacgacgaggactactcggattgtatccatattggtttccctagttctatttggacaaggggacatctatgggtataaatacaaggccccctagaaggagaggggacacaatcaacatacacggaacaacagaagccacaacatacaagccaacatacgccaagacaagacgccggatatcaacttcagggataggcatggctagtcccctacggtgcctatagctaccgtcaggagagatatagcgctgtctctgatctcgccggatgcgaattcaaggaggaagactaccctgttatcgactacgagtcagaccttcagaccgccatgtcgacaaaagttagataggctaccccaaatattgtactagtgtgattatgatgaataagagcaacgaccggcttcggccaacaggatgtagggttattacctgataattcaggggcccgaacctgtataaaaatccatgtctccgtctcttttatcttagtctcgtgtatatcctagtatcaacgatccacatactatgcaaataccggaatcgtgacatcaaacgtcgacagcgcggtcgcgccgctgccatccaccgcgcccggcctccacctccaaccctccaccgcgccagagccgcctccgcctctgccctccaccgcgcaagagccgcctcgcctccgttctccaccgcgccggagccgcctccgtcctccaccgcgccggagccacctcgcctccgccctccaccgcaccggagccgcctcgcctccgttctccaccgtgtcggcatccatcgcgccacggccgccgcctccgccttggcgacgacggctacatcctagttggctgttcatgtacttatttactactgcttgatcacaatttgtgaacctagttggctgttgcttcttgcttgatcacaatctgtgaactactaaacttatttactactgcttgtgcttgatatgtgatgtaatgttactcatcaacccggaacttcagttctgagacctgtgctatttattcttgtatattatcttgtatttttgtgatatatatatgtgaaaaaatgtctcaaaagaggggaagtgctgtcaaaatttttcatttcaaacttactactaaaaatttcggtcagatcgagactgagacccaaaagaccgagaccgaatttaccggtcctgagtttttttggatgaaattcggccctgagttttcgaagactgaaatacccgaaagacagaagaccgagaccgaatttttcgatctgaccgaacgcccacccctacccgagcggctgcggcagcgcggagcagcgaccgacaagcgatgcccctgatcctctctctcaaggcgacgacggtggcggcgtggagcagcggccggcctcctctccctcgccatggggccccgggagagctcgactgtggcagcggcagcgcccttccctcagctggatccagcgggaggggaggcggcggcggcggcctcccctccaccggatccagcgggaggggagccggcggcggcggttcggtggtgacctccccttcggtctattttttagatatatttgtgtgtatatgctttctccgattttatttgtgtgattgaattccgatttggattttttttttgggggggggggaggggtgattgaattccgaatgggattttaggggcggagggaggggggcgacagacgaaaaattggcgtactgacgaggtgacgaacggaaaaatatggatcttttaattagttaagatatgtaacgaatcatgacttggatatgacgtttgcttgtatattacggaacggcctaaagtctaggtttgataatgttgtaaagtagatttaggaaaccgataccatattggttaaggtttctatcttgtaataatgccccacatcctatataaggtgggcactgggctggaagccttctaaggaatgattcacaaacagatcgtcagatcaatactacacccggcggattcgaatcctcaaacaggagtggggtattttctctcattgagagggcctggacctgtctaaatccttgtctctacatccatctacttttaggtctcatgcactatccctttatattgtcgaaattttgtttggacacatatttttgcctctcttttcttgttcgatcgctcacttccatttcggggagccattactgcacggccaaacagtttccttttccgtgaaacgaagcctcccgaggagatggatcgatgtcgttcgctactaatccgaactatacgcgaatcccatcacagatgccgcatatcccgtccaaattatctatatgcggtcctacttcataatcgcatcgcggttttctttttatcatttgttatttttaccaaaggaccacagcagggtttttatttttaaataatgacctcagcagggtttttttttttgttgtttaagtaaaaaccgctcctctcagatttacaaaaaaccaacaaaagggacaaagcttgacaactttcgatcaaaaccgtatagaaaccaactaatataataccgatcggcttccacaaacagagaatcaccagtttcacgaaaaccgttgaatcctggacctcagtccgtttcttagtccactccctcttcgtctcattactaggctgatccaacagggtcggtgctgtggccgctaccccgatttggcgcagctaccgtcgcccgtcatgggtaagcgtcgtcgaatcgcgcctccgtccactagctccccctatctgcctctagccctctaccaagaaacaccatcgttgtaaccttcgccaagccaccgtgtgtgcgggtcatggggtgggttgggagggaaagatggagagagagaggaagaagtacatagattgacatgtggaacccactagctattagattggagagggtaataaagagaatgttagagtgaaagacaaatttgactctaatattttgtaagctagccaaatagagatttaaaaagttaaatttagagagaccgttaaagatgctattatacactcgggcaacagctgcatcatatcattgccttgatctcctctaggaggaaacaccacatggctttgtctggtgctctcttcacattaggcatgaccgagctagctacacgcaaatactcccttcatttcatacttattataagtcgctttaattttttacataatcttttaattgtttgatcaaacttaaaaaaaaactagcaacatctaaaataccaaattagttctattaaatttaacactgagtatatattttgataatgggtttattttatgttgaaaatgttattgtattattcaataaatttggttaaacttaaagaaaatcaaaacaatttgcaatatgaaacgaagggggtagtatatgcgcatatatcatacatgaaccatattgacaagtgaggatactcgcaaaaatacagacatttattttttaaagccccaggctcagtatggtttttgatgaaattgatggacgacggaatttctagatatagtagtctgttagtatttgttaattgttactacaaagattagggttgaactctgtgtgtgtgtgtgtgttttgtttgaaggagagaattaggatagactagatcaaatctacccgttggagttgaactctaagggggagagagagaagcagcatgaagaggggagagggtagggccgggtaacacagtactatgcatgcagcttcttcttcctccctcacttctttctccactgcagtagttcttgggtttgtgagactcccacagagagcatgattcactccggcggccgccgccgccgccaccgccgcggcagcaaagggccgtacgagcgcggcggcgacggggaggtggacggaagcccacgcgaagccaagggctgcatggacgcagcggcgacggacgcacaggcaggctccactttgggcagcggctgctgtgctgctatggctcacgcatggatggaggagtttcccggggacaaggtaactcttcttgtacacgtcatccgtggtgtttcttggttctgtcttgtgtgtctccttagatctacttagggctccctcacaaaatagacctattttctttctttcttgttcaaatatacctcctccccgcctgccttcggatgcgaccgagaatgaaatctgttgttcccaagtgtgatgcaaacatgctgctgctaattttttttaatgcattgggttttgtcttattaacatgattttgggtaaagatggtacggcgcttcgtcttactaagatcaatctcatgttcgttctgctatatgctattgtttatgctcttttgttgattcttttgtttgggttgtcttggtaacgcaggaggaggtgaaagatgtcttgcttgctcaagtcttcggtaaaaaaagaaccctctaattttcaagttaggcgtaaatttgtctacttttccaactcacggtttagttataaagtatgacataatttctttcttttttgcagctaagcataaacccattgaaagagactgacatgattttgcttgagaggggattctgccactgtgagaaggtttgaaccacatcttctatgatttagttacgggcattctattttgtatatgctctttaacttctcgaggttttcaagtatagcttcccatgctaatttaatactttgtctcggggatgttttgttggaatcagacattatttcttatgcctgcacaattgatgactgatgtatcctgcacacacctcttagttaagcaatgtgtatgtacataattaacatgtaatgccgtatcttcctctatttcaaatttgttatagagatttattttttctctttttagggggaagaactaccaaaaaaaaatcaacaggaaccaccaccgcatcaacttttacagcagaagaaccatcagcaatgtcagcaacaagctgctcacactccaaagtcgatggtgcagaagcctgaggtacgttgctactttaacaccgtgaaatggatcgtatctggtttgcgtccaatcgggtgttgcgagtagcgacactttgaacgggacgtgcatctcttcttcttcttctgtaggctgtagctagtaactcgtgatggcgatctaatcctttccccatttcgttcgcccagctgttgcttctgggatcaccatggcatgtcatgtatggtgctggttttcttctttgttttaaggagagaatttgcatagactgatcaagtctactgtgagggacccacgtttcacattttttataaacttgattaaatttaaaaatgtttggctaaggaaaaagtataaactacttataacatgaaacggggaaatattgtttatgctcttttgctgatttcttccttttggttgtcttgactgcagtggaacacgcatgaggaggtgaaggaggtccatttgaaacagaatgtccctgaaccatcttcttacctgcataagtcctcggtaaaaaagaccccctctaattcacaagtcagccataaatttgtctactttcctttaggttgtcctgaatgtagtagaacacgcaggaggaggtgaaggaagtccatgtgaaggagaatgtccctgcaccatcttcttacttgctcaagtcctcggtaaaaaaagatcccactaattctcaagtcaaccataaatttgtctactttttaggcccggtttagttacaaagtagtatgacctattttttttatttctacatcgaaccataagtatcttggattttcaatttttaacctagagagaaatgttaaatctaatccgaatacatgattataatctgtaaacatcttaaagtaatgtgtgcgccacttcttttaatgcactgttgctcttcatcttaagtaatgtgcacgtacataattatcttcatcttaagtaatgtgcacgtacataattatcttggattttcaatttttaacctaaagggaaatgttgaaactaatttatgtacatgataataatatgtagacaacttagagtaatgtgtgcgccacttttaatactgcacatcaacttactaacaagatttattcaatctcgcattcaaataaatcttgcattcattgtttgttgtgatatgctgttatttatgctcttttgccgttatttctctgcaggggttaaaatcattatttgtgaaggcttctggtgttagtgtatccatacaagtagatgtatctaacacaaaagttgattatctgatcaattctgcctgtgaaaagttaggtgtcaaagctcaggatacctatgcagtgttgtgcggtaaagttttagactatgataaatcattgtcggagtacctattgtatcaaaactcaaccgttgaaatccgctatcgaggaagagctggacagtgagtattatctatttaaaattgttaatttttttatttgtacatgtctataacattgtaacattgtgttttgctgtaggctaaattgggatcaaaaattcaatgttaatgatacagttctgtattatgatgttaacttagatccagctcttcaaaatgctggaatccaggcattccaatatgcacggtttttctcggatttttcctcatacaatatattcagaaggtgttgatgcatgttactgaacaacatccgtgcagggtggagttatgatgggggttttaatagccagaacattatctttcatgatggcgcagttagtatagaaaatgtccctgtagtggcatttgataaagatccatgtgctcgggattatactagtctctacaatatattctctacaaggtttggaccagtgtatccagtacatttcgatcatctccttgaattcctaagaacatgtccttgtggggtgaactccagaaacgatgcaatagttgcgtttgtcacaaatcatcctagtattgaaacatatgttgataggatgaaacaattgatgattttagacaatgtggtacatagacaccctgcacatcttcaggctaatataaaagctatggcagcatatgcttcacacgctagtttaagagctagtatgggaccatatgcatatgcttggaaaggttctgcgcagcttgttcctgaactcaataatgttcttatctatcaaccatccgggaaaccattacaatggaaaaatcccttatatactgataatgcaaaaggttgtcttcattttgccaataattttttgaagcatgcaagaaacagggttagtataatacttactccattattttttcactagtgaaaacatatttatgtctaacactgttttttcactaaacagttcccagaagaacaaattgaggcagcatttgctctacacatgaaaaatttcctgccaaagatattacagggactagctgaacttgctgatcgcaccccaaacagacaatacatcaatgacatgtaagtggatctcaaatcttgacaaaatctttctcaacctaaaatatttctcaatcaagtttaaaagatgaaatgagattatttttgtaggctttcaaacccactggcggatataagcacgggaaattagattcggagatgcatgtaagacaaattgatcaaaaattgacttaatattttattcttcatactatcattgcattcttatgtttagtatgtaggaagcaacaatctggagatattttaattggaaagctgtgaaggaatgtcattgtatcggaatgtcattgtatcttgctcaggcctcatggaggcatgtatcttctctgtttctttggaccggtgttgattgtgttgcagcatggtgggatggcgtcatgctggaatgcaaagataaacaaccatgttagaagctatttaatttagctagttattgtattgtatgaacatcactacattcgctcttaatttagtagtactagtaacttgttgtgctgaggagtactactactaccactactactacatgtgtgtatgcctgtctgtttggattggtttggtttctgtttggattagtagccgcttgctcagctcaaccgaaccagagatgagaggccctgccggagcgcgggcgatctgcttgcatgcatctacgcgtgcagtacagcgaaagtcggaccgagaaaacgtacctcgcgagtcaggcccgcttctcgctgtcgaccacgtctctcgacatggcgcccgagtcgtcctgagctcggccggccatctgcggtgacgaagccaccagatccggcgcctcccggccgattcgtcgcaatcgcctccctcgctggatatgccggccgcaaagctcgcagccgccggatgcccgtccgctccgaggccagcgtcttcctcggcggcctccgttagctcctcccgctccgaggccagcgtcttcctcggcggcctccgttagctcctcctcctgctcttagccggccgctaccggcgacaaacacaagaagctgctccccctccattttgcctttccttttctttttcttctatttttttccatcggccttgcgctatttatagaacgtactatgacgtcactgtcaaacggtggtgacaacatcattttcaataatattctaaaagagaacaatgccaccctcacttctttcatggagtactacaaaatcattcctatgcatattgttcattgttgttatatgtatgtactttcatctcaagtttatcagatatccggacggataagtttagtttcacgggtaaattttttttcctatcatatcgaacgtttgaatataagtacgaagtattaaatattgaaaaagaaaactaattgcacagtttgcatgtaaattacaagacgaatcttttaagcctaattgcatcatgatttgacaatgtggtgctacagtaaacatttgctaatgacagattaattgggcttaataaattcgtctcgcagtttacatgtggattatgtaatttgttttgttattagtctatgtttaatacttcaaatgtgtccatatatccgatgtgacccgatattttttttacggtggaaccaaacacagccttattctaaaagacctcacaattattttggggactaactatctaacatgttatagaaaatcccctaaatagtataagtatagtgtactccctccgttccaagatatttggatagatgtggttgataatatgaagcatcacattcgtccaaaatctcttactatattctaagacggatggagtatttacagtgcaactagcatataattacagctgtaattaggatgtaattatagtacatctagagtgtataggtcacatttgacttaaaatcttggtgtagctttagtggtagagatgtgtgctagtatgccacagttggtgggatcgactagtcatcgcgtgtatgatttttatttgttttattatgtatattacacgagtctttgtgcatatcggacggtcaacactaatctcaaagaacatccaactgccaaaatagtgcaagacatagccatcaattttctatcattagactagtagtatgtgtgtaattcatacttcaccctagcaaagcatgaatatttgtgtattcatggttagcaagagtaattaaacagcatccccatatactagcccacatgcaagtaaccaaacgccaccctgatatattgtttaacatctccaacctcactcaatatcacccactgcccactggccactatagctaggctagtatttggtttgcttcaatgctaaattttaacattagaaaaacctaggcaagttttgacgttgtcaatttctttcacaatttatatgtgctgttggcatatttggtagcaaattaaatactagtattaaagtaccaacgatttgatagcgcatattttagctccggaacaaaatgcctccctcagctctttttttttctttttttcctttggtatagatttgtgctccaagataccctaaccctagaccagtccaaaaataaataaataaaaagaatggtgcccagaatctcggttccagtgacttcacttcgaacaactgtgcaattaaatatgttctctatttctagcattaatataatatataagtttccctttaaaggctgtgtgtagttcagcgcaaagtttggattttggttaaaattggagatgatgtgactaaaaagttgtgtgtgtatgacatattaatgtgatggaaaaggactgaaatttggatccaaactttggatctaaacacagccttaataaaaatcatctgctaggtttcgtcctttaaatttatttaaatttcactcattttgagtatgagattctaataattggctgtaactttttgagcaaaagtcggaatgctctgttccattatctaaaaaaaaatgtgtattaaagcgactgcaatagaatgatataaatggattatacgagttgtcacattgtacctgtgcttatgtagtgggaagaatgagaggagagaagaaaaaaaggggttattacatatttatagccagttatagcactggaatggactccgataaataaattatgttagagggacaagttagttaaatattaaattgtgtaatggtatatatctacaactaattttaatttttgaagctaatgcttaacttgtactataagctttgctgtccgatccgggggttagactcgtgtcaatctgccgcctcaggccaccctgcacgcaaatctcgttcgtccacccctgtgggttcgtcacagtctggagcaacgcgcggctgcatgccaaagggcaaaggcgccagctcgtcaacccaaccctatcgacacccggtgaccggtgttggtggagcccatgaccatgggggaggtggagctatgctttgacgcgtcgtgtcgtgcgggtagatagatgccacgcggcgatagatggcgcatgatgatcactagtggagtagtcatggatgcggctgtgtcgtgcggtgcgggtgggccacgcggcgatggcacatgagcaggaagcggttgagagttgagacaaataatgtcatggaggcgtgcggctgtgtactgtacctccgcgcgcttgaccgacgatgtcagtgactgacgcggaagaattaatccaagggcaaagtatatactccatggagttgaaggagcaaatgagcgtggaatatgatttgttcttaagcttggattaacgagcatcgtatttacgcggctcatatactccctccgttttttactttgactttttttctatagtaaattccttttatgtttgatcaaatttgtaatagtaaaatataataacattttcaacataaaaaatatattatatttaatcaaattaatttaatattttagatattcataataaaaaattgactaggaaaaaagtcaaagcgactatagttgaaacggagaaaatatttatctttaatatggtcaaatatactataatagatctcttcacccggtagtcaataaaataattaactatttaaaaaaatgggattaacaaagtcttgaataaatgtgatttagaaattatgttttttacaaacatattctgcatcttaaaaagtttccaaatatgtcgtgttcaaaagacacaactttattaaggctgtatccttccccagttttctcaactcacatctctcattttccacacgcacgctttttaaactgataaatgttgcgaaagttattttaaaaaatcatactaatcattttttaataaaaatagttaatacttaattaatcatgtaataataaataattaatcatgtaataataaatgcttcgtttggcagcctgaaagtgaattcatggtgtgttcgacaagagagtaaagcagtggtggattgagaatatatgcaaaagccattggtacataattaattgtattaattattttaaacttgaaaatatatttgtatgattttaaaagtaatttttctatctatatatttttttgggataataactagtttagtccctaaagtttctctataggatcagtttagtccctaacattttaaatggtccaaagaaatacttaaactttgtcataaggtgtagaatagttcttgggtccactaaaatcattatatggatatgccatgtcatcattcatgcaaaatctatgatgaattgtccaatatacccttacgtatatcatagaaaaataaatataagggtgaattggacataaccataggaaaaaaatacttatcctttttttcacccttttgaggtatatttttgctcttacattttaccttttgttttttattttcctatgatatatgtaaggttaaattggacaaatcatagattttgcataggaatgtaacatggcatatccatgtggcgattttggtgggaccaaggactatatcaacccacatgacaaaattaaaggacttgtttggacaatatgaaaaattaaggactaaaatgagccatgagcgaaactttaggaatcatattagctattctccctatttttttaaagaaaaccgtttatcagtttaaaaacatgcaagcgaaaaattaagaaatttttctttgccatgccgcttgtctaaacacagcctttcgtatacagcatatagataacccacacagcacatcgtccattgagctatttcaaacagattaatccaattagcgattttgttctataggtgctattaaattgtctatttgatcatcttttttaattaacagttagtaatttaatattcctattctctatttctttcattctatacaatagtgatattcttacgatgactcagcactctaaaatgacactcatgattaattaacaatgaagcatgtgaaatgaaccaaattactactactacggatagtataacttgttgttagtagtacgtggatgaaacatgagccacgggttttttttaagaactcatgagcgagctgttgtttttgcctattgtacatcactacattggtcttgtttgtaatattgctatttaggagtattaaacgtatattattaacaaaatctattttataacctctaggctattttacgagacaaatctaatgttgtatattaatccatgattaacagatgattattgtagcatcactgtaacaaatcatggattaatatacctcgttagattcgtcttataaaataaattaggggttataaaatctatggctgtgtttagatccaaagtttggatccaaacttcagtcattttccatcacatcaacctgtcatatacacataacttttcagtcacatcatctctaattttaaccaaaatttaaactttgcgctggactaaatacaacctatgtttaatatttttaattagtactaagggcagttttgaattgctaccaaaatttgccataccaatattttggtagcataaatagtatccaccatttgtttggattggtgccaacattttagtaatgcccatctcaaatttggtagcaatctagaactttcttcactatgatatcacaatttggctagattttggtagcaaaccaaataagatgaatacaaatttattctaccaaataattggtagtgccaaaacttgcctatgttttggcactaccaaaaaattggtagggcacctatccaaacaagccctaagatttcgaagggctataataacatgaggatccaaacagggccattgatttggctctcctaccgcctcgggatgattttgtttggcagggtccgagtggacgtgtcgtaattcgtactactacgatcgtagcctctccatctccagtgtccagtcccatcccatttccagtccaagccgcttccaccgactccagtaataataatactactcgtactagctctaaataaagatgtcagaattgggcatcgtcttggaatcgtcttggaatttggaagatgtggtggatgtcacaatgaataagcgaggtccggcgacacgcaaccacccttggggatttaaggcgatagccagtaggccaccatagagtagaggcggtgcatatcacgggagttgaggagtgtgtccgagtagtactacacaaggagatggtaaggcctcgttgacaaaaacttttaggtgtgtttagttagggctttgcaaaagtagatagaaaggtggacctatgcaagatggtaatagtagattgaagatgcaccacaatgtatatatgtgtagagtgggtaataaggtgggacccatctgaaaaaaaccctaaacatgagccatgccacaattaaaaaataggtaggatccaccacaaagtgctataacctggtagtaagcttatgacttggcagtagctatttactactttcacaatgtatcttacctagtagtaacaatattttaatccctaatacccacttctccactacattgtggatgcccttacacgttaaaattagaagtttgaagaaattaaaatgatgtgataaaaaagttaaaagttaatgtgtggcctggtttagttcctaactttttctttaaactttcaacttttctatcacatcaaaactttcctacacaggtctgctttagtttccaactttttcttcaaactttcaacttttccatcacataacttttctacacatacaaacttcctatgtgttatcacatcaaaattgaaagtttggttaaaattagaatgatgtgatggaaaagttggaaatttgtgtgtaggaaagttttgatgtgatggaaaagttggaagtttgaagaaaaagtttagaactaaactcggccttccaacttttctgtcagatcgttctaattttactcaaactttcaactttggcatgaactaaacacacccacacacaaacttccaacttttctgtcacatcgttccaatttcaatcaaactttcaattttagcgtgaactaaacacaccatgtatagaaaagttcgatgtgacgaaaaagttggaagtttgaagaaaaaagttgaaatctaaacatggcatttgttctgcgtgtcacatcgaatatacggatatatatttgaagtattaaacatagtctaataataaaacaaattacagattccatcgtaaaaccacgagacgaatttattaaacctaattaatccgtcattagcaaatatttactgtagcaccatattatcaaatcatggtgtaattagggttaaaatattcgtctcgcaatttatgtaattaattttttttctacatttaatactcatacatgtgttatttcgggaactaaacaggtactaactcctgcatcgtcttgcatatctaaactatagattcaaccacaatactactcgtactcctttaatgtcaaaatcataaatcttcctatttccctccgattctataataattattgacgttttgacaaggttgtaattaaacttttataactttaaccgtcaatactaattttaaaaatatttagtttaaagaaattagaacaatgtatacagaggctgtattcggaacacagggttccaacccaatctgtccgcacggaaaacggagcggtccattagcgtattattaattaagtatttgctattttttcaaaaatagatcaatatgattttttaaagcaactttcatatagaaactttttgaaaaaaaaacacaccgtttagcagcttgaaaagcgtacgtgcaaaaaagagagaaaaacgtgcgcgcggaaaagagagatgtaagttgggaaagtggaggaatgaactcagctagatttgtctttcaaaacactataataacaataaacatatatttatttattgtattatactaaaaaataaggtcaaacatatatttgttcaaaacgtcaataaaaatgaaaccggaggagggagtaccttatattttcatcccgaaatcacaagacatttaattcacactaaggcccggtttagttccctaaatttttttcccaaaaacatcacatcgaatctttagacacatgtatggagcattaaatatagataaaaataaaaaataattgcacagttaagggaaaattgcgagatgaatcttttgagtctaattagtccatgattagccataagtactatagtaacccacatgtgctaatgacggattaattaggctcaaaatgttcgtctcgcggtttataggcgagttatgaaattagtttttctttttcattggtttccaaaaacccctttcgacatccggtcaaacatccgatatgaccccaaaaattttcttttcacgaactaaacaaggcctaagctgagttttgcgtgcacgcttttaaactaataaacaatatattttttaaaaaaattctatacaaaagttgcttaaatatcatatttaattcatttttaaattatttttaggtaattcttaattaattatgcattaataaactaccaggtttcccatgcggggaggcagagttccaaactccagctcccaactccctctttttttcatgggataagtccatttgacacccttaaactcttcgtttggtttaaaacgcaccctcaaactttgaaaccggatatgtaacaccgtctaactttcaataccgtttaggccccgtttgacacacctctagctcccaactccaacttacctggagccggaactgggccaaacgttccagatcctccattttttagagtggagttaacagagctactcctaaaaaatgaactagggggtggagcaatgctgctccagaactccactctatcccaaaagacccactaccatttaactttttagactatatacacaaaaataccactcaactacccctccacacctcctctcctcccgttctctctcctcctcccatcttcctctcgatctacgggcagcggtggcagacaacggcagaagtgtctacagcggtaggcagcgtcggcgggaagcagcgggcaacagcagtggcggcggcagcaggcgggacaacgacgggcggcacatgtggagacgacgcgcgaccggcggcatgcctggggatggcgaatggccggtgactgggtttcttttttttcagatctagagctgaaaactaggcaaacattttcaacaagtctccaactccaacaggagctagctcttactggcgctagcgatgaccttgagcttcctctcccacatcacacccctgagcaccgacgaggttgatctttctctccctcatgcctccctgttgatgaaaaatttgcgctcggtcgatggtgccggatttgtgttggcacgaactaagtcgacgaacagaacgtccagggagatctgcttagctccagtgtaggtccaaaatattgatgagatacggacatgctagtcagtttgtcttgcaatttacaagatatataaattgaagatcaaagaaaaaaaaatccagcctcgcaaaaaaaaattgaagatcaaagagccgatcggctgacaagtcgatggggggtaattccaaccgatgctgatattagccgatgtcgatagggttttgagcaatcggctatatgtccaatgtagataatgatataaatacaatcggttggtgataatgtaataagagtagaaaccaatcgactaataatgatatgatagaataaacactaatccgatggttaaaacatacatcggctggaggtttattgtcataaaatccaaatgattagataatcagtgaaacctttgttgcaatcggctaaatccaacttaattgtaatccttataagccgatgcaacgttcagataattcattggctgaatgtaacagccctaaaatttgacaactttttaaaaccgatttagtttgctttgattctctaaaaatataaccgtcgaattagacatttatttaaaatattattttccatacttatttttgatgtttcttttctcgtttaattttgtcgcaaagtgcatatcatccttcaaataattcctttgaatccaaatttaattctatcccgaatgtcgaattctatatattttaatcttccccatattttccttttccctatttccaccttaattttctttttccattttttttcctttctctttccctatttctctgtttttcttccgctctctgtttttccttttctttcttcctctactcggctaggccgagccagctcgtgctgcctcgcgccaaacccgtgccgccttgagcccagctcatgccggcccgcgcatgccacacgctcgcaagcgcgcacacgaggacgaacgacgaacgaatgcccggacgacacctccagcttcctgcctccataattccgtcgttcctcaactagaaggctcaagaccggaggcaaaagaagcgcaatttcaacctctttcacctcctcaaatccgcaccaacccccgctgactcaatcatcatcaccggaggaaaaatccccgaaaccctaattttgcgccattcacagagcttcaaaattcgtcgcatacgttgcaaatcttctgaaattgaaggtaaaaacggatttgacgtgccgagtactcccattcccttctgttttcccatccaatccgacgccggagtgccgccgtttccgcctcccggcgtcgccgctctgttcggccgcctccagccgcacggcgcgccgccgctcccggcctccccaggctgagccgccgctaccaccacgctccccttgctccactgatgctcaccatatccgccgccctcacctgagttcgccggaaccaccgtcgccatggccgccgccgtctccagctcctggccgccgtcgccagcctcgccaccggcgcttctctcgccgcagaccacaaaaacggaatcggctcgacttatagatcgcaaaaccggcgccccctttcccaaaaccggccatcttcaccgctggcgccagggagttgccgaccggctcccgtgcacagaacgagatgaataggaaatctgattttcctgttgaaaaataaataagaaaaaacatttttattttcctatcaagttgaccatccgtttgagctcgaaatcaaaatccgagacctattccaaactcctagaattattccgaatccaaccgtatcagtttcgttgcaatccgatcacccgttgtcgcgaccctaattttagccctagggtacgccgttcaccgaaattccaaaaatccctaaaattatttctttaaatccttttcacccattgttgcagtttgtgatactattttcttttggttatctttgcttttctgttatttattatggtgatgattgttgcgtaaatagaaagcactgacgttggtccggtagtcggagcaagtgaaatctccgcgccaggaggagacggtttgtacgactacatcgagcccgaaggttgcaagacatgcaccctcccttgaacaatttaatcccagtagttagagagttattttggtagcgtactcgtcctttggagtacgatagactgcacgaattcttttaaattaattatattactattattgcattatattttctgttgttgttataaacaccttaatgagccttagagtataacaaacttaggataaaatttgagaaacacctaaacaaatggttaattatttaacatgctattgatttaatatggatattattactgcatatgaaaacatgcttatggaactatttatggctatatgctgagaattgttggcaccgcatgtgagcgggtggtacacataatagagttcatgtgtttggttttatggacctgtttatggtcgtgttgaatatatggatatatttatggctatttcttatttaaaattgatataataatcaacccccttatgtcaataagaatgacatagtttcgccatccacacgatcgagttatcgaacctggccgtatattgctctaattgattaaacttctgcatgcctttcggtgtactggccattagctttcaagtgtgtgaagcaaagtgacatggttcatgtttatatgatttatatatgtgggctcgatgggccccgagagttcagaactgccctattggcccatgaagttctgggctgcccatcgagtaacgaacaatggtaagtggatgtggaggtaggttggcacacacctcggactggatcactccgagcaacatctcgagcatcctttaacttactaggcagaagggagagatatatggagcaatattacaccttgttacttttcagcctggccagctatgggtatcgtgtaggtaaagctgggcagacgctacagagtcgttgagtattcgaaaacgccgtgctcccgattagtggagatgtgtctatgggtgattccagattatgggcacaagttaaactaaatggctattaattaatatggttaacttatttattacttgatggtctattcaagttatttataagtaacatttatatttttatgctcattattactgtttaaattaaatgttcaatagtgatgtttatatcaaatgtttattaagataggctctatgaaataactgttaaggttagggtttaaaccttccagctcttaatattgcatgttttatattgcaattattgtatttgttatcataagcatgtcttgctgagtaccttttgtactcataaatgggttcagatcataaggaggaggatgcttgtgaagatcatgttgatccgttagagtgggacagctatggtttctaggtcattctacgctcaggcagttcctgtggtggagtctagcagtttatctgtttgtagaaataaggctttgtaggccatatatgtaatggtttgtatttgtgttctgttgtgaactaagtgacttaagtattgtataattgaagtttatgcttttatatcatttcatgcataactgaacatcctgggcagttacgtattcgtagggcaccatgactttatcaggtgtccccacactgaaaccccgataaaacccttattggcaataaaaagcacgctagagattatgattctaagcattactagaaaaagtaacaatttcggcatttatatattacttagattgatgactccatcttttcaattatacttatgcttgttcgtatcgcttattactaaaaaaaatatgggtaaaactttttgtgcatgtccttaacaattgaaaaacaaatgttgcaaaataaactatgataaaaaatacaaaatttggcttatatgcataagcaaaacgataaagatgttagggagagtggagaaggagagattgtattggaattgtcgagtgaaatgaaaaaaaaaatctactacaaacaaacttacgagtgtattccaatgaaattttacaattcaaaatctatatctatatctatgcctaattaaaaaataagtaagacttccgaaacgtttttgtccgtcgttgtttttatatgtgtggtacgcgatttttcatttggccaagcagactctactacacgagatcgccatccgtatcctgtgcaaattccaatatatcccaatagaaacacataaattgaactttcagttgaattgaataaagatcaaagaaccatacgcatagatgggaatgccaacaaaattattttcaagtattttcttgcattcgctagcatttgatcctaacaattcaaatagaaaataggaaaaaaatcaggcaaccatttggaaactcaaagttgacgacaacaaagatgaggacgacggctcgtcctcccatctgcctccgcctcaacccaattcgcttttttttggcgagggggggggggggggggggcatgttgttctccccgatatcggtgctcatagaatcaactagccgcgcggaagcttcgctcgtggtgttgctcacgaagtcgaggggagaggaagaggaataatgtagggtcagggattcagcatggctatgtttatctaaatcacgacagaccatcaccgtttgatcgaatacggcgactctcagcgcacctacgccgacttgagccgtagcctaccacgtaggtctgtgcacttaacagtcgcggtgtgaaaaagatatatggcagggtcgtgcttctaattgtgggcttatttatgttttgcttattccccattgatttagatatttttttcaccaacaaaattagtgtaattagcacgatttgagccattaaaaattgctgaaatttgatatagtttttccttcttcatattaaattattcctacctaaatggagtcaacaaatagtataattatatatttgccacggtatagagttatttcttgaccatagttgtttgtaatttcatgtcattatttttatgactatattgaattatcatttatgtccagcagtatcccagctaatttccgtgaaactcaggaaccatgttggttttacctttttttttttaagaataattagagtacgtgtttgattttagaaatgatatcacatgttttccatgcgagagttgagagagagagagagagttatcagaatttgagtatatccatatgcaatagtgtttttttatccgttctatgagtatatcaatcatgcgctaatatctttctttctttgtgcgtgttaattttatcttcatcttcattaaaaaaacaccaacttactagttcatgtggggtattagaggtagggcccataactagagaaaattaatgcagtatataaaacatccataggaatctcaccaaagatatagcttgcaagtaagagcatcttcaacggagttgccaaaccactctccaagacaaaatttagcaaatgtggaagaaaaatgccctccaacagcctctccaaccggctctccaagctatccaactgggccaaatacacctctccatggccaaatctggccagcctcgtcgacgtcgccaccaccaccttcctcttctacgccgacctttgtcacgacgctgcactggcaccggcacggtcctgcgttgcatcccctgcacggcaccggcacgttcctcgctggcactgcttcctccgtgacggcccccatcattttccctccctcgcctccggctctcctgataccgctgtcaccctagctcctcccgaagggggaggaccgccggcgcccccgtcgtcgaggtcaccgtcgccatccgccgctgcctaggcatctttcccatccccctctctatcctgcatctctgccattgcggcctccccatccgccgccatcgctgccgccagtgacaaccaccaccatccactgccacccctgagaccaccttttaccttttctactttttatttatcatccggcggaacttggcacctgacgcggggatgcatcggttttcgatctctggcgaagggataagtccaatgttccgccggcccagacaattgtattggatacattggcgtcgttcaaggctgcatcagtgtattcaacctcttgggttgctccggtttggttaatatatttgcctgcctatttatcatatgtcttagtaatctagttttagtatctcaatttagctctatcggctgtctctagctttatggtttctgccggtatcggctaaattgttttattagattagattagctaaggcatctatcaccctaaaaattagtcaagagcttgattgtctagatattatgtttcttttcatacttagtgctgcatcagttaagtttgatctactaagtcgtgcttagaaccataatctctagcctgatagttgattgccaataaggttttcatcggggtttcagccgatgagttatctaaacgttgcatcggcttacaaggattacatattagttggatttagccaatgataacaaaggtttcactgtttaatctaatcttgtggattttatgacatcggacctccagccgacgtatgatttaacctttcggatcagtgcatattctatcatctcattattagccgattggtttctactggattacatttaggggtgggcatttggtctaaccgaaaatttcggtctcggtcttcggtctttcggtcttttcggtctttgaaaagtgaagaccgaatttcagcgcaaaaatgttaggaccgacaaattcggtctcggtcttttcggtctcggtctcggtcctgaccgaaattcaacaacattttcatatatgcaaagaaataatggaaattttcaacacaaaaatcacaaaaaaatttcataagcacttatgagtaaagactcttgttaggttgcatgcctagaagaagtagagatgtgaaaattagagtttaatcctattaaacatagtggattgtaggttgcatttagacgttttttgataattcggtcttttcggtctattcggttaaccgaggagactaaccgaattgaccgaataaaattcggtctttcactacctaggaccgaattgatgaccgaatttctcggtctcggtcttttcggtctctgtctcggtcttttcggttcggtctttttctgcccacccctatttacattgttatttattattatcagccaattgtctttatttactcaagtatcaagatctacattggatatatagccgatagctcaaaaccctatcgctatcggatggtatctgctatttgtatatcttgtcagttgcagggtcaaactgactggcacgtccgcatcccaccaagatttggacctgcaagctaagaagatctcctaggccgttgctgttgtcgacctagtccgcgccaacacaattccggcaccatcggccgagcgcggatttctcatcaacacgggtgtagggatcatcgcagttgaagcacaaccccttccgccgtcgctcatccatctccggcggcgtcagacggcaaaccgtgcggctggccacctgagcggacgattggcccactgaagatgtcgtatctgagaggcaaagaggtaggcgcagccgatgatgatgccagcacccaagcgtccctgcacggcatggcgcagcacgcatggcgaactcacggcgttcataggaacgcgctaaactcatggcgacctccaaggtggttgggtattgaagctgcatgtcgatgcttaacggttcttggagaccggtggtgaagagatccatttgctagtcctcaatgaggggaccggcgcgagcgagcaggtcgaggaagcggtcgatgtagacagccaccatagtcatacgccggcaggcggcgagctcgcccagggcgcctagcgcaggggcgatccgaaatgcaaattaagaaggtcggagaagcgacgccaggttggggtacccaggtcacgttcgacgcacatgtaccattggcgtgccgcgtcgagcagatggtaagacgcgagccaaaccttctcctcttccggcgtacggaaatggagcgggtcgccctaatcgtcgaacttggggaaatcaatcttgtggtagcgcggtggccgatcaccgtggcgaccgtcgctgtcgcggtccccatcagcatcacggtcgccagggtgctgatgacgttcgcggccagcccgttccaggcgctggatcgcaatgtgatgcgcttcctgctggttgtccaggtcagaaagtttcccccggatggagtcaaggtgatcaaggaccttagcgagaccctttttccagttttcgccgacgttggtgacggttgtcatggcgcggcggcggtgttggtgagcaggatcgtggaagtctgataccaagatgttaggaactgggccgaaacggcgtagggcgtagccgtgctcgacaggacggcgaggctgcacacctcgtcgccttggatccgtggtggaaacaacgagaatttagggataacttgttgcttacttcattactctgatcgaatggtatatataggtggtgttcttttcttctaaagacgaagattaagattaagttttttacacaaaatgaggtggtattaacgtatgattgattgtgttttaattattacaaacttgaaaattagattaatatgattttttagaacaactttcatatataaagttttcgcatgaaacacaccgtttagcagtttgaaaagcgtgccatgaaaaccttaatcttcatcttattggaaaaaagaagggaccatagccttacaatggaactaatctgctaattaaaagggaataacaaactcctaaacaaaacacctaacttctgacgaactaatccaatccttgcgatatcactgtgcctgcgtcggcttctcgttccttcccttccgcttaaacgttaatacccacataacatgccttgtgttgaaagcctccaggttcgtaacactatgacgcacatagaaccatatacagggtgtgtttagttcacgccaaaattaaaagtttagttgaaattaaaacgatatgatggaaaagttagaagtttatgtatgtaggaaagttttgatgtgatgaaaaatttggaagtttggagaaaaagtttggaactaaacaaggccacaaaatggagcgtgatgcacaatcaatcagaattaatgaataatagtgaaacctggaataaagaaaaatagaagtataaagagatacctgctcaaaattagatatgccagagaacttgatggacacggatgcaccacatcaggtagggttttgcatcagtgcaacagttgatttctttggtgttaagactccagagaatacagctccagtattatttggtcgttcaacaccttgttggaagatcaacatggagggttttgctcattgtcaaatcctccttgcgtatatgcgactgaacagtacacaacagaagtccagaaactggaaaatagatattaataaatatatattggctgtgtttagttcatggcaaaattgaaagtttggttgaaattggaaagatgtaacggaaaagttgaaagtttatgtgagtagaaaagtttgatgtgatgaaaaaagttggaagtttaaagaaaaatttgaatctaaacacggtgattgttaggtttgatagtacttttgtggtgcaaactagagtaaccttgcatttcaatcgcttaaaaaaagcttctcatcccgtgaaaattgtattctgagagaacaaaatcattgtaaaatgaaaactatgatcacatgcagtagtatcacaaaagttgcatgccaacaactacaaatgctacaaaagaatggaaatttacacatttctaatgtctcaataatacctacaactactcagccaggccttcaacgaagatcgatggcaacgctggatcgataatcaggtccttgccttctgtttatctaggtataacattaagaatccttccaggcacataaattctcttcctgatgcccttcccagtcaaatatttggagagtttctcgtcggaggctgctatttggaatgcatcatcctcagagcactctttgtcgacaagaattgtacccctggtcttcccattgatttgcactggaagcacgagctttgattctttcaagtactcactttttccctgacagaaaagaaaaaattcgctaaaatttatggtaatccatggaaaagtttatatcatacccataggtagaacttttaatatcagacatgtagaacaccatggaaggtttgcacactttctggctgatgtgcagaagcatggaatgtttagggttacctctggaaattgctcgtgggccaatgatcttgagttcccaaggcgaaaccaaagctcctcagccatgtgtggtgcaaaaggcgaaagcaacagaataaaggattcaataactgactttggttgggtgtcccactgtaagaagaaagcacaatgagagaagtaaaaaaacacgtctaccagagtacaggttttgttgccaatgccatgttaaactgatctcatcttccattcttttgcacttcaatttgaatactcaagacatcctattgggttttactgacatcaggtttataaattgcaagaggttctgtgccaatttaccaagtgctaagcagaaaatgaagaagtacaggcacaaaagttcttaagcacattttaagccttgctgcacgaaagcacatatataagcttgcttggatttgaataactgcagtacaaacaccagctccatattcctgccttaggctgtattcttttcccctctttcccaactcatttccctcgttttccgcgcgcacgcttttgaaaatgctaaatagtgtattttttgcaaaagttttctatatgaaagttgctttaaaaatcatattaatccatttttcaagtttttttaggttagtacttaattaatctcaccataatcgtgtgcttcgttttccgtgtcagttgggaaccttgcctcctgaatacaacctaatcattgactagcgatgatataacaatggagacatacggtaaaataatccgagcaaaatattttggaaattccaggcaaataacttgaattttaacaaagcagacacattttttaaacttatgttcatatgggaacagtgtatacaaaacattatgctggttatttaatagcaaagtcatctggcatggaacttaaatagataatgtgtaggcaactacaaaatggatatgcaataaaattatataaatgacggcaacaacttcatttaaaagtatgaaactatgcatgtaaacattacttaaggttaccttgtatgcagcattcacaaattccatcattgcagaaattgcagtgttaaatcttgtttcttgaatttcctctgtgacctataaaacataacaatacattatagtcatcaatcaccaatcacatcagcacaactacaggaaaaaaattatcagtgcataatcatgtttagcagtaaggagaccctgagaattgtgtgatgatacaatcttgaaatagtcagtacataggcaaagcttttcacagggtaactgataggggaacagttgcaaagtaccattacaactaatccatctcaatattggaagcataaaaggtacaaaaataattgaaatggtggcacaggctgtaaaattaattaatagaatttatattccccaaagggcatgtcatgtataggaattatgtgccgggaacttggtaaaactgtacaaatttccaaaccaaactgctagtaaacctaaaattttgaatggctttcatttcagagtgaattagtgaaaagatgttatgtgatcatgctgtcaactgtgacgtactcttgcaatgcatttgtgaagaactcggagctgatccaaggttggttcctcatcagtaaccgtagttccaactccatatgatccatctggtaatggtgtaccaactacgagtctccatgtccttcctagaaatctatgcacaccttcaattccaccagtgctccatgtttttgaatctctgtgtacatcagatattctgtcagctttctaaaatggctgtaacttcatctgtaatatggatgcatacctcagtggtcccatgaacatttcatataagcggagagaatcagcaccatattctgaaaccacgtcatctgggttgatgacatttcctcgacttttactcattttataagcacgagcgtttagacgtatgtttgcatcatccttcagtacataatgatctccaacttttgtgacctttaaaaacatagaagaaagaaaaaaaatcaaactaaaaaacttttatcatgccaattgaataaagttataaatgtaccagagcccaccttatctgcaggtactttttcttggtagcaatcaatcaaacttgagttggaatctgcagaaacccatctccctttattgtctctatatgcagtatattcaacctgttatgatattacctgttaggaacacatgcacaagatagtaacgaacatgggcaacttttggaggtaattagtttcacctacttctcctagaatcaatccttgatttatcaggcacttgaagggctctttagtggaaactacgccaatatcataaagaacctaacatagaaatcagttagtttgaagataaggaatgccaaaaggaaccagtagatttgcatgctacagagtacagaaataaaaacaaattaatggcataagctgggaggaaaaacaaatgcaaataagtttactcaaaagaaaaaaaaacaatgcaaacgagaaagtaaccgcctgtacccggatttcttaagaataagtcagtcccctcgggaaaaaaatcatattaaagcagcaaaatctaatacaattgaacaaacagacacgatcaacaagataaactaaatggtttgtatatatttgcacgtcaaaaacttgctagtagcatccgatagaattatcaaagagcagatatttgtccatggaaaaagagaagtcagaaccttatgccaaaatcttgcataaagcaaatgcaagacagaatgttcagcaccaccaacatagatgtcaactgggccccaataactgcatgatgccaaaaaaagggaaaagaataagtaacagaatacatgatatcccttactgaggtcatatgaaagaaggagcacctctcttttgccttgtcaaccaacatactggcattttgaggatccataaatctcaaataatacctgaaaacattgaaatgttagggtttagaagccacttgtaaatttaagagcatatttcaacatggcaataaagattttcgagtgcgatagcgttagcaattgatatatctataactaatataaatattcgtatttttccggtcgtcacatctaattttcgtccgtttttcgtccatacacaatccgattcggttagcaatagccatggaaaaaaaattgcaaaaaaaaaaaaaaaaaaaatcggcggccgccgacgcctccaccgccgccggagggagaagagaggcggcggagggagcgccgctgccagatccgcccgcggtggccgccaccgccgacggatccaccctcggacgaagccaacgccgtcggcgccgccgttgagagggcgccgtcgaggccgacggggagagggagagggggagggagggacggccatctccgccgtctccgccgcaccccgccatcgccgtgccgcccacaccccgcaccccgcaccccgccgtcgccgtcgcccgcgccataccccgcaccccgccgtggggcttttaactatttgccactcttacgaatggtccttaacgatttgccactaggcccacatgtcatagacacatgagggcccacgtgtcattgacagagcgtggcaaatcgttaattgccatgtcacaagagtggcaaatagttaaatttcccccccgccgtcgcccgcgccatgccgacgagagggagagggagcggtccaccatcgccgccgcaccccgccgtcgcccgcgccgtgccggtgggacggaagggagagggggagagggagcggcaccgccggaggggaggggagaggaagcggcgccggtggggagaggagaggaagcggcgccggtggggagaggagggggagaggcggcgtcaggggcgagggaggcggccggctcggctgggggggagggggccgcctgaggggaggggagggggagagccggtgttgggggcggtggaagcggccggctcggctaggtgaagggggagggggagggttagggttagggtttcatccatttcaaaattatctgagccgtccatcaaaatgaacagctgagatcgatcaagggtttgggccgcaccacttgggccgcacgcgggccaacagtctagcaagcgagaggaagagtatagggatataaattagactttggtcacttgtaggctgaagaagaaagtgggccgaaaaaggcccatagagataaaagaatttttatttagatttttatttaaataaatacttaaatgatgtttgtattatcaaaattagcaattaagctacgtaaattccaagaaaatttcaatgagtgtaattaatgatatagaaaatttaataaaaattaaatccaaccataacattttatttctcacacttactttacttataaattaatttaattatatacctacctacttaaaaaatacccaaatattacagaaaatttatatttcatttaattagaatttaatatgttctaattcaattttatctttttttctttcacgatgcgagctaagcaggaatatttttatccatcttgattatcattagcgcaataaataatttacctatcttggaacattattatatacatgttaacggtgtactttatagaatttaacagttcctttacccgtagtgaagcacgggcattttgctagttaaaacaaacattgatagacgcagtctatttggagtcaattatgtaaattgttataaaattattgaaattgtgtcatgaataagttaccagcatgatccagcccattgtggcatggtgcttgtttcccttctagcaggcttcccagacaaaggttctacggttttaacctaaaaaggcagcaaaaccttttaatagatttgctatgtataagcaaaagtaagggggactaaaacctcaaaacacatctccatgccaactttgccgaacatataaatataaatatactaacaggtagtagtttaaattagatctcatcattcaattccgatatgattgatagaaacatactgactaggagtgttctcagtcattacaaaagaagcaacaaattgttagtaccaaactgctaacaacacatacccaatctgttgccttggtcagaggaggctctccagtaccagttggagtgaaatcatccaattcaggaagagttaaaggcaactggttttcttgaaggggcagcatttcattggtatcatcacggtaaatcacagggaaaggttcaccccaataacgctgtctagcaaagagccaatctcgaagcttgtagttcacctgatagttgggtttgcttaattattttatagtgaaagaagtagcatgaagaaggctgttacatgatgaagtgggataaagaatgcacctttttctttccaaagccattagcctctacccattcagtaactttcaaagcagcatccttggaaagcataccatcaatatttaatccagatgaagaactggatgagtttatcatgataccatcatctgcatatgcctcctcagagtcacaattgccattgagtggacttacaaccttaatgattggaagtttatatttcaaggcaaattcatggtcacgtgagtcatgtgcaggcacagccatgatagccccagtgccatagctgcaaggtagcatttaaaatttagagcatgcaaaactaacaagtataaaagtaggtttttcatttcctcagataattgttaaatttactgcgagtgtgggataacaccccgcaattgggtaccgagctcgaattcgcc

SEQ ID NO: 76697 - DNA, 9522 bp, Oryza sativa
agaccccttcacatgcatgtgaataaaagcaaatctaacttccaaatgaagaaatggtttaaaaaatatatactaatcataacaaggaaaatcaaaataatcttcattgagaacctaaagcagagaatgtatgtgacagctccacattcagactgttctgtttaacattacagtaagtagcataaagtgtgtatttattttaagatgttgaattaccatgccctctggcaacctacagtgtagagttaatagcatcatttttgtttcgaagatgaagatgatgatgcacaatgtaacttctgggtacacaggaggcaaagatgttttgacaaaccttcctaaaacataatctgccacccatattggaactatctccccagttgctgggttcttagcataagaaccactaaaaactccagttttttccttctgaagatcagttctttccagttcactctttcttgctgtgagttctatgtattcctctacctgcttttccagttagtctatattatgcttctaaacatgataatggtaatggtgagaaaagggaccaaaaaaacatacatgtacacgttgttcctcagaaattagagatgacaatagagaatgctcgggtgccagaacaacatatctgcaacagaaaaggtgtaatttaacattgaccatctaagagaagactaataattttgtgcaaattaaagaaaggatccagaatacacacgttgcaccaaaaattgtgtcaggtcttgttgtgtaaactaacaaattagcacctagatcgtgcccttccttgtccacagctgagaattcaagctcagcgccttctgatctccctatccagtttctttgcatttctttgatgctctcaggccaatcaagttcatccaaatcttcaagaagtcgatcagcataagatgtaatcctcagcatccactggcgcattggctatacaacaaaatataaaaatcgatcacagtggtatactttattttccatacaggttcttagcaacaggtactttgacacgaaagagtatagatggaagaaaaggctaaactgacaatatagtgcagattctaaaacatacctttcgtataacaggatgaccaccacgttcactgacaccatctattacttcttcattcgccagaacagttccaagagcagggcaccaattaaccggtacctcagcctgattgtaagatagcaatgccagcctaaaaatcattgaaaaccacaaatacaacactaagaacataacagaatcctaaaatgaatggtacagagcagatgatcagttcaaataaaggagatgcgaaacaggaaatgtatcaaacaataaacatgacatgtttgcaattcaaaaaattggacaagcaaggatactagtagcattaacctgataggccagtcctcttttcagtagttgaaggaaaatccattgtgtccatttgtagtaagtcggttccgttgtggaaatttcacgatcccagtcatatgaaaaacctaacgatttgagctgcaacaccagaaagcatatgctccaaataaacgattggtaatcaatgaaggagcaaattagtggcaaactaagctactgatgcaaatcaagtatttcttcagcactgcattaggctctcaggctatgaactatgggtattcctgatgagaattaatcagtatggtcaatcaaagcaagcatcagaatgtatgatttacctaattattttacatcatataacctgcattttatggttgattagtattactccacctttgcaatatggatgaactgataaagcattaggaactcagtagcagaagctaaatgcagcaaacatgctctatttttttaacgcaacctagtgaaaaactaccaccaaaatacagtagtaacatatgtaattgctaaccaaaaatgaaagcatgatggcttcagtttacttgctaccgtgacatcaattaaaaaggtttcaaaatataaatatgacacctgtgagcggaatcgattgatgttccgttcagtggtaatcttagggtgggttcccgtctgtgcaaaatgtaaatcggtcagatcatagcaacgcatcagcacgctataaagaagaataggctaaatgaccaagtcccacaagaaagagtaaaaacctcgatagcatactgctccgcaggaagaccaaatgcatcccatcccatcggatgcaacacattgaagccttgcatgcgcttgaacctcgacaggatgtcagttgccgtgtacccaaggggatgcccaacatgcagcccagctccactgcacaaaaaaaaaaattgcacaatcatgtacaacgaacagcatgtatctaatccaatcatacaattttcgatgagtttatgcatctaattgatccaagtaagaagtaatccaactatccaagtttcgcactacatggtctcagatcaagcttaacccgattacaccattgcagagccaatgtagcagcacagaaagcatagtaagctgaagcaagtgaagcagcaaacctggggtaggggaacatgtcgaggatgtagcacttgggcttggaggtgtcgaggccgtggccgatgtccggggtgcggaacgtgcggtgctcctcccagtgcctctgccacctcggctcgatctcgtcgtacgggtacgccctcctcgcctgcgcctgcgccttcccggcgtcggcgttcgcgcagcagcggcaccacccaccacctcgccgcggattcggcggcgggaacccgctttgcaggcggcggcggtggcgggcagcaacaacggccgggggccgcggctgcagccggagctggagcggcgtctgcatcatcgctaccgccatcggggttgggagcggaggagggagaggagtcgtgatggggaggttggggcgtagccaaatataagcgggaggtggaagaagaagacgagtttaggataaggtttcggaatttcgttcccttttccaaataattaggatgaaaattataaattagaccgattttacttacaagtgtttttctcttcttctttttcttctgctaaattcacacaaaaaaaaatctgtcatcgaagactgatcaattcagaacaacaatctgaagattaaaccagcaaatctaatctagtacaatttcctggatataattcaggaaaaagacacatatagtccatggtggtacaggaagttacatatagtgatgtgacacgaaatttagcatagaactaacagtgctttccaaaatattacatgtaattactctttgtctaaacatagattttttaaaaaaatcatttggtatcagccttctgatttcactgaatgtttgcctcttcactcctctgacaaattccaggtgccaaatgcatgggtaaaaagaatcatagactgacactgtaggagactttggtgaggcctttcttgactcttatgtttgtgacctgaaacattgcaaattagatcaatctccaaatccaaggtttatataagggcaaggtacaaatcacaaatattcagtcatctgccatagaaaggcagcaccaaagtaatggtttgcagaaaacaaattaaggacagatgaatggacacgaagatcatcgattcatgcatcaactagcaatatgcaaaaaaaaaaaaaaaaaaaaggtagtactaattaaatacatctgaatgcacagatgccactaaactgttccagtctttgtgctggatggtttcaaactgataatcatgattgattaccatttttcactgctttatgatttgtgattaagccttcaggaattttgtaaaactctgagaaaatccaaccagtgaaaaatagcaccgaaatatacaccatcaataagcattacctttatgttgttgatgatagagatatcggcaacatgtgtaccaccacaagggccaccaggataatcaccaaatttcacaatgcgaggggtgctatcctgaaacaaaaacattaggccacaaacaattataataattcatgaaataaattagaaacaaaaataaaggtgacatgattcataacactactcagaatttatgatataaagaaaaagaattggaacttaatagtatcacactatcatttcgttatttcagacagtttctatgatagttcatgatgggttcacatataggacgaactcaacactccacatttaaggaaatgtttctgcaactgttgcgaggaaagtaaactggaataactatggagaatccattagaatatacaaaaactaaccatgattttgagcgaatttataattagtacaaccaaaagtccaaaacaaatgcttctgaaaaaaggaacataggactaacttttgaaatgtagctaggcagagcacctccacacaattgagctgcctcctcataaggtaaaatataagctaatacctgcatcaagtgtaaaaaattgaagtcacaagataaacattataaacttcaacaagaacagcttcgtgtgtcttacttttgctcctttagtaattaactcatttgcttctttttccaactcgtttttcttatcctgcaactgatctggtggaatgactcctttatactcaacgaaaggtctgcagtgaacaaagaacacttaattgtgcacacaataatctaactacaaccaaattagtttgagaacacatgataagttggacgcaaaggccaagagtaatcaattgttgttatggagcaacagaataaagcatccaaaacaagcaaccatacccatcagggaaatgatgtcctttcccagggtcgaaatgtgataagccaatattgctcatgcagatgtctatcaaatgccctgcagaatgaagcctgcaagcaaacatcacaggttcagcacgacgattcaacaagaagctaataggtctgcaaatgcacatagcaattattttttttgaaaggaaatgcacatagcaaataaaacatgatgaaacgatgatgattaacgcaaacttcttccatgaggtattgctgatacaacatcatcccaacatagcatcctaatggaaattcatatccaagtcactaaaatcatgcaatagttatcatgccagcaattaattaacagcgacagtatgaataaatgagaagatgtagtttggttgatatggagttatagacttcaagcttgacgatttcaagcaaacatcacaggttcagcacgacgattcaacaagaagctaataggtctgcaaatgcacatagcaattattttttttgaaaggaaatgcacatagcaaataaaacatgatgaaacgatgatgattaacgcaaacttcttccaagaggtattgctcatacaacatcatcccaacatagcatcctaatggaaattcatatccaagtcactaaaatcatgtgatagttatcatgccagcaattaattaaccgcgacagtatgaataaataagaagatgtagtttggttgatatggagttatagacttcaagcttgacgatttcagtaaaatttcttggcgtctcaatacaagtttacaccgtgcacacctggaatttaagttgcggcgttccgcatcgacttccaagctaacgctctgcccttcactgaacccggaattgcatccatctccagcatcctcaaatctcccatagtggaaaaccttgatttaccagcacaaatactcaattagcctaaaaaaaataaatccaacatcctcagcaagcttgtatccttttcgagttctcggttctcaccactccatccttcatccgcacatcatcgacgatgaacctggtgccgccgccagcggagatgacgccggtgtcggccggctggccgccgccctgcgggtagaagacggtggagtccaccaacaccgctcgccggcccccctcctcctgccgacgagacaccaggggcttagtctagtcaggctctagggttttgcgcgcgctctacagtacggccgcttgttcgtgcacatggatggggcaagatcctgaggagaggagaggggaacctggaggagggagacgacggtggcggtggagctgagggcccacatgtcatcgaagtacgcgagcttggtggggcccatggccctcgccggagctgcggcctccgttcccatctccgcgggggtggagatcaccgccggtgggcagaatggagcgccgagtcgttcgaagttcgaactcccaaatttttggaacaaccttgggtgagatgaaatgaaatgagatgcatatttatagcctcatatgctacaagtcaattcaaatacgcggatcgaaaagaaaaggtagtattcggttaaaaaaattagaatgtcccagcatatagttgaatttgaccaaaattatagtgatctttgcaaaggttttcagaagaagacaaggaagtagaagtaagccggcagctgtggaaaccgtatataattccatacgaagtttccaggagctaactgcttccaataaccttcgatcatctgctcaaaaagttggatgctttttaccccttaaatttaacaaatgtaacaaaagcactactatacttgttgttttcagacatgttatctgcgtgttactcatatctagtactaatcagaaaatctatcgtatggtattccgtggagacggaatagtactactgccttatctcctgttcccctcttccagtctcttcccctccactcactctctctctctctcttttcccctccactcgatccctctctctgtaactaccacccatgagcacggaggcggcgacgacggtgacgacgacggcagcaacgacgacgacagcgacggcggcaacgacggcgacgatggcggcggcaacgacggcgacgacaacgacggcggcgccgtcaccaccagcccccgcgaacgacctagacgacagccagcggagctcccgaccaccacgggcgacggccgccatcgagaagcctccccatcaagctcctcaaggcgctcctcctcttcgtcgttcttgtcggtagcttccttgccgctgccgcctcctcctccttggcggcgctggcgcctcctacggtcggagagcggtggacgcggccaccgggggcgagcgcttggcacaacatgagcgacgaggagctgctctaggcggtgtcgatggagccacgggttcggcggtttggagcgaggcacgacgacgagcgacggaatggcacaaggtaggcaccagatctatcgcctcctcttcctcttcctccgccgccgccccgctgctcgacttccctaacccgcgactcctcctcctcctcctctctcttgggatatcacgctgatacccaggtaccaaggcctgatacctaggtatcagctcgatacccagggtaccaggtatcagtcaatacccaggtaccaaagcctgatacctaggtaccaagccctgataactaggtatcagctcgatacccagggtaccaggtatcagtcgatacctaggggtatcagtcgatacctaggtaccaagacctgatacctaggtaccaaggcctgatacctaggtatcagctcgatacccagggtaccgggtttcagtcgataccagggtgtaccaggtatcggtcgataccagtgtaccaggtaccacctcggtaccttatccaagataccagggaggattggataaggtggaatcgcaggatagcgtgggcctccccacgaaattgatgatgcgtattaaatctctcgggattttagttatcccgtgactgctaggagcaacggaataccgtggggtagcagccctcactactatttcactactacagtattatgcaacaatcagcactgccatcacatgatcttcgatggttccagagaaaggcattagacttccatgcttccaggaaaatctgtgaaagccgccgggttcagtaatcacaaggggatgatggtcaattatctcataatatactccatatgctttgcatctatgctcaatcgtttggcattctataccaacacaatttacaggtacaggcagacatcatcgaactggtatcattttcaatacttcgtttttttacacatgtagaagatgaaaaattatctatacataaactgaactgaacatcctggaatgatgactgaactgaatcttcagagttcatggaacacgcttacatctgcaccagtaagccactccccctcctctgccttgtgccacagcgatttcctcatcaacatagaaccacacaaagaaagggtcctttgtgctcggctccctaccatcattgccacctccgaggctgatttcgagggggccgaaagggccgacctttatgcgaacccgctcgaagatgaatgcgagtatcttcttcttccatgacagcctcccctcaaaggttaaggacccaacaggccccaaatacacgccattctcaatcctctttccctgtacaggttcaggagatgtggatgaataacacacagtatatagcagataacagtagcaaacatttgcaaatttcaagaacaatgaagccttttgcagcaaattcaggttaagtttgtcggttccctgtctttatcagtatcaaatagttaccacggtagtatcacagaagatggtttacaaagggggtttcttgcagtgttcaggaaacagtaagcagtaaaaacattaaactacaacatctgtgctgtcaggttcgtgcatggtgttgggccaaatttccctccacatggagcctttgctctcagcccattgcagcccaaaagtccaacaaatgtgagccattgattcatgtgttgattaatggtggagattgcctcatcctttgtgatgggaagaaaaaccgtagcctccattaagagaggttagagcagcagccattgaggaagtgaaagaaccaacaaaacacaagagagggagaggagagtggagaataagagtggcagtttgttcagcttggggctcttacccgatcttcatcaagtcagcgattggaggctcaaacgtggttggattagcaccaaacttggtgagtttgttcctcactttaagcactttaatttgattagtttgtgtgaggattggttgagtagagcaccggatttgagtggtggtttgtcagctcgagttactgcagttacagcttgcacaacagttggtagaatgttagtttgagggatcaaacggtgtccgattgggctgttttttttttggatatcttggaagggactcatagaccatcatttttgccaagtttagtgcaatttgcatctgtggtttgggagatctcatctgagaaccgaaaaggacataatccgctatttctttgcttatttgttgatatatctcttgttagctttgatggttgatgttgatgatgccaaatgtgtaacttgatgttatagctgctgttgtgatgtgcctctagatgttctagagaagactccatatgtacccattgttgattatggtggaagcttggagtggactgttggtctcgtggtttttactcctcacaccgagtatgtttttccac

SEQ ID NO: 76698 - DNA, 11244 bp, Oryza sativa
agcttactgcagcatcaaagcgctggactgcggtcactgggaagtactgtcctttctccagccgaccctgcaaagacattttcagttctttcagtttcaccaccaactaagcaaccaagcacgattttttccattttctttcagaaacaccaaaatggctgctcctctcgcgagcaatgaggcgcatgttggtgaccttagcagtgaagatgagcatccatgtcctgcccggggactgtgtcccaccgagggtctcgaagaaggtggatgtgtcgagctttgccttcttgatcttggccaatgccgcgagcaactccggcgacggcaccttcctcgtcttggccgcctccttcagcaccttcacgctctccgccacggcctacgctaaatccacatcaaaaaaaaccaaaccatttttactctttcaccaatcactaggaagagaaattgatgggaaagaaaaaaaaaggaaaaaaaaaagagatggggatctttgcaaagggatactcaccgacagatcaccaggggatttctcctgcggcgagggcgagggcgattgcgagggctccttctctaagtccggtgaggcggcggaggaagcggcgagcgagaggcggcggccgcgacggcggtggggggagccgcggatggcgaggtgctggggcggcggcttgcggagtggcgagaggacggggacgaaggtggaaggaggagggagcaaggaggcagacgacaacgccgccattggcgagagacggggagctcgcagtcgcaggtgtgtgtggctgcagtgctggggaaggaacgagaggccatggcgacgagcagacgtggacagggttagctcgcccagtggccaccacctgccacttggtcactctcattctgaaaccaggattagcatgttgaagacaagtcagtttagttatgcaaacaaattcatgaaatcattctagcaacttgatcggcactgggaaaaaaaccaggaatttatagaatttatatggtttctatgaaatttctactgtggttatatctaacacatggacaaattttactttgctccatagcaggttgaaaaattaaaatatcctcttcgttcaaaaaaaaaatcttaattgaagtgtagtggtagtttgtatgttagttcatttttcctcaacctgtataagataggatgtgcttattttaccctgacgataggatgttgctttcttgtttatataaggagttttttgatgataaaaaagatggcgtaaagtctataatctaataatctcataatttttcaaatgtatggaaataattgaacaacctgtgattgtgattatgtttaatttttattcatctacatattatgatgatatcttcactttttttaataagcaacatgattgctcatctttgtattaaaagaaataatttatgtgcaaaaccaaaaagaaatgggggagagggaataaaaaaaagaaagaaaagaaagactgcctatgatctaatctcacgatgactttaaaatgaccacgccatacagttattacagcgataaggtcgacatcggagaccaggatatatttgcatttgctttagagtttttaacgtatatgatgaattagtacctacgcaaattgtaataagtaccatccttcgttttacgttagcactctttcatccttactatcaaggtgaaggaaaccccaaacacaattatgatatgagctgatattgttattcatctcaacttttctttttgaatgcgcttataatttctttcctctagttatttatttattatagctagacaaaacaataaacacaatcagattacagcttccctgctgtttcgttttctaattctgggatgcaccttcttttctttctgaagaagaagaaaaaaaaagagaggagaaagaaaagaaaaaaaaaatttctccaaagaagaagagagcgtgtacaattcagtctcctcctacctccccggagcccgacgagatcccgccaccgccacctctcctcctcgccgcgcccggcgacctcctcctccacatgctcctccggtcggcgccgcgccgcctccaccacctccgcccgcaccacctctctaccgccgccgccctcgcggcggcgccgccgaccccgaccgagtggaccacggcgccggtcgcctccgtcggcgcggccaccgccgacgcgtccctcttccacgtctccctcgacctctcctcccgcgccgacctcctcgcctcccacgtcgccgccggccagttcctccccttccgcctccccgccgcgccctacccgatcttcctcgccatctcctcctcccctcccgcgccgggcctcgcgacctccttcgatttcctcgttaagcgactccccggcaccccctccgcgtgcctctgcgacctgcgccccggcgacctcgtccacgtcggcggcagcgtcgtcggccgcggattcgaggtcggcaggatcgctgacgcgcgcgatgtcctcgtcttcgccaccggatccgggatcaggtaacctacatgctcctctgcgacaagggcttcctcaaatcctcgtcaaaattcgctcacactagtgacctaaaccgattatagatgcccttgtgagatgtaatggctaattagaatctgtgcaagtcgatttcaatagatttatagatgatagaaatgatagtccccaccgtatgcatttgcatttcagatgatttagttgctgaatagctgcagaatgcatgtctgttttatgctgccacatgccaaaagctgtatctttgatggccttgatttcattttccgcatcggtagctttgcctaattggtttcataatctgcgctcttgcttacaaagcacaaatcaaccctgtttataagaaatcatgactaccctctctatcgtaccaattacacaggaaaaatatatgtatacaagacattcgaatgttattgcattgaagtgtgtaatcctgatcacattatttgttctacgtatgttattgcagtccaattcggtcactcatcgagtcaggttttggcgaaaatgagaacattgatgtaaagctcttttatggggttagaaatcttcagaggatggcatatcaggtaaatgtcaagtcttatgtgtgcaactcgtaagttcacttctgtatatatctcaagaccctactctgacaggagagattcactaattgggaatccagtggaatcaaaattatacctgttctctcaagacctgatgatcaatggaccggcgagcgaggctatgtccaggtactgttatcattttgcatctcggttatttttacctgtttgttcgttgttgtattcttatagctggttctgcatttagcagaatgctttttcaaggatgaagaaggttgtaaatccttcatccatgggggcaattttgtgtggacataaacagatgtctgaggtatgattacatttccttctgttttctttgatatgctgaagttgttgacttgatacaaccctcagaccgtgtcatacattaaatgtgttatgatttttttttgtccaagtgtttcaatgctttatgcaattttgattctgaattattctcttctattgaccatctatacataaaagcatagccttaaaggcttcaaccactaatactctccaacaatatgccttttcctgatatactggaacatggtttacatttcctcatatgaaactgtcatataaaatacagacaccagtgtggaattgctttgtagctaatgctcaatctgaggagatgaatgaattatctaccttactagtttgcgccagagagcaacaagttactgtaccgctaagatttgcatttaactgcagaataactatggccaatttatcttcatggcctgatagtttctgtggtaatccgtaatcgccaggggtgggcgtgtgttgagtgactttgttgtgtacattcattctgattttcatctatattgatatgttgcaggaaattactagagcacttgttgctgacggtgtgccaaaagatagaatcttaacaaacttctgactgcccctagcccactagaacacaattatcagccttctagatgttgtatccttattactcattacagtgattattctttacagcaagcgcgatggaaactcgcaacagagaaacagttttgtactacttacatataggggcttctttttccaattttcctgcacgatgcaacatgctgcgctgtaatctggattttgccagcctgatgtatcaatatcaacacttggtgggcattttcgcatttgaaccgaaaggccctagttcatacagttttgtacctcctgaaacaatacccccttggaaggtgttgatatactccaaattacaaaagctagctcaataaaaggggtagagatgagtggcctcatgtatttgccttataaaagaggtagagatgagtggcctcatgtatttgccttcagttataatttgtcttcagttataatttgtgtattatttccccgcaaaaaaaataataatttgtgtattagaaggctataacaggatcagttttgaattgatttgagatgcgtttgtttgtatgtatatacaactgttcttcccactatcaacaaaataaagagtaatgttcttttcgatcatacataaatttatatgcatgcaacaaaagcggacgtaaagcatgcatgaaaattttcatgcattgacatttactaatgtactagccgataacccagtacctgtagcagtcattcgagttgatttctacaattcagcatcacaacggtaaaacatagcacaactgtgccagtactaagcagaaagcatctttagttctcattttttgagcagtcaatagaacaattcgaaccaccgactgaagttcaaattagccaacacagatgaaacgaagaaacgacgagacataaaagtcacaatcaccgaaccgactttgtatcagtacaacgtcagaatccacaacgttggaataaagagtgaccaacataaaagataagacaactaaaattcttttcacgcgccaaaaaccaattcaactagtgccgctggagtttaatcaacgttgccaccttcaagggctttctggccatcttgccgcttcttgtcattaggttcagaagagctacggtgatcatgatggtgatggtggtggcggtggtggtgacgatggtgtccggtcttgtgaggccttttaccatttctcaccttttcatattcaccggcagctgcatcatcggatgactcctccagggagcgactcctacggtgcttatggttgttggaatctgatgttgcatcctcatcgcttgatctatgatgtttcttatgtcttgacctgcccctctcctcagactcagaccctgagtcatcaccagatgatcggtggtggtggtgcctgtgactcctggaactggaatggtccttcttggaagatctcctctcttcatcatcgctgctatagtctgaagcatcagaatcagaccttgatgaatgtcggcgatgctttctcctgtgtgagcgcttcttccttcgattttcttcttcagacccactatcatattcatcactatcagtatcatcgcttgagtctgagcttctcctctttgatctgcgcttgtgcctcttggcttcatcggaatcagagtgaccgtgtttcctgtgccttttgcggtccttcctcttcctgtgcttccgatcaccatcactgtcggaatcactttcagagtctgaggaagaatggcccctccttctgtgctttcttgacttaagcttcttttcctttgcttcagcatcagcttttgccttcgctgctgcttcgagcttttgctcccatttcagtggggcttctttcttctcaaggattctcttctttttctcttcaagcagctgtaggaacttcttggagtccatcccgacagatcagctacagacttaaaacctgtagggccgtgaaatgatgcaaggaggtgcatctcatagaagagacaaaatcactgttagtttttgaaatatctagaataatatagcatgataacagacagcaaaaatataagctgaacccaaaatagataaaataaacctaggcaaaactgacatccaaatacattggaaatcaggcatacatgaaatcgatccccccaaaatacaactatagaagaatagaatgtcttgtttaggcttcacgtaaaaagcaaagcaagcttatgcggttcaaatatttgagcaaacttccactaagcatctaaatcatgttgctagtagcagcagacttgcagcttctcagctttctgagttcatatagctatataaacaagagactttggtgtaatatttatccaaaatgatgagaaaagactacagacagtcaacacagatggtgttaatatgtatccaagaaaaaaaaaagaattggatatggcgccagtttaaagatggatgtaattttgaattccagagacatgtatagggtacaactccttacacgaacacggatggtagaaacagcttggtagcagagttgttgttaactaaagacgcgcataatgtgaattatatacactttcttaccttgtcgtccgtaagcttcaaatgtccagaaaagatccctcctttttccccttttactgagccgatagttcacctgaaacaacaagagaaaatgtgtgaattcgtagcggatatgacgtagctttcagcaagcaacttctcgagtcgccccctgatctcgatgggaatatatatgcacaaaaaagcatatcggggcatagccatagcccacaggtagtctgggcccaattcccatccctagcgggggggtgttcgcggcaacggtgaggcgacggaatttgaaaaaccgaagccccacgaagattccagcgacgagtcagatctgaattgcgagggaaccctagaacaaggacgaaccgcgcccaaaccctagacgcacagcacaaaaacctagccacccactcagaatctcccgcggctcgcgcgtctatacgtacagatccggagcctgagcaatccgcaccacgcgatctaagccctcaccacgaatctatctagtaagaaaaaaaattcaaaaaaaaagttggggaggagagaagtggatggatgcagcaagcggtgcagaggaggggggggggggagaggagaactcactggattggacgggagacgccgccgcgaggggaagagaagatctggagcagccgccgcgtcgaggaaggaggagaggggtaaggcggcgcgcggaggaggaagagagagagagagagaggcggagtggaccgagcctaccgactagataaagaaagagcagagcgcgtggcgtggggggggggatggcccacacggcagtgacagcgtgtggaaccttgctctttgcccaactcaagttgccgacgcctttcttttttttttcacttttcgttttctttcgaaaaaaaaaatttgaaactggggtggtagaatgttggtattcacaggaaccgttggatcgagaacgtgcgataaaaggagacaagcgaacgcatcctgcctcccaactccattccgagtttctgattaccagatggatttactgggcaaagccaatgggatgccaaaaatgacaacactcatcgaattttggcatgatgtagagggatggcatttcatgttgtacagttcagttcattgccatccatacttctatgcaaggtcaaacagattggcagtctcatacttctatgcaaggttaatgttttacttgagcaacattggagaacgttaatgctttacttgagcaacgtaggagaccgcggataggtaaggttgtatttccggtgcaaatcgagctccgaaatcccagtgcatcaaactaccaactgctagcagtgcgttcctgcttggggtacaccaccatgattcatgtttccgccaactcttcgtcaaagcttcatccgagtttggtgttaatcaagatcaacaagtcatattagtttgatgataatcaaaagaaatgcgatgtacttgtagcaacgaccaaacgaacaaagacacaaagacaagggcaatattccagtattactaacagcgccaaagtttggacaaacttaacgagtagcaatccagtgtgcaatggagtaactgcaacaacgaaataacatttgacataacttaggaaaggtgctattgccctgaagcaggtcctaactccaaaattttacgagcatttgatgcgcaaacagtcaaacattcaaccatgtttcacaggcttatctcagcaatggccctggacagcaaaaaatctcaccctagcagtccacatctgaaagcagacggcttcagttgcgcctgctgctccaggttgaggaagatgatgaacttgagtatcttgaaggtcgccatgtgcctggaggaccatcttggcgggctgggggagcagcatcgcgagcagggggtgcctcttggcggagcggacgcatatcaggacgtgggcgatcatcccgtgaaccccaacggtcttgctcaggtgccacagcaggtctctggccgccagcactactgccaccatcaccacctcgtttaaacttcgggacatacttaccagcagctggtgcagcagcggcagcagcagcagccggtgcagctaccggctgagctggctgtgcaaccggagcagcatcaggagtgcgtgcaggctcagcagctccagctcctcttcccatgagagcttccattctctgtttttccttcttctcttctagttccctctctctctgcagctgcttggctgcaattgcatccagcttagccttcctctcagtctcttccctctttctcctctcttcctctgcagagaaggtgaaatcattatcaacaatatgtataagctagaatttgatttcattgcatcaggcaaaaaaaaaaagatccgcaagataattatgcacaagcaaatcacactttgatgccaaataacattttaagttttaaagctatccattgtctaagggcttgttcactttgatgccattttcaatcttaccaaattttgttaaagttgcaagaaaagtggctacatttagtttgttgccaaattttggtaactatataagaaatcctgctaaaattttggcaagttgccgaaattttggctatgccaaaatttggtaaggttttttttggcatcaaagtgacaggccctaagtaacacaggtccatactgcagtaaagtcacagtaattcaacaagcaatgttcactaattctcaagaaattccaaaattagctggacgatatatggcagtgtaaattaatctaatctaataaggtaagataagaacaagtatttcaaagcacaaagtcatgaattcttgccttcacgttttctagcttcctcttcctcacggagcctttggaggcgctgctcttctaagttaagatagtacattaacttccgcactgtatccctttcacgcttccttgatgatatcaattgactagtcctttcatccctctctttcttaagacgactaaactcagcttcacgacgttggacaattctttcctggaaaatgttctgcaagcaaaaagggcaatttaaaatatgtgcgaaggagagaagacagctgtctattccctgacaggaacaaatcgcctggtgtattcaaatgtctagtgctcaaatcatgtgaacacacacatagccaaagaagacatgccaatattagattctcagcaagtatagcacatattatatgttaaattaatctgtatctaatcagacctttgcacagataatatactaagtatttcaactgttatgcttggaattgcaaaacatggtttcggaaaaacacaggattaattacagtgggacatttggtccttcaattaactaaaaagaagatgaaatagtgcaagaatatctggtctgaatacagatatgtatttgcttaccttatgctccaacattcgagaaagtctgttcttctcctgcaggtcacctgcatggtgttgcttgctgagctcaatctctctctacaagaagagattaatagtgatttttgtgagcttaagtaatcatatgctattgtaatgtgacaatcaaggaattgtgagaaacaaaccagctgctcttgctcatgaaggattttctctacttcaaggcgtttttgaaaagcttgctcaattagaggtgcctcttcctgcctttttgccctctccaagtaatccatttgcttaccagtcttctgtagttttttctccatctcttggcgctccttaaactgctcattcatagccaattccatcacagcctccttagtaacttcctgcaatgaaaacattcaaagtataaagggcctgtgtggagaaacaaatattaagctgtaattggcttgggatagtacaactttatagttccgacttcggagaagacaatcaattcttaatatgaaacaagagtaggacactacagaatataaagattcaaatatcatctgcgttctgcgttcttgtagtctataatggttagccacaaaacataaaaaacagcatattagcacaccctctactactccactagaatttctgagcagttaagacaaaaaagaatcaatattggactgaacaaacagacataactaataagcatattgatgaaacagaagtcttcacaacaaatataatgccttacacaaaaagaaatatataatgaaatatcgagcaaatataaattgagcaatacattaaacagaaaaaaaaacattatcaacaaataactagtcagcgtaataaataaaatataatgattggaaactaattattctcaccccctgaaggacaggtttttttcctcctctctttgctatctcctttatctgtttctgaagcagttcttctgcctctatcttttctttttcaaccaattgtcgacggatcctctcctgttccctcaattttacatcattgagaagccttatcctttcatcttctgcagatttcttgagaacactcaatctctttttttcttcttccttttcctggaaaagagagaatatgacataagcagaaattcacagagttggccactttgaacagtaccaaatagacaccttttccaatatttggcgctcaagatcttctttgcgtttttcaataattgatttcctcgcaagaagacgcttgtgctcattctccactactgcagcaagactcgttaagttttcac

SEQ ID NO: 76699 - DNA, 645 bp, Oryza sativa
tctggtttgcgtccaatcgggtgttgcgagtagcgacactttgaaacgggacgtgcatctcttcttcttcttctgtaggctgtagctagtaactcgtgatggcgatctaatcctttccccatttcgttcgcccagctgttgcttctgggatcaccatggcatgtcatgtatggtgctggttttcttctttgttttaaggagagaatttgcatagactgatcaagtctactgtgagggacccacgtttcacattttttataaacttgattaaatttaaaaatgtttggctaaggaaaaagtataaactacttataacatgaaacggggaaatattgtttatgctcttttgctgatttcttccttttggttgtcttgactgcagtggaacacgcatgaggaggtgaaggaggtccatttgaaacagaatgtccctgaaccatcttcttacctgcataagtcctcggtaaaaaagaccccctctaattcacaagtcagccataaatttgtctactttcctttaggttgtcctgaatgtagtagaacacgcaggaggaggtgaaggaagtccatgtgaaggagaatgtccctgcaccatcttcttacttgctcaagtcctcggtaaaaaaagatcccactaattctcaa

SEQ ID NO: 76700 - DNA, 764 bp, Oryza sativa
cgatcattctccaagcctaaggctgagttcgctatgggttgttcccaatagcacggaaaacggaacgatccattagcacgtgattaattaaatattagctatttttttcaaaaaaggattaatttgatttttttaagcaacctttgtatagaaactttttgcaaaaaaaacaccgtttagcagtttaaaaagcgtgcgcgcgggaaaacgagggagataagttgggaaaatggacgtccgaacacagaccgactagatactccattacacagcttcaccaaatcgcacatcgtagagacaagtgttgcatgagcagagcaagaaacatggcgagagataagcaatctgctttaatcgtcgcagcgttcgtactcctctgttcaggtaagcaccatggaatgatgcttggtttgatttgttttcaaaatttgcaatgtgctcaaatttgatcggttttttacttctttttttttttggttcctgtagggtgtttgtgcggagttgcagatggggcgaagggagggaggaagacgaaagggccggtgatcggcatcgacctcgggacgacctactcgtgcgtgggggtgtaccggaacggccacgtggacatcgtcgccaacgaccagggcaaccggatcacgccgtcgtgggtggcgttcaccgacgacgagcgcctcgtcggcgaggccgccaagaaccaggcggcgctcaacccggaccgcaccatcttcgacatcaagcgcctcatcggccgtaggtaaatg

SEQ ID NO: 76701 - DNA, 593 bp, Oryza sativa
aaagtcaacggcgtcatttgttaaaaaacgaagggagtactctaaattagtgtctaaatacaaagacttagttaaatcctgatccaaaccccaccgaaatgagaaaaaaggaaaagttagtttttacatgtttttttgcttgtttttctcttcttttttttgggttagttcgagagagccagcagctcgagagaacagaattaatgattggtgtggcgaagacaagcaaatatactgtcgataatgtgactttggacaagttgtgtagtactgtgtttggtgaatcctgttcaggcaaagctcatcaggtctggtttgtagttttcggagtaaggagcattagagctgaaccactaattcctctaaaaagaattagaccactagaattgtagtggatgttctaagcattaaaatttttcatttgaaaatggtagtgacaactttgatttcattactcaagttgtttgactttatccttttggcatttgtacaaccatcattatcaggcgtgcattcattttacccacagaattgacaattagtgatacaacagtttacataataacggctcaaacgcacgaccacgcctcatc

SEQ ID NO: 76702 - DNA, 663 bp, Oryza sativa
tggattataagctttggaggacgtttgggaaagtactagtatttggaattttgcatgaacgtttgttgttttctttacaaaattacaaatttgtgcattaacatgatggatgttctcagaatactactcttgactgccgttgacatgtgggcccaactatattccaaatagcttctgtacttactagtactattcatgggttttactagcattgtaatgttactgtcaaattaaaggcaaagccatgcttttcactttccattagaaagatcatctaaaaacagaccaattggacccaaacatgaatactctacttaattagatcaatgagcaataaatgagttgaactaattactctctgtttgcaaattaatgatcgtttaactgattaattaataaatgagctaataaacctcgatgaatcaattttttttctgtttttggtgcaacagagaacggcaaggtagtgtgccgctcgaacgggttctactccgacacctgcgacgtcgacggcgacgtccggatcaacggcacggctctctccgtgacccttgtttcggcgagccggccgtcagagcgccgccgcgagtggaagatccagccgtacccgcgcaggaccgtgtccggcatcgcgaggtgaccgtgacgcggcaacaggaccgg

SEQ ID NO: 76703 - DNA, 7429 bp, Oryza sativa
gcaggttctgctgctgctgctgtgcttgctgatgcacctgctacaacacctgatggtgctgtcgctgcatctgttgcatcatcattgtcatcatctgagtctgattgtccaacacctgagcaatcgttgggttctcgggcggtggagatgaactgctgctagatgcatcgcttgcacgtgctccactgatctgctcttcgctgccactggcgttgttggattcccgggaaccattccttgtcttcaccatctgaagggggataggtagaaatatgagaaaaggaagaaaaacagggggctcagaatctaatctttcttataaatttaggtacaattatcttaattttgattaaaacaccgaaaaggaagcaaacaactcctaattaaggcagccataccactcacacatgatatcgaccgccgactaacccacaagcagcagacctaaacacagaaactagcaaacaacaaactaagaaagacgataaagctaagggcggcgactctgaagctcggagcggcgcttgcgatcggagaacaggtctgacatctaaagatggacaagggataggaaccaattcatgctcaaatccaaattaaacaaagcaacaaatgactcaaataaataacctagcatggctgatttttatgcatagaacatttttcgtgaactcaaatgaagatactgatgcaactggctaatcaataaattaatgcataaaatagatgcatagctataatgatacgcataaaattgccccatcgaacagagacacgacttagtgcatatcacccgttagatttccgactgactgtcgaataaacctcaaataaaattttactaaaaccctagactgagctaattttaaagatccgatccgaatgaactaccaagatttttcccgcaaaccaaagaggcaaaaccccaaattttcccgaaacaaatccaggtgcaaaaggcatatgcagatgaaaagcggttcagagggctcttaggtttccagttggcttgtcctacggtcaaggctggctctgttaccaacttgtcacgcccagaaattcacgaaccagaatttctaagaatttttcctgggattaaatattgcactttggtgatttttaattggttaaaattatttccaaggctctgaaaattccactaaaaatcttgttaatgcattagagcatggggaactcaagaaaaaatccaccacgccgaattcgattattaattgcatttattaattagggaattagctctatgttaatttgaacaatttcttcggacgatttatttaacaaatttttaaagcaaggaaaaaagggggaaacttcagggcgtgacattacacctccaccaatcagcctaacccattggcaccagaacagaggaaccttgagaggtccatagtaaagttctcatatgtcctcaatggcaccgtaatacgtgccagttgtaccatcgtgtcccatggcatccatacgaacagcactgttctggttcgtgctctttatgtcttgggctctcgtgtagaatgtgtacccatttatctcatatccttggaatgttgctatcaagccagatggtcccctcgccaggtaggcaagttgttggctaatcgtctcgttacccatgagatgttgtcgcagccacacgggcaatgtatcaatgtgatgccgtgtaatccatgcatcagacttaccgatgtttctggcaggaactagagccaagtgctcctcgatgtaaggagccaccaatgaagattgttgcagaaccgtgaaatgggctttacggaataaattgttgtctaccgtcattgctgcgttccttccgagagtcccctttccccgtagtctcccttcatggcgtgattcaggcactctgattgggcgaaggtcttcgataaattctacgcagaattcaatgacctcctctgttccataccccttggcgatgcttgcctctggatgagcacggttacgaacatacttcttcaaaacgcccatgtacctctcgaaaggaaacatgttgtgtagttacacaggcccgagaataccgatctctttgacaaggtgacaaagcagatgcgtcattatattgaaaaatgaaggtggaaatattaactcaaagctgacaagacattgcaccacatcattttgaagggcttccaatctatccggatcgatgaccttctgtgaaattgcgttcatgaaagcacattgctttgttattgttgcccggacattgtctggaaggataccccgaattataactggtagcagttgtgtcatccacacgtgacagtcatgagactttaggtttgtgaacttcttctccttcgtgcttattattcgctttatattcgtgaaggacgtccaagaattcccaatagggtaactcccaaaatatatagttctttttccacatcgccgcgtgaccatcttcgctatcaataggctggctgccaggcccctttccaaacactactttaagatctttcaccatagcaaacactgtttttccactgcgatgtttaagcttcgtacggtggtccgccttatgttcaaagtgattgcctttcttccgtacagggtggtttgcagcaaggaatcgacgatgacccatgtacgcaaccttcctacagtgcttaagatacgtactttctgtttcatctatacagtgagtgcaagtcttggaccacttattagactgccccgataggttgctaggtgtaggccaatcgttgattgttacgaacagcagcgctcgtaggttaaactcctcatgtttgtcctcgtcccacacggggacactttctttcttccacaacagtttcagatcttcgaccagtggtgttaggtacacatcgatgtcgttaccaggttgcttggggccttgaataataatcggcatcattatgtacttcctcttcatgcatagccaggggggaggttgtagatacacatcataacgggccaagtgctatggccgctgctcatctctccaaaaggattaatgccatccgtacttaaaccaaaccgtatgtttcgtgcgtccttaccaaagtctttgaatgttctgtcgatgtttcgccactgcgaaccatcggcggggtgtgacacagtatcccgtcctgttgatgttcttcagcgtgccaatgcatcattctagcatttccccttgctcctgaactaacgccttagccgtggtattatagggaaataccacatcaccttagcaggaattctcttcttcgttggctgcccataaacttcacatggatcatctcgtctaatcttgtatcgtagtgctttacaaacagggcatgcttttagattttcgtactcctcaccgtgatataggatacaatcattcggacatgcgtgaatcttctgaacttctagtcctagagggcagactatcttcttagcctcatacgttgtctcgggtaatttgtttccctccggaagaatgttcttgacgagtttcaataaatcgccaaatgtcttgtcactaacatcattttttgccttccattgcatgaactccagagtggtatccaactttttgtgcccctgctcggaacctgggtacaacgacgttctgtggtcctctaacatacgcttcaatttatgggcctccttttcactttcacagtcctccttggcgtcctacaacatctgaccaagatcatcgcagcgtcgttattgtcagcatccctgtccacctcgcccgtttgatttccttcaaatccagcgtactgagcccagtccggaatgttctcgtcttccacttcatcttcttccatctcaaccccttgctcaccgtgggatgtccaacaattatagcttggcatgaaccccgactaaaacaagtggaaatgagtagtcctgcatacagaatactccttctagttcttacacttattgcatagacaacaaataaaacccttatgcttgttagcttcggccactctcaaaaaataatgcaccctgtcgataaactatttggaccaccggtcagcgtacatccattgccgatccacctacatgaaatgaaaaaaagtcatacataaataaatattcataaaataatgacagccatacaataatgatcaaacaattaaaaactctttcaatagtcatacaataatgacatatcattattcatacaataattataaaataatccaacaaacaattcttatttattatttttgaatttttaaactaatattaatgttgtacttcttttaattttcaatttagtttgttttctatttttcaagattaattttcattatattttaaactatgagaataaaacttttttaagtaaacaaacaaaattcctatatattcttcttccccacacaatttgtttctctcatcaacttacgacaaagttttggagacaaaaaatgtgtgaaacatagctccaaaagtaatataacaacaaaaaacattggaggatgaagttactaaccttttagatacctccgatttgtatataatcaccaaaaaaattcacaagaaattttggcatgacctcccctcttttttggagaaaatttgaagcttgctcgggctggaggaggaagaagacacatataaagagggagataattagtcccggatgatgttatcatccagggctaaaaatcgccgagatctttagtccccgggggcctgacaaggcctaacatctttagaaccgagactaaagatgatcttaccaactgggattaaagatcatatatgcccgctgtagccaccaaccgggactaaagatgatctttagtcccggtttttagtggaaccgggaatattgtgaatttcggctgaccgaccaaagatggtttctccaccagtgctatgataagatctcttgtagtgacggcttgtttggttattagagaggcagtttgagacatacggcatacagtttcatactgtgtgcgtgccaagttggcaattggatcctagtagcagcaaattttgaaacactcaacccaacccaatccttcttctcttaatcttctcttcctactcttgtgtttgtgtgtgtgtgtgtaagaggctagtagagttagctagcctaaatttttttgcacgttgcagctactagctgtgctgctggcttgtcgtcctctgcttgaactttaaagagagagctaatagatcggtgatccgcttgggtttctggtgatcatatgcaacatggactagctacttggatttgttcaaaggatctgcttcttggatgctgtctgggcacgtcgccatgcatgcgaattttgcggatggagtcaaaagctgcatgcacggagctgatttaattaagggcatgttcagattgtagtcaaaataaaccttaccaagtttttggcaatgccaaaattttggcaggatttcttatgtattaaccaaatttggcaacaactaaacgtagatatttttttggtaactttggcaaaaaatgatttggttgaaaatgacatcaaagtgaacaggccctaattaacttgttgacagctactccctccattccaaaatataaggcataaccacccttaactcaaagatcaagaaataattattatcatcttatagtttgaatcatgctaataaatataatgcatgcatccaataggattagataacatgagagtaaaggatttaaaaaagtaataacttaatgaagaagatgtcatagttaattgcatgcttgcatacatgccttatattatggaacatctaagaaaagtggttgtgccttatattatggaatagagggagtagtacctaattaagcatgtgtgttaatttattattaactagtaatctgcccgtgctaacgctgcggcgacatttagaaatacaaattaagatcgatggatatagctattatgttgttaattaaattgccacatgcataaaataacatagttattatcctggttcaaatggagtcattagtgacaacataccatggtaaaagcaaaagtaattaaactttggaacttggcaccttgaaccatcaaatccttgtctaccatgctgtctccctgtcaccccccccccccttaattctaaattaaatggatgagagaaagagattaatatagtttagtgtgatagtgccaacacatggaaaatttagagcttctagttctctccttctacatctctcttaaatgtcggaccaagttcttatggggcccactcatcatacaaccatagccaacacatcatctgctcttctctcatttaaatcttcttttatttctcaaaaggtgagagaaaggtttaaattgaatttccacccaaaatgccactctaccactccaagccttctaggaaacatctatatatgggcctatttgtcgtccaaatacctgcaaacaaccttggtgaatcatctctttatcctaaattatattttcaaagagagaaagaaagagagagagggagttaaagtccaatttacacccaaacttcaccatacctctcatcttctcataggaaacatctaaatggggccactagacagccactcatacttggttgagtgaagtacaagtgggatcacagcctcaaaccactgccaactcctttaaatcgtttctacccctcatgttgacaactagctctcactttccaccttcacttttaccattcactactacaaccaagatttttgtgtgagggctaaaacgatttttgcgagcgggtaggcggcccgcacgcacctaggggtctaggaaaatgatgatttttgcgtgcgggtggcgcacccccacgggaaaacaaaaatccgaaataacataattttttttaaaaaaaacgaaaccctagaatccggcggcgggcttccgcccgatagccatagtgccggctgcctcccgccggcctccgcgccacccaccgtcggatccgcgctcccctccggctgcaacgtcgacgacgcccctcccctccgccggatctagggagggaaagaaggggagaggaggggagctggatcccacgcggggagaaggcggctggctgccggatccatgcggggacgaccgccaccactggattcttgcgttgacggccaccaccgttggatccgtgtagggactaccaccgcccgccggatcccgcgccctccaccgcagccacatggaggaggccggcgcgctcctactcccaccaccgccgcgccgctgctgtcgccgcgtgccgccgctgctgccgccatcgggaggagaggagaggagagtggagagaggagaggagaggcgtgagagagagagtactgagaagagaagctctgcgtggaaattttaaagtggaaaaagggatagaggggaggggagaggagagaaagaggggaaattttaaagtgggtgagagaggaaagagggagctagtatttttg

SEQ ID NO: 76704 - DNA, 2935 bp, Oryza sativa
ctcgtcggcgttcccggtgtccagagcgccaccatcgtcccactttgtcattcccgtcaactcgaatcatctccggctgtaccattgcgccactgacatcgcctaggtcccagcagaacgacgcccacatatgatgaagccaatacgccgccacgaacgctgttggtcgccgttgctctcctgctgcctctgcttctcttgccgccgagtcactgacatgtgggcccggctgtttagccacttcattaggtgctaaggactttaattagtagaaatttaaatcttgtaaggttctttttgtaaaattgctttgtttgccatgtgggtttatggacctaaatgcaattcacctaatgcccagggacctttttgtatagggtttagggcttaccctaaaacatgaaattactatttcatgcactcattacttgagattttgccgaagccaggagtttaatcatataaattagtttcattccaacttagttcccaactctagattagatagatggtttaattctatagcaaaacattagagttggctcatcctatagcttctatagtaatagttagccacaatcttgtaaatacccaattattttatgtaaagaaatttccattggagccttaatcaaatgtatgcgatgaagattcagattgttgaacctgtatcaatctactgatccaggggttgattgtcacgcccggaatttctatccaaaattccaaacgcttacatgtgcgttaaaccctcatccaggaatcagccgaggcacacaataacaaatgataatagagtactatcaaatatctaattaatgtgtgcaaaataaattattacagaggtggatagttcctctcaaagaataaagttctacgcagcggaaaaaaaaacaaaagactaaacatctatggcgactccactccacaagcaactcgacccgaacaaagcctaatcctcctgatcatcaccttcattgaagcactcctcctctgaagaatgaatattgcaagaatgagcatatgacatactcaacaagccacacagcaaatatgcaaatgcataggataacaaaggatggcataattaagctcattcgcataaacagcatttaataaacatttgagagaatagtaaaacagttaagtaattaagcaatattaaataaacactatacatcacacccatgttgcataggcccaaccttatctgaacaaccaacccctaggtgtacaaatcaaacctccaaactaggaaatataccattccaaaccaggagtcaatttagttatcacagtattttcattaatactgagtaatatgagactaatcacgaaaaatattgttagacccacccataaccgctggcatggctattcgaatagttttactctgatcagagatgtaccactgtacccacaagacacaactctacaacatgacacaactccacaagacacaactccacaacatgtcacaacatgtcaccacaaaaaggaatgtgtagcaccggaatcaaaaagcacagttgcgggtatagagttagtaggaaacgtacccaaaaccacatcaggtgtattctgggcttctgcggctgcaacatgattaacacgagccttcggtgctggagcattggagttgttctgaacaggagcattcttcacacgccgaggcttgggacacttatcagcataatgtcctggatcaccacaattgaagcacacccctggcttgcttccctgttccttcctgacaggatgattctgagttggagctgctacaggacgagtgaccatattacgattatcgttgctgcgattaccagtgttgttgttgtagaactggcgttgagggcgagcaactgaagaggatcctccctgtgggtatggtgcagcttgaggtcccaaagcaatgtgcggcctctggctactaccctgttgtgccttgaaatgagcagccctacgctttttctgttccatcctattatacttgtcttcttggcgaatcgccttgtccatcaactgctggaaatcccagtaatccatagccatcaatgcataagacaactcatcattcaatccctctaaaaacttctcctgatgttcttcatcagtgcgacatcttctggggcataacgagctaagcaattaaagtcatggaggtactctgtgacagaacgggatccctggttgagtgctctgaactctctcttcttaagggccacaacacctgatggtatgtgtgtcttcttgaaagcagcagcaaactcccgccaagtgataggctgtccctcggctctgtttagacgaaactggtcccaccacttagcagcaggaccatgcaactgatgtgaagcaaaggaaaccttctcctgctcagtgcactgaatcaaatctaacttcttttccacagcatgcagccaatcacctgcctctactaggttagtggtgcttgagaaggtaggtggtctcacacgtagaaaatctgccaacttgttctacggaggtggtggttgattgttgttatttgcctgttggttctgcgcttgctgcactaacagattaatcaactcggtttgctgggccaaaacttgggcaagtgtgggatctccttcattgtgaccatttccacttccacttccacttccagtgcgggtgttcaccatctgaagaaaagcatgggcaaaaggaaagaacgacagagagatacccttagaacggagaactttaattaatttaaattctatattgctcttaactgtgtatgattacatttaaattgaattaacactatctcaccagctaacttactctctgacaagcaaaagaactaaactcatgtagttacatcccaccattgatgtaagcaacatgctaaacccacacacggacaagcaatcttaagctagcaaagtaacacagcgaactacagcaa

SEQ ID NO: 76705 - DNA, 37547 bp, Oryza sativa
  unsure (1)..(37547): unsure at all n locations
ggcggatggggcggcatataaaggaacattgaaaggaaggaattaatgcatatttttaagttagctgcacaaactagacttaattaaattggacccaaagaaaaagaaaataaaagaaaaggagcaaacatgactcaatttttttttctttttggaacataaatcaaccttgaacagagacaaataacttttgacaaatgaataaattaaaactaaaatatttaggatctaccaggagcacggtacagagtcaccattaacagggatgagtagtactgatgccatcttgattgaatcgataccataatagatgtacagtgccgactaaccaatgaaattcagaaaattatactatttaataccctaaacagtaaagttctttttctttcaaaataaaagaacaaatttctgttttgctaaattagaatttaataaattttgtacataaccttgcatgtggtgccaacttaattaatttataagagaatagagaagagcagttctattttccaaaataatttgaaggaaacttaaggtttaccatttggcttgtcctaaggtcaaggtggctctgataccaacttgtcacgcccggaatttctatccaaaattccaaacgcttacatgtgcgtcaaaccctcgtccaggaatcatccgaggcacacaataacaaattgataatagagtactatcaaataattaattaatatgcgcaaaataaattattacagaggtggatagttcctctcaaagaataaagttctacgcagcggaaaaaaaacaaaagactaaacatctttggcgactccactccacaagcaactcgacccgaacaaagcctaatcctcctgatcatcaccttcactgaagcactcctcctctgaagaatgaaaattgcaagaatgagcatatgatatactcgacaagccacacagcaaatatgcaaatgcacaggataacaaaggatggcataattaagctcattcgcataaacagcatttaataaacatttgagagaatagtaaaacagttatgtaattaagcaatattaaataaacactatacaacacacccatgttgcataggcccaaccttatctgaacaaccaacccctaggtgtacaaatcaaacctccaaactaggaaatataccattccaaaccaagagtcaatttagttatcacagtattttcattaatactgagtaatgtgagactaatcacgaaaaacattgttagacccacccataaccgcgggcacggctattcgaatagttttactctgatcagatatgtaccactgtacccacaagacacaactccacaacatgtcagcatgcgcctcagtaccaccacggtaccttggaaaggaactatgacaatacctctcacacaacacaactcaccacattgcaccgttcctgatcataatctccccctcataaccaggggcaatggactccctcgcgacccccacggacttctcgccgcttcacagtctggcaccccgtaatgaatcatgctatacaaaaggtaaagccgttgcccacgctggcttgtggttggcacggtaaatgtttcacaacagtagctcgtgaaacggtccttaattgttatgagcacgaccatcaaaaccatgtactcacaacccactttaatcaggtttatgtatcaattaattatcataacacgattaaccatcgtgagctaccactaaatataaccataagtaatatccttatatgattaaccccattaatgagctaatgtttctaagcatggctaagcaattatacctatatagcacctagctaaaccaaaccaatatataaggtccaagctattcaatttattacccatagaaaaataaagtcattgtcggccattaattaactgggaaaggctcaccacccgacgacattcgaaaataatgcataagttgaaataaaacattagctttaaacaggttcaacatgctcaaagggttgtttcagatctgtgtgacttgccttgagcttattcaaacacttctgaaccttcctcaacgtaaacgctctcctccggaatatcggaaactaaagcaaataaacaaaatcaacaaaacagtaaaaaaacaagcataaatagtacatgtggatatttttaacaagtagatcttgattttagatgaatttagcaacttgaaccactcgaatccgagttacgatgatttagttatgaatttccgaagtttaatcgattttcaacgaatagaaaaaactaataaaaaggatttatgacgtcatcgatgacatcatcgccggccatggtacggctccacgcgaccaccggcgatagagagctcggttgggctatccggggacacctacgagaagaggacgacgacgcgaactcatcggtgcaagaaactacgacggacgacgatgtacggcgaccggcgatgaggacgaacggcagcgcggctcgggtcgacgacggcggcggcattccagcggcttgcgacgacggcgaaggggtggccgaggtactcctccaccgtgcgaacccggcggcggcgacgctagcggcggtgtggcgcgactggatagtcgccggcgacggcggtggcttgagctacgcggcggcagcgctacgagcaacggcgggactcgggacttggggcaaatggaagaggacgactaggggatgctttatataggcttggattagagagatcggactccaaccgagaggaatcgagctgggaaaaactagggttagttttttttaccaggaaaactgccagggctttgcccaacagtgtaattttataaataaagaaaatatttacaaggttacaaatattacatgcggttcacacagagatactataaggtttgtacccaattaaaaacagtttgctttaaaggttcattcattatgcacatatgcagaagaacttctttgacgaaaagagatctccatgcctgaaaagagggttggatgttctgaaatatgaagccatttctttgtttccagatgtgccaagctgccaaaaagaaaatttccaggaaacccttgtgagcaaatttgattcttgctagagagatcatttggaaaaactccaaattgttattccactcaattcctaggtattgccaacacctgatgctgaaagggcataaaaagaagaggtgcagtcttgtctctctgcagttcgcattgcacaaaacacatgtgagatcatcttctttggtacaatgtcttctatccagcatatctcttgtattaagtctatcacagaacattagccaggcaaagaccttgatcttcatgacacattttgttttccatagccaaatcatgtgtctggggggttgcaatgcagaataatttcttagcagtgtacttatctgagccccagataaaattccaagcatcccccatccctgattgtaagttcaaggtgtccagaaccccctgaagttgcaagaattctgaataagcctcatccgagagggatagagcaaaagaatcttctaggggtagctggtagacatggccttgactgaatcagacttatacaaagtcacagcaaagagattggggtagctggtgcacttaaaatcatcattccatagatcattccagaaaagggcagttcttcctgtcctgatttcacattttgctatccccctgaatatgtctgcaagagttgtgatgtccctccaccaaaaagaacccttattcatcgtcaggtgtggaactttagaaacatagtatgattgtgagattaatttcacccatggtaaatcagcaccattatagaacttgatcatatgctttaggagaagggctgtgttttgaactctcagattgatcactcctaagcctcctttctccttaggcatgcacaccctatcccaggacgctagagatttccttgtcgaagaagggttattacctctccacaggcaattcttacgagctgtgtcaatgaccttgatgactgtaactggtagctgtagtgaggacatgtaataggttgggatagaggacaggactgagttgatcaaagttaatcttcctccttgcggtaaaaaaattgagcttgccgtcagcctcctttcaaccctgtctaccaatgtagcaaatcaaccactctaggcctggtggttcctaaaggtagccccaaataagtgaatggaagagaaccgatcttatatcccaagacgccagataataagatagctttgtcttgagacatattaagtggatacaggcttgatttattatagtttaccttgaggcctgtggattgagcaaacatatttaaaatagccttgaaacagaagacttctttctgagatacttttaacaagatcaaagtgtcatcagcatactgaatgattgggaaaccatcctcactgctttcattaattggttttgacaaaagtccttgatgaaaagctttattgattattctttgcaacagctctgcccccaagacaaaaagcagaggtgagagaggatccccctgtctgactcctcttctgcatttgaaagtattccctggcaccccatttaataacacagcagtagaagcagtagagaaaaccatctgtacccactcaatccattttggagaaaaacccatatgttgcataactgagaaaattgcagaatgctcaatacattggtgaatatattcaaaagaccaggtaagacaatcctgtatggtttttcctttgatgaaaccatattggttatcactcaccagtgtaagaattaccccttgaagtctatcagctagcaatttagttaagattttaagactgatacccgtaagggaaataggtctgaaatcattaacagtctctggggaggttttctttgggaccagggttatgaaggaggtattaaggatttccaaatcaacatttccgtcagtcgataatagtcctgagctatgataggccaacactttttcatgaaaaatccattgaaaccatctggccctggtgctttgtcagctggaataatagagatgagactatctacttcttgagttgaaaacatgtcaaccaagctactcaagtctatatgtctgccaaaaagggagtccaagtcaaaagccatctgtggggaattagatacactcaacctattctgaaagctgcgatgaaacaatgaagccttctgctcatggagatgtagaatctgtccatcatgatcaagcacctatgagatagtgtttattcttaacctttctatggctattgactgaaagaattttgtattttcctcccccaacatcatccatctactagtacacctctttttccaatagatcttcctgaattccaatagtttcaaaatctataccttaactatttctctgaaattccactcatagactgatagcattctgttttcttcaactaagtcaagaaagtccactactttgttccaattttttagcaatcccatcaactttgacagattcttactccaggcaaggagctttttcctaagcactttcaatttgaaagaaatgcaaactagggttagtttggagagataaactcaaaacgaattcgatttggttgatccgggcaaaattgatctccgaaactctaggggaaaaggaggagatgatttcccctcaagcaatcggactcgggggcgaccggttgaggaggaatcggaggagaggctgcggcgctcgggctcagctcggcccggccggaggtaggggatgaccccgacatgagggccccatatgtcgacggctagaggagaggaggggcggctcagcttggattgggccggcgtgggccgcacggctacgcgcgagggagagtgatgttgggccggaaacggcccaacgggctaggggaggattttaaagactttttcaattaaaataattcgtgaaatgatgtttcatttattaaaaatacttcccttgctcaaataattcccagaaaaatctagaaaatagataaacaagcaaagtatttaataaaattttatctagctcaattttatgttgaaatttttcctagattattagagtttaacttgtaggttttaaaataatttctaaaaatgcattgaaaactgaattattaaattaggctattttcagggcgtgacattgatatagtttaaacatgtatgttaccgaatctttaattttaggacccgacaaggtgtgtgggtgggggcccctgcgatttgggagcctagagcggctgtaccgctccccccccacaccaagcttgccctgactacatgggccttgaaaggccacatggcatcttatgacgatttctgggcttgatggcgacgaaaatggacgtcatagactctatgacgacagaaggatcgtcactagattagtaacaaaaagataagctttctttatagaacgccattagagacgcatgataggtaacgaatgatattcgtcacacgaatgtcatagatttcacaacatggtgaatcatctatatatgggcctatttgtcgtctaaatacctgcaaacaaccttggtgaatcatctctttgatcgtaaattatattttcaaagagacaaagaaagagagagagagggagttaaagtccaatcttgtcacaccctgaaaatcccaaatatataaattgttgtttaattagaattattagaaataattttaaaagcctagaagagaagatctaattttaaataaaaaattccaatataaaagtgggccagataaaattttattaaatacttctcttgattctatagttcctagatttttcagggatttatttgagccaaggaactatttttaataaatggaattgcatttcatgaataatttaaattgaaaaagttttaaaaatcctccttttggctttgggccgaaagttggcccaaaaccctttctctctctccctcagcccagtcggcccagtcagcccgcagccacccgcgcgcgcgccctcgcccgctgacaggtggggcccacctgtcaggcttcccgagccgcgccgccgtctccttccaaattcgatcgcgtctttccttctccggtcgaatcaatagaggggaaatgatctccgggacctcctctaccttttctcttttggaatcatcgtctaattttgtttggaaagcgccagattcgatctcgaatcggattcctctctctctcccgccgaaccctaatttttccatcgccgtcgccggcagccatgggcctccaccgccgcccctagcccctttataagaacccccgagacctcctctccacgctgccaccctcgccttagctcgcgccgcctgtagcgccgcctccgcgttcaaccgtgcgccgccgtcgccgccgcgagttcagccgagcaccgccgtcgctccagtcgtcgtcgtcgctcgggaaggacaccgtcgggatcaccaggtcatcgccgaggatcgccggaagaccgccgtcgtcgtcaagccgaccgtcgccgccgcttcttcctcgtcgtcgtcgtcgtccggtcgccgtccgccgccgttcgtgcctcggtaaggatcgccgcgtcacccgctacgtgtagatgtcctccgtttgcgccgccgcgccgtcgttcgccggtgagcatccgtgtccgagccgccgccggtgatgacatcaccgctgatgtcagcgctgacgctagccgtggaccggcggtagatcgataagatctcggccgttcgttttggataggatatatctcggccgttcgtttccgtagaccgccgccgtgcacccggtccatcgtgaacccgagccgctgacgcaataatccctttttccttttcaaaaataattcattattgcgtcataattcaattaaaatctatataaatgatttaatccgatttaaactttgaaaattcataactaattcatcttagctcggatttagttggttcaagtctctaattttttctaaaattgagatctacgtgttaaaaatatccgcatgtactgttcatgcttgtttatgtgctgttttggtgattttgctcttttctctttagattccgacgttcccggagagtccgaatttgcaggagaagactttgaagagttccaaggccagcaaggcaagtcacacagatcccaaacaaccctttgagcatgttgatcccgtttaaagctattgtttctattcaactatctacctctgtaatgacattatattcacttattaattagagttataattgtactctattatcaatttgttattgtgtgcctcagttgattcctggacgagggtttacacacatgtaagcgtttggaattttggataaaaattccgggcgtgacaagttggtatcagagccacctagaccctaggttatgccaaatggttaccgatagaagccctctaaaaatattggaaaagtagaactgttctcctctctttctcttttaattaaaccaaactaatggcacatgcagtttatagtctcttttaatggttctcattcaaaatttatttatgattcctgtgttgttagtactgtacatctattactgtactaatggcccatttaccagcaaaagtttcacaacattgatttatttaatcttgctgcaatgaaataagcttagcatgttgattttataactttcttttattttatttcttttgaaactcgttattaaaaagtgcaaaatttctaatcatgttttcaactgtttcaacttatcttgcaagattggtttactttatttatttaccttttactttgattttctaactttaatttaatccaaaaacttgtgctattaattggataaatgtcttaactctgtcctttcacttgtctttagatgccgcgctacaagcctgagtacttgtttggcactaagggatttgtccaggagttgcgtacgatgtcctttgccataggatttgggactgctcctttgtatgcccagattcctcatgatcgtgatgaagagaagtgccgtgtcaaagtcaccttgaacagtaatcgtgaagatatcccatcggtgatgttcgaggctggttggggaagctacattcatgcttgtcaggaggtggcaaggatcaccataggagagctccgcgaaagctacaatgatcggttggccaacactaagtatcgctaccatcctcgccaaccccagggaagcgatcgtggcagctaccttgaacctgcagggattgagaatgatgctaccacaaggcatttggttgagatgctgtgggccatggatgagacccgcgctgagattgtgatagcagctcaagatcgtgaagacaggaatcgcggcaagatctgcaagctggaggacaaggtggatcatttggagaaggaactagccgcattgacgggagaagcaccaccgaaaaaggccagggtttgtcttaccgcaaggaagagagctctattcgttcctcgctaccagttggcgccaaaggttcgtgtggtggaaaaagaagctaccccagccccagcggatcctccggtcgtcaacgtaagtgatgatgatgaagaagaatccaagcgcacccatttaaaggtcgagtggggagctactcaagatgatggggacgcgccgaacgagccttcaatcaactccgatgcccggaagacctagaacgccttgtcaagccgttgccttagatcgttgtgttagtttgcttgtttaagtttggttgtgtgtgtgggtcttgcatgtgatttacatcattggtgggatgtaaatgcatgcgtttgtttgctttcgagtgattaggtagttggtgagttaagtggtgtgagagtcttcagttttgtaataatgaaactcagttaagatcaataaaagtcaagctagtaaaaaaaaattaatttcctgtcctaagtagttttttcccctgtttctctttttgtgctcctgtctatgccagatggtgaatactcgcagcactgggaatggccccaacaacaacaacaacaacaatggagagaatcccacgcttgcccaagtcctggctcaataggcacagcttatgaatatgatgatgcagcaactccagaaccagcagaaccagggaaataaccatgcacctccccagaacaagctagcagaatttcttcgtgtgaggccgcccactttttctagcactaccaatcctgttgaagctggtgattggctgcacgccatagagaagaagttggacctgcttcagtgcactgatcaagagaaagtctcctttgcttcacatcagctgcatggccctgcctctgagtggtgggatcacttccgtctcaacaggactactgctaaacctatctcttggctagagttcaccgctgcttttcggaagacgcacaaaccatcgggagtggtgtctcttaagaagaaggagttcagagagctcactcagggatctcgctctgtcaccgaatacttgcatgagtttaatcgccgggctcgctatgctccggaagatgtatgcactgatgaagagcgtcaagagaagttcctggaaggactgaatgatgagctttcttacccattaatgactggggattatcatgatttccagaagttggtgggtaaggctattcgccaggaggacaagtacaaccgtatggagcagaagaaacgcaggattgctcacttcaaagctcagcaggggaatagtcagaggccgcgtcttgcttagggacctcagtcagtacccagggaggttcttcgtctgttgttcgtccgcagcgtcagttcttcaacaacaatgctggcaacaacaaccgcaatcaagctccacgtccggtggcaactccgacacagcatcagcttgccaagagggagcaagggaacaagctcggagtgtgcttcaactgtggtgaaccaggacattattctgactagtgtccgaagccccgccgcgtgaaggttgtccctgcccagaacaactcctccgcaccagcgacaaaggctcgtgtcaaccatgttgctactgcagaagcccaaggtgctccagatgtgattttgggtacattccctgttaattcagttcctgcaacagtgcttttcgattctggtgctacacattcctttttatctatgagttttgcaggaaatcatgggatggaagtagaagatcttagacgtcctttgatggttagtactccgagtaaccaagcactctcatcgcaacgtagcccctctgtcagaatagagattcaaggagtaccatttctggccaaccttattctgttagaatccaaagaccttgatgtcatcctagggatggactggttagccagatataaaggtgtgatagactgtgccaatagaaaagtaactctcaccagcaatgacggtgaagttgtaactgttcatgcattgtcctctgaacctctaaggtcaagtctgaaccaaataacgttggaagagattcccatagtacgggagtacccggatgatttacctggtatgccgcctaaaagagatatagaattcagaatagatctggtaccaggaacaactctgatccataagagaccttatagaatggcagccaatgaattaacagaagtcaagaggcaagtagatgatttgctttagaaaggatacatcagaccaagttcgtctccatggggagctccagtcatctttgtggaaaagaaggaccatacccagaggatgtgtgtggattatcgtgcactaaatgatgtgaccatcaagaataagtacccgctgcccagaattgatgatttgtttgatcaacttaaaggtgccaccgttttctccaagatcaatcttcgatcagggtatcaccagttaaggattaaaaaggaagatatacctaagaaggcttttaccactcggtatgggttatttgaatgtactgttatgtcttttggacttactagtgctcccgctttcttcatgaacttgatgaataaggtgtttatggaatacctagacaagttcgtgctggtctttattgatgacattcttatctactcctgaaccaaagaagagcatgaagaacatcttcgccttgcactagagaagctacgagaacatcaattgtatgccaagtttagcaaatgtgagttttggttgtctgaagtaaagttccttggtcacgtcatctcagccggaggagttgccgttgatcctagcaatgtggaatccgtaaccaactggaaacaaccaaagacagtttcagagattcgcagtttcctgggtctcgcaggttattaccggaggtttatagaaaatttctccaagattgctaagcccatgacacgactgcttcagaaagacatgaagtgcaagtggtcagaagagtgcgagcagagttttcaagagttgaaaagtcacctaatatcagcacccattttgattttgcctgatctaaagaagggtttctaagtgtattgcgatgcatctaagcttgggttaggttgtgttctgatgcaagatgggaaggtggttgcctatgcatctcgtcagttacgtccgcatgagaagaactaccctactcatgatcttgagttagctgcagtggtacatgcgttgaagatttggcgtcattatcttttcggtactcgtatagaggtgtacaaggatcacaagaatttgaagtatatctttacccagccggatctaaacatgagacaacggagatggttggaactgattaaggattatgacatgggaattcattatcaccccagaaaggctaatgttgtagcagatgctctcagcaggaaaggctactgcaatgctacggaaggacgacagttgccatgggaattatgcaaggaatttgaatgattgaatctgggaattgtcagtagaggtttcgttgcagccttagaagcgaagcccactctcattgaccaggttagagaagctcaaatcaatgatcctgatattcaagagattaagaagaatatgagaagaggaaaagctattggatatttggaagatgagcaaggaactgtatggttgggtgagagaatctgtgttccaaagaacaaagatttgaaagatgcaattctgaaggaagctcacgacactttatactccattcaccctagtagtactaagatgtaccaagacctaaaggaaagattctggtgggcaagtatgaagcgtgagatagcagagtatgtagctgtgtgtgatgtttgtcagcgattcaaggcagaacatcagaaacccgcaggtttgctgcaacctttgaagataccagaatggaagtgggaggaaatcggtatggatttcatcactggtctacccagaacgtcatcgggccatgactctatttgggtgatagtcgacagacttaccaaagtggctcatttcatcccggtaaggacaacatattccggaagtcgctaggcggaattgtatatggcaaggattgtgtgtttgtacagtgtgcctaagaaaatagtatccgatcgaggtagtcagtttacttcaaagttttggaagaaacttcaggaagagatgggttctaagctgaacttcagtaccgcttatcatccgcagacagacggacaaactgaaagggtaaatcagattttggaatacatgttgagagcttgtgctttagacttcggtggaagttgggataagaatctgccttacgcggaattctcgtacaacaacagttatcaagctagtcttcaaatggctccttatgaagcactgtatggtcggaagcgccgcactccgtttttgtgggatcaaacgggagaacgtcaggttttcgggactgatatcttaagggaagcagaagagaaggtaaagatcattcaagaaagattgcgtatagctcagtctcgtcataagagttatgccgacaatcgccgcagagatttaagttttgaggaaggagatcatgtgtaccttcgtgtcacgcctcttcgaggggttcatcgttttcacaccaaaggaaaattggcaccgcgttttgtgggaccttataagattgtcagtagaaggggtgaggttgcttatcagttggagttacctcaatccttggcaggtatccataatgtgttccatgtgttacagctgaaaaagtgtttaagggtacctactgaagaagctaatcttgaacagatagaagtccaagaggatctgacatatgttgagaaaccaatccgtatcttggagatagatgagagaagaaccaggaatcgagttatccatttttgcaaggtacaatggagtaatcactcagaggaagaatctacttgggagcgagaagatgaactaaagtcagctcatccgcatcttttcgccagttcttccgaatctcgaggacgagattctatttaaggggggtaggtttgtcacaccctgaaaatcccaaatatgtaaattgttgtttaattggaattattagaaataattttaaaagcctagaagagaagatctaattttaaataataaattccaatataaaagtgggccagataaaattttattaaatacttcacttgattctatagttactagatttttctgggatttatttgagccaaggaagtatttttaataaatggaattgcatttcggcccaatgccaaaatgaggatttttaaaactttttcaatttaaattaacgcgcgcgcgccctcgccgctgactggtggggccggcttcgtctacctcgcaccgccgccgcagccgaaccctagccgagccgcgccgccgtctccttccaaatttgatcgcgtctttccttctccggtcgaatcaatagaggggaaatgatctccgggacctcctctaccttttctcttttggaatcatcgtctaattttgattggaaagcgccggattcgatctcgagtcggattcctctctctctcccgaaccctaatgtttccatcgcagtcgccggccaccatgggcctccaccgccgcccctagcccctttataagaacccacgagacctcctctccctgccgccaccctcgccttagctcgccgccgcctgtagcgccgcctccgcgatcaaccgtgcgccgccgatgccgccgcgagttcagccaagcaccgccgtcgctctggtcgtcgtcgtcgctcgggcaggacaccgtcgggatcaccaggtcgtcgccgtcctcgtccacccctccgtcatcgccgaggatcgccggaagaccgttgtcgtcatcaagccgaccgtcgccgccgcttcttcctcgtcgccgtcgtcgtccggtcgctgtccgccgccgttcgtgcctcggtaaggatcgccgcatcgcccgcaacgtgtagatgccctctgtttgcgctgccgcgccgtcgttagccggcgagcatccgtgtccgagccgccgccggtgatgatgtcaccgctgacgtcagcgctgacgctagccgtggaccggcggtagatcgataagatctcagccgttcgtttccgtagaccgccgccgtgcacctggtccaccgtgaacccgagccgctgacgcaataatccctttttccttttcaaaaataattcattattgcgtcataattcaattaaaatctatataaatgatttaatccgatttaatctttgaaaattcataaataattcatcttagctcggatttagttggttcaagtctctaaatttttctaaaattgagatctacatgttaaaaatatccacatgtactgttcatgcttgtttatgtgctgttttggtgattttgctcttttctctttagattccgacgttcccggagagtccgaatttgcaggagaagactttgaagagttacaaagccagcaaggcaagtcacacagatcccaaacaaccctttaagcatgttgatcccgtttaaagctactgtttctataaaactattgcatttattttcgaatgtcattgggtggaaataacctattgccttgttatagcccttttgctattgattccctattctttgtcacttggttaataatttgattagctagaacattatatggctttagctaaagtgaataggatgcttagccatgcttagagacactagctcatataaaggggatactcatgattcactattatttaatgttggtttaatgatagctcacgatggttaatcgtgattggttaattaattaatttgccaactaaaatatgataatggtgggttgtgagcatatggttttgatggttgtgctcatgacaattaaggaccggttcacgattttcggttgtgaaacatttaccgtgccaaccacaagccagcgtgggcaacggctttactttctgtatagtatggttcattgtagagcaccagactgtgaagtggtggagataagcccacgggggtcgctggggagtgcactactttgaattgtgttatatagagggtattgtcacaatctctattcgggtacttgttaagtatcacgacgcatggttgacatgatgttgtggttgtgtcttgtgggtacagtggtagacctctggctagagtttaaactattcgaatagccgtgcccgtggttatgggcgggtctaacaatgtcttttgtgattagtttcacacttctcaccataataaatgatgctgttaataatttgtttagctcctggtctggaatggtatattcctggtttggagatagaactgtgcagccgggattggttgttcagaatggttgggcctatgcaacagggtatgttgtatagcgttggattaatactgtttaattaatattctactgttttattaaattctgaaatatttattaaatgctatttatgcaaatgagactatactatgccatcctttattatcctgtgcacttgcatatttgctgcgtggcttgctgagtatgtcatatactcaccttgtaatcattcatcagaggaggagttctacagtgatgccgatggtgtgtaggattacgcgtagccctggtcaagctgcctgtggagtggagtcgtctgcgccgtttatcttattttccgctgcttagaactttattgattgagagaaactatctacctctgtaatgacattatattcgcttattaattaaagtaataattgtactctattatcaatttgttattgtgtgcctcggctgattcctggacgagggtttacacacatgtaagcgtttggaattttggatagaaattccgggcgtgacaaatttacacccaaacttcaccatacctctcatcttctcctaggaaacatctacatggggccactagacagccactcatacttggttgagtgaagtacaagtgggatcacagcctcaaaccactgccaactcctttaaatcgtttctaatcctcatgttgacaactagctctcactttccaccttcacttttaccattcactactacagccaagatatttgtgtgagggctaaaacgatttttgcacgcgggtaggcggcccgcacgcacctaggtgtctgggaaaatgatgatttttggcgcaccaccacgggaaaacaaaaatccgaaataacataatttttttaaaacaacaaaaccctagaatccggcggtgggcttccgcccgacggccatagtgctgccggcctccgcgtcacccgctgtcggatccgcgctcccctccggccgcaacgccgccgacgcccctcccctccgccggatctagggagggaaggaaggggagaggaggggagctagatctggcgctgggagaaggcggccggctgcgggatacatgcggggacggccgccaccgctggattcttgcgttgacgtccaccaccgttggatccgtgtaggcactgccgccgcccaccggatcccacgccctccaccgcctccacatggaggaggccggcacgctcctactcccaccgccgccgcgcctctgctgtcgccaccacgccgctactgtcaccgcgcgccgccaccgctaccgctgtcgagaggagaggagaggagagtggagagaggagaggagaggcgtgagagagagaagactgagaggagatggtctgcgtggaaattttaaagtggaaaaagggatagaggggaggggagaggagagaaagaggggaaattttaaagtgagtgagagaggaaagagggagttagtatttttgcatgcggctctcttaataggtccgcatgggaaaatcggctcattttcacgtgctgtccatttaaggggaccgcatgaaaaaatcgatttttcccataagcaacgagttgccgcacggaaaaattgatttttccgtgtcgtcctcttnaatggacggcntgngaaaatgagccgattttcccagaagcaacgagataccgccctcacggaatctaaaaggtccctatccaggaaaatcgtttctatagtagtgattcatgaagttccttctctacttgatcgatccattttctttgtttcttttttggcatagatcgaacacttggtggtgcgctcgtcggcgttcccggtgtccagagcgccaccatcgtcccactttgtcattcccgtcaactcgaatcatctccggctgtaccattgcgccactgacatcgcctaggtcccagcagaacgacgcccacatatgatgaagccaatacgccgccacgaacgctgttggtcgccgttgctctcctgctgcctctgcttctcttgccgccgagtcactgacatgtgggcccggctgtttagccacttcattaggtgctaaggactttaattagtagaaatttaaatcttgtaaggttctttttgtaaaattgctttgtttgccatgtgggtttatggacctaaatgcaattcacctaatgcccagggacctttttgtatagggtttagggcttaccctaaaacatgaaattactatttcatgcactcattacttgagattttgccgaagccaggagtttaatcatataaattagtttcattccaacttagttcccaactatagattagatagatggtttaattctatagcaaaacattagagttggcttatcctatagcttctacagtaatagttagccacaatcttgtgaataccctattattttatgtaaagaaatttccattggagccttaatcaaatgtatgcgatgaagattcagattgttgaacctgtatcaatctactgatccaggggttgatacagtttaaaaatgtcggttacccaatctttaattttaggacccgacaaggtgtgtgggtggggccccctgtgatttgccagcctagagcggccgtaccgctcgcgccccctccccccagagccggccctgactacatgggccttaaaaggccaaatggcatcttatgacgatttctgggcttgatggcgacgaaaatggacgccatagactctatgacgacagaaagatcgtcactagattaatgacaaaaagataagctttctttatagaacgccattagagtcgcatgataggtgacgaatcatattcgtcacacgaatgtcacagatttcattgcatgacttaaaattcaatttttatgacgtaaatgagcatcacctatcataagattcttggctatttgagaggcagtttgcagacatacagcacacagtttcataccgtgtgcgtgcctagttggcaactggatcctagtagatgcaaattttgaaacattcaacccaacccaatccttcttctcttaatcttctcttcctacacttgtgtttgtgtgtgtgtgtctaagaggctagtagtagagtagctagcctaaaattttttgcacgttgcagctactaactgtgctgctggcttgtcgtcctctgcttcaacattaaagagaaagctaatagatcggtgattcactttggtttctttgatgctatccagccacgtcaccatgtatgcgaattttgtggatggagtcagaggctctgcatgcacggagctgatttaattaattaacttgttgccagctagtacctaattaagcatgtgtgttaatttattattaattactttgctagtgttaatttatccttagtttttttattccaaactactagcatgcatgcctttgtcagagagagaaaccgatggaatatcctcgtttcaaaagtccatgcataatgtgcatgctgtgtggattcgtgctgtattttcctgggtagataagaccaaaaaatcccacttaccaactaggttttttaaaagtctggtacatcgtgaaccatactgcttcacgtggtcggaactatatacgttaagatcaaatgtgctcaacgtggtctggcacatcatggaccatgctgtttcatgtggtcggatctagatgcattaggaataatccttttcgtagtagtgaaactaaagaacttcacttgcgaactacttcctccgttttacaatgtaagtctttctagcatttctcacattcatattgtttctaatgaatctagatagatatatatgtttaaattcattagcatcaatatgaatatgggaaatgctagaatgacttacattgtcaaacggagggagtagtttttgtagagactgaacaaagatgaaactttttggaaaggtgctcctgatgaccaagttcaattcaccaactgaaatcgcacactggatttacatgaaaaatgcgagatagacaaaaatgatttctttcggttttaaattaatactcccggccatttgggaggagcaatatgtacatatgcattcatcacacttcaggttttttgtcttttttttccttggagttgtaagaatgctcataattagggcatgcaagttgatccattgatatattcgcaatatttgacgatttttttttcattttaaaaattgttgacgatattagcttaattttggtatggaaaatatcggttaatttatctccaatttttatcaagagagaaaatgaaccatgagagttgaggtgcgaattaaccacaagcaaatattcattttaatttgtggtatatatatatacacgagcatgcatgtaaagatggaaatatgtgaaaaatacaatggtgctagtagatttgtctaaaacacttccataatactatgatcaggacactcgataaggacaaagttaaattttagggattgtgtcattatcaaaattatcaatgaataattggccagagggccgggattagcatgggtctactactgtcctgccatttcattaattaattagattaagtccccgattgcttgcatccctaattggcctacgagaaccgacaaaaatcgcaagatgggaggattgtggtaggttatcttctccaactgtgcctctcaagtggccataacatattagccagaaggataaataatcatcaatctgccttcacagttttgatcatctcatgagacatatatataaaccacccattagcaagagtctcctaggtgaattaattaactatactgatacacatatacttaattggtataagaaaattagtggtagttaattagtataaaagcatcaatcaaatggagactattagctagctaggagaccgggcaagcaaagcaaagcattgatcttgactaggaatcgtgcacgtacaaggcacgtataaaaaaaataagtataaaatgtaaactacatataaaaattaggaagtgtgataaaatgtcataactgcataatttaccaacgtaacagccaaaaaaattaaaattatctcagtgcaccaataacataaacaaaccaaactttggtagatatatattaaaaaattgaggcacatcacagattgaaattagtcaacaagttcagggaatgaactcagaaatgaaccggtaccacctagaatattaagttcaggtacatccccggataagatcagaaaatactatagcaaatgttccaaattttgtttctgaattctccttaatccacatgaattgtccttaatacaatccaggataagatcagaaaacaagacctctcttacaagcaataacgcatatattatttgtcaagacaaagccaagtgcataatccacatcaggttatcctctagatgatactccagccatgctccctggtcctccaaaaacaaccaggttcaatagtccaatgcataatgtaaataacagggccggcagaagaatctgaacatggtaatcttaaagcgaccttatataatctccacaaataatattggaaattatttgaaatactatcaagtgacaggagcaaggttacaacattattagcaagtgacaggtgcaagactaaaacattagatcagtgaacctgaagtaagacaaacaattgttgattaaaaataaataacacttgttgacaaacacaaaatggcattttattcttgcacgaagaccatgtctaagccttgatatatgcattatgccttcatgatctttaaagtcaatagatacctgcataaagcatcaactaagaaaatacattgtttttgttccaaaaaaactgataaataacaaaaatggcatgataaaaggaacaccttaatggatacttttgttaaaaaagatagtgaaattcttgattattcaacgccggatcgaatcatgtccaatggtcattggaattttgtctatccttctattcttcaaaataattcagatttgttagccaaaatgcgaagaaataggtttgccattccattacagtatcatcaagaacaagcgaaagaaccaatatcctgttttgggatttcgattgaaataccctttatgggtgttttacgtagaaatactatagttgcttattttgacaacccacgatacaaaaagagataaaaaggttttgagaattgttaaatttagatataggaccacataagcaacacaattaatttaaatacagaacatatggacatacttctctctttgctgccctgtgtttgtagatggttcaactatcaacataggatgctcctcagcataaaagctaataaagcaaaaaaattcagtagttgcatctccatgccatacaaaggaaatcctactatttaatcaactttatccggttgtacacataagaagggatttcactatcagtatatttgaagagcataaataaatatgtaaggtgaaaagatggtgggcataaagcagtaaccatgctgacatccaaaagattccatagaggcatagaagattaactttgttgctgattctaaagaaactatgttaaagatagagtttggttcatcccaaacttccccagaaacaagttaggcacgttcggccttttgcggcaacgggcaagtgtttggccaaccacataagcagtgtgccaaacctggttactccagtgcctctcatgtcatagatttatttttcagacaagttttgccacaagtgtggccagctttttgggcgtgcacttttggcacaaaattactcagatctgcatcaaatagataaagcaactcacctgaaagcatgattccatatattgtcaacaatatcccaatcaataaatgttccatctttcattggtgaaatcacctattgggcatggaagaaaatcagtgataaacaatagttaacaaaatcatgagcatcaatattgatattttagaatgttgataaactaacctccatatgatccctcctaaatagaataaaaacaccttttagtacatacactacaatagagtattatcacaggccaaatataaattgtctccaggtaaaataaaggtagcaagcaaagcaaaattcagacaaaaaataatagtacatgttattgcagaaatttgtagtgtagagcttcgttgattatccattgaaagtattcagaaagcacggctatgttgtggaccactattatggtagagaactgcaaatgcaagacactcttatgcatcagttcagaatcctcttatgccatggacgcccatcgtagacagccagagccagccaacaacccactcagccatggacgccatggacaaagcaatcaaagcaaccataaaaccaagaaaagaaaaatcaccggttgccgaggagagcctggaggtggacgatgagcttctcctcctgctcagtgaagttcccccgcttgatccccggctggaggtagttcgtccaccggagcgggcagctcttgctgcaacgcatcacccctgcacacacgcacagatcaaacatgcaaaaatctcagatctcgcaacccaacgcagatcgatcgatcaagaacacacaagaacacgtaccggtgttggtcggcacggcacgccagttgccggcgccgtgctcctggatgtaggaggccagcatcaggtcctcctccggcgtccatggccccttctttacccaaccttgtcgcagcacggcggcctccccatcctgctcgccggtgcgcggcggccggccggtggttggtggtgtatgtgtgtcgactcgatctcgatcagggaggaggagactcgcgtgttggcggtggcaacggaggtagccgggcgggtagcggcggcgtccctgcgagcagcggaggcgctgtggtgccggtcagaggcgactggacccgtgcctggccatgggcagcagtgcggtagtgcctcggcgctggtccgacattgaggcggagcgaggaggcgaggtcgctggtccggcggtggaccgtcgtgaggagaggaggcgcagagcgaggatgcgggcggggagagaggcgcggagcgaccaggcggaggagtcatcgcaccggggatttgcgcgtcgcagttaccgcgtcgggccgtgggggcgaaatcgctggtgggatgagatcgggccaaatcgctggtggatatagatctacggtgtacagcggacggctcagattggatgagagggtggatggacggatgggataagagtggttgatttcacttgtaggattgctaggggtgaactcctcctttttatattagtacagatgaatcctccaaagagattaattgcatattgccagttcctcctgacctattatatgcatgtaagtgctctctggtgcggtgcaacgacgagcaagagtgcgtacgtttatagtagaactgagggggtgcgccttatatacgccggacgagcaaagagtgcgtacgtttgtagtgacgtctccaattttagtgtctatggtagtgaaatattcgacgtttgacacctcaaaccggagaaaaactggagctgtgaaatgttttcttttttttatatgcgtggagctctgaaatattgatagttttgtttttttctattaaaaaagccaagaagagttgacgacttatcggtaggcgctcctcgatggagggagatgagcttaaaaagtttcagtaaatggacccatgcagtggaaatgcggagtggagtggagcagtaataaaatataaaatgccacgcgcagggcatctcgaccacgacaggactctccttgagatcttcgaacagtgtgtgcttgctagctgaactgcagcagtggaacagtaataaaatttaaaacggatgtgcagtgttcacagaggacgagtgtgctctgtgttctctgcttgtgaatagatatggcgatctctgcttgtgaatagatattgcgagtactatagtacgctacaaacacaactaagttaccttatgaaggactactcaatagtacacttaaaacattgttactcgttgccttttacatcgatttttccgtgccatcctcttaaaaggaccgcacgtgaaaatgagccgattttcccagaagcgacgagttgccgcctgcacggaatctaaaagggtccctgtagtagtgattaatctagccaactcgccactgtgaacctcatctatttctcacagtgttccactatgcaaaccaccaaaaactacctcggaatctccaagaacttccacttactcttttcacccgaaggagtttcatccatcgcacatattctctggtgagcttcaccgcactccaaccatgggaacgtgaagttccttctctacctaatcaatccattttctttgtttctattttggcatagatcgaacagttggtgatatgctcgtcggcgttcccggtgtccatagcgccgccatcgccccacttcgtcattcccgtcgactcgaaccatctccggccgagccattgcgccaacgacgtcgcctacgtcccaggaaaaagacgcccaaatatgatcaagccaatacgcagccacgaacgccatcagtcgccgttgccctcctattgcctctgcttccccagccgccaagtcaccgacatgtgggccctggctatttagccacttcattaggtgtaaggactttcattagtagaaatttaaatcttgtaaggttctttttgtaaaattgatttgtatgccatgtgggcctatggacctaaacgcaattcacctaatgcccatggaccattttgtatagggtttagggcaagtcctaaaccctacttagagattactatttcatgcattcattacttgatataatagcttgatgagtatgttgtactcaccattgctttaaccctctctttgagaatcattttggagtttttgctgaagccgtgagtttaaacatataaattagtttcattccaacttagttcccatgtatagattagatagatggtttaattctatagcaaaacattagagttggctcatcctatagcttctacagtaatagatagccacaatcttgtaaataccctattattttatgtaaagaaatcacctttggagccttgatcaaatgtatgcgatgaagattcagattgttgaacctgtatcaatctactgatccagggcttgatacagtttaaacatgtcggttactgaatctttaattttgggacctgacaaggtgtgtgggtgggggcctagagcggccatcccgctcccccctccccccctcgtcggccctgactacatgggccttaacaggccacatggcatcttatcatgatttctgggcttgatagtgacgaagatggacgtcatagactgtatgacgacagaaggatcatcacaatattaatgacgaaaagataagcattctttatagaacgccattagagacgcatgataggttgtcacgcccggaatttctatccaaaattccaaatgcttacatgtgtgtaaaccctcgtcctggaatcagccgaggcacacaataacaaattgataatagagcacaattattactctaattaataagcgaataaaatgtcattacagaggtagatagttcctctcaatcaataaagatctaagcagcggaaaataaaagaaacagcgcaggcgactcctctccacaggcaacttgaccaaggctacgcctaatcatccacactatcagcatcactgtagaactcctcctctgatgaatgattgcaaggtgagtatatgatatactcagcaagccacgcaacaattaagcaagtgcacaggataacaaaggatggcatagtatagtctcaattgcttaaatagcatgtaacaattatttcagaatttaataaaatagttaaataataattaaacaatattgatccaacgctatacaacataccctgttgcataggcccaaccattctgaacaaccagtcccgactgcacagttctatctccaaaccaggaattaaccattccaaaccaggagctatcaagttattaacagcatcatttagtatggtgagaggtgtgagactaatcacgaaagacattgttagacccgcccataaccgtgggcacggctattctaatagtttaaactctggccagaggtgtaccactgtacccacaaagacacaacctcaacatcatgtcaaccatgcgtcgcgatacttgacaagtacccgaatagagattgtgacaataccctctatataatacaattcaaagcagtgcaccgttcccggatcataatcacccccttataaacaaggtatggactccccagcgacccccgtgggcttatctccgccacttcatactctggtgctctactatgaaccatactatatagaaagtaaagccgttgcccacgctggcttgtggttgacacggtaaatgtttcacaaccgaaaatcgtgtgctcacaacccatcaaaaccatatgctcacaacccaccattatcaggttttagttggcaaattaattacttaaccaatcatgattaaccatcatgagctatcattaagccatcattaaataatagtgaagcataagttatcccaatagtgtgctaatgtttctaagcatggctaagcaattatgtctaatatctagctgaaccaatatataaagctcaactagttaagttataataacccaaggtatcaaggaatagagtaatcaagaacaaaagggctataacaaggcaataggttaattccacccaatgacattcgaaaataaatgcaatagttgaatagaaacaatagctttaaacgggatcaacatactcaaagggttgtttgggatctgtgtgacttgccttgctggccttggaactcttcaaagtcttctcctgcaaattcggactctccgggaacgtcggactctaaagagaaaagagcaaaatcaccaaaacagcacataaacaagcctgaacagtacatgtggatatttttaacatgtagatctcaattttagaaaaatttagagacttgaaccaactaaatgcgagctaagatgaattagttatgaattttcatagattaaatcggattaaatcatttatatagattttaattgaattatgacgtaataatgaattatttttaaaaaggaaaaagggattattgcgtcagaggactcggctcacggtggaccgggtgcacggcggtggttcacggaaacgaacggccgagatcgatctatccaaaacggaccaagatctaacggtctacgaccggtctacggtggacggcgtcgatgatatcagcagtgacgtcatcaccgacggcggctcggcctcgcgtgctcgccggcgaacgacggcgcgacggcgcgaatgaaggacacctacgggttgcgggcgacacggcgaactcaccggtgaccaaagcagcggcggaaggtcaacggacggcgacggcgacgaggaagaagcggtggtcaccttcagctcgacgacgacggcggggctccggcgatctacagcgacggcggagaggcggacgaggtcggcgacgatttgacgatcacaacggcggctttcccgagcgacgacgacgaccggaaggacggcggcgcacggctggacgaacggcggcgacggcggcgctagactacacgacgctagggctctaccggcgacaagagacttaggcgagggtggcggcgggtagaggagacaccgggggtccttttatagcggctagggggtggcggcgaaggtccacagcgaccggcggcagcgatggaaagtctagggttcggggagagagacgaatccgatttgagttcgaatccatggatttccgaacgattttagccgatgattccaaaagagaaaaggtagaggggatctcggggatcatttcccctctatcaatttcaccggatcgggaaagacacgatcgaatttggaagggcagcggcgcggctcggctagggttcggccgggcgacggcgcgaggaagacgacgagtctgacaggtgggtcccacctatcagcgggcgagggcgcgcgcgcagacggtgctcggctgcgggccgacctaggccgggagagagagaggggtttgggccgactttcggcccaaagccaaaagaggatttaaaaaacctttttcaatttaaattattcatgaaatgcaattccattgattaaaaatacttccttgcctcaaataaatcccagaaaaatctaggaactatagaattaagcgaagtatttaataaaattttatctggcccaattttatattgaaatttattatttaaaaatagatcttctcttctaggcttttaatatcaattctaataattccaattaaacaacaatttatatatttcggatttttagggtgtgacataggtgacgaatgatatttgtcacacgaacgttagatttcacaacatgacttaaaattcaattttcatgacgtaaattagcatcagctacactggtggagaaaccctttttcctcccggttcgtaacccccctttagtcccggttatccaaccgggactacgaatccgggactaaagatcgctatccttagtcctgggtgaaataacctggactaaagatcgatctaccaatttttttcttatttgcatggccctattgctgcatggtttagggtttatgttacaatacatatatatgcattatatatatctatatatatatatatatatatatatatctatatatatatatatatatatatgatggctctttcatacgcccaggtgtatgtacacccttttattaatggatgatccattagcattcaaattagctatgaaaaaaattaataatattaatttccaaatgactgcatgcatgtggcatagctgcacaccggattgggtgcagatttgaacaagattgttggcatgcatttgctttcaaatttgataacgtaccttagatatccccaccttttctagtatgcaacagtatatactgttttttaagccgcagtatatatactctttgaagtgatgagcagtactatatagtagttttttgtgtattagcagtacctaataaggagtaccttatatttttgttgtagcagtgaatacttctttttttaattagcagccgaatatacttactccagaactaatgagtatatatatactgattatgtctttttattggtacgtgcagtatatactactgcaacgagcgaatgagtacatactgttctttctcggaatgagtatatactgattttttttttggaacgagtatatatactgacttttctcggagtggtatatacttatttcttctccaatcggtatgaacagctactcggagtggtatatacttatttcttctacaatcggtatgaactgctctttggtcagtgtatatatactacattcctcattgaaggagtatatactgcttctttttttatcagtatatacatttgttattaattgagtatatactgtatgcactacttgttctgtcagtatactgcatatactaattgtcatgtttggtcggtatactgcatcgtcctcgctaaaggaggttatactgcctttttgtttgatcggtaaatactacgtatactactttttttcactcagtatataaataagtatgtaccagtatttcttagataagtcgtatatttgctatccatggaagctggatgcatatgcttttcagttgaatagaataattaatatgcttttcacgtgcaaattcagaagtatgcctgaatcactggcaaagtatcggctgttgcattatgaataaacctaaattaatgaaataccctagaagggcactgaattctgaatggacattaccagaccaaagaaaaagatcaacgcagactatcggaaactaagaacaaaacataacgggatcacccctcgatgtggctcatcgaagaatctctgcatccccgcagacatatctcggttaacatcgatgggatcacgccgaccgcacgccggagagaggtggacaagaatgtgtcttcctggattaacaccgttagctaggaatcacgggttcgatgccgacgacgatgctgttgccgcacggccacacatgctggactgttctgtcatcagcaccatctacgtccacgatacatgcatctcgcatttgcatgcaccaaacaaattcgatctgcatgcatgcattatcgatttgcaacctagaaaaagcaaatcaagaaaatcggaagaaggaaggacttgcctgcagcatagtcgatgttccagttccggacgacgctcagcgtcgtcttgatcgtagcatgggcctgcatcgatgccgtcgccgtacggccacactgacttgcccgaagatcaatggcgtcgttgtctggtcacagctcttcggccagccagtcgcctgcggatagtcatactgaaggcattggtaatggaagacgccggcgtagacatcagcagacgccgtgaccttcgaatagccgatgggtcgcgccgtcgtcgccttcgaatcgccgatcgcgataacctgcagatcgatctatcgattctgtttacaaccacccacgagattttaatacgagctattcaaaagggttctggttagtacggaataattcagattatgaggatttttttcgtaactagaaatcaaaacgggctcggtatatggatccgcttgctgatttgatcggtggtgttcgctgatggacggtggatggaaccgggagtacctactcctgggagtatagaatcattatatatatatatatatatattatatcctactaccgggagtagctactcctgcatcatctgctatacgtgctttcaagatttgtgcagctttctgctaattcgaatttgtcattagcgggttaattaacccgttaaaatatgccgatcgctattttcgtgggatacaaacttttgaatgcattatgcacgtcagatgtttgcattatctgcctgacggccgcatatatatatgatctgctcgtccacgcatgtatttcgcatctatagcatatcatcaaccacaactaaaatgaacagatgatgttctgctggcacactgcgtgtggtaattacgtactgtccaactatagccttgtgaacaagataattaaattgagcagaagatgttctgttctttctctctatatatacctattcaaagaataataaaaaaaggcagcacatattctgctacctttcatggatgggaagaagatattctttttgaatgaagcagaacatgcagttttctagtttctgctcccggttcacattctgcccattttctaggttctgcattttgaagttctggaggagcagaacgtatccatgctggtattcaattacacaatcagaacttgatatggggaccagaacaaaaatgttctgctcttgtttctgctggggccttgtcgaaactagatttcggcaatagtaaaagggggtggctatcaagctagaaaagtgtatgggtttggagacaaaggatttatacaggttcaggccttcttattcaagaagtaataccctactcctgtccggggatggatccgccgagtgtattattgattgtatgattgggagaaaatcaacctatgccccaagaggcacccggaccctccttatatatgggaaggagtccgtgttacaaaagataatctatatccctaacggaatatgcagatacaggtaaaatacagtcgtaaccgactaagtctcaaggtgtttccttgatgtacaagttaagaaacgaacccgagatacaaataagatattctatatatattcggtatcctatatccagtccaaatatcctcgccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaaaataaggaatatggtgcatcgaatagatgcacctaattaggtgtagcccccaactatgtgattagttaacaaactaaacatatagttgagaacaaaataatagcacaatcatgcatcatatgacagaagcatatgcggcgcctaaagaggcattctagccgactgctttttagtcataataaaaagaatccgagtggttaacactctaaaaggttcacgaatgaacacacttgacaggcatccgaataaaaaactctaaagattacccaccaaacattataaaaattatggtaatgaataagtctaatagcctaagctatgactatccatcataatgaaaacaggcatatgtggtgtaaaatccgagtaaataaactcataaaggatttaccaaccgcctaaggaaaaatgactataatatataatcagcctaagccataatattggtcaataaaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcttaaaaagttgagtaactgcggtataaaaggattttaaggtattgagcacttgatcacgcgcactttggcctaagcgaaaagtgcctgagtccctaaaagaacgtgacaggccacacctgaaaattcgcattgtaataattccgaagaattatatgaccgcgtaaaaaaagattttatcagcattgggcaacactattgtgcgcataagttgccaaagcaaaaaatgcctaagtccctaaggagcacaatgggccacgctgttaaaagtattgggctgaggtactgttcaagcctaagcccattcgcacctccgatacccttaacaaaaaatcacgtgatccaagcgccacttcgtcttccccgccagaactctcgccattttccccacttcctgctacagtacagagctgcgccggcaaactagggttcaccattccactcgaatccaccttcgaaaagttcattaaaatccttcctgtgatccaccgcctcaattcctcacctctcccaagccatccctcgaatcaaatcagcgcattcaggtaaaatcgatggcgaaagagaaagaaagcttcgaaggccaatgggcaccatccgacgtgacggaggagaatctgaaggagatggtggcgcacggtgttctccctgccaaggagatcattgggtggcgaccagcgtgcggtgaggtttttccgtcccccgacacacatgaggttgtagttttttcccatttcttctatggcggcttcgctcttccgacctcaaaatttttccgcgggatattaaacttctatggaatcagcttgcatcacctaaacccaaattccatagtccatatcgccaatttcatccatgtttgtgaagccttcttaggaattaaaccccacttcgctctgttccgccgaatcttttttctcaagccccaaccgaacaagaataagccatgtgtagtcggaggggcaggatttcagttgaggggaaccctgagtcagaagtatttctctatgcccttcaagacctcaaacaaaggatggcatgcaaactggttttatattcagaaccctgagcctgctcttcccgagtactcttgtcttcctccggtgtaccaagatacttggaactctcttccgatcggagatgaagctgctcaagccttggagttgatggaccgcatgctaaaactcaaagaacaaggtttacaaggagagcagattactcggcatttcatcaaatgccgattggcaccaattaaagaaagatcccgcacagcattcgagtttgacggcaagcatgatcccaatcgtgaagaaccagactctctggactttaaaatcatgaaggagagaatgtataaaatcttctcaaatgctattgtcgtcagctactcacatcaactgccagttgtgccatataacgcattcaatccgcctccgcaggtatgtatctgaaatcttcaacctatgaccaaaatagtatcttgtcttcatgttgagttaactaaccatggaggcatcttattcaggaatatgtactgataaaatctgatcccccaatcactcagcgccggtctcctcgccagcacaccgttcagggaggtggaggaccaacaatcagaccagattcgcaacctcaaacctccaatccaactggacagacaggttctcgcaagagaaaactggtgccaaatgacgacgaaggcgacgagaaatctggggacaaaggctcgcctaataaactcccgaagcgtaccatgcccaggaaaaaactggctggccgtccaatgccaaagattagaacatcttctaggtataaacctcttggtaccattttatttcggcatgctcctctcatgaaaataatactgaatattgaaagaacattttgcaggaaaccatctgacatagacccaactggaaaagatcctgatccggctgccacagagccaaatttatccaaagatgctgagccgactgccgaaagccggccgattgccgaaagccagccgactgccgaaagccagccgactggtgcccatgcttcggatgacaaggcccatccgagtgaccagccgccgactggaaaccagtcggcagcaactgaaactgtaacaacccaagagcccccgactggaaaccagtcggatgtaagtctaaatcaagagattcctgaagctgaagcgcaggcgacaacttctcaaggaccaaaggctggtaatgactcgatgattgggtctccaaataaagaacaaggatcacctcacgctcagctaggaacatcctcaggtaactcatcttctcaagtgataccgatttaaataactccagtttatttgcctaatgtcttggaaatacatcaggaccaccgggcgatggcgaagaagaaattccccgcataaaggcggctgatgattctcgtcctcctatcttgctcaaatggtgggatgagaactcacaggttgccggcatcgtcataaaccgtcaaaaagaagatgaggaagtgtgccagctgaagaaggcgcttggagaaactactcgcattgtgaatgtaaatatttcaggcgactgcctttgatgactttgttttctttttagctgaactaaaccatgaaccatcatgcagagaatccatcttcgtaatgaagccaagaccgcaactttggagaagctggttcctcatttgggaactcttgaagcagttagggaccagctacacgaggccaaggagctcgccaaaaagacggaaaaagaattaagggagcaaattgctcagctccaggattcaaacttcgagctgagtggttcgtcaaaaggtaatcttctagacctgtcccattaatctatgctgtcataactatatcctcaaccatttggatttcgaacagcgcaagccaccaggatggttcaaatggagaaacaaattgaagccttgaaaaaagacaaagtagaactggctgcgcaaagggattcggccttgaaggaggttgaaggtactgccagctagcaatctggacgtctctcttttaaatgcagcagattcttatcataaatgtgttttgtagatcgtaaaatcaaatctcaagctcagtttgacgtcctggttagtaagatcaagaggcttgaaggagcaagagatgaagtcgccaatgtcgctataccactcgtccaagctatgttcctcaataacagtggtccgagtgcactcgacgcaaccgaaattttcgacaagctgagagttgctccggatgtatatttcaagaacatcaagaaagctggaagtatgggagctggcatggcattagcgatgaccaaatccttgt

SEQ ID NO: 76706 - DNA, 9353 bp, Oryza sativa
tgagcataaatgtaacaaatggaggctcaatttgtacaatactggtgtatttatgctgtgcttgataactctagccaagtctttgatttcttaaaagcttttatcaagctctgttgagcctaaaacccaaagaagctattaaaaactttcagtcctcgcaaactaagtagaaaaatcgaacaaggcaatgaaaaaccaagtaggcaaattgaattgataaaaaatcacactctattattatgatgatagcccccgactgacaacttcgaggagaaaacttgatgttgacagtcaagacagggaagtacaatgataagcctaagcgtagaaacgacgaagatgttcaatgttccaagagttgtcgacgagagtaccgtcttcgcgcttgagtcgataggaacctggccgggtgacttcagagatgataaatggcccctcccatagaggagataacttgtgccgatcccgtgtagtttgaattttccgcaaaaccagatcgccgactaaaaaggcgcgggatcgaacattgcgattatgataacgtcgcagcccttgtaagtatcgagccgactgaatcaaagccgcttcgcggacttcttccaatcggtgcaagtcatccactcggtcctcttcgtagcgttcttcacggaaatttcgaaagcgcaaagactcgaattcaacttcactcggcaacattgcttctgccccataaacaaggaaaaaaggtgactggcctgtggcccgactgggtgtagttcgcaaagaccaaagtactgatgacagctgtttcacccatttgccggcataaggttttagccggtcaaaaacacgcactttaatcccttgaagtatcatgccattggctcgctccacctgtccattgctcatgggatgcgccactgaagcatagcaaatcttaattccaaagtcttcacaaaagtctttaaaaactccgcccgtgaattgtctgccattatcagtgatgatccgattgggcactccaaatctatgcacaatgttgatgaagaagtctcgagcgttatctgctgtgattgtgacaactggtttagcttcaatccacttggagaatttgtcgatggctacaaagaggtgcgtgtaaccaccgactgcctttttaaacgggccaaccatgtcgagcccccaaaccgcaaacggccaagacagtgggatggtctgcaacccttgagctggtagatgaatttgtctggcaaaaaattggcaaccttcgcacgtgcgcacaattttgtcggcgtcggacacggcagtaggccaaaagaaaccctgcaggtaagccttgccgacaatggtgcgtgcggcagcatggtttccgcatatcccagaatgtatgtcttttagcaattgtctcccttcctctaaagatacgcagcgttgcagaatccctgaagggcttttcttgtacaactcagcttcatgcataacataaagtttgctccgcctcgaaatccgctcggcctcatctttgtcttgggggagttcttgagaagtcaaaaatcgtatgaggggctctcgccagtcggcttcaaccataactacgtcatgaatgcccgcaacttgagtagtatctttgtgaggtaccgtcggcgtataaaggtgttcgacgaaaacatcagagggtgccgcctcgcgtttggatccaaagttggcaagtctgtcggcggcttcattattgtgtcgaagaacatgactgagctagagtccatcgaacttgtcttccaatttgcgtacctctggtcgatatgccatcatgttgtcgtcaaggcaggaccactctttcataacttggttgacgaccagctgtgaatcgcctcgaagtattagacgctttatccctagggaaattgcaattcgcagcacatgaaggagggcctcatactcggcgacgttgtgggacgccgaaaaatgtatccaaagcacatagcttaatctttctccagttggggaaatcaaaaccactcctgctccaatgcccgaaagtcgttttgacccgtcaaaatgcatggtccagtgctccatcttctccgcgggggtatcctcctggcactcggtccattcggcgacaaaatcagctaacacttgggacttgattgaaattcggggcttgaatgatatgtccaaagacatcaactccaaggcccacttagcaatacgtccgtttgcttcgcggttgtgcagtatatcaccgagtggaaatgatgtgaccaccgttaccgagtgaccttgaaagtagtgagacagcttcctggtagtaattagaataccatataacagcttctgaacctgagggtacctcgttttggagttggctaggacctcgctgacaaagtaagtcggtcgctggactttctggacatggccttcttcctcgcgctcaacgaccaagactgtgctcacaacctgggaggtggctgatacatacagcaacaacggctcctgcggatgtggtgaagctaagactggtggctcggtgaggagtttcttgaaatcttcgaaggccttctgtgcttcgggtccccactggaaatcatctgttttcttcagtagcttaaagaagggcatcccccgctcaccaagtcttgaaacaaatcggctgagcgccgccatgcatccagtcaacttctgaacatctttctgggtgcttggcggtttcatgttgaggatagcagtaactttctccgggttggcttggatgcccctatgagacaccataaaaccaagcagcttccctgacggtactccgaaggtgcacttttcagggtttaatttcatcctgaaagcgcgaatgctcgcgaaggtttcttctagatccgagatcaaatcatcctttttcttggtcttgacaactacatcatccacataggcttcaacgttgcggccgatctgcgttgagaagcatctctggatcatacgttgataagttgctcctgcgttttttagtccgaacggcatggtgacgtagcagtatgctccaaagggcgtgatgaatgaagtcttcaagcagtcggattccttcagtcggatctgatgataccccgagtagcagtccaaaaaactgagaagctcacagccggcggtcgagtcgactacctggtcaatgcgaggcaacccaaaaggatctttagggcaagatttgttgaggtcagtataatcaacacacatgcgccattgccccgttttcttccgtactagaaccgggtttgccagccagtcgggatgaaggacttctttaatgaagcctgccgctaacagcttggttaattcctccttgatcgcgtccttcctgtcttgcgcaaatcggcggagtcgttgtttgataggctgggcatcttctttgacatgtaaggagtgctcaatcacctctctaggaataccgggcatatcagatggtttccatgcaaagatatctttattgttctgaagaaaggtgatgagcgcgctttcctatttacaatctaactcggcgcctattacagcagttttagtagaatcagagggatctaggggaatctttttagtcttagcttcgctttctccgctttttgaagtcttggtagcgggcatttctccttcgctcgtcgtggctgcagccagtcggatatcctctcgggcagacgctatctcgcgggtttgggccatgtcgcaactctccttgtcgcatgtgacggcttgcttgatgtcgctccgtagggataggactcctcggggaccaggcatcttcatcatcatgtaagtgtagtgcgggacggccataaacttggctaacgccgggcgtccgagtatggcgtggtatgctgtctcgaaatcggcaacttcaaagctgatattctctgtgcggaagttttcccgagttccaaaagtgaccgggagggtgatctggccgagtggagttgcggataatcctggaattactccgtgaaaaggtgcattgctgggttttagctcggagcgaggaatctgcatatcatccaaggtcttggcgaagaggatattgagtgcactgccaccgtcgatgagggttctgcgaagcttgacattacggaccactgggtctagtaccagggggtaccgccccgggtggaccactcggtcaggatgatccgagcggtcaaacttgattgcaatctctgaccatcgaaggtactggggcgtgtcgggctgaacagcattgatctcccgttcggtcaacttttgcttccgtttagactcataagccaaggggccaccgaagatatggttgagctccttgcggtggtcttgaaatcctgccggggcgtcgccgtcgtccttcttcctcgacgtgctttgttcttcgtcggagttcttccgtgtagtcttggtgtattgatccgcgaattgcttgtagacgaaacaatctttggccacgtggttggagttaggatggtgcgggcattgggagttcatgatcttgtcgaacgtgttgacgcgcgagcgctgtcgagaagagtgactggcggttgcaacaagttccgcaggcttacgcttgcggtccttatgattgttacttccacctcctcccgtagccggcgtacccttatttggcttccaactaggacccgactgctttgatgcggtgacggcgtcttcagctttggcgtactcgttggctttttcaaacataagcttgactgtcctaggaggtttacgcccgaacttgccaaccaattcttcgtggcgaatccctttggtgaaagcggcgatgataacgtcgtcggtgatgtcggagatcttattacgttgttcagaaaatcgccggatgtaatctctgagggattctccggacttctgaataacgttgtagaggtcgtattgtgtgccgggacgctcgaaggtgccttggaagttggcgatgaagtggtcgcgtaattcggcccaagatccgattgtaccacggggtaatccatggagccaagatcgggcggaatccgctaaagccactggtagatagttcgccatggccttgctgtctcctcctgctgcgcggattgcaagaccgtagacggtaagccacgattctgggttagtggtaccgtcgtacttctctattccagtcggcttgaagccggctggccaatccactcgacgcagatcgtcggtgaaggctgctactccgtcaaggtcgtcgtcgtggcggtccggcgaatgatgatggcctcgagctgctcggcgctgtatgatcgtgtcgcgaagatcgacggggcggcgacgaggtggtgagcgaggccgttccactcggcgctccccatgatggtcgggaggtgagtgaacggaccgcccgtcgtgacccttgctcctgcgattggatcctgcgccggtgatgctgaggcttggatgacggtagtcatgagatcggaagtggggaactcggctgccagtcggcgtgtggacgctttcggagttaactgggaccgaagccgcaatcatggtcttcgtctggttcaagatgttgacgacgtgatcagattgattgagctcgttttccttgaggagggtgtcgaggagggtgatcgcggcaaccgcattctgctgaggggtgcggaaaaccggtgtcccttcaacatcttgttggccgatgagatcacgcgctcggcgccctgcttccaaagctcgctgtcgtcgatcttcagcctccttcgcggtccgctcacgctcctgctgctcacgccgtaaccgttcttgttcttgtgcttgacgctcctcctccagtcggagacgctcagcctcgcgacgtgcttcggtctcccgggcttggcgttgctcctccgtctcgttatcggccatgaagacgccgaagtagagaggggtgtagttgtcatctaggctttcgtcgaagtcgtcgagatccggttcgttgtagcgagagctaaactcgtcgtactccacgatgtctgtggggcgcgagtcgacggtgggagagctgtagtggccgtccaactgatccgtcgaaaccgtgccgagtggttggaggatgacgccgacttccctgaagctaggcgaaatcggcgttgaagccgacttccgcctaggcctacgggatgaagacgctgtcgtgatgggggcggccgccgaatcgtcggggagcttcattaggatcggtgggtaagccccatcatcttgatctggtgtcgttggggaagatgcgatttcgcccgagtggtttgaagccaactcgattgagatggtcttgaagtaactttcggccgcgtttgggagtccaaacgggaccgaaagccggttctctcccgactgggccgacaccgagtcaaggagagagatcttgccgaagttgttggtgacgaagtcgaggctgccgaaccgaaacgtctgcccgggtgggaagacgaggtcgtcgatgccggagacggaacccattgcactgatcggcgaaaagcttgacgctacccctacctggcgcgccaactgtcgaaactagatttcggcaatagtaaaagggggtggctatcaagctagaaaagtgtatgggtttggagacaaaggatttatacaggttcaggccttcttattcaagaagtaataccctactcctgtccggggatggatccgccgagtgtattattgattgtatgattgggagaaaatcaacctatgccccaagaggcacccggaccctccttatatatgggaaggagtccgtgttaaaaaagataatctatatccctaacggaatatgcagatacaggtaaaatacagtcgtaaccgactaagtctcaaggtgtttccttgatgtacaagttaagaaacgaacccgagatacaaataagatattctatatatattcggtatcctatatccagtccaaatatcctcgccgtgtagatatgggatatccataatctccacaggccttttgctctaatagtagattgaattgtttttgaaggaacagaaactattccgttacatattcataattataggaacagggagattagcttctgttgcatgcgtatacatatttatgttatgcagattagcttctaccatatttttagcctgttttttcatttgccggctagtatatatcttctgtcggccaggagcagaaaatcaattccaaaaagaacagaacatcagttagttaggagcagaaaatcaatttgaaaagagcataacatcaacaattgcatgtgctgcccgtttatatacaacatatcaccaaacagtgctcactttcaaacgaaattaataataaaaatattggtttgagagcagaacatattctgcctccttataagtagatcgagtttgttttgaaagaacagaaggtattcttctttcttcttgccaaagcttcctataagtaaacggactttgttttttgagcagaagatatatattctgctttcttgtttctagaaacagagataatttcaggtacaaaattcaaatctctttctgctccctttctaaccgatgttctgctcctttggtagtttctgctgattttcaagttttggatcaaggagcagaacttaccgatgatgagatttaattagacgaggagaagttgaatatgtactacttatctaagtacgtacacagcagaaactatacccagcagaaactcggttatgcagaatatgtactacttatctaagtacgtatagatgacatacagtatgttagtaatcaaccgacagaacatgtactgccatcaaaaacagatacggagaaaaaaattaggtggctgttctgctaatttttttaagttgatgttctgtcattctttttaattcatgctctgccattttttctgttggccggctaatatatatgttccaccggcacgagcagaagataatatgccaggacgagcgggtgcgaggaagaaactgcatccgagaagttggtttgcatgcagccgatgatttagcaactatctgaactaacaaactatttaattaaacaacacaggtattcatcgttattggatcctcgtcactccattaactgaatccgatccataataggagggagtaactactctcggtagtaggaaataggctatatatatatatatatattagaaaaactattctacacccggggtatagaatagctattctatacctccctcccaccaacccacctcctctccccccaagggcccaaaacccacctcccacctcggtcaaaggccagtcaaaggtctctcacgtcggtcaattctaggtcaaacccgtcggtgactttccccacgaccctctctcttcttagctctcgtctcggaatgacgtagtaacgtgttgttcatcgtgtagtaacatagtgttttacttgcagtaacaaaattaaaatttactcataatatacttatgatggatctacttttggtaagcaattttttttgaacatcatggtgcaaacggtttttaaaaatagtacatggtgtgagagatattacccttcaaagatttgtttttgaagatttaactctccacaagtagtaatactatatcaaaagttttactactgcctgttttgcgttactgcaatcacatcatgtcattactacaagatgtagtaacgattataattttcacgtaacatagtgtcttactgtaattacttgataacgttactgcaagactataagttttgcagcaataaagcgtctaactacattttttgagtagtgttactgcataaacacgtggtaacgtgtaattgtcgtgcagtaatacttttacttttgtgcagacttttgtgcagtgacaagtgtatgattagcatctgagacttttaacccatatatttttgtttcaattcctgaattactgcaattcaccacaatattacggtcaaaagtgcaataacgtcatatacatgcagtaacgttatattggagggaggaaaccaattttcttgagaagagggaggaaaaacggttcttgaggaggggagtacgtagatgctttttgaagtttaatcctccacatgcagtaacacgataacatcatggtggaaacggttttaaaaaataatacatatcttatgacatattgcttttcaaagattgacattttgaactttagccctccacatgcagtaacagaatgtgtaatttacagtaataggggtttatacatgcagtaacatggttttaccaaatgtataaaattattcaaaatacttctacatcaatcagaccttgcttaaagccacctacaaactttatctatggcccacctattcgaacttcatctcgtaaaaatgacatagtaacactgcatttatcatgcagtaacatatctacttggaagtggtacatgcac

SEQ ID NO: 76707 - DNA, 9058 bp, Oryza sativa
tattatgaagtacggcttctactttttgtgtagtaccaagtatatggttagcatgtgaggctttaactcatatatttttatttcaattcctagtttatgtagtaatactatccaagaaaatgcaagacactttgttactgcaaagcttattgtctttactagactcttatggtaacgttgtgatagaaatgtagtaacgtacagtagtaacaagtaatgctattgtattattacttgtggagagtcaaattctaaaaagaaaagcttttaagaacaatatctctgatgtcatgtatggttttttaaaattgtttgcaccatgatgctagaaaaaaaatgcttatcaaaagtacatccatcatgactatatttcaattatatttgagcgttgttactgcacgtaaaacacagtgttacgagacggtgaccgccgcgttactgcacagtttcgcgaaacgagagctaagaagaggtgggtggtgaggggagttagtaggtgggtttgactgagctttgaccggcgggagggagctttaaccggcgtttgaccgaggttggaggtggtttttgggccttagaatggagggggaggtgggtgtggcccttgagagcgaggtgtacaatagtcttaccctatatatattacatatatattacgcacatatatatatggaatacatatatatatatatatgcatatgtataaatacatatacatgcatgtatagtacaattcatttgctcactagctagctatgacttcgacgccggcgttatgtcaaaagaagaaagaccgacgttatgaattgtcgatccgtcgtagtagaattcaccctcgggattaaggacttcttcgttgatgaatctcatcagttgttcctgaacaactgtgatagaatctttgtgtgggagattgtccctgatgtgaatacactatcattcgaaaaataatgacatatgaatatatgaaattaataaacaacaaatcgatacgcaatgaaattttgaatggtttatatatacgtacatcgagctctcgtgtggtgtagatttgggttgataggaagtgggcatactcgcatacgtagtagccgcacaggttagttccctggtcatgctttgcacattacatgagaaaggacaagagatttaatatacacttacattaactgtaactagtaatcatatataattagcatatgcatgatttaaaattgttaaaaattctaattatcatatgtaaataccacatgcatgatttaaaaatgttaaaagttctaataatcatatataactagcatatgcaaaatttaaaattgttaaaaattctaataatcatatgtaaataccacatacatgatttaaaattgttaaaaattctaataatcatatgtaaataccacatgaatgatttaaaattcttaaaaattctaataatcatatataataagcatatgcaggagttaaaacttttaaaattctaattatcatatataactagcatatgcatgatttaaaattttaaaaattctaataatcatacataattaacatatgccgtacaacaattgatttatatggatattcaatacatccaaaatattttacatcgtgtacacaacaattacggcaatacatcggcggtgacggttgaccgcacgtacttcctcctcactattgttccttccttatgatcgctacgtgagtaaggggtgtcttcgtttgataggaggatgctagggtcaaccgtcaccgtgaaagggggttgcccatcaaactgatcataatcttcatcagtcttgtcctcaactccgatgatttttcttttgcctgggagaaccacgtggcacttcggctcatcaggccctttgcccttctttcctttgctagacatgtccttcacataaaaaacttgcgttacatcattggcaaggacaaaagattcgtccgagtatcgaaccttgttaaggtcaaccgttgtcatcccactgtcatcaatcgttacgcctccaccaatcagccaaactcattggcaccggaacagaggaaccttgagaggtccatagacaagttcccatatgtcctcgatggcaccgtaatacgtgtcagttgtaccatcgtgtcccatggcatcgatacgaacagcactgttctggttcgtgctctttatgtcttggtttctcgtgtagaatgtgtacccatttatctcatatccttggaatgttgcgatcgagccagatggtcccctcgccaggaaggccagttgttggttaatcgtctcgttacccatgagatgttgtcgcagccacacggggaaagtatcaatgtgatgccgtgtaatccatgcatcggatttaccgatgtttctggcgcgaactagagccaagtgctccttgatgtagggagccaccaatgaagattgttgcagaaccgtgaaatgggctttacggaataaattgttgtctaccatcattattgctttccttctgagagtcccctttccccgtagtctcccttcatggcgtgattcaggtatcccgattgggcgaaggtcttcgataaattctacgcagaattcaatgacctcctatgttccataccccttggcgatgcttgtctctggacgagcacggttacgaacatacttcttcagaacgcccatgtacctctcgaaaggaaacatgttgtgtaggtacacaggcccgagaataccaatctctttgacaaggtgacaaagcagatgcgtcattatattgaaaaatgaaggtggaaatatcaactcaaagctgacaagacattgcaccatattattctgaagggcttctaatctatccggatcgatgaccttctgcaaaattgcgttcatgaaagcacatagctttgttattgttgaccggacattgtctggaaggaaaccccttattataactggtagcagctgtgtcatcaacacgtgacagtcatgagactttaggtttgtgaacttcttctccttcgtgcttattattcgctttatattcgtggagtatcctgatggtaccttgatgctttccaagcattcaaacatactgtttacacccaaatttggcatctgtggacgaaatagggaaaaattgccaaagtttggaaagtaacgggtttccttactcgggaaggcaggtttagtgtttcctttggtttctatcccgagttggatgtggagaagggcctatagagggtaagaccaacccctatataagggacaaggccggttcattgtaaaacccccgaatacaatctacttgaatcgttcttttactatgtcttctattttaccctagtttagtccatctttgtcggtttgcgccgtaaaccgtccgccgccgctacgagagtgcgacacctctttgtatgtttgtcctgaaaaccttccgttttgcccacgagacgggtagttatcctcatatcgatctaaatcggcctagaggctgattttgatctctaaatcggctccgctagccggtttaggttttgtttctacaaaacccatcttgatttggccctttggctagatcgaggtggttggcgactccatatcaccgcaaggcatttaggtgttgtgatcgtgcttgtcgacttgtcaaaaaaattaccaacacgatttttggcgactccactaaggaacgatctaatcggccatatcacggctgaatttcgtttaatacagtagttttcgtcaaattgagagtttgggctaaacagccgagatcaatctgtacaacttatcgctgctgctacgaagttttcctcggatcagtatattcgacggcggtactgtttggtcaccaagtggaattaatctacatagctcagccgacgctatttggtttcatctgccgcagtcagccggcgtcgccgttgtctgtgttgaggccgatcgattcaatcggtttgggagcagtacgctgtccttctattttgctgtgcacggctgaaattttgagtcttcgtcctattcggtttgctatatacaaattcctaaaaacagaagaaatcaggctatcaaagccgatctgccactgcccacataccgaaaatcaggctattagagccgatttacctagaataagacaaaaccaaatcggtttctgttattgtgcattaggcaactgttaccgagaaaaaaaaaagggatcgaagccgattcatattgtttcggctgttattgtgagacatcgattttctgaatttttgcctacacacgagacagaaacagttctgttcttgctgcacgctgttaccgaaaaaaaaaatcaaatcaaagccgttgcagtgcatcggctgttattgtggaacatcaatttccaaatatttgctagctatacacacagtagcataccgaggaagttaagaccgtatattaatttattcggtcaaatatttcggctattagctatatggccggatttaatcaagaaatgtcttcatcaactattacgagcgggaacgggttaaacaatgttactacacaatacttcaggaccgatcaaggcgtcgtgagaggaaacgtcccgctacctcaagttgtaatttcaccaaaggtaaccttcgtttcgcctaacccgtcctttgctattcaaaacgttaataatcattgtgtagatgcatatgctacttctagttttgctcctatacaatatgcttataatgctacgggggagtcaatggatgattatacggccaattacacagaaatcggctataggcaaaacctagataacggtatgactggtcatggtaccggtttaaccacatcttatgccggtcagaccgtgcccaccatggccgatcagaccgtgtactacgccggtcagaccgtgcccaccatagccggtcagaccgtgatctatcctggccagatcgcgcctcatgtggccggtgtgaccggttccctggaaatttctccaggttttcataccatgactagcagtattgattttaattattattcatcacctgttaatactgttagtcatactactccacatatccctaatgcttacaatgattctaatagaagatattctcctgatactaggtatggccaatataacaatattgcgccacaaacacaacctattaggccaccaagtccaccaccagatccaccaaggcctgaaactgtggagaattggtttagaaatattatcagggagaatttagcaaagctaaggaatcgctctagggactaccgaaagccgtatcctgattattatgacattttcccatatcctcgtgattataaaattcctgaatttaccaagtttagtggtgaggatagtaggactacatgcgagcatgtagatcaattcttagcacaatgtggtaggttaaaagtgatatttttaaattgcgcttgttttctttatctttgtccggtactgcttttacatggtttacttctttaccggcaaattctattgatacttgggctcaattagaacaaaaatttcatgattattttcacactaataaaactgagcttaagttatctgatttaacatcggttaggcatgaatacaatgaatctgttgctgattatattgaaaggtttagagatgttaaaagccgatgttttagtttgaaaataactgataaagatttggccaacattgcatatgatggattgcttgattctattaaagagaaattgaatggccagatatttcttgatattgatcatgtgttgcatgaagctctggctcaggaaagccgagtggatggcaatagcttacaagctagtttagatgaaaatgcaatatcatgtatagccgaaccaagcgatggttcggattgtgttaatgatttgtgcaatgatgcaacaaccattatagccgaaccaagcgacggttcggattgtgttacttgtttagacaccgatggaatagccgaaccaagtaatggtttagattgtgttgctagcttagagagtaacatcattgaaaatatagccgaactaagtgacggttcggattgtattacaagcggaagtgaaatagcattgtcacctaagaccgaatcacaaatcggtcatgtggatattggaaaagataatgacaatgtcttgtgggatagtggtgaaatagaatccaaagtagctatgcatacatatcaaaggccgtatcctgaacatgtagattcggtcccatacccgcaaggatttgaggtgcccaacttcacgaaattcacaggtgagaatgctatgactacaatggagcatatcggccgctttattgattaatgtggtaaagccggtagcgatgatttgcttaagttgaagttgtttcccctttctttgtcaaactttgcatctacatggtatagtttacttgctcctaattcaatttctacatggtcacaaatggagcatgagtttcatgattatttcaaagatgcaagcttgatggagcaaagaccgattgatacttcatcggtcacttgtgaaacgatttcggttacatctatgtctaagatcggaattgttagtaatcctctccctattagtcctattgatgttaacaaaaagaaagggaaaagtgttattattggggatcctcggcccaagactaggatcaataatgcgaaggccgaagatcataaagttgcaaaggatgagtcatctagtttgcaaaggaccaaaaagccgaagctcacttttgagatgcttatggctaagtacgagaaaggattagcgggtcaacgatttgataatcaaactagtgattcaaaaataccaagatcatctcgtaggaagagatttggtcaaacaccaaagcaattggagccatcaactataccaactccatgcaaacctccgattgtgatgccatggtatccatatccaatgtcactatatggttatccttttatgtattatatgccatggatgcctcaaccacctatgctgtgtcatcaaggatggaagcaatcacctaggacggtaccaagtcattctaactcaagacaagaccgtttcccacgaaagaatcggtccggtggatcaaaggtgaaaaaggtgaagaaggtgtgggtgagaaaagaagacaaagctccggaggtcgttgctatcaaggagaaatctcaggatattcaagtacctactgaagatgcggcgaaaactatacaagcggagaagactgaagccgacgccgttgctgtcgacattggcagtctgaccgagccagccggccggtctaaccgccagactacggccggtctgaccgacccttctagccggtctgaccgacggcttgtggccggtctgatcgggcccaaaggccggtttgaccgggcggcattggataagagtgggaaaattgagagcaacataggagcttccacttcgaccaaaaatatgaagaataattgcttagctcctggaaaacaactacagccgaagtggataccttctggcttatctcgctctcaaaagaggaggctacaacgtcttcgggccataggtaagaaagaaaaggaggccgaagatgtggagaacaagacatgcaataatttagagtctcgaacagcacctagacaagtgtggagacccaaagaggtaaaagttaagagaccggtgatttcccatagaagtaacaaatccaatttgatgagagaagaatcatcggtcattagagataagtctccttcacatgatgctatgggtgttagtgcggtattcgtcttgccttcgaaatcgcacaatctagaaagccgattttgcttggggggcaagacatcaatatgctcatgagggaaccaagggaagatgaacggcgatggatacaacatcacatctttgagccgccgtttgttggatgctaaggcaaggtatgagtttattgtgtttaacattatattatatgcatatgccatgttattagaacattgcttgctatctagcacatgtgtgtttttgcttatcaaattgatattatacatacatgttgcaaatgccaattctaggtagtagaattggtaggttggcatataatttgtttgaagtatgatttggctcatgactctttgatatttatttaaagccaaatcatatgtgtttttatgaatcaccatataagatatagatttcatatttattgcaccatgaaagttttgcttactagtaattcggctaatgtcaatggtcaatgtgatgatttgctctagagtggttttctttaggaacattggcattgttaatattttgcatacatgctcaagccgattacttacatttttagtttattggaatctatgcatgtgacacatatgactttgatgatttattattgatcatacttcaattggctaagtgttgtgatgccatgatgattattttttcaaaagccaattgaattagtattcatctagacatattagttggatattatgatttttcatatgtctagaaaggagttttggttcaataatttgatataccaagcatctggctattatgtgaagaaaaatttatatactaaaagccgatgcttgatttcaaaagtttggacgaaattggcaaagtcatagaccaggggcggtctgactagcattgcacggccggtctgaccggtggtagccagcggtctgaccggctctgcatggccggtctgacagggcagacagggtggtctgaccggcattgcgtggccggtctgaccgatctcgggcagagagctgggggcacgttacaattgattaaaaggccaaattaattatgaattcggacatttgtgctcatgagttagaaatagcttggagaattcctttgattaaatatttgaaagatcctacacttaaggttgatcggaagattcggcggcaagtgctcaaatattatatcgccgaaaaatagatatagtattacttagataatgatcaatctaaagttgctaggagagtagtacatgaagggatttgtgaaattcatcaatatgcccgtaagataaattggttgcttaggagagtggggttttattggctgaaaataattgatgattgtttcaaatgctatagagagatt

SEQ ID NO: 76708 - DNA, 641 bp, Oryza sativa
agttgtaagttccatagtcttgaccataaggcttgtgtgggtgatactggaaagctgatgactctaactcctcatcaaagcgatgacgtagctctccaatggccaccaaggctgcttcctgacaagcatggctgtactttcttcccccagcttcaaactttatcgacggaaggtcttcacgatcactagtcaacgtcacgcgaacacgacacttctcctcattggggtcatagggaatctggcaatactcgggggcaacctcgtaacctacttcaaatgccatcattctcagctccctgacgaatcctagcacctcgatcaagtttttcggcggatggggcggcatataaaggaacattgaaaggaaggaattaatgcatatttttaagttagctgcacaaactagacttaattaaattggacccaaagaaaaagaaaataaaagaaaaggagcaaacatgactcaatttttttttctttttggaacataaatcaaccttgaacagagacaaataacttttgacaaatgaataaattaaaactaaaatatttaggatctaccaggagcacggtacagagtcaccattaacagggatgagtagtactgatgccatcttgattgaatcgataccataatagat

SEQ ID NO: 76709 - DNA, 1216 bp, Oryza sativa
aacttcgaccctcgagtatcctgctggaatcggcctgcagtggtaagtccctgaagggtcagttgggatggccattcctgatgccaccttcacgtgatgagaggttatctattagtaatcaaccgaagcagcaacttgcggaatgtacaagtcaaaaatcataaaactatgagcataccttgactgataagttcttgaaggaaatatgtagctcacatggtgtccgctacgtgatctcatcaacggggcaagtggtttcatcctgagtttgcatggagtccatgctctgtgatcctacctgccccgttgaggctgtcacgccctaaagttcccctccttgcttaaaaattcataaaataaatcgtccgaagaaattgtttaatttaacctagagttgaatccctaaactaataaatgcaaataataatcagaatcggcatgtggaatttttcttggattctacatgtcaaaatatgctaacaggaattttagtagaattttcagagccttagaaataattttaaccaattaaaataagcaaagtgcaatattaaatccctgggaaaatcctttttcctttttatcttttcttttccctcctttttccttttcttgggccgtcggtccattccttcccacaccagcccgcttctcctcccttccccgaagtcctccctccctcctctctccttcgggcgctgacaggtggggcccacctgtcggtcgtctcctacctccggtcgttggagccgcagctccaaccgcccgcaccgccggtgccccacctcctccactcgccccacgtcgtcaagcccacgtcgccgcccccttccccacgccttcccgccccgcgcgcgcggcccgagagggcgggattcggttttgaatccgtctctctctctctctcccccccacgtcgccggccgaatcgggggggtttcccggccgtgtccgcccctcccgagcccctataaagcttccccgcatccccctctcccttttccccttttcaccgcgctctcgcacgccctctaccgcacccgcgccgatctcctctagcgccgccgctcgccgccgtgctccggccgcacgccgccaccgctagagccaccgccgccgttagcttctccgccgccaaagctacctcggccgccgcatccccatccaatcccgctgccggaacgcctctctctccgtgcaccggtgagtttcgccg

SEQ ID NO: 76710 - DNA, 12798 bp, Oryza sativa
  unsure (1)..(12798): unsure at all n locations
atagggcgaattcgagctcggtaccccgggtcatcgccgccgccttcatccttcgggccggccgccgtgctcgccgctgatgatcccctctcctcccttttcccctctctcccatgtgcaccgccgcctttgcgccggtcaccgccgttgtttcccgcctcccgtccgcgtcatcgccgctcgccatgggggccggccggcttgaagccgagccgagaccggccggtgccaccccttcccctgagccactgcctggtgggacccacccgccaggtcacctcctcctcctcttgtgtcactgacccgttgggcccgcttgtcggcgccgcccctcccggataacttcagccctgggatcctttattgcgcaataaaactcattaaggcttttcttttatagtaataaacacagagaatcttctaaaaatcataactaattcatctgagctccgattaagtccattcaagtctcagtaaattcatacaaatgcatagaatccattaaaaatggttttgtttcctgtttcagtagacttatagcttgttttgcttgtgtgctttgtttgtcgcgtagatttcggccgtttcgtcgatccgtggttcctcgaagacattgctgtggttccatcagtacgagagcaaggcaagtcatgcattacgattgatcatattgtacccaatttataaatgtcccgcatttctattaaatgttgcattgttttacaatgtcatgtgggatgggtcctgctactcagccatatattgtttaccttatgtcattgataactggggtatcaaaatgattagatgttggcttaggaaatgcttagccatgcttagttcaactagtacacaaaaggggaattacattcaagcatagactttgattattggcatagctttggattagtgccaccgcaatggtgttggttaattaaaatacactacatggtgggctgtgggtgcatggttttgctagttgtgcccatggcaattaaggactggttcgcgggatgccctggaagaacttaccgtacttaccacaagccagcgtgggcaacggctgggcttgtagtgtagctttcctctagccgacgtacccaggcgagggtgggagtgatggagttgggtcggccggggtgtccggtttatcggcttccggattcaccgcggcacgaaaggggggctgcccgttgcctgctggggacgggggcgaaccctaaggtgtggtgcgatcggttagagggggttatgcgaagggttctgtcacggcctctttccagtatgtcgtggtggcatgtcggcgcatgggaacgtgtcgtgtggctgtgtcttgtgggtacagttgtacacctctgatcagagtaaaactattcgaatagccgtgcccgcggttatgggcggtcgaccagattcaccgtgattagtctcacccctagttagctaatgaactggtgtagttcaggtggttggttgggcctgttgcaacgtggtatagcgttggacagtgattggttaatattgattaattgctacaactgttttactgctttcaactaccgcttttaaatgctagctttatgcaaaagaacctttagcctccttggatatatcctgcatcataccttctcttctggtatgacttgttgagtacagtgggtagtactcagtcttgctctcttttcccccaccctagagttgaagttcttttcagttgaagatgtctcgaagaagttggtttcgtcgctgccgtcaaggatgcctgtggaatggagtcgcccgctgcagaagtcaagtcttcaggcttagctcgttttttttctttcttttccgctgcatttgtaaacttttatatttttgtaagacgtggatctgtatgtcaacaattgtcgtttaatgcacattcagcttagaaattttggttcgtgaatttctgggtgtgacagaggcacagctgctacgattgcctcaggggctgattattacatgaggaatgtacggctggggatcgtggcaccgatgtgcggccatgcgttcatccactttccttgccacctcctcttgcatgctgagctcgtagctcgataccctataatcaagatctgcaatctttgcctcggtatctatcttgctcctcatacgacttctgtacatgtggatgtgcttcttgaatccaatatttgaaggaaccacgccttttcctcgngttcgacctggatgctcgggaatctgcagggcgagtgacagctcgtgcttctctctgtcaggtcggaacgttccctgagaagacgcttccactgcgtccgttagtcgactggcagcctcacgtatttgatcggtgaacaccagggagacaacaacggggttaagcgttccaccgtgagcatagtaccagaacttcgatcgatccggccatttagcggtgaccggttcgatacccctctcaatcaagcttgcttccatctcctcccactttggcactgcgacgctatagccgcctgacccaggtggtgatggtacttcttcttgggggcattttcatatattaatactttaataggcatatattaatactttaatagccatatattaatactttaataatcatatattagaaatcaaataatcatatatgctaagtctatgtttcgtatattaaaactctaataatcttatattaaaactctaataatcatatatgataagtctaataatcatatatgctaagtctaataatcatatattgatactctaataatcatatattagaactctaataatcatatatgttcagtctaagtttcgtatattaaaactctaataatcttatattaaaactctaataattaatatatgctatgtctaataatcatatgtggtaactctagataatcatatctttacatcacttgcctgcgcaaattcctccgagggctagctaccacttcggcttgagggacgacgacgacatattttctgcaacatgcaaaaaaaatgtattagccgaaatgcaaaggaacatatatttttcgttcacgttttcaagtatataatcatatatgctaagtctaataatcgtttaattttctcgttcgtacacgtctcgttcgcgttcgttcacacgtttcgttcacgttcgttcgcgttcgttcgcattcgttcacgtccgttcacttccgttcgcgttcgttcccattcggcattgatggggcggcaccgaaaaggagcggcggtggcgtgccgcagcgggggcggcggcatggcaaggcgcggcagtggcggcggcgttgttggcagtgacggcgcatcgcggggtcggcgtcgacggggttggcgtacgtcgtcgacagtgccggccgggtcgacgtcggggttggcatcggcgggaggcggagtcggggtcggcatcggcgtggcacggcggtgtcgcaacgacgacgacgacgaggcggcggcggtttggagagagagagatcgagaaggcggcggcggcgacgacgacgacagcgagacgacggtgagagacgacagtggcgtcggcgcgtgggatgccctaggcagtggcggtgaaggagaagccgagatcggagaaaaacttctaagtgctggtggagaagacaagtgcgcctcgagcatatcggatctttagtcctagttgattttttcccgcgattgccaaattcttttttaacccggttagggttaagaacctggactaaagataatagcactacatatttaatttcattatgtatgggtttctaaaatagtaaataatgatttcacgtcacaaaattaatgacaaaaccttaaaaatatattaagtggataagcatatgcatgatttaaaattgttaaaaattctaataatcatatctaattagcatatgcatgatttaaaattgttaaaaattctaattatcatatgtaaataccacatgcatgatttaaaattgttaaaaattctaataatcatatataactagcatatgcataatttaaaattgttaaaaattctaataatcatatgtaaataccacatgcatgatttaaaattgttaaaaattctaataatcatatgtaaataccacatgaatgatttaaaattgttaaaaattctaataatcatatataataagcatatgcatgatttaaaacttttaaaaattctaattatcatatataagtagcatatgcatgatttaaaattttaaaaattctaataatcatacataattaacatatgccatacaacaattgatttatatggatattcaatacatctaaaatattttacatcgtgtacacaacaattatggcagtatatcggcgatgacggttgaccgcacgtacttccgcctcacaattgttccttccttgtgatcgctacgtgagtaaggggtgtcttcgtttgataggaggatgatagggtcaaccgtcaccgtgaaagggggttgcccataacactgatcataatcctcgtcagtcttgtcctcaactccgatgatttttcttttgcctgggagaaccatgtggcacttcggctcatcaggccctttgcccttctttcctttgctagatatgtccttcacataaaaaacttgcgttacatcattggcaaggacaaaaggttcgtccgagtatcgaaccttgttaaggtcaaccgttgtcatcccactgtcatctatcgttacgtgtcacgcccagaaattcacgaaccagaatttttaagctgaatgtgcattaaatccctgtctaggaccagccagggtacacaaacgacagttgttgacatacagatccacgtcttacaaaaatataaaagattacaaatgcagcggaaaagaaaaaacgagctagactcggaagcttgacttctgcagcggggcgactccactccacaggcaatccttgacggcagcgacgaaaccaacttcaacaagacagctcccattaggaagatcttcagctcttgtgtgggggaaaagagagcaagactgagtactacccactatactcagaaagtcatactggaagaggaggtatgatgcaggatatatccaaaggaggctaaatgtacttttgcataaagcagacatttcaaagcagtagttgaaagcagtaaaacagttgtagtaattaatcaatattaaccaatcactatccaacactacaccacgttgcaacaggcccaaccaaccacctgaactacaccagttcattaagctaaactagggtgagactaatcacggtaaatctggttgatcgcccattaccgtgggcatggctattcgaatagttttactctggatagaggtgtacaactgtacccacaagacacgattccacacatgtcgccatgccccgaagtatcaccatgatactgcaaaggggaaaatcgtgacaagaccctccgcataaccctcccctaaccatccacaccatgctaaggtttcacccccacccctcaaaaggcagtgggcggtcccctcttgcgccgcggtgaatccggcagctggacaaccagacaccccggccgacccaactccatcacgcccaccctcgccaccggtgactaggaaagggtcgagctatacttcagatcaagcagttacccactcccgcttgtggtaagcacggtaagtctcctagggtttcccgtgaaccggtccttaattgccatgggtgcgaccagcaaaaccatacacccacagcccaccattcagtgtatttcaattaactaacaccatttcagtggcaccaatccaaaactatgctcatagtcaaagtctatgtaataatgtgatccccatctgtgtgctagttgagctaagcatggctaagcatttcctagaccaacatctaatcattttgatacccaagttatcaatggcataatgtcacgccctaaaaattgcctaatttaaaaatacattgtttaagtcatttttagaaattaaattaaaagcctacaagctaaacccaaattatctaggaaaattttcaacataaaaatgagctagataaaattttattaaatactttgcttattcctctatttttaagaattttctgggaattatttgagcaagggaagtatttttaataactgaaacaacatttcacgatttattttaattgaaaaagttctaaaacccctcctttaagttgttgggccatttttgccccaacatttcttcttcccgcgctgccaagccggcccaaagccggccgagctggcccaccagcccaccgagccgccagcccctctcccctcacatggaggctgacaggtgggacccacctgtcggtggtgtctcccacctccagccggccggctgtgcaagccgagcccgagccgagcacgagcatcgccgtgccacctccaatcccaccccaaaccggccccgattcttccggatttttgaggggtttttatcctctcattctcctctatctatccccccaaaaatcggagcaaatcgttgagtattttatcagaatcgaactcgttttcgagtttatctccaaaaccgagtttttgatttcccaagtcgatttcttgcgggaggagtccgatctcttcaatccaaggctataaataggacgccctagtccttctctttcgtttgccccaactcccgtcctctcccgtgcctcctagccgccgcgccgccgccgctaagcttgccgccgccgccggccatctccggcgccgccgcccagccgttgccgccgtcgccgccgcttgccgccaccgcctttaggtgcgtgggagcgaggagaagctcggccgcctctttcccgcagccgccggacgccgtagcccgccggccccgtgcaagccgagccgcccgcgccgtcccttcgtcgacggcccccgtcgtgcgtcgttcggcgtgtaggtgagcaccgtcgggttcgtctcgtcgccctctacgtgtccatgtgctccaaattcgcagccgactgctctagctcgggagaggttgccatcctagcccgccaccattgatgatgtcatcatgacatcatcggtttttctttttcccgattttctaatagattaaattttcggaaaatcataactaaataaccgtagatccgtttcaggtggttcaagttgctaaatttttctaaaatcaagatctacatgttaaaaatatccacatgaactgtttatgcttgtttttgtactgttttgttgatttttgtttaattgctttagtttccgacgtttcggaggagagcgtttccgttaaggatggttccgaagcgtttgcggaagcccaaggcaagtcgcacagatcccaagcaaccctttgagcatgttgaacccgtttaaagctattattttatttcaactatgcattgttttcgaatgtcatcgggtggtgaaccttttccaattaattaatggcctacgatgactttattttcctatgggttataatttgattagcatgaaccttatatattggattggttcagctaaatgctatatgtaagtttgcttagccatgcttagaaacattagctaactaaaggggttaaatatagattataatatactatattattattattaattatggttatatttaatggtagctcacgatggttaatcgtgtgaggttaattaatggataattaaaacttggttaaggtgggttgtgagcatatggttttgatggttgtgctcatgacaattaaggaccggtttgcgagctactgttgtgaaacatttaccgtgccaaccacaagccagcgtgggcaacggctttatcttttgtatagcatgattcattatagtgtgacagactgtgaaacggcgagaagtccatgggggtcgctggggagtccattgcctctggttttgagggggagattatgatccaggaacggtgcactgtggtgagttgtgttgtgcgaggggtaatgtcacagttcctttccgaggtaccgtggtggtactaaggcgcatggtaacatgttgtgggattgtgtcttgtgggtacatgggtacacctctgatcagagtttaatctattcgaatagccgtacccgcggttatgggtgagttgagcaatgtttttcgtgattagtctcacattattcattactggtaattgtgttaattaatgtgattcctggtttggaggtttaatttgttcaaccggggttggttgttcaaatgaggttgggcctatgcaacacgggtgtgttctatggtgtttatttaatattgattaattatacaactgttttactattctcttaagtatttattaaatgatgtttatgcaaatgaggtatattatgccatcctttgttattctgtgcacttgcatatttgctgtgtgacttgttgagtatgtcatatgctcattcttacaatattcaatcatcagaagaggagtgcttcagtgaaggtgatgatctggaggattgagcttcttcctggttatgatgcctgtggagtggagtcgccatagctgttccgtagtttgctttagttttttttctgctgcgtagaatgttattctttgagaggaactatccacctctgtaatatttttttatttgcgaatattaaatagttgattatttgtactctattatcaatttgttattgtgtgcctcggctgattcctggacgagggtttaacacacatgtaagcgtttggaattttggatagaaattccgggcgtgacaagttggtatcagagccaccttgaccttaggacaagccaaatggtaaacctcaagtagccttcaaaatattttgggaaattagaactgctcttctctattctcttacaaattaattaagttggcagcacatgcaaggttatgcacaaaatttatttaacttaattccttttcttttgaaagcaaaacgttgttcttctcaaaatgtttcttatttcgctttattaaacttcattgattagtcggcactgtacatttattatggtatcgattcaatcatgttagcacaagtactactcatcccttttaatgatgatactgtaccatgcttatagtaggtcctaaatattctggttttattttatttatttgtcaaaaattatttgtccctgtttaaaaagttaaattctaaaaatatatatataatagcttagtatgtgtcttttcttttatttttcttcctctttggtcaaatcagttaagtctagatggtgcagctaacttaaaaatatgcattaattcctcccttctatgtttctttagatgccgccccattcaccgagaaatttgatcaaggtgttaggattcgtcagggagctgaggttgatggcttttgaggtaggctatgaagttgctcctgagtatcgccggatttcccatgaccccaacgaggagaagtgtcgtgttcgtgtgacgttggctagtgatcgtgaagactttccgtcccttaagttcgaagctggaggaagatcgtatagccatgcttgccaggaagcagctttggtggccattggagatttgcgtcaacgcttttaagaagagttggattcatcagctttccagtatcatcctcacaagcctcatggtcaagattatggaacttacacctatcctgatggtgaggagagtgccactctgatgcaggcggtgcatatgcttagttctatgtatgcagtaagtgtggagcgagacaaagccgctcatgacagggaaaactggaatcgaggcaagatttgcaagttggagagtaaggtgtaccgtctacagaaggaattagctgagcttaaaggagagacgccgccgccaacacccaagcttcacctcaccgcaaggaagagaacctgtccaccacctcgtctccagttagcttcgaagcttcgcgtgatgggagatgctgtgccagatcgtgctgaacctgtcatccacgtcttaagtgatgaggaagaagaggaatacccagaagaaagagtgccagctactccagaggaagaagatccatcgcttcgttccgacgcaaggcgggattagtcgcttagttagatcgttgccgtagttcgctgtgttagattgcttgtttaagtttgcttgtgagtgtgtgggttttagttgttgcttacatcattggtgggatgtaacagcatgagtctagttcttttgcttgtcagagtgtaagatagttggtgagatagtgttaatgcaatttaaatgtaatcatacacagttaagagcaatatagaatttaaattaattaaataactccgttctaagggtgtctctctgtcgttctttcctgtgtttgtgcttatcttcagatggtgaacacgcgcactggaagtggaagtggagctgctaacaatggaggagattccacgctagctcagattttggcccaacaaacacaactgatcaatctgttagtgcagcaggcacagaatcagcaggcaaacaaccagaaccagaatcaacccccacctccccaaaacaagttggcagatttcttacgtgtgagaccccctaccttctcaagcaccaccaatccagtagaagcaggagattggttgcatgcggtggagaagaagttggatttgatccagtgtactgagcaggagagtttcttttgcttcgcatcagctgcatggtcccgctgctgaatggtgggatcactttcgccaagccagggctgaaggagaacctatcacttggcaggaattcacggccgctttcaagaacacgcacataatgacaggtgttgtagctctgaagaagagagaatttagagcgctcaaccagggatctcgttcggtcactgagtacctccatgatttcaatcgtttagctcgctatgctccaaaatatgttcgcaccgatgaagaacgtcaggagaagtttttggagggactgaatgatgagttgtcttatgctttgatgtctacggatttccgggatttccagcagttagtggacaaggctattcgtcaggaagacaagtacaatcgaatagagcagaagaagcgcagggctgcccaatttaaggctcaacagggcagtaaccagaggtcgcgtctcgttacgggacctcaagctacatcataccctcaaggaggatcttcgtcagttgctcgccctcaacgccagttctacaacaacaatactggtaatcgtggcaatgacaaccgcaacgtggtcgctcgtcctgcagcaactccagctaagaaccagcctgtcaggaaggaacagggaagcaagccaggggtgtgcttcaattgtggtgatccagggcactatgctgataagtgtcctaagcctcggcgtgtgaagaacgctccagccccgaacaactctaatactccagcaccgaaggcacgtgttaatcatgttgtagcggcagaagctcagaatgcaccagatgtggttttgggtacgtttcctgttaattctatacccgcatctgtgctttttgattccggtgctacacattcctttttgtctaaaagttttgcgagcaatcatgggatggaagttattagtcttgggagacctttactagttaataccccaggcaatcaagtatcttcgacacagtattgcccttccgctactatagaaatagaagaagttcctttcccatcctctgctggaatccaaagatctagatgttatcttagggatggattggttatctcgtcacagaggagttatagattgtgccaaccgtaaggtgactttaaccagtagcaatggggaaaccgtttctttctttgtgtcctctcctaaatatcatggtgtgatcttaaaccaagttgctctacaagagatccccatagtacaagactacccagacgtgtttcccgaggatttgccaggtatgccacctaagagagacatagagtttcggatatacttggtacctggaaccaaccctatccataagagaccatacagaatggcagctaatgagttagctgaggtgaagagacaggtgggtgattttcttcagaaaggatacatcagacccagtacttcgccatggggagcaccagtcatctttgtggagaagaaagatcatactcagagaatgtgcgtggattattcagaagaattcagtggagcaatcattcagaagaagaagccacttgggagcgagaagatgaattgaagtcagctcatcctcatctgttcgccagttcttccgaatctcgaggacgagattccgtttaaggggggtaggtttgtcacgccctaaaaatcctaaatatataaattgttgtttaattggaattattagaatttattttaaaagcctacaagttaaactctaataatctaggaaaattttcaacataaaaatggtctagataaaattttattaaatactttgcttgttcctctattttctagatttttctaggaattgtttgagcaagggaagtttttttttaataattggaacaacatttcacaaattattttaattaaaaagttccaaaacccctccctaaagttgttgggccgtttccggcccaactcttctcttcccgcgcgcggccaagccggcccaagtcggcccagccgagccgccccgccccctcctcctctagccaccgacatgtggggcccacatgtcggggtcatccctaacctccagccggccggccgcctagccgagcccgagctgccgcctctctccaccaatttcgcctcttccggtcgccctcgagtccgataaattgaggggtttttatccccacatcttcctctatctttaccctcaaaaatcggagcaaatcgttgggtattttatccga

SEQ ID NO: 76711 - DNA, 695 bp, Oryza sativa
ttcgtgcggcaggcagggagggagctctcttcgccggcggtggtgtggcgatgcgaggaggtgggcggtcgcgtgcggtggtgcggcgacgcggggaggcgggaggcgagacgccggcgactcgcgacgacgaccttgacgccgctcggggcggagctcggcggcggcggctcgcgacgacctcaacggcggatctagaagggggcggcggcggagctcgaggcggagctcggcggtggcggtggcggtggccggccgcatgacgacggggcggcgggggctggccgcgcgacgacggggcggtggcgccctcatcattggtgcgtgccgcgtggagagagagggggaaacaggcgtgggtcccacatatggttagccggttttggctggccaactttggctagtctggtggggaatttagccagccagatggcttggagaggtatttagctagtctgttggagtagattttttgtgcaagttagccaaattttaacttggaaagccatttggctaggctcttggagatgctctaatgtattttactcatttgagtaaagtgtacgagcggtccttaaacttgtagaggtgtgtcatcttggtccctaaactctcaaaatgcatatccaaatcccagaacttgtcatagtgtgtcatctaggtcccaaatcgccacaaccccgggctgcaggaat

SEQ ID NO: 76712 - DNA, 889 bp, Oryza sativa
gatcgatcagacaaagctgggttgctgggtatttgtagtggtgatacagaaattcagaattaatgaattggagacttggtaataataagcctagtcagaggctttgtctgaatgcaatggacgtgtcactttacaaggagttagcacttgccacaggttgtcactttgattattactaattgggtatttcattggcataatatgtgttgtacaggtgatggtctgacagagtgacaagtgctcatgaaaattcacagtttaatgcttcgatttggatacgtatccaacgtcattttcagatgagggatgactcgagaagtcgagatgttaacccacacacatggcgaggcttgaggcgacgacaccatgcgttggtcggcagtagtagaaggattcagaaaagaattctctgcataggcggcgagcagctaatcttatctatgcacagagagagattcagagaagaatttgagttcatcttgtagttcagaaaggacaatcattcatgtcatagaaaaatttcagaagcctcctggatcgaatatagtaggtgtgttggaacattgtgagaggaatctctgaacaaacagcagtagtaacattcagtaaaaaaaaaaattctgagaatttgatttggtaggggctcttgcgtcctcctagaatgctcaaagatgctgtaaaaagtttcaggattggtcaagaaggcagggagcatggagccaccaaatatgacaatttttttcaggaatagacaaaagacttgcgcatccacaaaatctgacaatgtcttcagagaataattgttcagactaggtggaacatttttgtttattcaccattttcaggtccggtcaacttttcaaacttcagaaatagccaaaactcaaaa

SEQ ID NO: 76713 - DNA, 1104 bp, Oryza sativa
ttcacggtataatggctcggacgccagatgatattcttctgatgtgtggtcatatcctgattgttggcgttcttggtgccagtctaatcctggaaacgccacatatatttacatagtatttttttcgtttatgtgaattttgtcttttggggatctaaatgatgcgaaactctgaaaggaaagcgtccaatctgcggattgtggcgttccatgacatttctttcatattgaataggaagatctgatagattcctcaattgatatgattttgtttaaggttatttgctttgtgatttttgttaaattctttgtgcttttttttcagatgtggatgatgaaatcacaagtgaaaatacagttatccctgtctgattccttcataagggtgctgagaatactttaatctgacacagttttgatgaacctatatctccttttaaattctatggctgttcgtgcagattaatcttttgtgagttgaatgcgaattgttggattggatctgatgcctttgatgacatgatggtttcagaactggcacacatcgttgttgccagagctatgttgatattgctcatgaactaggacggtctgaggcctttccaatccgatactatagaaaaataagagttcaaaagttttttttctgagtatgttttattgcttgcttgctttgatattgtttctgagtatattttgccgtcccaactgtgcatggtcagaagtgaagaatcggcagggatttcatattggagcattctgcaatcagagcaaatggaccacggagaatggaatgtgtttgtcaataagtaaaattgtactaaagtaaattgtggcaaatctgtatgttgatttgtactatgtactggtatcttgctctaaaacattgttaagttttaccagcatctttgcccaaattgaattcgtcaattcttctctggcgtcttagacggaatttggactataaacaacaatttgctctgctggttaaatttcgtacttcgtagcctaagaaggatgcttagttcgtgggcctgcttaacgatataggtggtgttattaagagttccacgcattatcacaaatttgaaaaatagattaatc

SEQ ID NO: 76714 - DNA, 1171 bp, Oryza sativa
taaatctttcatggcaaatgattctatctgcatgttttccagttcagagcggaaaggctaatgggcgggtgatcgctcccccacccgcccagcgaaaagttagaaaaatttatgtatagaaatattatatataaaaaatttgaattcaaattcaaatttgaatcgggtatgtaaacttttgacttataaactttgggtctataaattttagatgtatagaaatactatatatagaaaatatttgaattcaaattcaaatttgaataagatataattcaaattcaaatttgaatcgggtatataaactttagatctataaacttttaggtgtataaactttagatgcatagaaatactatatatgaaaaatatttcaattcaaattcaaatttgaatcggatatttgaattcaaattcaaatttaaaatgggtatataaacttttgacttataaactttaggtctataaactttagatctatataaactttaggtgtataaactttagatgtatagaaatactatatataaaaaaatatttgaattcaaattcaaatttgaatcggatatataaacttttgacttataaacttttggtctctaaacgttagatgtgtaaactttaggtgtataaatttactaaaataggaaagtaacgcggtgccaaaaaagaaaaccaggttgagggagggaggggggaggtggagagcgaatctgatcgctaccctatctccacggcgatccatagcccatcaggggtacccagttcagagaacaagtcaagcgcctatgggccgtggccagtggccaccgatctcgggcctcgagtcgtgccccagccaagcagttgaccagctgccatccaagtcaactacgtgcccatgtgatctgctcgtctttgctctcttcccgggcttgcagccttgctgacttgcagggtcattgacatgccggtcctacaaagaggtggccagtaaaatgtcagaaaaggcccactcgtcagtgacagtccacatatatgtgtgaagacggcgcttggcaagctatgttactagacagatgtgctgacgtggttaaactaatcacgatggagtctttgtgatgatcattaggctataatagtagtactagctggagtaagtgatagtaataagattattagcttgattact

SEQ ID NO: 76715 - DNA, 7654 bp, Oryza sativa
ggcacagatggtcaggatggtatgtagatagacagccggtagaatacataagagtaaaacgtacggtgtgatggtttgtgcgtgttactgatcgaaaacatgggtgcacttgacagcttccgccatgatggtgatcaaggaaaagtatcaggtgaagaagaactggatgggtgatccgtgcgttccaaagacgcttgcgtgggataagttgacatgcagctatgacagctccaaacctgcaagaatcacagacatgtaagtaattcagtccacatgtactccctccgtccaaaaaaaaccaactagacacggatatgacactacatagtacaacgaatctggacatgagcatgtccagattcgttgtactatgttgtgtcacatccgtgtttaagtgggtttttttttaggacggagggagtactgaatattggacttgcataatggaattatggaagtatggaactcgcggtcatctgatcatattccttttgcagaaatctgtcatccggtggtttaagtggtgagatatcgtccgcttttgcgaatctcaaggctcttcaaaacttgtatgttatgaggttcagaatgttaatttgttgaccgtttgtggaattttgcgttaaaagacttgcttcatatcttgcagggatctgtcaaacaacaatttgacaggttcgattccagatgcactttcacagttgccttcgttggcagtattgtaagtttggcaactcctgtcaaattttactttattgcctagcatcatttgtaactgacatatgtatataatttatgggcatatggcttctttagagatttgacaggaaatcaactcaatggttcaattccatctggacttctcaaaagaattcaagatggtaccctaaatataaagtaattaagtacacccccactcttctcttagtaatctttgaatgtccaaattcagtcaatttgacaaaatagactgatttggctaaacatcttcattccatcaacagatacggaaataacccaaacctctgcaccaacgacaattcatgtcagccagcaaaacacaagagcaagcttgccatctatgtagctgttcctgtagttctggttttggtgatagtatcagtcacaatactgctcttttgccttctgggacgaaaaaagaagcaaggtgaggcttgttacaaacatagcaattatcaactctatttctctgtccttgaacatttctgatgctagtagttccattcttcgcttatgaaggatcaatgaacacttccgtaaagccgcagaatgagacagcgagctatgtgccgacaaatggcagccatgggcatggctcatcaatgcagcttgagaaccgacggtttacttacaatgatttagagaagataacaaacaactttcagcgagtgctcggcgaaggagggtttgggaaggtctacgatggcttcttggaagatggcactcaagtggcagtcaaattaaggtctgaatcttccaaccaaggggataaggaatttctcgcagaggtagaatttcttcggttgaatttgatcttgctacataaagattctactaagaaaagtatgattaattagtcaagttttgcttgtctaggctcagattttaactcggattcaccacaagagccttgtatctatgatcggttattgcaaggatgggaaatacatggcacttgtctatgagtacatgtcagaaggaacccttcgagaacatatttcaggtatgtacttaagttgttgttcccgatcaattcgcagggtacattgtaaaacttcatctagtggctcatttgatagtcctcatgatatctcccccttctgtgttctcttcctatttgcaggtaaaagaaacaacgggagatacttaacctggagagagaggcttcgaatcgcgctggaatccgctcaaggtaactactttaaaattgtaatactgtttcgtgaggtttgattttacattttctctagaaggttgatcagtaattaaatttcctggttaatggtcagggctagagtacctacacaagtggtgcaatccgcctcttattcacagagatgtgaaggctaccaacattctattgaatgcgaagctagaggctaagattgctgattttggcttatccaagacgttcaatcttgagaatggcacacatgtatctacgaacacgcttgttggcacacctggatacgtggatccagagtatgttaatccatatgtatttcttgatgttgttatttagtgttttatgtgagaaacacaaagtttaaggcttgtggaactaattgaatgtgcaggtaccaggcaacaatgcaaccaacgaccaagagtgacgtctatagctttggtgttgtcctattggagctggtcacagggaagccggctgtcctacgtgatccagagcccataagtatcattcattgggcgcaacagcgcctagcacagggtaatattgagggagtggtggatgcacgtatgcatggtgaccatgatgtaaatggtgtatggaaggctacggacatcgcactcaagtgtaccacacaagtatcggcacaacggcccactatgaccgatgtggtggcacaactgcaagagtgcctcgagctcgaggaggggcgttgtgccatcagcaatgcgaacaacaatttctataccgacaataacagcaactctaactcaagttatgacatgtatgccactgaccactctattgatgtaagtcagaacagcgctgcatttgagacggagcgtaattttggaaggatgccatcaacggccaccggtccagctgcacgataaatcattttgcccatctgatctgaatgctgtcattttctgggaaagatcttcatggaagttttaacaatgttgttttaccaaagtaaatgcaaatgtacaaattaatttcaaaaactcaagatcctcagtataaaccctttcggttatgaactcagaattcatatacttgtctcttctttgagtggcattattgtcctgtactattctttaggaagagaaacaccaatttatctgttcattcatgatgttttgtagtaaccagaatccacattttctattttttctaaatgctctttgctttgatgttggaaataaactcataagcctagtgttgggatgccaaaatttatggaatctgcatagcttagtaggctagcataccacaatttgcatgcattttttttcctgaagggtttagtttcgatggaactgaagctaactttattcgccaagatggactataatctagtgactttactcatcttctattggtagtctaccacctgtctatttgcggtacatttagctgttattaaaaaaaattcctttgggtggatttcaggtggatggagtcacacattgtataccttcctaagaccttgttcggtaatccccatgagatatggattaaaagagattgatgaggaataattccacatgtattgaggtgtgccccccctcaatccccttgttggtgggattaaccgaataaggcctaagggagaacacaaaagtaagatccatttgacagaactctatgtgcatgtacttgaagtgaaaatgctaatattttccttcaatagagttataaaaggatgaatgctcaattattgaacaagaactttctagccagcctttgacttctttaaggagcccatcccttactagggttggtatgcttccagatccagtcgtggggaactccatgacgagtggagtagtggtcccatgtgcgagaggggtcggagggggatctagcccttttgagttctgactagtgtgatggtcgagctatgctaggtcgtgagatgtcgttgtgcagaggtgaagtgttgaaggtggcccgggggggggggagggggtggctgacaaagaggcgtatggtggtgcgatgtcacgcccagaaatttagcccaaatttccagactattttgtgtattaaatccctgtccaggaccagccagggtacacaaaacgacaagtaataaacagttccaaacgtaaataacgcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaaggggaacacaaggacggtttgtggctatttgcataaaggcggttgtaaaacattttattgagcgaaacagtaaaacagttgagtaattaaagtaatattgaatctccactgatcaacgctacaccacgttgaacaggcccaaccaacccacctgaactacagtgcattgggtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaattgccatgggtgcgactagcaaaaccatgcacccacagcccaccattcagttgcattttagttggataattacgaccatgaagcatggccagatgtctcgagcacgcagctcatcaagatactagaatgtctaatactgcaattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgaccccatgtaattagcaaaacatgcatatttgtttgcaaacagtaaaacatttgtaaattaggatcaaaatgctcaaggggaatgtgtgacttgccttgcttctccactttgatctcccgaactcttttcctcgcgaccgcggacttccgaaacgacggaaactacacgctggcacgcaaaacgaggaaaaactctaataaaaaccaaagaaacagtacataaaaagtaaacaaacatgtagagctcaattttagatgaattttgcaatttgaatggctcaattcggagttcgaatgaattagatatgaattttagaagttttgagccatttaaatgaatttctagaattaaactcgatttattgcgcaattattatttatttttacaaaggaaatggtccttgctgacgtcagcaaggggcggccggcgccgacacgcgggccccacacgtcagcgagtcaaagggggagggcacacggtggaccgcgtccaccgcgacctcgggcgcgcgtccaccacgtggacggcccagatcggccaaggccgatcggacggcttggggacagccgggtggcgcggcccggccagcgctcacacaaagcgggcggcggcggcggccgggaccgaagcgacggcggcacacgggctgggcggccaccggcggcggcacacggcgcgcgcaagcacgggaggcggccggccaaggggagaaagagggaggggagaggagtgctcaccgagggcggcgacggcgagacgaccacggagaggcgaccggcggcggaaaggatggcggcggtcggcacgggaggcgacgagaacggcgttccgatgacgcccgaccacggcggagccacggccgagggacggtgggatgcagcgaatgcggtggaggcggtggcgcggcgtgaggtagatggggatggcggcaagaggcggccgacggagggaggcgagatggcggcagcgcgagagaggtggtgcgcgaggcggcgattttccggaggcggagaggggagatggagtaggggccggggtagagcttggcacggcgttgccgacggcgcaagcggcgaggtgcggcgacgactaacgtggcggcagcggccggctgaaggcggtgtgtggcggtagtggctcggcctcgcgatgggaaggtggttccggcggtggaggagggagatggagtggatgccggggtgcggtggggtgctgtgatgctataggtggcggcggcacagcgcggcagcgacgggagcggcggtggcgggcggctggagatcgctggcgagcggcggcgaaggggatcggcgtggagagctcggtagagggcgcggcggcttggggaaaatgggggaaatggatgaggggaggccggggattgtttttataggggaggggaggcgggatcgaggccggacgtggcggaatcggccggcgaagtggggcgccgacgtggggtggtggaggggttaaccggcgccgattttcgcggggagagtgggggaaatggtggaggacgtggaggggatcgtgcccacgtcgttggatgcgagctcgggtgcgggagggcgccggattttgcggcgacgtggacggctatggcggttggcgtcggccggcgagaggtaggaggaggagctgacgggtgggaccgccggtcccacctgtcggcgaagggagagaaggagggacgcaaaacagacttttgcgagcgggccaaggaagaagggagccggcccgagagagggaggaggcgcgcgggccgcgggagaggaaggagggggaggaatttgggccgaaaatggcccaaagagatgaaggaggattttatttgttctctttttattttaattgattaaatgatcttcgtgactttaaaactatttctcgagctccgaaaattcacggaaaattccggagagtacattagggcacaaagaatattacaaaatattcccggccaatgatttttaagggaaaattttaattctcccattattttacttgattaaattgatttaacttttatttaatttctagaaaatgcattatttaatgatttttaaacccgaacgaaaatcggggcgttacatgcgacagggcacattgttggtgcaggttggatagcgggagaacatggggttacgatgttagggtggtcgcaatgccttaatttgggtgcctcatttcccccatggggcattgctgagaaacatccatctctcccttcatggtgggatcctccaggtaaaaatcttgtctaggtcttgggtgggcgggtgggcgggcgggcgggcgacgtggcgacgtcacgaccttcatggaagcatatattgtctaggagatcacattttctatctttctagtctccaatcgatttggtctacgatggtactctaggatgtcttcaggttatgcgggctgcaggaat

SEQ ID NO: 76716 - DNA, 698 bp, Oryza sativa
attgttactcggctgaaggtcgttgttgcggaattgctctacaacgtcacttgcaatcctgtcagccgcgttttgagcattgttgataagatcaagagcagcctcttcgcttgtcccgtctgcaaagccatcaatggcgtcaatttcaatcctcgggtacaaggatttggtcatcgctaatgccatgccagctcccatacttccagctttcttgatgttcttgaaatatacatccggagcaactctcagcttgtcgaaaatttcggttgcgtcgagtgcactcggaccactgttattgaggaacatagcttggacgagtggtatagcgacattggcgacttcatctcttgctccttcaagcctcttgatcttactaaccaggacgtcaaactgagcttgagatttgattttacgatctacaaaacacatttatgataagaatctgctgcatttaaaagagagacgtccagattgctagctggcagtaccttcaacctccttcaaggccgaatccctttgcgcagccagttctactttgtcttttttcaaggcttcaatttgtttctccatttgaaccatcctggtggcttgcgctgttcgaaatccaaatggttgaggatatagttatgacagcatagattaatgggacaggtctaaaagaataccttttgacaaaccactcagctcgaagtttgaat

SEQ ID NO: 76717 - DNA, 684 bp, Oryza sativa
gctccgcgagggaaacctgacacctgtccagatcccatgagacgaagatgcaacccatcaaggtcacgaaaacaacgggaagtcggcaacctgtgctgcacagtgcacacagcctttgacagcacgtgcgcagcgcgcgagccagatctagctggtagtacagatgggcagcatcggcggcggcggctcgccggaggagcgcgcggcggccggtgggccggtgtgcgtgacggggtcgaccggctacgtcggctcgtggctcgtccgcgccctgctccgccgcggctaccgcgtccacgccaccgcccgcgacccaggtacgccgtacgcgcgagctcgctcgctagcatcgatgaagctcgtggcgtggtgaaactgacgatcatggcggccggcggccggggtttggtggcagacaaggcgtggcgggtgttctccgccgtggaggaggggaaggaccagctgcgggtgttccgggcggacatggccggcgaggggagcttcgacgccgccgcgaccggctgcgtggcgttcttccatgtcgccgcctccatggacatccacgtcccaccccagaatggcaacgacaacaacatcggtaatttacgaagtttaatctccgccaaatcaagattacttccatcaatcgctactaaccgcatgcacatttggattagaccgtaa

SEQ ID NO: 76718 - DNA, 1018 bp, Oryza sativa
aattcctgcagcccgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccataactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataatgatttaatttattccataaataaatcatgacattacagatgaaaactagcatgaacgcatcattagatctacacatgtaaactacgtagaaaaacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcc

SEQ ID NO: 76719 - DNA, 2898 bp, Oryza sativa
cggcgacgcggacccgtcgctggacgcggagtacgcggcgaacctgcggcggagcaagtgcgcggcgccgtcggacaacacgacgatcgtggagatggacccgggcagcttcctcaccttcgacctgggctactaccgcggcctcctcaggcgccgcggtctcttccagtccgacgccgccctcgtcaccgacgccgccgcggaggccaacatcgccagcgtggtgtccagcccgccggaggtgttcttccaggtgttcgcgaggtccatggcgaagctgggcatggtcggcgtcaagaccggctccgagggcgagatcaggaagcactgcgccctcgtcaacgacatccactactagtattatcactagctcatcgatcttcagctcctcggtgcttgataaatttcagtagaaatatatatacatgtaacttaattcgatcgtcatcctgtttattctctctctctatgtaattttgtttccaaattgtaactgttttattttggagcaactgtaactatttctgtatgtgcccatgaatatatttcaattatagaaaataattcactttttagtcatagatatttaatgtttaggataatattcagattaattatcattaatattatattaaaataaattttaaaatgttttgatatatttacgattttacttttctactagacaaatttacgtatattgattttttaaactagaatttgagatcctactactagttaaagtttaaaaaattaactaagttttattattctaaagttaaattgctcccctctttctctctctctcttaatatctgacaccattacattttcaacgtactaatcattcatcttacttaaaataatataataaattgtcttattaaaattatataattattaattatcttgttatgaattgtacgtttaaacattgaagataatcttagcataacttatatattcttgtatttattttacataatttaaataataaaaagtaaaacgtatatttaaaattcgacgccatacaatactgaaaatcaaaggagtatttatgaccatataatcgtatttgcacgtggtcctccttgtcggcggctcggtggctgtcgccgtccacgcgctgccttctcgacagggcggtactccacccggtaggtaggcacccgtacggagctcggctaatccagctgaccattcaataattttagatatttaaatataaacttttgtagtgaggctgtgatcagttgttttggcaaaaaaaaaaaatgtatacgacacatatttaaagtattaaacgtaaactataaacaaaacaaattacagattccgcctgtaaactgcgagacaaatatattaagcctaattaatatgttattactaaatgtttactgtagcaccacattattaaattatggtgtaattaggctcaaaagatttgtctcgcaatttgcatgcaaactgtgcaattggtttttttttgtccacatttaatgttacatgcatgtgtccaaacatttgatgtgacggaaaagttggaagtttgaaggaactaaacacagcctgattctctgaaactaataacagctttcaaatggtctcctaaattcaactttaaccattacttcttaaaccaactaaaaatataatattgtgcaattattttgtaagaaaaaattgtggctttcatgcatccaatttaagcaatttactatattatggtagctaacgtttaaagtttttatcagataaacaaaacaccatatttcactttgggccacattttatcacctatatttcgctttggatcacatttcaactaatgttttattttggatcaagtaattttacctccatgatgtttggaccatcctgataacttttttatccaactatatccaatttattatataaaaatagattaaaggatgatccaaagcacatatcaatagtaaaatgtgaagcaaagtgaaatttactcaaaacgaaagttcactctgtgaagtgtcaaattatcaaatccctcctcctattcgttgtgttgtaagaccagtttaaaacaattgatgaagtggagaattaccaaattccccctaatctctgtctccccctccctcacggcctcacctcttctccctccaaattctccatccccggatccccctctcctcctcctcctccgccgctcgtcggagccggaggcgcggcggccttctcccgcgcccttcgtctcctcacacccgcggcggccggcgagaaggcccagaggcaaaggcgtgaagcggcctcctcccccggcgcggcaccctcggacgcacggcggccggtgagcaggagcaggttcggagggggcgacgcggccgggctccttccaccggccagcatcctggctcgagtcgaattttgaaggtattgattactctcgtagcctccctccctccacctctccgcgatttcatgagccagtgtagattggggttgcagatcccctggagtttgacctccaaatccaccggggtggatttcagctgatgatttctatggatggcggattaagcaagtcactttgttccccatctactcggggtggccacatcatttcaatcctatactgctttgcgacatgtcaatctgtatcttattagctttcctgggctatcagtagttgacaaccagaacttgattggagaagaaacatcttgtgtgaaatacatatgacactgggaacatcatcatatgatagttatgtattacttacttttcagaaacttggggcaccagtatttaccgcaattgattgaatactagtactcccgacggcaaatataaggaaagggtgggagtatattattagcagatcaacagcgaaaattataaaatacggcacaagca

SEQ ID NO: 76720 - DNA, 4930 bp, Oryza sativa
atttgtttacagtgaacgactctttggatggtcaaaagcctgatatttttccatcggtgagatccagtagggttgaggggctactaccagaaaaggcagttgatgatcttaattataggcttcaaagtctagtgcctggtgattcagaacatgttcaagtacttggtcctgatgcgctgggatcccattctcatgaacggcgttatcaggctgaatctcaaaatctttatcatcttctacaaggtagaccacctgcactggctcctcgtcctatgatggatcacattggtaataggaatcagcaaaccccgtttgacatgacacaagcgatacagcatgatcctcaccgttccttttcatcgaacatgaatcctatgcaacaatctcttcatgctcctcgggctcctcatgtagacccagctgctcatcatcttatgatgcagcacatctccacacctggaaattttccaccagaaggcctgcaaagaggtgttccgccatctcagcctgtgcatcacatgcctggttataggcctgagatgagcaatgtaaataacttccatatgcaccctcgccagcccaactatggagaatttggattgatgatggcaggttagaaagcctctgcaagctgatattatatgttgtgtgtatttgcaaatttatgttgtcacagtttacaaaggtgagattgcagaagcaggcctgctacaggtgacaagataatatatgtgtcccaaatgtgacatccatgactgaaaactacagaattcactaattcacatagacaaaatctctaatctgaattatatggcactaaggtttgggaatatgaattgtggtataattgtgtgcttctgctttccttgagcttaacatgccaagtacttttttttcgttattcttgtctataccaattgttttattctctatatggaacgggctttctattatttccttgaaatcactttttaaggggaacattttctcgattcgttcattgttaggactacattaccattgtttgtcaaccaaataggtttggtttttaccctgaatttacctgtataccaatttggaccacatgtttgatttctgttctttcgtttttcgattttaggtccatcaggtccagaactgagaggcaatcacccagatgcctttgaaaggtttctccagatggagcttacagccagatccaagcagatgcacccagcaatggctggtcatgtacctggcggcatgtacgggcccgagcttgacatgaacttgagatacagatagatggatgcgtgtgattgcttatgcagtatgaaggacccagaaacggtttgctgtacttgcgtcaaatagtactctttacccatgccataccgctatgtacctgtgtcaatgagcttgggttagcgtttaccatcaatacaatcgtttggctgcgataaggtacctgatgattcactggtggtgggggttggttgcatttgcatataaatatggagaagttatgaatgggttggtgatctggagtgatctgttgtgaaagtggggaacccaacgaatattgggtgaggtccatcaccgtagcagccacctctgcattgtgtctgtctgcctgcctatctgttgttttcagtttctgtataaatactattctgcaaaagaaagtaccagattgacagacacatttggaagtgtttccctggcctcaccttttcttttagctacagtagcattttatgtttaatttagtttctaggataaaatgctatccatgtaacgattctctggtatttaagcatttaccccctccgttttcaaaaaaaaaaaagagaccaatcctaccaatgaaccttgattcgtagctaggaatttgtttttttttaacggagtagtagttcagaataaggagtcgccgcagaaagatcaacccctcagaacatgacatgttagaaaaatagtgtataacattggtattttcctatactaagctatctgtttttttaaccaaacaatttatatcaatccttcttttaatatatgacttttgcaaatatatgatttttgcacgtatgtatgtaattaccatttattttgctaggatttgttcttttacaaaatttttaacaaaattatatatctatactaaacagttgtggtggagtagtcactaccactgacatgcgatgccattgtagggggctttcacccattttcctgattccctccttcgaatggtaaaaaaaaaacatttaaaataggacagagggagtacaatgtatgatgatttattttcttctactcgtatatatgcaaaattcaatggtaacatttttcaaattaaataaatctagaataggatatcatgttattctaagttggtttattttagaatatattataagtgggtttattttggtagggagcaaacaattcatgggcttaaaatgttgggaagtttctcatttctaggcctaaacgatgctagtactaggcaagtagagtagcagccaaagcggacaccgctaccacctccactacccaccttccttccttcctgaggatctccgcttgaagaagagaaccccaaccctaaccctaactccaatggcgttcgccccgcgcctcctcctaccttcccggtgccccccgccggcctcctcccccgcgcgccacggcggccgcaccgcgcctgagctgtccggtcccaccccgcgcgtggtggtggtcacctccggcaagggcggcgtgggtaagaccaccaccacggccaatctcgccgcctccttcgcacgcctctccttctccgccgtcgccgtcaacgccgacgcgggcctgcgcaatctggacctcctcctcggcctcgagaaccgcgtccacctcaccgccgccgacgtgctcgctggggactgccgccttgaccaggcccttgtccgccaccgcgcgctccatgacctgcagctgctctgcctctccaagccccgctccaagctgcccttcgccttcggctccaagaccctcacctgggtcgctgacgcgcttcgccgcgccgccaacccacccgctttcatcctcatcgactgccctgcaggtcagtccgccccaccaccatttccatcaacttatgatgatggatgttatatgccactcgatttgctttaacgcaattaataattgtgatgtttatcttgttctcgcttgcccatccctatctattgcccagaattgtaactttaagagccatgatgcaagtcaaactttttatgatgccagtgcataaccgtgatgcaacttatattctcaaagtcaatccatttatgcatattacctattttctattttagattttagagccatatcaagttatcctttgatcattgtaacttaagattttgttttcttacctgccacatataggtgttgtttaggccaggcatcagtttgtttaatttggttgtgagctgtaaatttcaaccccactgattgagtgattgaccatccataactaactgcagcataattctgtcatgtcaatatataattatgaaccttcaccttttagtgctggtctgttaagtgaaaatgttgcaagacttagctttatcctttgcttaggacatggcaccggtgaaatggtaataggttccttttggctttgtaatcactggttaaacgtctattacatttccttaatgaaatgggaatgtcatcctctctttcttaaaaaagaaggaaccttctccttttctatctctatagtgctgtattcactatcccatgttcacagataataagttagagcactgcaattgtcaccactgatttgatcaattccagtgccacaaatattatctgcagttgcctgataataatgttagattataaccagttatatatgcatccacatatgttatgccagattgcttaaatcagatttttctttgtaggtgttgatgcagggtttgtcactgctattgcccctgcagaagaggccgtgcttgttactacccctgacattacggctctccgtgatgctgaccgtgttgcagggctattggagtgtgacggcatcaaagacattaagattattgtcaaccgagtacgcccagacctggtgaagggagaggatatgatgtcagcacttgatgttcaagaaatgcttggcttgcctttgctaggtgttgtgccagaggacgcggaggtgatccggagtacaaatagaggtgtgccgttggttctgaacgacccacccacaccagctggtcttgctctggagcaggcgacttggcggttggtggaaagagatgcaatgacagcagttatggtagaggagcaggagaggcccaagaagaaagctgggttcttttcattctttggtgggtaatttgctgtgagattaatgagctcagtgtaggcagtgtgtacagatttgcgttttggagctacgattgtttttcccatttcttttgctttgttatagtgtagaatgattcatccgttgtgcttaaatccatagactggagtattttgccttgtttgctcagtacataagtaatttacgaagatatgttttggtgcttctagtcttggatctggttttacgtcagaattaagcaagaatggagatgctcgtttttgtcgtcagaatcaaaccgtatagttgtcgagttgaatgcttccatagttccattgattttaaactgtatactgttcggtttgacgccaattactttataatgtttcccttaaaatttttctgtcttcgaggactaggtctggttgatttctttgacattttgccagacctttgctatctcggcaatttgataaatggtagccacatcataacaaggtaaattttgtatcacgacatcaaactcaactggaacactccgaaatcttttgatgattgttgaatattttcttatcaata

SEQ ID NO: 76721 - DNA, 642 bp, Oryza sativa
gctaatacattttttttgcatgttgcagaaaatatgtcgtcgtcgtccctcaagccgaagtggtagctagccctcggaggaatttgcgcaggcaagtgatgtaaagatatgattatctagagttaccacatatgattattagacatagcatatattaattattagagttttaatataagattattagagttttaatatacgaaacttagactgaacatatatgattattagagttctaatatatgattattagagtatcaatatatgattattagacttagcatatatgattattagacttatcatatatgattattagagttttaatataagattattagagttttaatatacgaaacatagacttagcatatatgattatttgatttctaatatatgattattaaagtattaatatatggctattaaagtattaatatatgcctattaaagtattaatatatgaaaatgcccccaagaagaagtaccatcaccacctgggtcaggcggctatagcgtcgcagtgccaaagtgggaggagatggaagcaagcttgattgagaggggtatcgaaccggtcaccgttaaatggccggatcgatcgaagttctggtactatgctcacggtggaacgcttaaccc

SEQ ID NO: 76722 - DNA, 2055 bp, Oryza sativa
tatttgttaaaatcccaaaggggacgctgtcaccactcttcattcagagttgcacttgctgctgctgttgttgctgctgttgctgttgctgttgctgttgctgctctttatcatgttcagcaacttttggagggaggtgcaaggcctcctgcctcttgccccacagcagaagataaaggccacctatcacaagtacagatcccagcacgctgcatatgtgtatggcagtgcaatggtttcaaaatctgaatgtgcaatcaatctgacattacttacataggagcatatatatgctgtaacaatgagtaaccgtaccttccaaggaagagctgttcatggaggacagtgaagtcaatcactgaaacaatgatctgcaccaccggaatgaaggctgcgacgaacactggaccgcgcttctcgatgcaccatgtcagtagcacaaacgaaaggccacaccccaccacaccctgaaacaaaagaaatgaagaaagaaaaaatgatgagaaaattaagcagaattgaagctctgtaagtgatcagtgaattgaagcaagaagaaacagaaaggagttgagtaattgcgtacggcgtagaggatggtgagtatgtggaacttggtcctgacgatccagacggagacgttgcgttgtgtggagaggccgacgacggccacctggaggaagctgaacatgcacatgaaggcattgcaggagtagacatgggggtacttcttggcgagcctgctgtggaggaggaaccagcaggagaggcacacgcagttgcccaggatggccaccgtgcccagcgtccagttcctgctgctcatggctgcttctgctgctactgctgctgctgctgttgcatggtggatcttggttgtgtgggtgacagccacgcccttgtaaaatgtcagcaccatggctcctgctactgatatcagcgtgcccacaagtttgcaatgcctgtctttctctccaggttcagtgattttgacctgtccattcgtgtataaggccaggccaattaattggcaagcaaaagataaagagaaaaaggttgccacttggtgtgcaataattcagaatttattgggtcttccaatcaagaacctcccgtgttaggatggcaagcaagaatgtgaggacagaacggatattggagaaggcagtgacgaaggtcgccgtggtgtatctcaaagcaacgaagatcatgtactgccttagagctgccctgcaagaacaagagagaagaacaacttagtaaagccatgaatttgttttttcgccgggagatgaatttgttttttcttcaagagcaaaagaagaagaaaattaaactagaggcaaaattcgtatgaattgaattggtacccgagcgcagcactgacgaagagataagtgaagatctccagtgtgagctttggcctggacttcctgcatgagcacaattcaataaagcagttacagcactgaattgttgaataatccaggtccaggatgtgtagatgcaagtcattgatgaacacctctctttgaagtaggcaattgggccgaggaagatggcggccgtgagctgctgaagagtgacgaggacgagagggttgaggccgccgtccatggcgaccttgacgagcgacaccaacaccgccgcgacgacgttgagagccagcatggcgatgaccggcaggccacctccgagccaccaccccatgctagcttcacttgttcttggaagctcgatcctctcggtgcagtgccctctgctctctgactggactgcaacaacaacagctaagctaagctgtctccttgatacaacaacaaagtcagtttcaggtagatttatagggtttcgatcgatagaggaaggagatgaaagaaagaaagaatgaggtggcgaggatgacaagacacaaaatgctggacgggcaggcgcagggggtgaccaaagaatcgtttcaggtacgcctttttcgtcctgaagaaaaaaagatgttgatctctgaattctgatgatgatgatggattagtagttacagcatttgggtgaccgatg

SEQ ID NO: 76723 - DNA, 1787 bp, Oryza sativa
ctaatgtgatccatcaaccagtcaaaaactaacttgcaccagtccaaactttcaattaagtccatgtcttcaaaggcacttaggtattttgtactcggaatcaaagaagagttcggacaaaggaagcaattcaaggaaacaatcataaagcagatgagaatttgatcatcaggaagttcttcatttttaattaacttttctccaaagaacttgacagaaggaatagaagttttcccaaaaatatgaagaatcttttgtttgccagaatcaaattttgaatggattgtactaccaccaacatggaggcctagcacaacatggacagattgcttgttcaatggaataagtttttggcccaaaactatatcagaacagttcacatctacttgttttgcaatccaaagagcaaaagaattgggaacaaaacacttgtcaaatagcagcatgcttcgaaaacaagaattttcaatgactgttttgtgatgtggacttaaagaatcaagaacttttgagaaatatttgacagagaatctagagaatgcatcagacttcaaatcagtgtcaacatttttgtcctaacaaaaagaaaataaaacaaattaattaataaataaaaaccaaacatagatataaaagggcattgcaaaaaactaaccttcaaattttgatcacctatgttgtgatgaatattaagcttttttttcaaattgttgataatctgatccatttgtatgatatcacgtagaacctgatttatcattacatcattgtccaattcaatagattcagaccttttcatctaaaaaaattcaaaattaaaaacaaaaatgatggaaaatataaaatgaaaaataacaaacaaaataattaccttaatgttatcatcttcacttcttttagacttactgagttttcttttcaaagttttcagaagttcatttgtagaaatttcatttacatgtggttgtgaaacatccatatcctaagaaaacatattaaacagttaaaacattgcaaatgtgctatgaaacatggctacaacagaaattacattaagatcatttgtagaaattacattaagatggtcttgtgaaggtacatccatatgctgaaaataaaaaaagaaaaattaaaactgtgcaaatgcatatcaatgaagcattagtgcaaaagtaaaacaaaagtaacaagttaaaaaaaaacttacatgactgtcacaattatcaccagaatcacagtaaaaagaaaagtaacaagttaaaaaaaaacttacattactgtcactattatcactagaatcacattggtagttatcatcattatttggcaacgattcagaatgaatatcatcagattcatttaaagactggctacaatcctccaattttgagcgcttttggcgaaccatctgttcaaaatttgttatcagcaaaaatggggcaaaacattaaaatattatatgaaattggggcaaacagagaaaggcccatgggttaaaaaaattaagttcacaaacatacatacaaaattaatgtaattcactagggcatacacatgcaaaagaaaatggtgtacaattaggtaaggatatgaacattgcacaatgtagtgatgcattgcagaaagccccatcaaaaatcagctagcaaaaaaaatcataaaaagcattgaacatattcagagagggaaaaatgcaatgcactactatgtatgccaaccaaagctaccaaatataaatttaaaatcaatgtgtaacttctgcatagcgatgcagtactgaaaaatat

SEQ ID NO: 76724 - DNA, 1698 bp, Oryza sativa
catcaacaagaactccaaatagactctgaaaaagaggggttgaagtaagggtgagtacaacgtactcagcaagctattatattattcaacaatgaatgcatgagaggtaatatccgtgtagagctaggtttacttgcagaaggctgagaataaagagggagaaagcctgcaacgtatttgatgcaatagtatttaataaaatctggaattgagtttctaaccaaagtaccatatgagtcccgatcctcaaatccgtcagttcggctattcgaatagattcaaggatattcatactgcagtagatgtacgctttacccgcagtccatgacttgccactaatcattagcttagtcatggcccagtattaggttattaacaattgtggcacctgttccatgaactctagtccccatgcgctatgactgtaacgttatcagcagcgagaggagttctggcattcccacgtcatctcaaccaggttttcataaatttacacacacatcgcgcgataatcaagatatttacctgcgcctcggtaaatatcacatttgcccttcgcggcatatatttgcctccttcgcgaggacttacataagaaccactgtacagaggtaccacattgttaattaacataatatctaggtctgtccccattgtagaagctgcggtcgtactcgttcgtttgacataagtacttggtaaacttatatcgaccgagacagtactagccacccggaaatcaaccaaatcttgcgtactgtcccaatctaagttcattatattttatgcaatctaacttggcagggctaagcaaaagctagcatatctggtttgctatatgtttaggttatgcattgtaaatcatgaatggctaatgcatgtgtaacatacccgaaattttaggacttaaaatttcttgtcaaaatagttagaggttaatttctccaattttgagagccaaaaatttctgttttaatttaggtgatgaccaacttaaaccattgcatgattaaaatttgagaacaaaataaaaccttttcattcccaacattagactagaaatatcatcaagcatacatgtacataatgcatgcctaggcttgagttctttgtgcatttggagttttggtcttgcattccataataggtcccatgagcataatctaaaagaattatttcactaaacaaacctatagttaatcttgggtgataacatgtggacttaatattaaactcaaatatcatcttctcagtctaaaagaaatttaatgtaatccctataataatattagatgcaattatgaagtgggaatacatatacaaacaaaggtcatcctaattctctaaaatattttgtgcaagataaaatcatggaaaaatttatgtgtacagtgattagcacaaacttatcctctgtaattttggtaacatgttaacactcaagttgatatctcaaattaatcagttgaagcagacaactaaaagaaatcaaattaaatttaatcggctaaaaccatatttcatccaaaagtacatttaactgcacataagtgaacatggaaaattatttattcaaatactagattaggtatcatgaataaatgtaatttttctagaatttttctttctctgtttaagcctcctaaaaattcaatctagctttctaatagcccatttttgtttaatttgtgtgagcag

SEQ ID NO: 76725 - DNA, 27353 bp, Oryza sativa
  unsure (1)..(27353): unsure at all n locations
tagtaaatcatcaacactgtgctagtaaaacttttcaaattgaagttgagcttctgtagcatgaacataagtacaacaaatcaggagtacaaaaaaattgaaataaggttgaaatgattggttaagataaatcatattcctagtgaaataaaaatgttacatcaatcccttttggtaaaaacaaagttctacatccatttgatctcagagaaaacatacatagcaaagagaattacattaagatcaaattaaaataactacaataccaaaacacattacaagttacatccctatcatcagatagagtactaaaaatcacataaaccttacattatatccagaaaaaacttatagaaagaataataaaaagcatcacatcacaaacaatttgtcctcctgcttgtgagcacctagttgcaacacaaatcggtagcacaagttggggataggggggaaaccatgcaaaacacagaacaaatgcaacaacaatgataaacagatgcaaaagcaaaaaatcacacagttaaatcatagatctgaatttatattggcgaaactacacaaaataaatcagcctagtgaattaaaatcatatctacatcacacatcacgttctattaaatcaagagcacaacaacttcaaatcccacatcatgttctattaaatccagtacattcatcctcagatctaaactgaatcaagtccagataacaactagatcgaagattcaaacaccaaatcatacacgaacaacatgacatcgttgtgagaagcaaaacatcacaatctccaaaaagcaaaagcccaccacgcaaaactactagtactggttgcaaaaaaaacttgatccccaaatcctatgcatcaacaaattcgaccacaaatcatatacgaactacccaaaaaaatcacgcatccagatggctaccgattccgtcgacactcgaagggaagaaggaggaagatgagcaagtactcaccgacgaatcaccctcacgccgctccggcggaatcgccagatcaacgccgcggcggaatccctcgcgttgacgacggcaaaatcgccgaaatggtcgcctctctctctgtttctctcacctcccagagaagagaacgagaaaaagttctctccaactctctctctctctctctctctctctctctccgacacggtcaatgccagcaaaaagataggcgcgtattccgaaatttgaacagtaattgtgggttccacatgaaaacaaaaaaaataaaaaaaacgagcccaacctagaagaagcccaacttaagcccgaagaaaacataaaggcaagtccagcccaaacaaaaagtccaactgtcagcccaaacaaaaagtcagaagaaggcccacatttagcccgaactaaaaatagtccaaatcacagaactcaactgcacgaatctcaaccatatctaacagcccaaaaaagaatgattgaggactcaaatatcatgcgacagtaatatagcctttccgtttttaattaccttggaggactcccccccccccgcgtcgcccacgcgctggcgacccgggggcaaaaccctagcagcgccgccgcctttcctctcccccctcccccacctctccgccgccggaaagtcggcgggcgagccataatggcggcgacccctcttagcgcgggagaggcggcgaacggcggcggccaatgccggcaaggagacggcggatctggcttcaccttcgccgaatctggccatcccctggccagagtgggtgctggtggcggaggaggccgcggcgcggcgacgcgacaaggccggcgacgccggcacgacgaggcggcggcgacggcacggcgacgcgacggcgacgacttgcacggcagccggcggcggccgccccgacggtgagatgcgcgcgggcagcggtgctcgcgccgctggggggcgagtgacggctgcagcgccgccggccctggtggcagcgggccgagtgacggcggctgcacggcagcgacggcggcgcgaggcttgggaacgacggtgtcggcggcgcggctggtgatgggcaatggtggcggtgccagtggcagccgcggctgcagcctgaggcagtagcggcaacgcccgtcggtgcggaggcagaggcctcggagctcgtcgcagcggcggcgtcagcggctgctgtggcacggtgagaggaggcatggtggtgcgttcggcagcagtggctgcggttgcggtgaccacggtcgccggaggcatggtggcctcggacgactggcttgaggcgtggcaaacggctacatcggaccggcgcagcattgtttggaggaggggtcggagaccggcttggcacagagtggcatagccgatgacagcggaggccggctcggtgcgagaggcgcgagcggcggagatggaggccagctttgcgcgagaggcgcgaccggcggtggaggaggcgaccttggtgcgaggaggagcggccggtgggtatggcgtggtctttggcgcacgaagactggctggcgggagacgccagtgcaggggtcccgtatgtcggcagagctggagaggtggtggagcaccggtgcgtcagccaaggatttgcaggtggtgagcagcgggtgaaaacctagtccggccttggccgggccgacgacaatggttcattccccctcctgagggcgttgtcgtgctgtctcacccttcaagggcggttgccgggcaaaagcctagtctcggctcctttgagccccgacggaaggcggcggcggttttttcggtcgcttctcttcttgaagacgtcgtttttggcatcccttagagggcgatcttgtctgtgttcctttgttggtctagcggcggtcggtcacgcttagcggtggccggtccggtgctatcctcctcccgggttgtgtgttggcgctgtcggtgtgcgggtgttggtatattttttttcctttttcctggttacgaccctctagggttgtaatcttgtaattttttcctgctctatcaatagaacttcgcaccgtctcgtgcgagtcgttcaaaaaaaagttatggagtactccctctgtcaaaaaaaaagcaacctagtattaggttaagttttcttgggacagagggagtagacattaagcagatgaagcaggcagtgacaccagcgcacacacagatagagagagcgatgtatgtatactcttaggcagcagtgtgtaaaaactattgaggcaatctacctctcgtggaggctgttcaagtcattatatacgatacagcaatagtacaactcaagaccgaatcgtatattactaacctatacagattctacatacacaaggaaaacacctatacagcatcggaaacgaatcagttatgcagtaacgtaagcagcagcatctctattgtttaacacagtgatctctgattaattattgtttgacagacaattgacaatcgagcgctgcgctgtataagactgacgccatagttaaaagttgccatagaaagatgtcaaagattttctttcatcagaatataagcatgcaaagtggctgacgactaatttctcatttgtatttcacgaactgaagtttaagttacataattgcagagcaaggagaggcagcactgacatgacgcagagcgagcgctgtgaagcagcacagtcagaaaggtcactctgggttattgtttttgtttcagaagaccgcacgcagaggctagtgttgtagtagtaacgacggtcacagctacagctacagcgctgcaggctgcagccagatcagctagatggaggccgggacggagtaggcgcactgctgcatgacgagctggtcgatgggcagcgtgtccgtggggaacgggcaggcgccatcgtgcgccccctgcagcggctggcacggcgccggcgtgacgccggtggacaccccctcgatgtcggtgcaggtccacgggtacttgcgcgacttggagagcgtggcggtgacgttggcgatgcagatgccgcggaagggggcgccctggatgccctccagcctggcggcctccttgtacacccccgtggccaccacgtcctggtagctgatgttgtccacgacggggatggcgttggggtcgtaaccgtcgtccgggtgggacttgtagttccccgtcatccagaacacccacttcatggtgtccagcgacatcccccggacgaacacgtcgcgcacgtacgccccacgccccaccgccgtcttgatccgcaccgccgactccgagttcaccgccgttatgtcctccgcccgcacgtcgctgatcccgcccgacatctcgctgcccagcgcgatcaccgcgcttgtcggcgacacgcacgtcagcctccgcaccacgatgtgctggctgggcatcccgtacgcgatcccgtactcgtcccacccggacttgatcgccacgcagtcgtcgccggacacgatgtagcagtcctcgatgcggacgtgggagcacgagtccgggttgatgccgtcggtgttgggcgagtgcgtcggtgccaggatcgtcaccccctgcaccacgatgttgctgctgtacaccgggtggatgttccacgccggcgagttcaccagcgtcacgttcgatatcaccaccgtgtccgagtgcatcacctcgatcaggtacccacgcgtgtacttgagcttgttcgaatggaacttggaccaccacatcgccccctgcccgtcgatcgtcccgttcgcgccggtgatcaccacgtccgtcaggttggacccgccgatcaggctcgcgtaccggccgccggccttgtcgcggccgcggccgtacgacgggaggggatcgatgatgggccactcgcccatgtcctgggaccccaggatgacggcgtcgctgtggaggaacagggtgaagtggctcgtcaggttgaacggcccagtgagccacttccccgccggcacgtacagcatcgccccgccgccgccctcgccggagtactgcgacaggtggtccaccgcgacttgaaagccgccgtgttcgacgtcgtgccgtcgcccacgccgccgaagtccgtcagcgacgccgtgtgcgcgcggcagctcggcgccaggtacatgctctgcccggcgatgggcgccgccgggccgtggcgccgcgccgccaccgtcgccgacgcggccaggaggaggacgcatacggaccgaagaacctgtgccaacaaattaagatcatcttatttactaaagtactctcctaaataaaagggaggaaaatatgaaaaattgcagatttcgacatactcagatttctcaatctactgtgcttgctagttacttcgacagaaaaggggatggagattgctaattggacagaaaatttagtgaaaacaaatactatactccttataatagaggggaaaaggtggtgatgaatttcagactttgacagtgaaagctcacataatttgtactactgcactgtccgacacacccgacagaaaattttaaccagaaattgggattcaaaaagcagggagcgcgtgatctttgtttagttggtagtgcattcctaaagcattgttaaatcagtatagaaaacgagacaagaaaaaaaaacattactgtacaatattcagagaagaagagagcattcttcaggataggagaagattaggtacagagaaacaggaacaagcaatgaccaagaacaggttgcaagacaatgaaacgggcgttctggcactgccattcataagatttttaggacagccataaagaatacagcaagcgaaacagctacgcaagcaatgaatgatgctactaaatagcaagatggaggcagagtcagttacatacatgaagaggtgacgcatttggtaccggctgcgtttgcaacgccattgctctggatgagagtggagtgtggtcacggatgagatgagagaatggagtggggtggattggatggtaacggcgagtgaagctgcagatttataggaggcctttctgcactattgagcactcactcctgcctcatccttagtactattaattaattagtgagatttattatccatgcaatccagcactaactttccctgtcttttcttttctgtacgactcctccctttttctcttcaaattgacatcctgaatactttatgctattaccagttcatgtgaaaaatttacctttttactagtagagcttttcagctgcctgcctgcctgccaatagcccaatagcttgctttttaccggccacccggcctcatcttatcgatgcctagattatattcgctgtgacttaatacgaactagtgaactactaaagcattcagtttatactagtagtagagttcttgtttgttcagttcagagatcacatgtgatggtcagttcagtgttgtgctctcttttcaggttgtctgtttccctatcttaacactagatggttgatactgtcaatcagtcacgggtctagaaattaggcagcagcatttaccctccgagtttatatcttttctataacatattctcaaattaaacccctaattaattttcagctataactaaggtttttttttctgttactgaatcagctctgtttttttttcagtctttattgtgcactatgaagtatgaatgaccacatgctgtattttgtgataaaaaaaagtgcatgtgttaaagctgtgattgtgggacggtggtaatgaacaattcatttgtctaatcaatcatgttgtgatcgatgaaccacatatatatggtgcggtgcttgtcatcgtcgtcgccggaattgaagtgctctgtttcagtgcgcatgcaatcctacgcaagacagtctttgggaagtcgccgctcgtgctggattttgtggccaccaattgctttagaattttgtgcaccttttggttccactagttagtatagtagttattattcaggaggattaaacctgcttttgcacctgatttccctcctttggatagaaaagggcaggtgcatccgtgcatgagtattactccatatgaaatcagcctgccagatcctccaaaattaaaagcttatggccaccgaaggatcacatttggactgaatanctatgatagatcatgtgtgggggtggtgactggacatatattcagagacaaactgccggtttagtttttttaaaaaaaaagaagccggttcatagttcatgcattgcgtctcattgtattgtactactatcagagattcagagagagagagagagagagagagagagagagaggaattcagccatgtcacggggcgttcatagttggtgagattggtcgttctttgtggttcacgggtggatcgtagtatatgcattagtaccattgtcgtattattgttgtcggtcccattacacgatcacgatgctttcggccttcactctactactactaattagccttttcttggattacgcaaagcgagctcacgagctcaacatacatacggatatgcttgctcgcctcagttgagtagaacttgagtgttcatcagctcagtcctttcagttgttgctgtcttctcctgaatcagtttcagtacgctctctgccctctgcagccggttccaaactgtaatcctactccgagcatgcaaatgaacctcagttaattcattactgctgctaatcagtgaatacaagtgtttttttaactaggagagccaagcaaatgagacattacatcagtgaaatgagacagaaatgagacattacatcagtgaatacaagttgttaaggaaaaatgttacaaacaaatactactatgatactattcagtgaggctttaaggattcagacagaaaagatagtgaatgctactgtagtacatgttcggtaccactacaaacacacactacacttgcattgcatgcgtgcaagcttaacttaatcaagtaacaagtggcaacctcatgtctgcatgcgtgctttacgcgcttagcttcagtgggtcggcgccgctctgccatatatgctatgctctccaccatcacaacaacattcacaactcgatcagcaatttatttattttgagcaggctgcacatgtacatattacaggatatcagacagctgaaaatgcttgtccaaccacaatatttacatatgggaattgaaaatgcatgcatcacttaatatatatgctggtccaagcacaatccatatttttacaaggtcagaaaagaggccgaaattatacgcacgcccggtgcttttcgtcagagaaaagggtttctccttttcctttcctttcctttcgtttgtggcacgcccggccgtccagtaatgggatgggattggtatcgcccactaccattttccatccatctattccattctcaacttaaatcacccgatcattgctcagtaaaattcaagtgaactgaaaggagtcacagagctttcggtgataatgctggcggcggcgaaaaatcaaggataactcaacctaggctctagaagtaaaacgactctcacaacttatcctttaactttgtttctttctcgtactttttttttccgcgaagattacatttctttccttacttgtaccttttcctttttctcctgctatatataataaaattggtatggtttaagtgccggttagttttttttaaaaaaaaaaaagaaatcacctagcaagccgatatatatactcttgtttttacttaatttttcagtgataaaacagtaaaaaaatgacacatagctttttataatgaaaatggtttgaatttccaatctctcccagcaggcacgcaacgagcaaaatgacacatataaacacatgtttataccaccatacatacatgacactagcaaggagtagacatgtgtggtgttcaggcctaaatatgttcatggacaatcgatctgcagtagctcttgtgtgcgatgcatgccacgtacacacgcacaaatgagcttaccgttcttgttatactattatgtaacatatactccatatcttttggctttttgcatgaagcagtttggggagttcgcacaaaggtgagagacatatatagatcgatgggaatgcagtccccaccactcacactatagctagagagtacagatccaatattaacactgttctatcaattaacaatggaatgactgctgcaaaaaaggaaggtggccaggagccaacccaaccatgcatggacaacaataatacatgcactttctatccactagaattagagtacatgcatatgccggaaagaaattaggaaaacaagcatcacaacctggaggtgacaattcatcaataatccattccagccacatctgatctactactatgagggaatttaacatgcagatgctaggttatttctggtcgagatgcgatcatgccaacacaacgaaacaatcaggtaagcatcatatcattcatcactagtctcctcaactctcaaggaagctagctaggccatctaaaaatgcagtttacaccacaaacactttcaatcaaataaggcaaggagggcccattacaacacctatataattaactgacaccaaacatttttgtctttgaactcgtaacatgcaacagtaaaaatggctttcctataccaaactttggtttctaaagaaaagaaaaaaaaactaagtatcactctgataaaaagatgcatcttatgtgactacatacagattatgcatttggtatgtttataatcctctctgtatttctgttcagcctattgttggttccactgaccactttcagactcagtggctgaagatgctgccgctactgcttctccttggatggtaaatggatcctccctcctcttctgcaatggtgagacaatggctatagggccagggtggatatctgactgagcaagtgcttcttgatagagtggtgcttcacaatccgtcaattgctcccatgatgaaaatgtctgggacatgccccaattggtccatctcaattggggaacataagcatgagagacacttgttggtttgccagaaggataagcatctactccttgtgaatctggagcaaatccaaagcccacaaaatcctcccagtggttgcatattctaaggttgttcaacatcaaatggcagggttcctcggagtcttcgtctatgagaacatgaagagccactgcttcagctattgcagcaccttcatcatctagcctctgttgctcttcccttttctgctgccgtttcttctccagttctgaaataatagcagccgagtttgcaagtgctttctctaaccggcgccttttcttctccgcttgcttttggcgatccagctcatcttttgcatgcttctttttccctttcttcaacaccttgcctccctgattgcctccagccttatccatggaaaatgtgccaccttctcactatatgtgatgttcctatacaaatcaaagattcagaatcaaaagatacctcaatgatagattttattttaatgaagaagctattcaggcagtaatgaattcaagatggaatacctaaatcaactcaggagtcaggactgaaagaatatactgtttcttctattgttaattttgcccataatttcttgctgcgcagtttttgccccttttcatagcacaacaaactcatatggatcttctcctgtattaaggaaataacaaagtgaggtactgactactgaactaatatatgaaggtacaaaatgcagatgctggagtaaagcaggagagcatacaaggtgattcttagcagtcaaaggaatatacacggggaataaaggccatcaagtacaacatatgtttgctgacaggcctaagatgagggtgatacattacttgttgaacctgaacgcaaagtcaagccaaaccatgttgaaaaaaaatggaacatttttttcaaaattaaagtttgatatgcttttggttttcggaatttttcaggaagagacagtggtatcttaaccctattgtcaactacaaatttcaataacatatatggagaacagaggaatataaataacaaaggcaaagaagatgctagcagccatgtactatgtgcaccagaaattataattagactaagaactaaagagttgcattcttagatataatatgcagaccacgaatatttagttcttatcattaaataacacatagctggagcccaagatcaaagattaatacttctagtcataggaaagtctacttttgtgtctcagatttaataaagaccaaaagattcatatcagacaggagctgtcttcctaagcccaacatcagactaaactccataaaactatagaagtgatcctgagtaactgcagttaatactaatattatttgtctcatcacttagcatgggaaaatgcagcctgaagatacaattcacagctgccttgcccgtgccaaagggttctgattccacccacccggagcttgttggtcctccagggctccttccaagcacaatacgcattaatcaccgccggatagtaggacccagcgcgacaagtttctggctttaattttcacagctactctaaatacccctggtgaattctgttgtgtatactttgtttggaaattggaaatatagacgggtcatagaaaacaagagtgcataggaactagctattcaaggagttagctacatactaaccaaaatttacaagtttgggcatccagaggataaatagttatgacaagacattccccctcatagcattaattggaaattgaacctaaatagtggagtcccatttttacctatttgatcgccaaagccaaaagtttcctaatagagtagacaaaatcaagcaaaatttgtatctagcgtaaggctttcaaatcctcggaaataacctagatttacagatttgatcaatactactatatgcaaaacaattaccaccactagtgttatcctggtacagttgaccggaaaaaaaagatggaaaattgaagcaattggcgtcccttgtccatctgagtaagaaacaagagagagaattgaggatgaaggattgggggaactcacccctatggacctatatgcgtcccagtggcggcggagaaggcggaggagggagagatccgttgggtgcgagtggagatccgggggggaggaggcgaagtcggcgagcggaggggggtcgagatccggcggcgaccgagtgcgtcgcggcctcgcgggggaagagaagagaagagaagagaaggcggcgacggagggaggaaggaaggaatccgcgggcaccaaaccggatatcatcaattaatttccctccctccaatccaaccaccgcaaaatactaccgctgtactacatgggatgggatgggtgggaccatcggtatccaagactattatctctatttggcttaaatttgcaataaaaaatttaaaatttctcaagccaatttgcaacgcaccatcataaaatgccactaagttgaaaaaaagaaacatcatatttgcaatgtagatttagactgggtgacgctaatggacgggtgatcgccgtccctccccccccccccaatgcactcctctccccccttcctcctcctcttcttctcttcctactacaccataattttttaaagaaaataaaaaaacaaagttagaaaaatttatgtatagaaatactacatataaaaatatttgaattctaattctaatttgaatcaggtatataaatttttgacttataaactttgggtctataaactttagatgtatagaaatactatatataaaaaatatttgaattcaaatttaaatttgaatcggatatataaacttttgacttataaactttgggtctctaaactttagatgtgtaaacttgaggtgtataaactttaggtacataaatttactaaaataggaaagtaatgcggtgccaaaaaagaaaaccacatggaggagggggtgatagctcggggcgatcgattgcccattaggcttttcgattcagactttacatgtcatactcatataaaggctatgtttagttcctcaaaaacttttcgcaaaaacatcacatcgaatctttggacacatatatggagcattaaatatagataaaaagaaaaactaattgcacagtttgcatgtaaatcgcgagacgaatattttaagcctaattagttcatgattagccataaatactataataccccatatgtgctaatgacggcttaattaagttcaaaagtttcgtctcacggtttacatgtgagttatgaaattaggtttttcattcgtgtccgaaaactccttccaacatccggtcaaacgtccgatgtgacatcaaaaaattattatttcaccaactaaacagggcctatactagatggaaaaaacgttcttccagcacatgctcaataggacaggcaccataaataaaccaatacattaaaaaaatcttataagtattcgggtaaaaagatctatgccgtacggatttatcaccattctaccttatacgatccagtagtagtactacctccgtttttttaatcgatgatgccgttgactttttctcacatatttgaccattcgttttattaaaaaatttatgtaattataatttattttgttatgagtggttttatcactcatagtactttaagtgtgatttatatcttatacatttacataaaaattttgaataagacgaatggtcaaacatgtgagaaaaagtcaacgacgttatgtattaaaaaacggagggagtaatagttattatgtgccacatcatttattgataaaacattttgatttaccttgattctcatcgaacctatctcaagaaaatcgaatgcaaaactcctgctatcgaaaggggggaaaagaaaaggaaagaaacgtagaaagggtgaaaaatagaaagcaagggaggcaggcatgagccaggagggatcacagacgtgactacacagctagtggtagctgatttgtctaaactaactaccactccatctataagagatcctatccacctatacttcaaataaaattttctcttaaactactcatccgatctacgatccgattacaccgttgtgttcgtaacaattaaatatttataacaagatcttacatgattatattttgatgaaaaattataaattacttttagatttcactaaattacttcttagacatataaaagtaaattcaatatagcctaaaattaatttacatatattaagtaacttataaaaaaagaaagtaactttaatgcatgcctttttttcattagccgtgactacacaactagtggtagttggtttgtactccatctagtgtctcctttcatattatttttaagatctatttgtatcattgtacttcactcaaaatatgtgacaaaacgagattcatattgaatatattctaacattttattaatttaaaagtaatttattacatgttatagaaagtaacttccaagttatcaggaagtagctattacatcttatacatggttaattctcattatttattccatcaatgttatttgcaatccatcaaaggttttatcttcttttctcattctacacgaaaaacaaaaatgaaaggagaaaaacaattggtaattaaacagatttatagagagttacttctgaaccatgcaaaagttccttccaattaacattgaagttacttttaaaaattgttaaacttatgtgtgttaatctgtgctgattaaatttaatttctagataaagtcatatttttatccctacaacgaatttacttctaatgtcgtgacaaagttacttccgttttgttttaagatacttttataatatatgtaaattacttttagactttattgaatttacttttatatgtcgaagaagtaatttagtgaaatctaaaagtaacttacgtatataataaaaataatttataaatataaacatttgttcatcgtaatataattatgtaagatattgttttgaagatttaattctaacgaacacaatagtgtaatcggattgtagatcggataagtaatttgagagaaaactttataagaagggaaaagagaggttactttttttcatttttcccttaaaaaataggctttcttggaaataggaatcatggaataatcctgaattctaatgtttatttctatagtataagaaaaactaattgaatcaaattcatggatttaccacgacctcggctgtgaccccatagataaaaatgcaaaatttctatcttcgagaccattgaaaaaagacattgaacgagaaaaaatcgtcggaaaaaaaaagacatgcatgtctacattgaaaaaaagcatgcacgtgtagtagtactttttctcacaactagatggtcgctgattaacactaaatcaagaggcttctcggtttagattttgccgggggatcacccatgagcgagggcgaggaggaggaggggaggcaggtccaggaggtggtggcgcacgtgtacgacgttgcgagcagcgggtcgtcggaggggggcggcggcggcaccgccatcctccacgtcaaccgcttcttcaaggacgccatcggcctcggcggcatcttccacaccgccatccaggtttccccccattaattgttcttccggattgtaagaaatatcgatctgcatcttgcttgcgcccggcccaatgtattcgtcttctacggaaaagaaaaactctcattttgaatgctaagcaaacagacagcggtcgatctgggaataaccagtttctcctgggaagatctttgctcattcagtcacattggaaccggtggtgcacaactcaattgatgtagaatgccttgcaaaaatcggaccttttagaaactggaagaatactgtgagaaatgtagtacacctggtaggacaattcagagcctttttcggcttccacttaggtctcaatttcttgttgattaaatcgtcaaaaaatatcctacattttagctgaaatgttcactacgaattgggtaaatctgcatatactagccttccgggaaaaaaaattatattgatgcacttaataggtggcaatactgttccttgttgaactttcttgatacatggtcttgcaacgaaacccctagctacttactgttgattaatacatgctcattcttgagcatctgcaatcagatgaacccctaggtattgattcattctgtgtgcctattacaggtgtatggagatgaagaatggtcctttggttactgtgaaaatggcaccggggtttttagctgccccccgtgcaaaaaccccatgtacacgtaccgtgagtccatagtgctggggaagacgacctgctctattttcacggtaaaccaaatactacgggaactgagctggaaatggcctggaggctcatatgaactcctgtccaggaactgcaatcacttctgcaatactttctgtgagaagcttgatgtaccaaaacttccaggtccttcaaattgtttgctgattcattaccatataaaccatatgtactcatatctgactgtaatagttttacaacacacaatgacaacaaaatttcaatcaattatgtacagcttgggtcaatcgcttcgcaaatgctggggatgctgctctagaggtagctgaaaatacagcagaaaaggtgcaccattctgaacttctatgctatatgtaacagcccagtgtccaagccggctctagtaagtagtaaccccattatatatactatacacacatagcaacccatttgcacttttaactcaactcatgctaattggtaaccagcttcctttgtgcatctaaggtttatatgctggttcccagcttcaacttaatactggttatactccatttgtatgttcagtactttaactggcactagaaggtagaaacccaataccatatatatcccctcaagtcccgtatatctgctagatttttcagtaacaaaatatggatacagccgtagcacataaactgtgtgagcacatgaatgatacttagatgctcaattgaaataaataaataatatggtgaaagcacaaaaaaaaactgcaaatcagcacttatactagctgtcaaaaattttgaaattaatgtgcacactgtcaacttgtcacatcggtttggaaaggtaattcatgaacaatagttcttagtataaatttttggtacctcctcaaggatcataaaaacaaaagaagtgcaaaaatccaaataccatgtccactgactattaacattagttagttttactgcctatttatttggagtaaattgatctggcatagatcttttttacttttcactcagctgaagcaagcaaaaaaggacattgcgggtgcatgcaaagcagccaccacatatttgactggtgcatcttcaagttcaccatcaaatgcagatgactcaggcggttcaacaaatagttctctttttgaggggacatggctcagaagtatcatcggcatcagtatgaaaccatcaaggagtctcatgtgttcggatagttcagatagttcagatgatgaaaaatctgaagatgagagggaatcagattgccaacagcctagcggtgatcaaattgaagaaaaaaaggatgctacacaagagcaagcaggaaagtgagaatagaccatgccatcatccatgaaggtcacaccacaatgtaccgaaagaggagcaacatttcaagattgcaatttgctgattaaaaaaatttacacagcgagcaagcaatctacaacaagaacctaatttacacattgggtggcatcgacttgtgatcaagaacggggagctgtgacaaagccctgacaagtgccgaagtgatggcgctcatcacaatgcgtgcaatcctggactttacttgcccacggcgtggcagtggacgaactctcatttgcttttcgcccttgtagactttgatgagatgagcagaggcaaccttgcaagctttctcgcccatgttggtgaaggagatatcagaaaacttgtctggcactatgcttgatctctgttcccgtcgtgtacttataggctaggagatgttgtatctgaatggaagacatgacagctaaactcttgtttcattgccgtattagctgagggagccattgactatacctgaatgatgttgtttttttgtataatcttgcagtgtctgttgagatgaaatgagatgcttctgttgatctatttgtgtcaagattgatagagctgtttgtccgcgtgtgatgtgcaaatctttgactagatagaggctctgtggtttctgatgaacagacatgtgtgcatctggtggaacaaactgcagacttgtcatttattctggtcaggtgtggtgtcgtgtccatgtttctcaggtgcaaagaattgttgccaacctgtgatgtcccccaaatctgagtataaaacctgatgcagaagcatttgtggttaagcttgtttattaggggggcaatcatgaggttcgtagcattgtctcaatcttgaaggaaatcatgtccaccattattgccaattatccttgcttgcgtggtagagtagttgcagtccagagattggctgaatgcacgtactggtgatgaatctctgatggatggaagaagtttcctatgccaagacttgatcatcctgaagtaaggtattccctccgtaaatatttttttttaaaaaaacgaacttggaactgaatgtgatatattctagtacaacgaacatggttagaaattctgtccagatacgttgtgactaggacatgtcacatccaattctaaatttatttatttatttatttttggaacagtaggtaggagaagccctggtcctgtgggagagaagcagaagcaggtcgcggcgttcatctcatcactcatcagggtttgtggtcacaagtaactcgtaccatatcttctcctatctcatttctcaactgaatgactcgatttttatggcgcttttcgccactccccgtccccaaatataaaaccatgatttcgcgcagcaactcaggcacagccaaacagcctgaccattaaaaaaaattataatttactgttttgtgttttggtgtgcctgactaaaaatgtttaaacagcacgccacgacggacaaactagaaagaaagaaagaaagaaagaaaaaaaaacatttatccgtttggtaccacggtagtagaaaatatcagcatgaggaattaaattgcgtttggatttatcaggagagaattgatgctcaaaacctgaatgctactagttgtttgttgcaacataaagaagaagaagaagaaaaggaggagggcgtcacacttggcgcagacaaaacaacgagaccgtacaggtagaggtggtaaaggtaaacgacgagagctaaagaaatctggcatggcgccaccggcaccggccgctttcctcctcccctccaaccattcatatcgcccgctcttgcctcgcccaatcctgcaccacgccaccggcttcgcctgcgcctcggcctcgccctcgccgccccctcgccttcgccttcgccttcggcatgccgccccgctccgtgccgccgccctgccggccatcgccatcgcccccggcgaccactggggcaactgggccttcctcctctccgccgccgccttcggcacctggtaccgaatgccgctcccttcttctcatgctcgtctcgtctgctctgctctgcctgctcattgctgaataatgatggcatggcaggtcggaggagtccacgtcgtggggcgccgcgctcagcggctcgctcgtcagcatcatggccggcctggccgccacggccacgggtctcgtcacggccggcgcgccggcgcaagacgccgtcatggactacctgctgccggccaccgtcccgctcctgcttctcggcgccgacctccgccgcgtcgtcagcaccaccggcgacctcctcaaggccttcctcatcggatcaggtaacttaattatcttccttattatgtgtatattaatcaattctagtacctccacaattaattaattaactaatgtctctctcttgaatcagcgaaccaataacattgcaaaactttgctactttaattgattaattccccctcttgccgtccggcctgccggccagcccagctaattaattttcgtttaaaagcaaacaaatcgcaagctcccaagatgcaaactcactcggtcatactgacattatagtgcatgtgtcattgcctttgtaactggtaggagtacttactttgattaatttttaactacaaaatgccacaatgatttcatctttccaagtcacccagtcactcaaacactgggacagtgatgttgagcaggaattaactgactgacaagattgatgtgatgcggctgaatgtgctttattattgatgatgcaattaacctttgcagttgcaactacaattggcacaacgatagcctttctgttggttcctatgaaatcactgggtcaagatagctggaagatcgccgctgcgctcatgggcagctacattggtggaggtaaatcatcgttaccagctaaatggggggtatattttggcaggatttaagaaagaattacacatactacattttgattaattaggacattaattatgatctgagcacgcatttccatttccatatgattgaaacagcggtgaattacgtcgcaatctctgaagcacttggcgtttctccgtcagtgctagcagccggtgtggctgcagacaacatcatctctgcactctacttcatgaccctcttctcgctggcagccaagataccagctgaacctaaaactgctcaaggtacgtacggagattcaatatgtatatatcatctgaatttcttagcttataaagctaattaatgaaatgatggatggagcatagcagagggtagtaacggcggcgagtctgagggcggaaggcggatgtcggtgctccatggcggcgcggcggtggcgctgtcgttcgtgatctgcaaggccgggtcggccatctccagccagctgggaatccagggcggcaccctgccgtgcgtgacggcgctggtggtggcgctggcgacggcgttcccgcggctgctggggaagctggcgccgtccggcgagaccatcgcgctgatcctgatgcaggtgttcttcacggtggtgggcgccaacggcaacctggtggacgcggtgaccaaggcgcccagcgtgttcgcgttcgcgctggtgcaagtgaccatccacctaggcatcgtgctcgccgcagggaagctgatggggttcgagcggaagccgctgctgatcgcgtccaacgccaacgtgggcgggccgacgacggcggcggccatggcgacggccaaggggtggagctcgctgatcgtgccgggcatcctggtgggcatgttcgggatctccattgccacgtttgttggcatcgggttcggcatgtttgtgctcaggaggatctgcggcgcctaaccaatctatagtactaacaattcaattggtttatatatagctgtgatcaataaataataatggaggagtagtagcaatgaagaatcatgcatgcatttcaatgaaaagtgtaaacattagaagaagaagaagaagaagaagaaaatactgtattatttatcaagagtaatactattattattagaagaagaagaagaaaagtttgcagatgatggatggattacaacaaattaaggttctgaaccgaaaaatcaagctcgtccttgtgctactgatttccacagtgaggaaaattggttgggtgcagtaaacgggcagggggacagaaggcacaggtggtggtggtagttggcaatggcagggtcaagcgtggacgaagctgggggcgtcgaggaggtagggcgtaaagcggagctcggcgaagaggaggtgcttgtgggtggggtttttgatgctgcgagcgacgaagttgaggtggaggtagaagaggcctctgaagcggatggagcaggcggcgatgggaggcgggtcaggcagcagcttgctgtcctccactgggtcgaacaccaagtagtcgtcatcaactccttggctcttgcaatggcggcgccatcgtggcgagttgtaatgggcgagggcttcttggatgtactccgcacggcgctcttgctccgtcattggcgttcggtgctcggtgcaggaccccatcacaagtagttgccggcgtgcttgctcctgctcctccaggtacggtggccgcttggggtcgtccaaaacggcgcccccctctaccatcacccacctcacctcatcacctttcgttgcgcgtcccaaaactaaccccaacgattcgatccaccgcgcgatgtatctcttatatttatttacaatctgtaggcagcctccctcgtttcgtgtttgtatccaaatcggaatcattatagattaatctcaatacgactcctactgcttctcatcaaaattacaaaaacggatttgatatacaactgtcgccagattttttttttccctgaataaaactcttagtttgtcagtcatcagatgagtgttacgattcgtgctagggcatggaatggaaaaaatatcggaattgctaaatgtcatccaatagaaaactaaggtcaaaatcttgtaaatttaatttctaaccttgagatttgctttgtgattcatgctccagcaaccctacctcctccatatccgacgaagctcggtgaccggcaacaactgtaacaaccctccctcccgtaccgcgtagccagcctatcggacaggcgggcccacttacacataccactccgcttaattacactttcgtcctcccgccagaaccgcgtagctgtcgatgcgaaaaatacgcgctagcctaagaggtttgctttactctagtgcaagtccaaagagatcgctttcgagttcagggcgttccagttggtttgatcctacaaccaacaagaaacaaagaaaccaaagaagttgtaattgatttaactcctgcacgactaggctaacctcttgaaaattagtctttctttccacattaaataccactagtaatatgcacatactaacgctacgatgatatttggaatgcaaaccaaacataaatgtaatataacgagcttgaataagatatatttaagattgatgaaaaatgaacgacatagaattattatattgtgaattacatagccacaagtgtctaaaataacatccccattttttttatcttttgaaaccatatatatgttcttgatgcgcttcttttttgagaacgcgcaaaaggattgcacgtcaatatattagcaagaaaagagtttttgttacacaaagtaatcggccagactggcttatgcaaagggaggaggggagaaaaagcaaaataaaaaaacttgaagctaggaactactacgacggttaaaaacgcaactccaaacaacgggaggggacagagccacgctacactcctaagagatccccaaaaaaagcaacgtcggctaaagaccacagctggccctccgagcgggtggactccataaccactgcgaccgaagcgagcgcagagtcgaaaaccctggagtttcgttccttccacagctgccaggagactaggagtaccaaggagtcgaagccgctgcagtggtgctcaggtaaacaggccctggaggatgaccaccaatcctggagccagctgccacgaaggggagagagggcagcccagccaggaggggacatcacacggagccagacctgccgagcgaacacgcaatcgatgaggatgtggttcgccgtctcaagcttctgagcgcaaaaggggcaagcagagtggctatcgataccacgcttttggagaagatcggcagtccagcagcgctgctgaaatgcaaaccaaaggaagaacttgcatttagcagggcccttcgcgtgccagagtaggtcggcacaggcaaaagagtgctggccaaggaagaacgcccgatacgtcgattgcgttgagtagcactggtcacccgtccaacgccaggcgaggtgatcctcaacacccgatgagagctgggtaggaagcaccgcatcccagactaacaggaactgagagatgaccgggacagtgagggcgccacatatgtcaccaacccaggagttgttcgctaacccaacggcaaccgtgcgcgatccccgaaagcgtggaggcacggcgtggaggaggtcaggagctatagaagctatcgagcgaccatcgatccatcggtcagtccagaagagcgtggactgaccatctcccaggatagagaaggtggatgctgcaaacatgtcgaagacgctccactcaacaggggccttcagaacaaaccagtagtgatgtcccgagtgctgaagccagagccaacgaactctcaaggcaaagccagccatcatgagatccataatgcccagtccactgagatccctaggacgacaaaccctcgtccaggacacccggcactatcccccattggccgagtccgtacccgtccacaagaaggcgcaacgcttcttgtcaatggctttgataacccagcttggcaagccgatcgccatagaaacatggactggaatggaagagagaaccgactggactagaaccgagcgacccgccagagtggtgagacggcccttccaggagggagccgatgggagactttatccacaagcggttgcagggccgcttttggcagcttgcgaactgacagtggaatgccgaggtaggtgcagggaaactccgagattgagcaaggaaaagaggactgaaccagtttcaggtcaagaaccgagcagcggatcggagtaatcgagcacttggtgaagttggtccgaagcccagaagcggcaccgaagacagagaggatgccttggatgaactcaaggtcttgccgaacgggggaaaggaagagaactagatcatcggcgtagagggatgcacgatgtcgaatagcacgatcattgaggggaagaaaaccacccgagtcaaaggctttgcggagcatcgcattgagcacatccatgactagaatgaaaagcatgggggaaagaggatctccttggcgaagacctctccgatgggggaaccgtggacctggcaccccattaaccagcacccgggaagaggaggcactgagaatgagggagatccaatcacgccaacgttgactgaagccaagttgggctagcacctcaagcaagaaaggccagctgaccgtgtcaaaggccttcgcgatatccaccttgagaagaagtcagggaacgcgtttggcgtggagcgcccttgccgcaagcttgacatagcggaagttgtcatgaagagagcggcccttgatgaaagcgctctggttagacgccacaagctcgtccaggcgaggggagagacgagaggccaagatcttggagaacagcttcccaaagctgtggataaggctaatcagcctaaaatccttaatgtcaacagcctcgtccttcttcggcaagagggagatcagggcgttcttaaattactgtatgactataggtgtaatgtcttcaaataaattctcattgtaattcaataagttaatgaatctgcaaatagttcacgtaaatggaacataatgcttgatctcaaatgacaaagaaacatatatagtatgggcatcttatccctgatcaacatcacaaagaaggattcatcattttacagtgttaaatgaaaacatgcagcatcaaatctattgcagccggattatgagccacccctgcaacatgaaaattcacatttatatttgcatggatctatgactcgtacagatttgaaaggcatgaacaatctaacctgtgaagtaattccagtagtaaaatggaatgcattgtcaataaattgtagtaaaaaaacaaaaaaactgtaccaactgaaaacctttcaaaagaggaaggagtcaaaccatatcaagcaacgaggtttcaaaatgaaatcattttgtgtaatactccctccgtttcaaaatgtttgacaccgttgactttttagcacatgtttgaccgtttgtcttattaaaaaaatttgtgaaatatgtaaaactatatgtgtacatgaaagtatatttaacaatgaatcaaatgatatgaaaagaataaataattacttaaattttttgaataagacgaatggtcaaacatgtactaaaaagtcaatagcgtcaaacattttaaaacggatagagtagtatatatactactgaaatagtgagagcagagcactatatgagttggcatcaataccccagatattatgcagtgaatcaggcatcaagaatagccaaagttaatcagaaagttgaaaaatagtatatacaccttatgaatttgtctgcaatttagatattcttttacaagattgctccatcactcttttatggtcaatattctcaacatgattgaagaacaatgttcaatattgttatacttatcctacctattgtgtgataatccacaatcatttctgacacaatgtgatatatgtctaaagaagtggtccttctaagatcatatgccaccaaaccactattgaattcatcactgagaatagatattttgtggcacagctcaggttattagaagggagctatttacctgaaatgcttttggacatctaccatttgacgctgcaaagcaaccaaggtaacatgataattcctgccaaaaaaaaaattgactgaataagcaactgaatatcagagacaggatgcaggaaacaaagaaatttcaacaactgttatgtcatccttgttgaattgttgagatgaacctcaacaatctgacccctgcgatagattcaaaagcatatggagtgcaattttttctttgtattttattccatgatagtgaataagtcggcagcgatggaacgatgggcggaggtcaatggcgaggaagcgggatcaggcggtgatgtagtcttcgagatgataatatcgctgagatggatgtatacggcaagatcagcttaccaagctcagatcagttcataattctctcactgtcccactttgatctggaaagttccaagtgctgaatttatgtgtggcttggctactgatttcaaaacaggatatggacagctgatcgcctgcaactacggggctggtaaaacaacaacatgagatggcattctgggaggctgtggaagcacgaatgaagtattcacaactcaaagcgtgccccgggaatccttgttggataattaaccacggaccaagaaaacgaacaagggcagagtcaaatctctttcaatcccggtttcttgggagtttttttatcgctgagatggatagctat

SEQ ID NO: 76726 - DNA, 7978 bp, Oryza sativa
tcaacttaaaccattgcatgattataatttgagaacaaaataaaatcttttcattcccaacattagactagaaatgtcaccaagcatacatgtacataatgcatgcctaggctcgagttctttgtgcatttggagttttggtcttgcattccataataggtcccatgagcataatctaaaagaattatttcaccaaacaaacctatagttaatcttgggtgataacatgtggacttaatattaaactcaaatatcatcttctcagtctaaaagaaaatttaatgtaatccctataataatattaaatgcaattatgaagtgggaatacatatacaaacaaaggtcatcctaattctctaaaatattttgtgcaagataaaatcatggaaaaatttatgtggatagtgattagcacaaacttatcctccgtaatttggtaacgtgttaacactcaagttgatacctcaaattaaacggtcaaagcagacaactaaaagaaatcaaattaaattttaatcggctaaaaccatgtttcatccaaaagtacatttaactgcacataagtgaacatgggaaataatgtattcaaatactagactagttatcatgcctaaatataatttttctagaattttcctcctctctttaagcctcctaaaaattcaatctagctttctaatagcccatctttgtttaatttctgtgagcagtccacccattatttttttagtgcaaccaaagaaaatggaatctaggtgtaatcatctaccaccagtaaaatctacactaattcttctggtctacacattgaattatgtagttacaaagttagaggagaaaataattccgaaaaaaatgatctaaaaatcaagtttacccagaatcttacccaaccctctcaccctagcctagtttgccatgacctggacccacctggcagcctctccagctcgcccttcctctgtccctcatcctcagccgaccaagaaacacatagagggagagattgagagccgaccgagtcctggacgcgtcgacgcgtggtgacgacgtgtcgacgccttcaagtcactgagtcatgcctccatctcctccagaccgagtcgcccaactccacacatcactctggagctgaagaagccgagggagaggtcctcagcctctccgtcatcctcaacctcgccactggtcgtagtgacgacgaccttcgccatctccgtttgagtcaaggtcacctccatctctttcgcgttcccatctctccacacaatgccgagcatttcctcttttgacctaaacccctctcgtgcagtgcatcgccgggaacgcaagccacgccgacaacgccctggagcacgcaccggagcgccgccgcttcaaccatcgtcgccgtcgtcggccattctcatccacctcagagaaagccgctgcgccattgtcatcgcctcgacctcctcttcaaaacgcctcaagaaccccagccggaaacatcaagaacacggagaacacatccttttcttcaccggcgccaatctaggatcgcctccgccgtcatcgtcgtttaccgctgcctcggtgagccattgttcgattccttgcgcatacaccatctccttgacctcacaaccctcgtgcatgcttgcttgaagcagctcattgtcccgttcgagccgtcgtcgttcacccgaggaggagcgccgtcgccgagccgttccacaagtcaccgctgccgccaagacctcgacaaccctagctcgacccacggtgagcatcctgaagtctagaagactacatgcatgcatccttttcgttcgtaatcgacttccatgcgcacatgcactttcaccccaaaaccaccgccactcacactcgccatcggcgctactccgatgtcctctaaccaggaaaactagaggaatggaatcgcgagagctttctcttcattttatcttttgacctcaacctcaaacgagccaccgtttgccgccggcgagctccagatcgagctcagccatggctagctctgctctgcctagagcagagggatgacttccgtgaattagattaagtgcagggatctgtttacaattgtagaaacacactgacatatgggcctaggactgcgggttgattcctagaaacctcaagggcctttgtgcatattggtccctcacagccatgtggacccatcctttaaaatctgaagaataattaggaaaatgcccaaacaaatatgtttagcagaaaaatgcacaaagttgtaaaatctatataaaatcaaatatagctcattttgaagtgattctagttgctgtagattcttgaagttatgaactttattccaggaatataaaacttgacactcactgtacaaataatgtctctaaaatttatctaagataggtcatacataaaacatgtacaaacttataaaatacatagaaaattcatcacaactcattttgaaacaaaatcaaattctacagattcatcatcatacagtctctgattaggtgaaataaaagtaattacttactttgcatcaaatgcctctaaaactattatctctataatgattagttttagataagctaaactttagaaattcatgtagaacccaatttagcttcaatttgagtaaacttaagttctgtaggatcactaaacatgtatttctaagttatgaaataagattatatacttactgtgtagtaaaagtctctaaatattcatataaggatttactaacatagagcagcctttaatttgtaaaacttgtagaaaatttatttttagtccaaatgaaatgaacaaagtttctatagaaccagcaaatagttatcttcaacatggtaaaataaaatttggaaccttttgtagagaacatagatcgaaaccttaacttagtgaaataagaatttaaacacatagtgttgtttaagtaatacataaacatatataagtatatatatacactttaggtctaattaaacctaaataaaaacttgattgaccagtgaagccatagttccatcctcatataaaacttagaagaacttggctcatataacaatttctaggttaatataatatattgctagtttagattaaagcatctctactttataaaatatgaaccatagtagtaaagaccataaacatgtgagataaaaatgttttagttaaccaaattattccttttattcaacttaaacatgaagtagcatgttctgaacctataactcaggagtcatgcacatataaaacactatatgcctaaaacacgttgtaacttgtaaaatctataagaaaatcattataactccaaaaattgtgaaacaaaatgtgttagtcttagaaaacacatctccacacccctgtgaagtataatctaataaaaatcactttacaaaagtatttcataacactacctaagactatactactataaaccgataaaacttctaaaaattcataactccctaatggaataagataaaataaaaattctttcacctaaattcattttagatcagtaccaacccactgtgcataaatcatgcattttagagcattttggattttcagctctttcggtgtttaattgcatatcgtgtcctttatctagataattgcataatcggtgaagaagtggattaggtgctaacaattctctgatcaaggcaagttttctcctcccatcctttgaacacattgaatcccatgatttgaggaatgaaaatatttgtttgcaaagttgcatgtgaactcagattatatcggtatttgaaattgggttaaggtagttatgacctatttgctgcataccccaccttgaataattgatcctcttgctgtttgaacccctagaaatggttagagtacactctttgtgctcaaatgggtttatatatgctctatgtgcaattactttgcttagccatgcttagaaatatgcaaatgctcattccatttataattaaaatgtggttttgatacttgaaccttcgctagaataaaatgaatatgatgggtatttgcgaactaaaatgtgtaaaatgtgattttacacttgggcagcaagtggtgtgcatacagtgttagttgcataccgatagggggagtgtttgcccaagtccataaggaccgaacttgtgtcacccatttaaagttattcgtacatccatatgtgctagtatgggatggcctaagctgattaatctatttaggactagccttgcattctggtaggccggtgtgtatgagttcgtataattcagaggagcttcctatttaccccgacgtggtagtttaggtgactaagcgtgtccaatacaacggtattgtgccacgtggtgggttcccgtcgtgtccgccaccacggtgttaagtttaaggcgtgggcccgccacttaacggttctaggtatattccaagtatgcctaggatggaggaacacgtatcgtgctggtgcaaggctaggctctaagtagtgtaaaggcttcgttatgacctctagatcacattcaacatgaagagtgtggtggagtcttgcaaactcaaaacaaactagagagttcatatcatgtgggtaaagctgtacaaactctgcagagttctttaaactaatcgattagccgtgctcacggtcatgagcgctttggtgatgtgtcatgagtatagactatgttttaaaaatgtgatcatgtgacactggtttgaaattgataaatgtgttgagttgtgtgtgtggtgatacattatgacttattgttaagtatggcaataagagattgattatgatggaattatgaagaagttaataatgaaacttaaaacttgtctttgttaattgaagcatcaactcttttacaaaagaattgcgaaacaaaacttgctttatgctgaaaatgaactacatattgtcttcctttgaatatatgccttacatgtagtatagtaggattgacttgtgcttgccagtacattaacttgtttaatgtactgactcttgctattgatataaccttttgtttgcaggtttagtcttagtctttgagtgatgcgggttccgattgcttcttctaggatgagaacttaatggggtaaacccctagtcggtgtgcttgtgattgggtagtcaagcttccgctgttctctaataagtctatttggccggttggcctatgtaattattaagttgttgtaagtcttaagtttctttcatcttagttgtgtttgctatgtgtaatcatgcttaagatgaaagtgtgaatctagtgcacatcctgggaactagattcacatgagtatgagttaggaatatttgagaggttgtagatctttagctatttttatcaagtctcctgaatgtgtaacacatctggtcgccgccttcgagtggtttgacgggcacatctcaggctgaagttgactggcaggctaagggctcagcaatgtctccaatattcctctctcgaggcgtcggatgtttcattatgcttgtttgatgacttgaattattcacttcatctcaaatataatggaaggtccggagagcctacgacacttagtcttgggagacaaatagccacactaaaggcaatacagccgaggaatggcaaccttactcacaaggacaaatagtcattaaaaaattatgacagcactaaccatatctaatttcagttcaccaaacttacatttaaatttaggcagtattacggagatctaaatcaacaaacaacaaaccatacttcattgtcaaaacaaatggccttctatgtactttacaaattctcacaagatcatatttgcaatttttcctaaactaattaaccaagagaaaatatgtagtggaggattccacatataatttcacagcataagtacataatacaatatggtataatacacatatgcacagtactttgaaatatgcataccagaacatatgctttagttcactccattcattcttgcattcttgcacattcaacatcaatcagatctaccaagcattcttgtacattcaaccacaagcagatctaccaatgaatcactaacttatgtagcaatgggggaaatcggaggagaattaaaaccattcctcgtcagacgacggaaggacaggaggcggcggaagattcaccggctgcacaccacggcacgcgaatccctgaggtgtgggcatcgcatctatcagcaccaacgacatcggcagaggcaggggtggactggggctctttcgtagaccgatgtaaactagacttgttggcttcgttttagggaggggacggaaaagagataaactttacccggctggcctttgggcctgcgtggagagggataggagtttgcttggtttcagccaaaagataggaagaggattttaaataggttgcatatgcatgctttgtctaaagaaaattcctaaaaataaatgaagcaacaataaatcccaccaaaattctcataaatactaaacaacaccctaagcttccagcaattttagtttgaatttatcacatcaattgataacccaaataaatctttcaacacagctaaaaatctggaaacagcataccaattagcctagtttgcaccttcaccaaaattaaaccataactcctctagcaaaatctcaaggtcagaatgttaaacatactttatcatctggtgcaatggcttagtctaattcgaaatgtaaccacatgaaatgagagccataaattacgtaaactttggaacttggcaccttgaaccatcaaatccttgtctaccttgccgtctcccccctaattctaaattaaatgtatgagagaaagagagtaatatagtttagtgtgatagtgccaacacatggaaaatttagagcttctagttctctccttctacatctctcttaaatgtgggaccaagtccttgtggggcccactcatcatacaaccatagccaacacatcatctgctcttctctcatttaaatcttcttttatttctcaaaaggtgagagaagggtttaaattgaatttccacccaaaatgccactctaccactccaagccttctaggaaacatctatatatgggcctatttgtcgtccaaatacctacaaacaaccttggtgaatcatctctttgatcctaaattatattttcaaagagagaaagaaagagagagagggaattaaagtccaatttacacccaaacttcaccatacctctcatcttctcataggaaacatctacatggggccactagacagccactcatgctaggttgagtgaagtacaagtgggatcatagcctcaattcactgccaactcctttaaatcgtttctacccctcatgttgacacctagctctcactttccaccttcactttcaccattcactactacaaccaagatttttgtgtgagggctaaaatgatttttgcgtgcgggtaaacggcccgcatgcacttaggggtctgggaaaatgacgatttttgcgtgcaggtgaagcaccaccacaggaaaacaaaaacccgaaaaaacataaattttctttaaaaatgaaatcctagaatctggtggtggcgccgccgctcttgcttgccgctgccgcctcctcgtcgtcatcatcatcgtcagtggcggcctccgcgccgctcgcctcggatccgtgctcccctccggccgcaccgccgcggacgcccctcccctccgccggatctagggagggaaggaagaggaggggaggggagatggatgccatgcggggggagggcggccggccgctggatccgtgcgtggacgaccgccaccgctggatttttgcgttgatggccgctgccgctggatccgtgcagggacggccgccgcccgccggatcccacgccctccaccgccacaacgtggaggaggccggcgcgtgcctatgcccaccgcggctgtcaccgcgcgccgccgccgctgccgccatcgggaggagagg

SEQ ID NO: 76727 - DNA, 21862 bp, Oryza sativa
  unsure (1)..(21862): unsure at all n locations
tgaaaggtgtgattttagtgcacatccttgggaactagattcacatgagtatgagttaggaatatttgagaggttgtagatctttagctatttttgtcaagtctcctgaatgtgtaacacatctggtcgccgccttcgagtggtttgacgggcacatctcaggctgaagttgactggcaggctaagggcccagcaatgtctccaatatttctctctcaaggtgtcggatgtttcattatgcttgtttgatgacttgaattattcacttcatctctcaaatataatggaaggtccggagagcctacgacagcatgagatatgggagataaagaatataggacatttatgctcaagagaggaataataacttgccttgctccaacgcaaatgaatccaagataggcaacctgattaaccgattctcgaaataccataggttgccatcccaaaagacaatagactttactgagaaagtggaagaaccaaattcaataaaagccataaaataataagaagacgataaacggctaaaagggctagggtttaaggtataacctatatcttagggattatggggcttgtatttgctagtggtaggtttaggtggtataatacctagggtttagttatatgggagtcgattgtggagtaggatagcatataggttaggctctatattttatgtggaggttctagaggattggaggctagaggggattaagcaattattgtcgcttatattttatgtgaaggctctcgtggtttggatgataggaaatatgctggatagttgatatggttaaataggcatgtggctaatatgggtcaaggttgtacttttgtagaatagtggctagggtttagttgtttaggccgatatcaaggtaggataaatatcggctagggttttgggtgttcgctagtcgtcgctagagttggacggcatgacgactagatttggtatcatttctagccatgtcgatagacagcatatcagctagaagaataggaggtgggtgcaggtttagtggggcggaagtgttactccgacaaccgtgagtggcggcggagcggctaggatcacacagagctcaagagctaactgtgcggcgtgcaatggaggtcgaggggatagtgaagctccgaccgatgtacgcatcaaggcgtggggtgccaggagcagcacttcgaccttgggtttggtttatgccgggctttacaaccaacggtccgacgttgaggtccgtagaccgtgaacgtccccatggaaggcgtaaagttccaaccggcggctttttagtggctaaagggtattttggaaataaaagaaaatatttgaaaagcaaatataagtttaaattgtaaattcaattataagattaaatcaaatatttattcaaatggtatttgaataaattaaagaaattcaaataaaatcttaaaatagcaaatttgatatcaaaatgaagagtttgaatttagatgaatttaggtccaaatttcactggaatcggatctacggtttaggagatatgggcttctaaagattgggatttgaattaaatctagaaaatacgaaaaggtactatttatgggcccacctgtcagtacctgcccttcttctcttcttcttttcttcttcttcttcttcttgccggcaacagagaggagggagggaggtggggcgccggtgctccagtggccaaagtgtggcgacgttagcggtatatcgtgttcccgggcgacgcgcacttggggattgtggtagctagccaagggaaagagggagatggccggaacggcggcgacgagagctcaactccggcgataagagaaggtggtggtggcggtttatctcaagatggagggagaggggaaaggggaaaaatggaatcacctcggtgaggcggagttggtggcgcaagggtttggcttgcgaagctccggtgagggaaatcggccaatggcaaccatggccggacatgggagagaaagagagagagatggagctctgattgtatgtagagaaggggagggatggccggctatttatatgggagagaggtggtggtgaaaggcggttgtggaggaggagatcgagaagcacacggcgacgacagtggcgtgcaaggaagggcaacggcggccggctttcgtttccttagcggcgacgtttgcggcggcgtgagcagtgcacggcacgcgcacgggaggaggaggcggctcggctggggtgtgggctggtttgggccggctcggcttagctgggacggcagcccaagatggtggaggaaaatagaagataaaagaaaagggattgggccaaaaaggaagaaagaatggagtttcggcccgatgacagaaagaaagaagtctaatttgaatacctgatttggataactaggttttgcaaaggatttgaattcggaaagaattcacaaaagagatttcctaatttatttgagtgcaatatttagaggtggagtttgagggaatttgtttggaagcactcaaataggaagggaaattaataatattcctcaaaatatttttgggaatatagaagagaattagttgaaggcaataaataggatttgaactctaaaattggtgttatgtatatttgtggctaaaagagaaattgagtgaagagtataaattgaaattttcttagcacaagagcaattattcacaatatttgcaataatactattcttgtgccgaagaggaaatcaagccacataaattaaattggtggctagatcaaaaggaggaatttggatagttggatcgagaatcaaaggatggttttaagatcaaaggatgggctaacaattaattccaatgagattggaattactttggtttaggttcaagggcaaaattggaggatttcttggaccataattcataatagtaaaaatggttttcaaactaaattcgaataaaagagttttagtcgaaagaaggtttaatattcgaaaataaaatttcaacaagaaataccaaatatgtttttaaatgaaaaacacaaaagggattaaataccagagaggttttatgcgagttagttctaggaggtccagctaattatattttcctaggtctagaaggttattaaaaacataagaatcagcatgatgcaagattagaaaatgacacattttcaggatgttacaaaacaagaccatgcaacttctcgctaaagtatgcaacaggcttaccatcttgcattaacacacctccaatgccaactgcactagcatcacattctaactcaaaagtcttaccaaagtttggaagttgtagcaaaggtgcatgtgtaagcttgtccttcaaagtatcaaaggacttctcctgtatctttccccaatggaagaccacccctttcttcgtcaaatcattcaatggtgcagcaaaagtactgaaatctttgacgaaacggcggtagaatccagcaagaccaagaaagctcctcacctgtgtgatggtttcgggaaccggccaactccttatggcttcaattttcgactcatccacctcaattcccctgtggagtaacaacatatccaagaaaggagactcgttccgtgcaaaagatgcacttttcaagggtagcaaacaaacgtgcatcgcgtagagcattaaaaacagcacgtaaatgatccatgtgttcattcaaagacttgctgtaaatcaatatgtcatcaaagtacactaccacaaatcgtccaataaaaggccttaaaacctcattcattaagcgcatgaaagtactaggtgcattaatcaaaccaaaaggcattactaaccactcatacaacccaaatttagttttaaaagctgttttccattcatctccaagtttcattctaatttggtgatagccactacgcaagtcaatctttgtgaaaattatagagccacacaactcatcaagcatgtcatctaacctaggaataggatgacgatatcagatagtaatattattaatggctctacaattaacacacattcgccaagaaccatctttcttaggaaccaaaattacaggaactgcacagggactaagtctttgacgtacatacccgtggtctaaaaggtcttgaacttgccgctgaatttccttagtctcctctaggttagttcgataagcagcacggtttggcaatcctgggggtatctcggctggaaagacatcctcatactcctgtaaaaggttagtaacaacaagatgtatcgaactagcaatatcatctaaagaaaccaaggcttgtttgcatatcaagaaatagcacatatcatcatctgaattttcagcaatgtcacatttcgttgcaagcataacaccacccttcgacttaattcccttagccttagaactaggtgaaagattatcctttttaggtggaaaaacagttttagccacttgctgattttcagattcatcaagtttcaaactagcagctcgctctttatcagcttctacaatttcagcaggggtcaaaggtagcaaagtaatttgcgtcccattatgcacaaaagcgtatttattactcctaccatggtgtgaagcatcattatcatgttcccaaggacggcccaacaaaagtgaacaagcttgcataggaaccacatcgcaatcaacagaatctgcatatgagccaatggaaaacgaaatcctacaaacttgtgttacctttgctcttccggaatcgtttaaccactgaatatggtaagggtgtggatgtgtacgtgtagtcaagccaagcttcttgaccaaatcagaactcacgaagttgttgcagcttcctccatcaatgatcacacgtgcacgacggttgttgatgacaaagaaaatctgaaacaaattatggcgttgcaacctgtcatgctgctgtacctgcgtgctgagcacccgctgcacaatgatggttctgtagtccgttgtgtcatcacgaccaaagcttcgccatcctcatcctcaacttcttcttcctcctcttcctcttccacgtcggaggtggtgatgtagccatcttctgtagcaacataggcccgttgactagggcaatctttctgcacatgcccaaacccttaacaacggtggcactgaatgcgtcccgtcgaggcgacatatgaggcactcttggcgggtacctgcgaggatcctttacctgactctgctggtcgtggtggtggagatggttttggtgccgcagaagctccgaatgctgctggtcgcttgcccgctggctggaaggatgcccgaaacgaaatggccttgggcagtcccgcagatggcgtcgtgcgcggagtgtatgtgcttgccttgctcttgccctgatggtcgcacccctgtaattccttctctgcaagcataacaaatcgaaacaactggttgacagagttaaattccttataatcaacaatgttctgaatttcctccctcaaaccagaatagaaacgacaaatagcatcctcgaccccctccactatgccacagcgtctcacacccttttgtagctcaccatagtaatcctgtacagatttatccccttgttccaaacgcatcagtttcttgcgtaaatctctatgataagatggaggaacaaacctatcgcgcatagctaccttaagttcttcccaagcagtaggtagtaccccctcatcagataacccagcccaccacataatagcaaaatccttgaactcactactggcttgtctaactctatgttgctcgggtacaaggtgggcattaaacttttgttctaccgtcatctcccaatcaaggtatttctcagcatcataatatcccgaaaaagatggtattttaaacttaaccttagcataaggatcatcgggcacatgattattattattaccttgttggtggcgagtgccacccatacctgtgcggtttgtgcgtaggcgatgtcgtagccatgcttgccttgtagccagtgcatcaatatagccactggaatcatacaccgtgtcttcaggatgagcatcgtcgtcaccactcaccacttcctcattggaaggtgtctccaacgcggcgacctgatcagatagcgtggatatccgcttgtccaacctctccatgtggttcaggaaaccgattttagtgaaggcatcttgaacagactttgcaacggcctccgtgatgtccttttgagtattttgttggagagttcgtagttgctcttggctgacacagtcagcaaaatcctagggactcttctcaccttcgttacctgacattgaaacaccaaaacataaacaaaatggtgaaggttatccctaataatctactacgcaggtgtagtggtgcctctcaacgattctaagcaatatggagttcctaaccaagctcttataaggttcttaccagcaaagcaaaggatacctagaaggcgtagtcagcgattgcagggatcaagaacctgtgctgtgcagaagtaatatgtggagctaggaaggccaaatatatgtatatgagtggtacacaatccaatgacagatagtaatgctgaataaaaatcccaagtcacttgcccatagttgctagtctactcatgtcctagacagtagtgataacaaagatggctcaaagaatatgacactagtaaacagcaaagaaggactggcaggcaagcttcggcgagtttcagcaaaaactacaaaaccgaactggcaaataagctcaacggagcgcgtcatgagctcaatgcactagtggaaatcaacttttctttttttttcttttatttttttgatatttttttcttttttcagaacacaaaaataggcagacctccaagttacagcttaatcggagtaggtatgtggcctatggatttttctgaaaccactataaacaaggtgcaggaacttgtgagctcgaacagacaattttgcaagccaattttcggaattttggattcgccaaacccgccgaaaattttgcaagccgatttttggaatttttgagaaaatttttttctcttatctgaaaagttaaattttgcctgattccgagtccgtatgcaaaagttatggccgtttgaagtttcggcttctggctaggttttccaaaggggatataacctagtctattttgcggtggaattggggatatggtggcagcggagttgtagggtgttctggtggtgatctggatgggtgtttatgatggcggaaacggctctcaaaggatgaaccctagcacacggtgaaaggtagcggctagggttacgaaaggacaaacacacgactagactaaaacacgcattagaccagcaataggaatttagactaggactcaaactcaacactacggactctgaaaaggaatcatgcaaaggctaaacatggtctaggttaaggtaactaacaactaaattttttttgccttttctgtagactctaggataattgcgaaaaacaaaaactaatctagggcaaagaactcagcgaacttgacggtgaacctagagctctgataccacttgatgtgcactatggttcccgatcttccgaaaggttctgataaacaacgatttggacggagtcgcgacacaaatcgatccggcttcttgaacgcgcacgtcttgagccccgcaatcgcagcaccacgtctcctctggttatcaaccatgtcgaaacgcggatgacctcaccgagaaacctaatccctgtttgccagtcgaagaacacaaacaagaacgagatagaaaaacaaccaaaattgcagatgaatgattaagctcacggagttggggtcttacaaaccgatctagcggcgaaactgttctcgacagattaatctaagcaaaacccaaaaacctaaagatggcggtgggtactgatatatagagtttagggtcgtgcaaacccctctcgacgccaccctaatgggttccaacactatacacgggccaaaggcccaaatacggtgacgcagcaccgggacagattctggatgtcaatttgttcggtcatttcccattgactcggaaagaatttagacgtgggaccaaaaccattggaaatgttatcttcttagctttccatccatataaagtatgccccaatccggacacgtatgcgacctgggcgcccgttttagtgcagactggtcctggactccgaattgcacccgacgtcgacttggtttgggcctccaccttgacttggacgtcccagatgatcctccatggctctaagtccttctccaagtgtctccttgtcccctccattgttcctaattacaacataatcattaggtagcaatctattctcgaattcatacaaagaagaacataggaacgagctcacctctaaatttaattgtcgcgcacgagctcttgttatcggtccttgaatgaccgttggaggattgttgtgtgtatccgaggtagtgatgtccgcatcagtaggtacacaggcccgagaataccgatctctttgacaaggtgacaaagcagatgcgtcattatattgaaaaacgaaggtggaaatgtcaactcaaagctgacaagacattgcaccacatcattttgaagggcttctaatctatccggatcgatgaccttctgcgaaattgcgttcatgaaagcacattgctttcttattgttgcccggacattgtctggaaggataccccgaattataactagtagcagttgtgtcatcaacacgtgacagtcatgagactttaggtttgtgaacttcttctcctttatgcttattattcgctttatattcgtggaggacgtccaagaattcccaatagggtaactcccaaaatatagagttctttttccacatcgtcgcgtgaccatctgcgctatcattaggttggctgccaggcccctttccaaacactactttaagatctttcaccatagcaaacattgttttctcactgcgatgtttaggcttcgtacagtggtccgccttatgttcaacgtgcttgcctttctttcgtacagggtggtttgcagcaaggaatcgacggtgacccatgtacacaaccttcctacagtgcttaagatacgtactttctatttcatccatacagtgagtgcaagtcttgtaccccttgttaaactgcctggataggttgctaagtgtaggccaatcgttgatggttacgaacagcagcgctcgtatgttaaactcctcctgtttgtcctcgtcccacacggggacaccttctttcttccacaacagtttcagatcttcgaccagtggtcttaggtacacatcgatgtcgttaccaggttgcttggggccttgaataataatcggcatcattatgtacttcctcttcatgcatagccaaggggggaggttgtagatacacgtcgtaacaggccaagtgctatggccgctgctcatctctccaaaaggattcatgcctgtcacgcccagaaattcactagtaatttctgaactaatttatgcatagaatcctcgtccaggaatcagccaaggtacacaaactgacaatttaatatacaaattcatcataataataacgttacatacttacaaaacaaaagaaaaacaacagcggaattacgatctagcgatggcttcagctccactaccacaggcagctcaattggggtataagccaaacgtcttctccttctggatcctttttcttcagctgaggttgattgattattgcaaggtgagcatatgacatactctgcaagccacatagcaaatatgcaagtgcacaaggataccaaaggatggcataaataggctcatttgcaaaagcagcatttagcaaacatttgagaattgaaaaacagtagagtaattaatcaatgttattcaacatgaacatcacacccatgctgctcaggcccaaccatcctgtacacaaggagctaagcaaattattaccagttatagcatcaataattatttgagaggtgtgacactaatcacgaaaaatattgctcaacccgcccatgaccgcgggcacggctattcaaatagttttgttctggccagaggtgtaccactgtatccacaagacacagctccacgatatgttaccatgcgcctcaataccaccacggtacctcggaaaagaactgtgacggtacccctcgcacaacacaactcatcatagtgcaccaatcctggatcataatcaccccctctataaatataaccagaggcatggactccccagcgacccccatggacttctcgccgcttctcggtctaatgtcctgcaatgaaccttgctatataaaaggtaaagccgttgcccacgctggcttgtggttggcacggttaatgtctcacaacagtagctcgcgaaccggtccttaattgtcatgagcacgagcttcaaaaccatatgctcacaacccaccattatcaagtttaaattatcataacacgattaaccatcgtgagctaccattaaatataatcataaataataatgtagtatgattcattccattaatgagctaatgtttctaaacatggctaagcaattatatatatagcatttagctgaaccaatccaatatataaggtccatgctaatcaatttattacccatagaaaaataaagtcatcttcgaccataattaattgggaaaggctcaccacccgatggcattcgaaaataatgcataagttgaaataaaacattagctttaaacaggttcaacatgctcaaagggttgtttgggatatgtgtgacttgccttacaataatcagtcttcaattaatcttctgaaccacttccgacgctctcacgaaccttcgcaatgacggaaatgacaagctaacacgcaaaacgaagaaaaagactaataaaaaccaaataaacagtacataaaaagtaaacgaacatgtagatcatgattttagatgaattatgagacttgaacggcctcattctgacttcatatgaattagttatgaattttacaagattaagtccaattaaacctattaaagaaaaaaaactattccaaattaattaaacaatttacaaataatttataactgagatataagactaaagcatcctccggaaattattggaatgaatttagtagacgacatatagtaaaaagaactaatatgccattgaaagggataacatgatttatattgattttggaaggctgagatcaactttgacctagttgaccaaaattggatggctcggattgatctgatctaaggttttagatggctgccacgtgggacaaaagagatgacgtggcacttaggtgccagggacggtagctgacaaggcgatgacatggcaaccacgcgggatcgacgtcggctgctctgttcggcggtgaggacggcaaacggcggcacaacggcggaaaccgagagcatggggaggatgaggatgacgcgacgatccttaccaacacttacgcagcgatgaacagcgaaggagatggccggcgacgagatcgggagtggcgatggggtactgatcaacgacggcgacggcgttctccttacagatgcaaatccaatggaggcaacggcgaccgaaggcgacgacggacgacgacgaacagcgcgactggagatcaaaccatggcaacaacccacaggttcacggcgacggcaaccttccggcgggattcggcctcgggtaaggggtggacggggtgtagcttgaccttgcggagccgaaagaggtggcggcgtaggagggcgacggccgaggcgacgacaaacggcggctggagcgactgccggcggcggagaaagaagacgagcgtggggaggcggctagggttagggaaaacttcgggaaacagaagaggaggctgaggggatgctatttataggcaaaggtggaggagatcggctcgggaacgcatgaattcggtgaaggaagttaggatttatcctgagtttccccggataaaaacgaccaaaattcgtgagatagataacgaatttgatgaggcatcttagggatatgatagaggagatagggaggaatccgtttttgcactcaatttggaagggaagcaacggatgcatcgaatttgatgcaggagacggcggctctcgggaagaacacggcctctagacggctggctggagctttaagacgcactgtatcgcgggggaggccaaacagactttaggctgggctgaggaacagggagaagggaggaaggaatggtcccaaaagggcccaagctgaggaggaggatttttattgcttttccaaataaatcaatcaccaaaatgatctttgaattgttaaaaatacttcccatgctcaaataatttcaagaaaaatcctgaaactaattggacacccaaagtacttaactatattataatcagaccatttacggattaatttattatttcaataattgctgaactgctctttgtattattaaaattaggaattgagctctgaaaaatccgagaaaatttcagagagtataattaaccatggagaatttaataaaattaaatccagccattctttatatttaggaaattttatttcccacatttaacttcacttgtaatttaatgagcatttaatataaattctaaataaacacaataaactcataccttgccttagcatctaacaaacggcggctcaaagatgtgatgttgtatccgtcgctgttcatcttctcttggttccctcataagcataataatgtcttgccccttgagcaaaatcggctttcttgattgcacgatttcaaaggcaagacgaacaccgcaccaacatccatagcatcatgtgaaggagacttatctctaatgaccgatgattcttctctcatcatattggatttatcactagtttgggaaatcaccgatctcttaccttttacttctataggtctccacactcgcttaggtgtcattcgaggctctaaattattacatgttttgttctccatatattcggcctccttttctttttgacctatggcccgaagacgctgtagcctcctcttttgagagcgagataagtcagaaggtatccatttcgactgtggttgttttccaggagctaagcaatgattcttcatatttttggtcaaagtgaaagctcctgtgttgctctcaattttctcactcttctccaatgcccctcggtcaaaccggcctctgagctcggtcagaccggccacaagccgtcggtcagaccggccaggagggtcggttagaccggccgttgtctggcggttagactggccagctgttttggtcaggccgccgatgttgacagtaacggcgtcggcttcagtctcctccgcttgtatagttttcgccgcatctccagtaggtacatgaacatcttgagattcctcattgatagcaacgacctccggagctttggcttctttcctcacccacaccttcttcacctttgatccaccggaccgattcttttgtgggaaacgatcttgtcttgaattagatgaatgattctgtactgacctaggtgattccttccactcttgataatacggcataggtggttgatgcatccacggcatgtaatacataaaaggataaccaaacggtgacattggatatggataccatggcatcacaaccggtggtttatatggagttggtatagttgatggctccgattgctttgatgtttgaccaaatctcctcttacgagatgatcttggtctttttgaatcactagtttgattatcaaatcgttgaccggctaatcctttcttgtacttagccataagcatctcaaaagtgagcttcggctttttggtcctttggaaactagatgactcatcctttgcaactttatgatcttcggccttcgcattttttattctattcttgggccgaggatccccaataataacacttttccatttctttttgtcaacatcaatagaactaacagggagagaatcactaacaattccggtcttaggcatagaaataaccgaaatagtttcacaagtgaccgatgaatcatcaaccgatcttttctccatcaagcttgcatctttaaaataatcatgaaactcatgctccatttgtaaccatgtagaaattgaagtaggagcaaggaaactataccatgtagatgcaaagtttgacaaagaaaggggaaacaacttcaaattaagcaaatcatcactatcgcccttaccacattaataaataaagcggccgatatgctccattgtagtcatagcattctcacctttgaatttcgtgaagttgggcacctcaaatacttgcgggtatgggaccgaatctacatgttcaggatatggcctttgatatgtatgcatagctactttggattctatttcaccactattgtcacaccctaaaaatctccaaattataaattttcgtttaattggaattagtagaatttattttaaaagcctagaagagaagatctaattttaattaataaattccaatataaaatggggccagataaaattttattaaatactttgcttaattctataattcctagatttttccgggatttatttgagctaaggaagtatttttaataaatggaattgcatttaatgaataatttaaatggaaaaaggtttttaaaattcccttttggttttgggccgaaagtcggcccaaaccgctctctctctctccctcggcccaagttggcccaagccgaccgcccgcccgcgcgcgcgcgcgcgaccgccgctgacaggtggtgacccctttcctctcgccgaaaccctagccgagctgcgccaccgccgccattccaaatccagccacccctttccgtttccggtgaaattgattgaggggaaaggatccccatgatccactctaccttttcccttttggaaacatcgtctaaatcgctttggaaatcgccggatttgagttcgattcggatcgatctctctcctccaaaccctaaactttccttcccgtcgccggtcgccgtgggccttcgccgccgctccctagcccctataaattgacccccgagctcccctctacccgtcgccactctcgccttagcccgccgccgtctgtagcgccgcctccgcgtgagaccttgagccgccgtcgctgccgtcgctccagccgtgcgccgctgtcgctccggtcgtcgtcaccgctcgggaaggccgccgtcgtgatcgccgtctcgttgccgtctccatccgcaccttctccgtcaccgttgaccgccggaacgccgtcgccgtcgtcaagccgaaggttgctgccgccttttcctcgtcgccgacgtcgtccgttgctcgtccaccgtcgctttggtaaccggtgagttcgcagcgatgcccgcatcgtttcggagccctccgttcgcgccgccacgccgtcattcgccggcgagaatgcgtgcccgagccgccgccggtggtgacgtcgtcgctgacgtcatcgtcatcatccctcgtggtctagccgtggaccgatggatctcggccgtccattttggatggatcgatctcggccgtccgtttcgtgaaccgccgccgtgcacccggtcaaccgtaaacccgacccgctgatgcaataattcccttttccttttcaaaaataattaattattgcgtcataattcaattaaaatctacataaatgatttaaatcgatttaatctttgaaaattcataactaattcatcttagctcggatttagttggttcaagtctctaaatttttctaaaattgagatctacatgttaaaaatatccacatgtactgttcatgcgtgtttatgtgctgttttggtgattttgttcttttctctttagattccgacgttccgggagagtctgattttgcaggagaagactttgaggatttccaaggccagcaaggcaagtcacacagattcctaacaaccctttgagcatgttgatcctgtttaaagctattgtttctattcaactattgcatttattttcgaatgtcattgggtggaattaacctattatttgttatggcccttttgttcttgattactttattctttgataccttgggttaatgtaatttgactagttgagctttatatgatggttcagctagatgttaggcataattgcttagccatgcttagaaacattagcacactactgggataacttatgcttcactattatttaatgatggtttaataatagctcatgatggttaatcatgattggtttattaattaatttgccaactaaaacttgataatggtgggttgtgagcacatggttttgatggtcgtgctcatgacaattatggaccggttcacgagtttcggttgtgaaacatttaccgtgccaaccacaagccagcgtgggcaacggctttactttctgtatagtatggttcattgtagagcaccagactgtgaagtggcggagataagcccacgggggtcatcttcggccattaattaattgggaaaggttcaccacccgatgatattcgaaaataatacatagttgaaataaaaataatagctttaaacgggttcaacatgctcaaagggttgtttgggatctgtatgacttgccttgggcttccacaaatgtttcggaaccttcctcaacggaaacactctatccggaacgtcggaaactaaagcaattaaacaaaaattaacaaaacagtacaaaaacaagcataaacagtacatgtgaatatttttaacatgtagatctcaattttagaaaaatttagcaacttgaaccacctgaaacggatctacggttatttagttatgatttttcgaagatttaatctattagaaaaacgggaaaaagaaaaagatgatgatgtcatgatgacatcatcaatggtggccggaccgagatggtgacctcgccggagattggatggtcggctgcgaacatggaggacatgtacacgtagaggacgacgagacgaacccaacggtactcaccctcgagccaaacgacgaacgacgacggccggcgacgagatgaacggcggcggcggctccggtcggtggtggcgagtaggctccggtggtcggtggctacgggggacgggcggccgggcttcccctcaccttggcacacctattggcggcggcggcaaggggcggcgacgacgaaggcggcggcgcggcgctacccaagttggccggcggcggtggcgagctagccgncggtggcggcggagctacggagcacggaaaggcttggagacggggaaaacgaaagaccagcactaggggatcctatttatagccttgattgaagagatcggactcctcccgcaagaaatcgatccgggaatccaaaacttcggttttgaagataaactcgagaacgagtttgattcggataaaatactcaacgattagctccaattttttgggggtaaagatagagaaggatgaaaggatcaaaaccccttaaacaatcggactcggggaggccggatttgatgcggatttgaaggggaaagggggcggctcgggcggcatggctgggctcggccagccgactgctagaggttagggaagggtccgacatgtggggcccacatgtcggtctcccgagtggagggggtggctggcgggttgggttgggccggctcggtggctttgggccggctcgggcgcgcgggagagagagaagttgggccggaatcggcccaacgacttagggaagggatttttgaactttttaattaaaataatttgtgaaatgttgttccaattattaaaaatacttcccttgctcaaataattcccagaaaattctagaaaatagaggaacaactaaagtatttaataaaattttatctagctcatttttatgttgaaaattttcctagattattagagtttaacttgtaggcttttagaataatttctaaaaatgatttaaaatatgcatttttaatttaggcgatttttagggcgtgacagcccctctgtcagaatagagatccaaggtgtacctttcctgtttaaccttattctgttagaatctaaagatcatgatgtcatcctagggatggactggttagccagatataaaggtgtgatagattgttccaatagaaaagtaactctcaccagcaatgatggtcaagttgtaactgttcatgcattgccctctgaacctcgaaggtcaagtataaaccaaataactttggaagagattcctatagtccgggagtaccctgatgtgttccctgatgatttacctggtatgccgcctaaaagggatatagagttcagaatagatctggtgccaggaacaactctgatccataagcgaccatatagaatggcagccaatgaattggaagaagtcaagaggcaagtagatgatttgcttcagaaaggatacatcagaccgagttcatcaccatggggagctcctgttatctttgtagaaaagaaagaccatacccagaggatgtgtgtggactatcgcgcacttaacgatgtgactatcaagaataagtatccactgcctaggattgatgatttgtttgatcaacttaaaggtgccaccgttttctccaagatagatcttcgatcagggtatcaccagttaaggattaaggaggaagatatacctaagatagcttttactactcggtatgggctgtttgaatatacagttatgtcttttggacttaccaatgcccctgctttctttatgaacttgatgaacaaggtgttcatggaatacctggataagttcgtggttgtctttattgatgacattctcatatattcccgaactaaagaagagcatgaagaacatcttcgtcttgcattagagaagctgcgagaacatcagttgtatgccaagtttagcaaatgtgaattctggttgtctgaagtgaagttccttggtcacgtcatctcagcaggaggagttgtcgttgatcctagtaatgtggaatccgtaaccaactggaaacaaccgaagacagttacagagattcgcagtttcctaggtctcgcaggatattaccggaggttcatagagaatttttccaatattgccaagcccatgacacgactgcttcagaaggatgtgaagtacaagtggtcagaagaatgtgagcagagttttcaagagttgaaaagtcgcttaatatcaactcctattttgattttgcctgatccaaagaagggtttccaagtgtactgcgacgaatccaagcttgggctaggttgtgttctgatgcaagatgggaaggtggttgccaatgcatctcgtcagttacgtccgcatgagaagaactaccctacttatgatcttgagttagctgcagtggttcatgcgttgaagatttggcgtcactatcttttcgggactcgaacagaggtgtatacggatcacaaaagtttgaagtatatctttacccagccggatctgaacatgaggcagcggagatggttggaattgattaaggattatgacctgggaattcattatcacccgggaaaggctaatgtcgtagcagatgccgttagtaggaaaggctattgtaatgctatggaaggacgacagttgccattggaattgtgcaaggaatttgaaagattgaatctgggaattgtcagtagaggctttgttgcagctttagaagcgaagcctactctcattgagcaagtcagagaagctcaaatcaatgatcctgatatccatgagatcaaaaagaatatgaaaagaggtaagctatcggtttcttggaagatgagcaaggaactgtatggttgggtgagagaatctgtgtcccagataacaaagatttgaaagatgcaattctaaaggaagcccattatacgttatactccattgaccctggtagtactaagatgtaccaggatctcaaggaaagattttggtgggcaagtatgaagcgtgagatcgcagaatatgtagcggtatgtgacgtttgtcagcgagtcaaggcagaacatcagaaacccgcaggtttgctgcagcctttgaagataccagaatggaagtgggaggaaatcggtatggatttcatcaccggtctacccaaaacatcgtcgggccatgactctatttgggtgatagtcgactgacttaccaaagtggctcatttcatcccggtaaggaccacctattccggaagttgtttagcggaattatatatggccaggattgtgtgtttgcatggggttcctaagaagatcgtgtcagatagaggtagcaagtttacttcgaaattctggaataagctccaggaggagatgggttccaagctgaattttagtaccgcttattatccgcagacagatggacagaccgaaagggtaaatcagattttggaagacatgttgagagcttgtgctttagacttcggtggaagttgggataagaatttgccttacgcagaattctcgtacaacaacagttatcaagctagtctccagatggctccttacgaagcactgtatggtcggaagtgccgcactcaccggtgcaagaaactacgacggacgacgacgtacggcggccggcgacgagctccgacaacggcacggcttggctcgacgtcgacggcggcgctgcggcggcttgcgacggtggcgaaggggcggccgaggtgatcctcctccgcgcgaacccgacggtggcgacggaaggcgggggcaacggctacaacggcggcgcggcgtggctggaaaggcatcagcgacggcagcggctagggctacgcgccggcgacgctacgggcaacgatagagctcgggacttgaggggaaacatagaggacgactaggggatgctttatataggcttggattagagagatcggaccctaaccaagagggatcgaagccggaaaaaagtagggttagtttggagagataaactcaaaacgaatttgatttggtttattcgggcaaaattgatctccgaaactttagggggaagggagaggataaggaggagatgatttcccctcaagcaatcgaactcggagatggccggttgaggcggaatcgaaggggaggtggcggcgctcgggctcggctcggccggaggtggaagaagaccccgacatgtgggccccacacgtcggcggcttgagaggagaggggcggcggcttggcttgggccggcgtgggccgcacgcagctaagaggagagttgggccggaaacggcccaacagccttggggagggttttaaagacgttttcaattaaaataattcgtgaaatgatgtttcatttattaaaaataccttccttgctcaaataattcccagaaaaatctagaaaatagataaacaagcaaagtgtttaataaaattttatctagctcatttttatgttgaaatttttcctagattattagagtttaacttgtaggcttttagaataatttctaaaaaagcattaaaatatgaattattaatttaggcgatttttagggcgtgcaagtccatatgtcagaatagagatccaaggtgtacctttcctgtttaaccttattttgttagaatttaaagatcatgatgttatcctagggatggactggttagccagatataaaggtgtgatagattgtttcaatagaaaagtaactctcaccagcaatgatggtcaagttgtaactgttcatgcattgccctctgaacctcgaaggtcaagtgtaaaccaaataactttggaagagattcctatagtccgggagtaccgtgatgtgttccctgatgatttacctggtatgccgcctaaaagggatatagagttcagaatagatctggtgccaggaacaactctgatccataagcgaccatat

SEQ ID NO: 76728 - DNA, 16154 bp, Oryza sativa
acccacccactgagctaggagataattcaaggaggatgttgaggtgaggacggaacatgggaggtggatatggacatggcgctgcaagcctgcaacagccactggagggagggagacaggaaactacaggagacccacgccgtccccgccacccgctgctctccgcccgcggaccacgccatccccgcctcctaccatatgaagttttgtgaaggtctggtatggtaattatatataaaattatcaaagttacaagctttttttactacaattagttaactacgaaagctcaattatacagagtcatacagacacccttcatgatggcccaaaaaatctcaaatatgcagtacaagagggataacttgaacgtaaagcagagacaaatcgatacagagcaaagacatgggaacagagcaacaggacattagtgcagtacacattgacgatgcagggatgcacgatgcaatacctgaggacagcgcccgttgtacagcccaatcgcgagtgaagcggttggcgatgcagtagctcggcggcgcaaccagctcggcctcgcactccacaaccttgcgggagcgcacgtcagatcgagacctccgtccccgccacccacgtcgccgtccccccgtccacaccgcctgcagctctccgctagcgctctctgcccgcaacccacgccatccccgccgcccgtcgccgtccccgccatctacgccagcaacccacgccatccccgccgtctgtcgccgtccccgccgcctacgccgccaacccaagccatccctgccgcctgcgccgccgtcccccctgcccaaagctctccgctcgcacctccggcccgcgccatccgccctcctcgtccgcccttcccctcagacctcatcctttccattttcccctcttctgtcactctctccttgctatccatacgtatactcgtatagcggaatagaaaagaagagcaaaaaaaattagctagagttacagagtattagttgcctactactaattagtattttagtcaaagcaaagtgatgcaaaatttgtttggttaagtgcagttttttttcacaaatgcataattatttcatctacatagattaacaaaatttaacaatcatctgtgtttttcctgtacttgcgagacgaaacttttaaaactaattgcgccatgatctaacaatgccgtgctacagtaaccatttgctaatgacggattatttacgcttaataaatttgtctcacagtttatatgcggattatgtaatttgttttgttaataatctatgtgttaataattcagataaccacttttctctatcctctattttacacatgcttctaaaaaatcctacgctaccacatgatttaaaatcttagacctattattttggaccattacattatatcttttcaaaataaaaaacatatataaaatataagaaaaaaaatatgaccattgtaactttaatcggtaaaacaattatttacatccgatagaccaatccttaaaaatacaaatccattccacctccctcccgtacataatcactcatctctccacaatatctgtacgtacatgcaagatatatatcttgcatataacggaattttaaaaaattaccatcgagacaatcgtcaagctactaatgcaaaggttgtttgattattatttgtgcagatgataatttgatctaactgggttaatacatttaaaattttttacactctatccaaacatccattatattccatactatattttaaacattcatttctatcatatttatataccattttcttttcttttctcaaaatcatttatataccattttctattcttttctaaaaatcctgtgttacaaaggaaaccctaaattctttctaataacaacaaaaattatgatagtttaaataatatgcccgcgcaactgcgcgggctaccttcctagttatagtaatgttgacaaaaatttcagcttgtttctaaggtgcagtgtcatattaattagtccagaattctagacccaggaaattagatagtaatttctattgctaaagtgctaaatgctgattgtcttgcaaagaaaaagttcatctggaaactgaacttgtgcatgctgagttcaccaattctgcaggcttttttgaaaaattgtgaatcaatgtccgaaatctgaaaactgatcctagaaaggtctatctctgaaccaagaacttcctgtgtgattcacagtagcggtcctcgtatgatcgtatcaatatccaatgtctgatgaaaaaggaaaatagtagtatcgagtagccgacacaacctcagtttcgtgttacaagtcactttagcttttgccacaagtcgaacttcctattaacagcattcatattaaaatacactaacattcacaacaataaaactatacaattggtcgatgttagatatgtttaacttaagacaaaagctaaagtgacttaaaatatggaaccgaaggaataatagcgagtaggaagacaaggaaattaatttgtgcagttcaagtcagaacgtagcaggcggagacgatggtttttacaggtgcaggtccagagagctcctggagattttattcaggtagtgcgccgggtaagggcacctgcttgcccccttgcaagttgtcaccgggagattttcggtcgcgtgtggcgacatggtctggcagcgaagattgcaaggaacccagattataatgactaaaaatctaccctattagctccgcctgcgtcgctcgccctaggcgacacgggcagcgacaacacgcgccgacagcccgcttcctccccctctcttccgccttgccgccgcccgagcagctgccggcaaagccacgcagcagcaaggatggtggcggcggggcctcttttcttctctcaaggagtacggcggggcaccggtgggacttgagcgactgaggcggcggcggcggtgccgccagatccgcgccgctccggccggatctggcgggatggcggctggcggcggggaaggtgatggcggcgggggtgatgatggcgtcggggatggcgagctgcgtctgttattgggggccgtcgacggcggggatggaggtggcggcgaggctggcgacggcgggccggatccaggcacgccggaggcggatccggccccccgtgggtggatccggccccccatatgggcggatctggcgcgggagctccacgtgcttggcggctggtggctggtggcggtcgcggcagctggtggcggtcccgacggctggtggcggcgtcggggctgtcgcggcggcggctttggctggcgacgtcgacagaggacatggcggctgcgtcagggtggttgctggcagcggctgcgttggcggtggcggcggttcgcgatggcggtggctggcgtcggcggctggtgacagcggccggcttgcggcggccatgactgaggaggcagcggcgacatcggcggatgtggcagtggaggcggggaaggagtctgtttggtggcggcgggcgacggcgcagctgttttgcggaggcggaggctggcgtcggtggcagcggtgacgtcggctgtagccgtgaaggtggtggcaacgtcggaggatgcgggtcgctggcaacagcaagtggaggcggggaaggagtcgggtgcgaggtgaggatggcgtcggcgaggtggctgggtgttcggcaacagcggctgcggtggtggtgaccgtgtctgcggccaccgaaggcatggcggcctcggacggctagccgagggcgtgggagacgactacatctagctggtgcagcatcgtttgggtggaggggtcggagaccagcttggcgcagagaagcgcagccgatggcagcggaggctggctcggcgcgagaggcgcgggcggcggagatggaggccggcttggcacggaaggcatggccgatggagggaggctggattggcgcgagaggcgcttccggtggaggaggccggcttgacgcagagtggcgtggccggcggtggaggaggcgacctaggtgtgaggaggagctgtcggtgggtgtggcgcggtcttcggcgcacgaaggctggccggcaggggacgccggtgcagaggtcccacatgtcggcaaagcttgtgtggtggtggagcatcagtgcgtcagccgtggattcacaggtggtgaacggtgggtgaaaacccagtccagccttggtcggactgacaacgatgtcctgagggagttgttgcgctgtctcacccctcaaggatgattgccgagcgaaagcccagtcttggctcttttaagtcttgacagacgacggcagcagtttttccgtcgcttctcttcttgaagacgttgttttggcatcctataggggcaatctcgcatgtgtccctttgttggtctagtggcggtcggtcacgcttagcagcggccggtccggtgttagccttctcctgggcttgttgttggcgatgtcgccgtgtgggtggtggtatatttggttgtaatcttgtaattttttcctgctctatcaatagaacttcgcaccgtctcgtgcgagtcgttcaaaaaaaaaaaactttctagcaaaggaaagagatctaagatagtagagagtccagcattggaagagtggagctagtatggagaggacaggctacctgcagtgatgaacggcgtcgatcaccaccggtcgccagacaaagtggggagcgagaggataaattagctagaggcatttcggtatgggcatatgtgaggaaaattgggttaccattttaatttggaagaaatttcgaaatgtcattctggcatcggcccctaagttggaaatagcattccacgaaatcaaattggaatttttacaacggcatttcggcgaagcctacttttgatgatggcatgtatccaaatttctcatgacgcgcagagtccacggatcggtcactagtgtgcaatgcgccgtagacaagtgtctaaccagaaccgaacatccggatcggggcaatggtggtgtcgaccggagcgggagctgatcggcgggaagaccgccggcagcgcacgggggtgtgtgccgtgcgcgcgcggctccccttctagcccaaaaaggaaaaaaaactagcagttttgggccccgaaatatccagcccaccaaaactatcaaggccgaaaccgaagcccacaatgatgaagggctcccggattcaccggtcgatcgcgtcgcgcgatccctcggcgaggccctgatcggcggcaggagcagagccatgatcgacgacgacgaggaggcagcgctatggtcgcgacgaaacacgccagtggagcaccccatccgccgcgcgtacgaccgcgtcgccgccgccctcagggagaagcgatccaacgagcggctcgcccgggagtgcctggaccactacaacgccctgcacccgggcgacgagcacgacctcgcacccggcggcgacgtgacgctgtcccgctcgcactgcagcaccggcgcctggacgcacggcaacttcgtggctcgccgccgccggcggcaatggcgccgctgcctcgccttcgtcctccccgccacgcggacgctcttcttcttcgagcacatgtccggcgacgactacctcggcgtcatcacgtgcatcccgatgccggacgagccggtcggcggcttcctcgccagaatccctgtcatccgccggtgggcgacccctcgccggagcggcaggtgggactgcgtctgcaagacgtgccgccgcggcctccgcgtgacgcaccactggctgaagaggaaggtgatcggcgagttcccgtgcgggcacatggtggcggagagcgtctgcaagatgtgctaccactactccgacgtcgtccatccgagcccgggcaagttcgcgcgcgggtacctggagcacgaagacgaatttggccactacggccgtaatggcttgagggattatccatgttaactaaccccagcgtgtttctcttcgcttgcaatgctcacattagaagatctacactaataaatacgtatgtaacagatatttttgtcacttacaggtaggagtagaaatttgacatgttgcagcaaacaattcgtcatgcatgttagagctgcacaatttcagattttgctatatatatttcagaatttgatgcttgtgttggataatttcgtaggtgaaggcgtccagcacgctgtcatgatgcgataatgcttctctttggacaatttcgtatgagtgaaggcgtccagcatgctgtcatgatggtattatgaactgcactgtaatattattagtccaaaattctagaccccaggaaattggatattaatttcctattaccaaagtgctaaatgctgaatgtcctgcagagaaagctaataatcaggaaaaatccgccgtccgcccattacttgccttgctcaactgggcttgagcacatcctgatcaattctacgggcttctagaaaaactgtgaagcgaggcttaaaatctgaattttgattctaggactagaaggtgtttctttcagaacgatgaattcttgttagtgacctgtcctcatatcaacatctgaagccttgtgaaatcgaggagtagcatctagcagatagtgccgttctagaatcttgatggttacaatccctgtctggatctcgcgtgcggttttctcaaaagtcaaaaacacaagctgttactctctggaagcgaatcaatcatatagtcttcgggtacacttggaccatacagtagcttgcatctctgtccacaacctttttactcaaaactcaaaaaagtcgttgaagtttcagtacagaaggaactgacagagtagtgccgaactcttaacgaaaaaccaaattcgctacatctgcagcgcaatttttcctttgcggacagtgtgctaagcggtgaattctgcaacacaacgagtttcagagtctacaatgtcctagcctactacaccaaaactcagactaatcatggacttactgccagaatagttagtactaatgtttagcaatataaaacgcaacaatgtgctggtaggtagtaggagttgtacagacagtgggcatcagagtgacatcctttatgtgtttttctgaagctagtctacgcacaagtccacagtcagcaaaggcgagccgggctctttgaaattttcttcagtttctgacgttgcacatgagacttcctgctcctttccttcgtggccactctcactcatcgctagccactggatcaccgaacgtgcggctgagatcgaagctgggatctctctgtgggagacgggtcaatgggctgcacagctgcatcatccagaagcatttcctgtcgctgccagcattgtcatcgagcacctatacggtgtgcattttcaggttaaaaaaaaaaacggagtatccaaagctatactcggtattctagaagtgaagaaaccggataaacttttcactgtggtatttatccatatataccgactatatactgtatgcacgtgtggtattgagtgcagtatcttatgctccctttcacttaccgtttcaggcctacgactagtcaacgaatgaccacaaagagtttaaagacaacccagaggcgccagagccacatcattatctaagacttttctgtttgactcaactttagaccagggatttgtgcacgagtacatctagatgtgacactgacatcgtgggcccaactcaccctgaacccgtgacctcgtgctgacgactcacattcccggcctcaggtggatgatccccctgtaaaatcagtggaaacaaaaagcttatcatcatttgctaattgcttccactttaaatttacttgccgtgcttgaccggttataatctcgactctcgtaatagttttctttttctttgaagactaataaatagtgtgatactagttctaatcggtttgaagatatactaaaagaaatggtttcaacagcgacaatacggccagtggagcaaaattagatgtttaaattattggtggccatgggtgatagcaataagatcgcgcgatctgcaacatcttccactcctctttgtcgcaagtgatcgacacctctgtgcttccgaatagtttgaccattcatccgacggcagagtaatgtgccggcacatgctacagtccaagccaacggagcatattgtcgtaccttgatcatgaaaagatcgcaaaactcccataaagaaaccatgtcacgagctgtgcaattcgtacacgttgctcagcttagtccttaacttaacttagtagtagctgcataaacaaaccatctagaacatatccctttcaaacaacgccaccatctgaccagcaaaaaccaaacaaaagatgagctaaaccaccaactggtgaactagtatcaaattataaaggaaagcatggctgaaacttccaagcaagcagcacccaaaaactaatcctaaattcctaacaaattcaatcatttaaccaaacaggataatggaggaagaaaagtctgcacgtgccgttcacactgcatataaatggcccacccatgtttctcacggtggagtccgcgatggctgcttgcctcaccgagtgaacgcacgcgctcgccggcggcgaccaagaaaccacgcgaagacatggcattcccgagcggcaaagcctactacctccacctcctcctgctcgcgatcctgccaagcctcgtcgcgcggcgcggcgcggcgcagcagggcggcgtcgacgagaagcagctcctgctccaggtcaagcgcgcgtggggggaccccgcggcgctcgcgtcgtggacggacgcggcgccgcactgccgctgggtgtacgtgtcctgcgacggcggcggcaccggccgcgtcacgtcgctgtccctccccaacgtcgcggtcgccggcgccgtccccgacgccatcggcgggctgacggcgctcacggtgctcaacctccagaacaccagcgtcggcggcgtgttcccggcgttcctctacaacctcaccgcgatcacctccatcgacctctcgatgaacagtatcggcggcgagctccccgccgacattgaccggctcggcaagaacctgacctacctcgccttgaacaacaacaacttcaccggcgtgataccggcggcggtgtcgaagctcaagaacctgaaggtgtttaccctcaactgcaaccagctcaccggcacgatcccggcggcgctcggcgagctcactagcctcgagacgctcaagctcgaggtgaatcagttcacccccggcgagctgccgggatcgttcaagaacttgacgagcctgaagacggtctggctggcgcagtgcaacctcaccggcgatttccccagctacgtcacagagatgatggagatggagtatctcgacctgtcccagaattcattcaccggaagcatacctcctgggatttggaacattccaaagctgcagtacttgttcctgtacaccaaccagctcaccggcgacgtcgtcgtcaatggcaagattggagcagcgagcttaatttatctcgacatatctgagaaccagctgactggaacgatcccagagagctttggaagtttgatgaacctaactaacttagccttgatgacgaacaacttctccggcgagataccggcgagccttgctcagcttccatcgctggtgataatgaagctgttcgagaacaatctcaccggtcagattccggcggagctcgggaagcactcgccatttctgagagacatcgaggtcgacaacaacgacctcaccgggccaataccggagggggtctgcgacaaccgccggttgtggatcatctccgccgccggcaaccggttgaacggctcaattccggcgagtcttgccacttgcccggcgctgctgagtctccagctccaggacaacgagctttccggcgaggtgccggcggcgctgtggacggagacgaggctgatcaccgtgctcctgcagaacaatggacacctcaccggaagcctgccggagaagctgtattggaatctgacgaggctttacatccacaacaaccgtttcagtggccggcttccggcgacggccaccaagctccagaagttcaacgccgagaacaacttgttctccggcgagatacctgacgggttcgccgccgggatgccattgctgcaggagctggacctgtcaaggaatcagctctccggggccatcccggtgagcatcgcgtcgctcagtggcttgtcgcagatgaacttcagcaggaaccagttcaccggcgatattccggcgggattgggctccatgccggtgctcaccctgctcgacctttcgtcgaacaagctctccggcggtattccgacgtcgctgggatcgctgaagattaaccagcttaacctgtcgtcaaatcagctcaccggcgagatcccggccgcgctcgccatctccgcctacgaccagagcttcctcggcaaccccggtctctgcgtatcggcggcgccggcgggtaacttcgcgggcctgcgctcgtgcgccgcgaaggcatccgacggcgtatcgccgggtctccggtcgggtctcctcgccgccggcgcggccctcgtcgtcttgatcggggcgctcgccttcttcgtcgtccgcgacatcaagaggcggaagcggctcgcgcggacagagccggcatggaagatgaccccattccagcccctcgacttcagcgaggcctcccttgtgcgcgggctcgccgacgagaacctcatcggcaagggcggcgcggggcgcgtgtaccgcgtcgcgtacgccagccggagcagcggcggcgccggcggcaccgtcgccgtgaagcgcatatggaccggcggcaagctggacaagaacctggagcgcgagttcgattcggaggtggacatcctcggccatgtccgccacaccaacatcgtgaagctcctctgctgcctctcccgcgcggagacgaagctcctcgtgtacgagtacatggagaacggcagcctcgacaagtggctccacgggaacaaattgctggccggtggcgcgacggcgagggcgccgtcggtccggcgagcgccgctggactggctggcgagggtcagggtggccgtcggcgcggcgaggggcctctgctacatgcaccacgagtgctcgccgccgatcgtgcaccgggacatcaagtccagcaacatcctgctcgacgctgagctcatggccaaggtcgccgacttcgggctcgcccggatgctggtccaggccgggacgccggacaccatgaccgccgtcgccggatcgttcggctacatggctcccggtaattcacctcaaccaacctcgctgctcgtctcacgattctcccttgatttcttctcttagcacagcgacttaccttgtgctgaccacgatcgtctcgtgcagagtgcgcgtacacgaggaaggtgaacgagaaggtcgacgtgtacagcttcggggtggtgctcctcgagctgatcaccggcagggaagcccacgacggcggcgagcacggctcgctggcggagtgggcgtggcggcacctgcaatcgggcaggagcatcgccgacgcggtggacaggtgcatcaccgactccgggtacggcgacgacgccgaggtcgtgttcaagctcggcatcatctgcaccggcgcgcagccggcgacgaggccgacaatgagggacgttctgcagattctggtgaggtgcgagcaggcgctccagaacaccgtggacgggaaggtggcggagtacgacggcgacggcgcgccgtttctgccgatcaggggtggcagccgccggaagcagctttcggacaccaaaggcatcgacgacggcaacggcagcttggacagcatagtatgagaacaatggtcaataagaagtataacctgatccaatggttaccatctaggagagatggcacgctagttaggagagcaggtagataccagacaaatacattcgccatccttcagttatttgcatgtaatgagtattgtaactttgtaaatgcatctataaaattttgggacagtgagagtgcagtcacatacatatatgagatcaaacaagagcaattagattatgtccccttctttattacgaagagaaaatacagagcaaaaaaatcttggttctcaacatcaattaagggggaaaagaatctgacagaacaggaatggaaattgcctgtgcctccatttccctgttagtctgctactgccatccaacgttttatgccattagaaaacctccaaactcattggcgctatactagctatatcccgctgcagaggcacttatgtttgccctcagaatagccaaaaaaagatggtaagatttcaaggggggagccaggagtattatgtggattttgaagggggaaatgagaacctacaaacggagtttgattcatcattcatcaagatcatccttaaagctagtcgatctcggcatactgggagtgcgaggctgcgagaagagcagctccaatgccagaaccatcgttggccagcttggtaaccaccgaagacgagacatcatccccaagaaggtctgttagagttgattctaagcaactgctgaacttcttgtaatgttcatagagcccaccatccaaggcaatgacagtcctaggcatcttactgccgtcttttggcatcttgtcccgacctagcttctttaggaccccatatatgccagcagcagccaagcgtgcagcacgctctgcaactatgtcacaaatgtgactggtaatgtatcttacttccagggaagtatctgggacctgaataaaagatcaaatcataaataagcaaccagtactcattgaacagtgttggatgttgcgtatccactttgggtcaagaaatttcataccccgacgatatcctttagcttagctccaacagttttaaggtcatgtgacgagtcatgatgcatggctgacatatccggtgtcctgtgatacaacaattgagatacttataaaaaattctaccagagttgcataagattgaggggttagaagcataaagaaaaactggtgagcaaaaaccaaaccaccctaattatccaagctagataacttctagttgcacacaattatgagaatcaaccagaaccagaagaaagtagtaatggataaaacaacaaagtgtatgtttgtcaccttccatggatttgctaactgatttagcatgataatttcaagatatacaaacaacttccccttccataatctatctgggtatattatcaacagtgcgaatattataatggaaacgatgccaacgtctttatatcatgtgcactcttatccaaggggtagtcacagaaatcgtgaaaaaaaaaacttgaccagcatgatagttaacaacaaagtaaaacggcttttgccatgacaaaaggaaggaatgaagatcaaaagagagatggtacagaaatataccttagtacaaacggttgctctagcttagatggaacaacatccccaaacaaagctgcatcatgagcaagcttcagcaagattcttcgcactatctctccaagatacatgccagaaatcaacttttcatatatctgttggaaaatacatacaagttaatgcggtccacctaaaaggctaaaactaaaaggagaggaaaatactggggatagaatacctgctctccaggattcaagctttcaaaatccattgctttatcgaattctgaaagaggaagcttatctgatttaaagctcccccattctgtgttgattacctagagaataccaaataattccacgtttacatatttttttaagtagggttaacattcaagagtgttggcattgatcatctataagacatagacaactaatgataatcccaagcataaggtattcacacactaaccatatttccggacctaggcagtaaaccggtccatttaggaattgcattagcattctcaacatatgctgcatttgtaccagtgcccaatattatagcagcaacaacactgttatccgcatacctcccaccagccaatgtgccgacagtgtcattaacctaacatcagtggtaaatcatgtaacaatgtttgcatcacatcatcagatgtgaataccccaaaagcagcatcaggatacaaatgattatcaatgcctcagataacggagctgagcatagatatagtgtggaagtaagaaattgacgaaattaatatatattaacttaccaatgctgcaattttcatatctaatccctgcctctccatggccttgcccaactcagatacaacatcttcgccaacctaattcaggagataatatagcaaaatcaaattattcttattggatgcttgacagttcacacagatatgatcaaccaggcaaacataatactgagtactattaaagatcctcaaattaaatatgcttcctgatcaaggtcgatatttcttttcactaacctagttaagttgattacaatgtacacaaagggagattgtagcaaatagctaattgaaatactccattgccatattcaatcaagctttatcaaggaaccttgtgacataattcatgtgtttaaagaaggatcaggattgtgttctagtcagggtatgtccaaaagttatttttgattttaccgcgtcattgatggagaaaccctttgtccacttgatgagcgttcctgacgatattgatgtctggctcactgggaaggaaaaggtgaagcccagctctctctgtctcccttctgggaggtggaaatcatcaccttcagtatcaacaaattttgacaatgcagaagcaataaaatcaaacagttcctgcattaatagtcagaaaatacataagacaagcatggaatgtacagctccaagaaatttaaaatcaagcagcaaatgcttaccatggaagttccaaccatcagatgtggtggaattgagacttcctcgtactgttgttggacgacacgtttctccttgccaccgagttggactcgcaggacgcggaagttggttcctccaagatccaatgcataaaacaacccctgttcatttctgcaaagggaaatcattatgatcaaagaatgaaattactacttttggaagaaggcagcaggaaacattgtatgcttatgggtgagtgagttctaacagactggtagaaggatccgatagaataagaatgaatcattatatttaagaaacttccttcaggatgtgcctgccacatttagcttaacgatgtggaggttacagagaaacttattaccagaccaactataccatgagataagctcgactgatggatctaattggtcagattgctaacaaggaaaccacaatgcaaagaaactctctgccatacattagttaattacctgtcactgaagccttaacaaatcaaaccaacaagaaattaattaatcacatatcataatcagaaatcctaaagagccaaagtaggaacaaatggacgatcaaattaattaatcacatatcataatcagaaatcctaaagagccaaattaggaacaaatggacgatctactatagatcacaaaaccgaagatcatctgagaacgataggatatgttgacgggagacctatctttcctagcttagataggccaatttatctatcttgtttgagttctatgtagaatcctgtttacacaaggacatgaggggtacagttcgtaatccggtaccccgcaaattgttttagcaaacaaatgtgatctataatctataacatgtatgtatagtatgtgtatgcacaatcagctaaattaaaacaatcattttcaagcacaaaaatcatccttgtcaagagtattatcattttctcttggctactttatatttttttctataacaatgatttatgtttgtgttaataacacatactagcacttcattttttttctcattgcatgatgctttagtaactctgtacccccatcaccgaaatcctgcgtcctggtgcatgagaagcaatttcagatgcccacgactccacatttttccttcaatcactggtatgagccaatttgccttggctctcctcagcagagtccgagagcaagcgtttccttgtggttacataacttatttcagttataacaaatg

SEQ ID NO: 76729 - DNA, 2107 bp, Oryza sativa
cccattatgcttgtctttttcgcaatccctctcgctgatactcccttccaaatatccctcgctgacgggtgattctttttagtgaaacacttgcattgtgctagttctagattaaaaaaaaaaaaggttagaataactttcgctggctgtcgtccgctgccgcgccatcgtctcccccccccccccccccatctcgtgcagccgtccgccgccttgaagccaccggcgtcgcctcgtcggcgcgctacatgatcgagcacgcctcggcgtcggaggctgcgccgaagctttcgttgccgccgccgccgtaaaggtcgtcgttgccgccgatgtcgccgccattggtcccgatgctgctgctgccgtcgagtccgccgccgccattggcgctgtgcccgccaccgccgttggcgccatagtgatggtgatgatggtgtacggtgacgtcgggtcgaccgtctccagccggcggcggacgcggacgatacagaggaagcggcggcggtggcttcttcttcttcttcaagctcttccagcactggctccggtagatgtaggcgccaccgcacgccgagaagagagacgcgatcatcgtaacgaacacttgaacccatgaccatgacttgcagttgcagacgaacacgcgacgctcatccccgccggaatggccgtcgccgccagaaccatcattgccgccgccgccgccgccagtgcatgcagggaagccagcatagcaggggagcgcgggtggagagaagtacgaaacgtctggtggagagtagaaaatgggtggaggtggcggcggcggtgagagaggtggtgggcagaagatcgcagggggagggggagcaccggagatgatataatccatctgagctacgcggtggagaggatgaagctagggcgacagagtcgcggagagagagagacagagcgcacgccggcgaagaagaagatgggagggttttgtagtcttcctccctctgctcacggtgggccaaaaaaaacccagcaaaacagggtttccttcccagaatgtgtaggttcctccctctgctcatgatgggtcaaaaaaaaccaggttttcctcttctcatagtgggtcaaaaacctagcaaaacaggttttccttcccagaatgagtaggttcctccctctgctcatggtgtcttggtgtgtccaaaacccagcagaacaggttttccttcccagattagaatgggtaggttgggctaaaattgacccacctagctctgctgcctctgcatccccaggccagcctctccaggctccactattctcttgttttgggcctgttctttcttttcttttctttttttttcaaatgcagcattaggccactggcttccatactagtgctatatatggaggggggagggaggtatatatggatggttgaatgtgacacctcttggagcatctcaactgtttattccgatcatcgagccaaaaggccagtacaggccaaggtttagatcagctgaaagagacgcttcagatcagttgaaagagacagggtctttctgatagaaaaatatatgatgacgtgccatgagcctcttaatatcttgtactagtggctaatcaaatatggttagatttggaagtggcctgcatggtagtggcacaccgggctctcctagtacttctctcggcaagagtgacattgacgctggcactacaaactcatccgctgactgctggatcatcatatgttgaccatcatcattatttctatatagcaaatcttttcgcaataccattatataattttttttcgacatgaaactatattacatcttcacatgataatgctgtatagtaatacatacgttattcgttataaaatgttttcttattattatctaaaaaaaggttttcttattgaaacataagcttattgctaacaatacagtaatagtattagaagtactactaccgcgtttgaacaaaatatcaaattactcctctaaactattgtgacaatttaccaactgaacggttacaccaggctacccaaactcgttaatccaaataaattatcctttgaacactcttttaggcggttttggcatgagatgacaca

SEQ ID NO: 76730 - DNA, 4256 bp, Oryza sativa
  unsure (1)..(4256): unsure at all n locations
acgggtggggtccatgttattttccatgcgggcacgccacgatggctcaccacgtaggcaaaagtggcaaatagttaaaaaaaatcacctctctccagtggcaaattattaagcgcgaacctaaaaggagcatttgaataattgacaaatctaaaagtggcaaataattaaattccccgaagctctcggtggcggcggtgacctgggtggccggtgggtacccttgtcgatctcttcctacctcccttcttccctacttgttctagaagcgccggtgggcacccttgtcgatctcttcctacctcccttctttcctgcttgttctagaagcttctggtgccttctaccacttgcatctatttagttttccctcttccaactctcccaaaatatactagacttgcactggtagattaccaattgagttggtgttaagattgctgattgggttgctaacagcatgcaggatgaatataatatttacgacaataacttaagtttctgaagcgacaaatcaagctcatccttgtgctgctgctttccacagtagaattcggtggggtgcagaacacgtccgggcgggcagaaggcacagccgccattagcggcggcggtggtgagatcggcatcggccggccgctgctggagcacggtgcatgtgtcgacgaagaagctgtgtacgtagggggtgaagcggatcgagctcagcgaaaaccaggcccgatggtcacgcccgcaccgacagcttcgctgctgcctgccatgtccggcctcctctccttcgcctcgtgcccttcctagccttcccttcccgcgccgagaaccgccgccgctcccaggccgcgcctccgcatcgcaggctccgccgccgtgtcccaccgggcatcttcctcctccagagatcgcctccgctagctcgtccgccatggggagctcgacaaggcgctccgcctcgtcgggtgcgcgcggaggcctgatgcgggcaccttcgccgcgctcatcaagaagctaagcgcgtcggggcgcaccgaggaggctcgccgcgtggagccgatcgctggatcaactctgctccggccgacgcctcctcgttctcctcggcgccgaggaggccgtacctgtcggaggcgtgggacgaggaggaggaagagctgaggaggatgctacgcatcaaggaggatcccaccgccggcgacggtgacggttgtggtcagtactggttgttgcacatactgtgtttttgttgttgcagtcagcgttctcgagtgttgcattcaattgcaacattttcgataaagcggtgaaacatttttcagtgaaagatgaaacatcaagaaacaattcatattgaaacattttttcaagcaatgaaacattgcaacattttttaacgtacagtgcgacatcgtccggagatttgcaaatttcgatatacttagtgaaacattttttatcaacttagtgaaacaattccgatatacttggcgcaacaacgtacaacatttaaaaataattcaataataaactaattttttttcatcagattatattcatatgtggtcttgttttaaagattcaattgtaacggatttaatggtataatcggatcatgatttggataaatattttaagagaaaaaaatagttaaagttcgcttgatccatacatgatggatggctggcgcgcacgtgcgtggatccgacggtcgtgcgaggcgtccgatttttcgtctcgcgccgtacgtccgacgcgtagcacgctccccttaattgtgggccacacaggcgcgcatgcacgtgggccggagaaaaggactgtgctgcacaaactttgagtccgagcaggccttcttcaccttcgcgggccgaatgcactacacttgtttctcacagctccaagagaaccaaatctataactaactaatataaatattcggatttttcctatcgtcacaagtgggacgaaaggcgccttcgtccctcacggtgcgccttcaaaaccccccgaatccctattgcactcagaatcgatacaaggaacacatcccaaaatcggcacaaccaaatcggatgaacacaccgcaaaaaaaaacaaaattcaaccaatctttgcccaaaattacaaaatattacaaaaataatcatccaacatacatacatcacaaaacttcactccctaccaccggatccaccctcggccgtcgccgtagccaccgaatccatccgcggcagccgccgatgccgccaccgtcgccggatccatcgtcgcggatctggagcgggagggaggcgagaggggaggagcgagccgacgccggatcaggagggagcggagaggggaggagggagccgccgccggcccgccgccgccgccaccgccaacggactcacccgccgacgcacagacatcgcaatcgccgtcggatctggggcaggagggagacgagagggcaggagagagccgccactgtcgtatccgcccgcagccgccgccaccacttacggatccatctgtggctaccgccgccgccgccccaccggcggatctgccgcgggagggaggctagagnggatggagggagctgctgtcgccgccgccaacgctgcctccaccctcggatccgccgcggccgccaccaacccgcagccgcttaggtgagagggataggaggagggggggcgctgccgccgttgctttgagagaggggatcaggggcaccgctcgccggtcgttgctccgagccgccgcagccgctcgggggaggagggtgccaccaccatcgtcgctcgggggagattgggggcagggggatggggaaatgaatcctagggttagggttagggttttggtatatttatttaggttaggattaatctggaccgtccattcgatcgaacggctccagatgctcccgtgtcgggccgccgacctattgggccaccgaatggaggatgcaaaatggacttcaacggagaaaggaaacaggccagacacatagaatagacgaagggagggaaacttttctttattcggcccaaacctataagggaggattttgattcctttttccaattaaataattgttaaatgatgtttgtattattaaaaattagcaattaagctctgataattttaataaaattctaaagagcgtaattaatcatggagaatttaataaaattaaatttaaccatgtcattttatttctcacacttgatttacttataaattgatttaattatacacctatctacttaaaaatactaaatatttcagcaaatttgtattttaattgattacataatgtaatttttttcttaacttttcctcaattttctggtctatacacttcccgttgtaacgcacgggcatttttgctagtaatccaaattttgtgaccaaaatgttaatttttctaaagcagtataatttttgtggaaaattagtacacactactgtaagtgaactcgtgctcgatctgttctgttttctgaacaggggaaattaaagagcatgcactgttgttacccagggcccatttagttacctaaatttttttcccaaaaacatcacatcgaatctttaacacatgcataaagcattaaatatagataaaaagaaaaactaattgcacagatatgggagaaatcgcgagacaaatcttttaagcctaattagtccgtgattagccataagtgctacagtaacccacatgtgctaatgacggcttaattagtctcagaagattcatctcgcggtttccaggcgagttctgaaattagtttttccattcgtatccgaaaacctcttccaacatccggtcaaacgttccatgtgacacccaaaaattttcttttccccaactaaacacacctccagtatttgtgacttgatagaccaacacaatatggtaagtttagattagatcagaggtgtttgtcaatagtgtctatatgaaaaataaggagacagataaaggtggctcctcaaagagttgcatgtgttagggtctttgcctattctatactatactatatattccatgactcaaaagggagctctagcatatcaacaatgtaatgtctcgtcaaagtgatatatcgatcgaggaaagcagagaattaagctagcaaacgatctgtcagggcaaacacagcgtcctctgcccctacaaattaaagaactgccctgctccttcttgcttttagtttagggctgtatttttttacctaattgaagcattattaacagtgtta

SEQ ID NO: 76731 - DNA, 1086 bp, Oryza sativa
caatatccattcgggaaagggttctcatctctcaagtggatatccctcattttttttacatgtcatctaaaatagtcataaataatttaaaaagatagattaatatgaactatatcactccacaaacatacaaattcaaatccaacttttacaagttgtaacaaaaacaaaaaaatatataactatgaatgcacgttaattattttcagtttaatttgttcttttttttacatgtaaaagttgaatttagatttgcatgtttgtagagtgatatttcatattaatctattttgtcatttttgtcaaaaatttgatgacatgcaagaaatgagaggaatctcctgtccattctacttctttttcagactcagtatattaattatcgtctggattattattacagaagaaaaagctcagaacggtggagtactggaactgaaagttttcaacttgatgaagataaggttcaatattgttgagatgaaatgaataaatcccttggagtgaatcatatgattctgcatgcagttgaaagatattactgtccattttaaatttgaagacagcatgaaagcccacagcatatgcttcaactgtgtgatctgatcatttactaatatatatatatagaccaaagacgtcgtttcaggaggggtgctagctaattcccctttgtgtttctttttgtacaattgcagctaattaaagagcagtagcatcagatccttttctcatgtcaactgaaactgagagagagaggcagcaaaatgaagaacagccagtgcatgcatgtgttactgtagtacatatagatgaccagaccacatgggtgtgcatgcatgctactccccttacttcacttcacttcacttcatcacttccatgggagaaagaaagaacattaaagaaatggtttcaagtgactgattctttcatgcactaggaaaagtcccatcaaattttcatttcaggtcatctcagacacaaagtgataaggtcatcgcttttcctctcccctaccattcttttctcaccttctcatctcaatcaacagttgagaggacaactggcctcttgcattgcctt

SEQ ID NO: 76732 - DNA, 11236 bp, Oryza sativa
gtccatctttagatgtcagacctgttctccgatcgcaagcgccgctccgagcttcagagtcgccgcccttagctttatcgtctttcttagtttgttgtttgctagtttctgtgtttaggtctgctgcttgtgggttagtcggcggtcgatatcatgtgtgagtggtatggctgccttaattaggagttgtttgcttccttttcggtgttttaatcaaaattaagataattgtacctaaatttataagaaagattagattctgagccccctgtttttcttccttttctcatatttctacctatcccccttcagatggtgaagacaaggaatggttcccgggaatccaacaacgccagtggcagcgaagagcagatcagtggagcacgtgcaagcgatgcatctagcagcagttcatctccaccgcccgagaacccaacgattgctcaggtgttggacaatcagactcagatgatgacaatgatgatgcaacagatgcagcgacagcaccatcaggtgttgtagcaggtgcatcagcaagcacagcagcagcagcagaacctgcagtttggtcctccacctccacagtccaaactgttagaatttctctgagtcaagccgcccattttctcaagtaccaccaacccaatcgaggccaacgactggctccatgcgattgagaagaagctgaatcttttgcaatgcaacgaccgggagaaggtcgcttttgctacacaccagctgcaaggtcccgcttctgtttggtgggacaactacatggtgaccagtccagctgggacaaaggttacttggtcagagttttgtcagaatttcaataaagcacatgttccagagggaatcgtggcacaaaagaagagagagttccgttctctgcaacaaggaaccagaacagttatagagtatctgcatgagttcaaccgcctcgcgcgctatgctcctgaggacgtgcgcactgatgctgagaagcaggagaagtttttgtttggtcttgatgatgaattgaccaaccagctgatctccagagactatgaggactttgagaagcttgtggacaaggctatccatcaggaggagcagtgtaacaaaatgaaccgtaaaagaaaggtcagttcaagacttcccaggggaaaagtcagaagcctcgcttcacgatgggatgtcagggtgcaccttccaccatgattatctggcaacatcgtccgtaccacccgggtaatttcaacggcatcaacaacagtggcaggcacagtaacagtaagcagcacagcctcaaccttactctaagtcgactaatgattccagatcagtcagttcagtcagctctgccagctcagccagaacagccccagaggtttggaggaaagcccaaactctgcttcaattgtaacaaacccggacacacggttggaaagtgtcaatcatgcgtatgcagaggaggcgcagtcagcaccagaggttatattgggcacatttcctatcaactcgacaccggcagtaatattgtttgactctggtgcaactcattccttcatttccaagcgttttgctggtgcacatgggttatctttagtgaagcttaagatacctatgcgagttcatactcctggaggtggcatgaccacaactcactattgcccgtcagtgacagttgaaatccaagggttgatttttccagccaacctcatttttcttgaatccaaggatctagatgttattctgggaatggattggctgacaaggcacagaggagtgattgattgcgctagccgcaccatcaagttgaccaatgcgaaaggagaagtggtaaccttcccgtctccagtaccgcagaagccagggatcagtctgaaccaggctactagtgaagaacaagaggtagtagtggataaaaccactaagaagttggaggatattcccatagtcagagaatatccagaggtttttccggacgatctgacaacaatgccaccaaaacggaatatcgagttccggattgacttggtacctagaactgcaccgatccacaagaggccttacagaatgggagccaacgagttggcggaagtcaagaagcaagttgatgaacagttacagaagggatacatccgcccgagcacgtcgccatggggtgctccagttatttttgtggaaaagaaagataaaacgaaaaggatgtgcgtcgactaccgcgcactcaatgaggtcactattaagaacaagtatccgttgccaagaattgatgatctgtttgatcagttgaaaggagctactgttttctctaagatagacctgcgatcaggctatcaccagttgagtatccgtgaagaggatattccaaagacaacattcatcactcggtatgggttgttcgaatgcacagttatgtctttcggactcactaatgcacctgccttcttcatgaatttgatgaacaaggtgtttatggaatttctagacaagtttgtagtggttttgatcgatgacatacttatctactccaagtccgaggaagaacatgagcagcatcttcagttggtacttgaaaagttaagagagcaccagctatatgccaagttcggcaattgtgacctctggcttaaggaagttcagtttctcggtcacatcgtgaatgctcaaggagtagctatggatccaacaaatgtggagttagtcaccaaatggaccccaccaaggacagtcactcaggttcggagtttcttaggactcgcgggctattaccgccggttcattgagaacttctctaaaattgccaagccaatgacacagctcttgaagaaggaagaaaagtttatctggtctgctgaatgcaacaggagtttcaaagaactcaaacgacggttggtgtccacaccagttttaattctgcctgatcagacaaaagatttccaggtttattgtgatgcatctcgccaggggctaggatgtgtgttgatgcaagatggcaaagtggtttcttatgcttcacagcagttgcgtcctcatgaaggcaactaccctagccacgatctggaattggccgcagtcgttcacgccctaaaaatcctaaatatataaattgttgtttaattggaattattagaatttattttaaaagcctacaagttaaactctaataatctaggaaaattttcaacataaaaatggtctagataaaattttattaaatactttgcttgttcctctattttctagatttttctgggaattgtttgagcaaaggaagtttttttttaataattggaacaacatttaacaaattattttaattaaaaagttccaaaacccctccctaaagttgttgggccgtttccggcccaactcttctcttcccgcgcgtggccaagccggcccaagtcggcccagccgagccgccccgccccctcctcctctagccaccgacatgtggggcccacatgtcggggtcatccctaacctccagccggccggccgcctagccgagcccgagctgccgcctctctccaccaatttcgcctcttccggtcgccctcgagtccgattaattgaggggtttttatccccacatcttcctctatctttaccctcaaaaatcggagcaaatcgttgggtattttatccgaatcgaactcgttttcgagtttatctctaaaaccgagtttttgatttcccgagtcgatttcttgcgggaggagtccgatctcttcaatccaaggctataaataggaccccctagttcccctctttcgtttgccccttttcccaagccttcccgtgctccgtagctccgtcgccaccgccgcctagcaagccgccgccgccggccatctccggtgccgccgcgccgccgtctccatcgtcgtcgccggtcgccgtcaccaccgttgggtgcgccgtggtgaggggaagctcggccacccttccttttccgtcgccggtcaccggagctccgccgccccgtgcaagccgagccaccgccgccgccccttagtcgccggccctcgtcgttcgtcgtttggctcgagggtgagtaccgttgggttcgtttcgtcgttctccacgtgtacgtgtcctccaaagttccggccgaccgccctatctccggcgaggtcgccaacccgggccggccattgatgatgtcatcatgacgtcatcatcggttttccctttttccagttttttttctaatagattaaatcttcggaaaatcataactaaataaccgtagatccgtttcaggtggttcaagttgctaaatttttctaaaatcaagatctacatgttaaaaatatccacatgtactgtttatgcttgtttttgtactgttttgttaattttttgtttaattgctttagtttccgacgttccggaggagagcgtttccgttgaggaaggttccgaagcgtttgcggaagcccaaggcaagtcacacagatcccaaacaaccctttgagcatgttgaacccatttaaagctattattttctttcaactatgcattgttttcgaatgtcatcgggtggtgaacctttcccaatggttagcggccgaagatgatcttattttcctatgggttataatttgattagcatgaaccttatatgttggattggttcagctaaatgctttatgtaggtttgcttagccatgcttagaaacattagctaactaaagggattaattataaactatgttactttattattttaattatggttacattaaatggtagctcacgatggttaatcgtgtgatgttaattaattgataattaaaacctggttaaggtgggttgtgagcatatggttttgatggttgtgctcatgacaattaaggaccggttcgcgagctactgttgtgaaacatttatcgtgccaaccacaagctagcgtgggcaacggctttatcttttgtatagcatgattcaatatagtgcgccagactgtgaagtggcgagaagtccacgggggtcgctgggtagtccatgccttgtttataagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctgatcagagtttaatctattcgaatagccgtacccgcggttatgggtgagttgagcaatgtttttcgtgattagtctcacctttctcaccatagtaaatgatgctttaattggtaataatttgattagctcctggtttggaatggtatattcctggtttggagatagaactgtgcacccgggatggttgttctgaatggttgggcctatacaacagggtatgttgtatagcgttggattaatattgtttattacttaactgttttattaaattctcaaatgtttgctaaatgctgtttttgcaaatgaaactatattatgccatcctttgttatcctgtgcacttgcatatttgctgtgtggcttgttgagtatgtcatatgctcattcttgcaatattcaatcatcagaagaggagtatttcagcgaaggtgatgatctgaaggattgagcttgttctggttaagatgcctgtggagtggagtcgccatagctgttccgtagtttgttatagttagtttttttccgctgcgtagaaggttatttttttgagaggaactatctacctctgtagcaatttattatttgcgaatattaaatagttaattatttgtactctattatcaattttgttattgtgtgcctcggttgattcctggacgagggtttaacacacatgtaagcgtttggaattttggatagaaattccgggcgtgacaagttggtatcagagccaccttgaccttaggataagccaaatggtaaaccttaagtagccttcaaaatattttgaaaaaaatagaactgctcttctctattctcttataaattaattaagttggcagcacatgcaaggttatgcacaaaattaaattaattcattttcttttcttttaaaagaaaaaaaaattgttcttctcaaaatgtttcctattccgccttagtaaacttcattgattagtcggcactgtacatctattatggtatcgatacaatcatgatagcactagtactactcatccttcttatggtgacactgtaccgtgcatataatagatcataagtattttagttttattttagttatttgtcaaaaaaaaattatttgtctctgtccaaaaagttaaattctaaaaatatatgtataatagcttaagtatgtgtcttttcttttatttttcttcctctttggtcaaatcagttaagtctagatggtgcagctaacttaaaaaaaaatgcattaattcctctcttctatgtttctttagatgccgccccattcaccgagaaatttgatcaaggtgttaggattcgtcagggagctgaggttgatggcttttgaggtaggctatgaagttgctcctgagtatcgccggatttcccatgaccccaacgaggagaagtgtcgtgttcgtgtgacgttggctagtgatcgtgaagaccttccgtccattaagttcgaaactagaggaagatcgtacaaccatgcttgtcaagaagcagctttggtggccattggagagttgcgtcaacgctttgaagaagagttggattcatcagctttccagtatcatcctcacaagcctcgtggtcaagactatggaacctatacctgtcctgatggtgaagagagtgccactctgatgcatgcggtgcatatgcttagtgctatggatgcagtaagtgtggagcgagacaaagcagctcatgacagggaaaattggaatcgaggcaagatttgcaagttggagagcaaggtgtaccatctacagaaggaattagctgaacttaaaggagaaacgccgctgccaacacccaagcttctcctcaccgcaagaaagagaacctgtccgccacctcgtctccagttagcttcaaagattcgcgtgatgggtgaagttgtgcccgatcgtgctgaacttgtcatcgacatcgtaagtgatgaggaggaagaggaagaccctgaagaaagagagccagctactccagaggaagaagatccatcgcttcgttccgacgcaaggcgggattagtcgcttagttagatcgttgccgtagttcgctgtgttagattgcttgtttaagtttgcttgtgagtgtgtgggttttagttgttgcttacatcattggtgggatgtaacagcatgagtctagctcttttgcttgtcagagtgtaagatagttggtgagatagtgttaatgcaatttaaatgtaatcatacacagttaagagcaatatagaatttaaattaattaaataactccgttctaagggtgtctctttgtcgttctttcctgttgtctctgcttatcgtcagatggtgaacacgcgaactggaagtggaagtggaagtggaagtggagctgctaacaatggaggagatcccacgctagctcagattctggcccaacaaacacaactgatcaatctgttagtgcagcaggcacagaatcagcaggcaaacaatcagaaccagaatccacccccacctccccaaaacaagctggcagatttcttacgtgtgagaccccctacctttttcaagcaccaccaatccagtagaagcaggagattggctgcatgcggtggagaagaagttggatttgatccagtgtactgagcaggagaaagtttcttttgcttcgcatcaattgcatggtcctgctgctgaatggtgggatcattttcgccaaggcagggctgaaggagagcctattacttggcaggaattcacggccgctttcaagaagacacacataccaacgggtgttgtagctctaaagaagagagaattcagagcactcaaccagggatctcgttcggtcaccgagtacctccatgatttcaaccgtttagctcgttatgctccggaagatgttcgcaccgatgaagagcgttaggagaagttcttggagggactgaatgatgagttgtcttatgccttgatgtctacggatttccgggatttccagcagttggtggacaaggcgattcgtcaggaagacaagtataaccggatggagcagaagaagcgcagggctgcccaattcaaggcacaacagggcagtaaccagaggccgcgtctcgttacggaacctcaagctccatcgtaccctcaaggaggatcttcatcagttgtccgcccccaacgccagttctacaacaacaatactggtaatcgtggcaatgacaaccgcaacatggttgctcgtcctgcagcaactccagctcagaaccagcccgtcaggaaggaacagggaagcaagccaggggtgtgcttcaattgtggtgatccaggacattatgctgataagtgtcctaagcctcggcgcgtgaagaacgctccagccccgaacaactccaatgctccagcaccgaaggcacgtgttaatcatgttgcagcagcagaagctcagaatgcaccagatgtggttttgggtacgtttcctgttaactctatacccgcatctgtgctttttgattccggtgctacacattcctttttgtctaaaagttttgcgagcaatcatgagatggaagttattagtcttgggagacctttactagttaataccccaggcaatcaagtatcttcgacacagtattgtccttccgctactatagaaatagaagaagttcctttcccatcctcacttatcttgctagaatccaaagatctagatgttatcttagggatggattggttatctcgtcacagaggagttatagattgtgccaaccgaaaggtgaccttaacctgtagcgatggggaaaccgtttctttctttgtgtcctctcctaaatctcatggtgtgaccttaaaccaagtcgctctacaagaaatcccagtagtacaagactactcagatgtgtttcccgaggatttgccaggtatgccacctaagagagacatagagttccggatagacttggtccctggaaccaaccctatccataagagaccttacagaatggcagctaatgagttagctgagataaagaggcaggtggatgatttgcttcagaaaggatatatcaggcccagtacttcgccgtggggagcaccagtcatctttgtggagaagaaagatcatactcagagagtgtgtgtggattatcgagcgttgaatgaggttactatcaagaataagtaccctctacccagaattgatgacttgtttgatcaactggaaggtgctacagttttctccaagatagatctccgttccggataccatcaacttcgaatccgtgaggaagatatatcaaagaccgcctttacaacccggtatggtttgttcgaatgtaccgttatgtcatttggactcactaatgcccggcctttttcatgaatctgatgaacaaggtgtttatggaatatctggataagtttgtcgtggtgtttattgatgacattcttatttactccaagacaaaagaagaacatgaagagcatcttcgtctagctttagagaaactacgtgagcatcagctctatgccaagttcagtaaatgtgaattttggttgtctgaagtgaagtttcttggtcatgtcatctcatccggaggagtggcagtagatccaagcaatgtggagtcagtgttaaattggaagcaacccaagacggtttcagaaattcgtagtttccttggacttgcggggtactaccgcaggtttattgagaacttctcaaagatcgccagaccaatgactcgtctgcttcagaaggatgtgaagtataagtggacagaagattgcgagcaaagtttccaagaactgaagaaaaggctagtgactgcgcctgtgttaattctgcctgattcaaggaaaggttttcatgtgtattgtgatgcatcccgactcggtttgggttgtgttttgatgcaagaaggaatggtggttgcctatgcatctaagcaattacgtcctcatgagaataactacccgacgcatgacctagagttggcagctgtagtgcatgcattgaagatttggcgtcattatcttttcggtaaccgtacagagatgtatacggatcataaaagtttgaagtacattttcactcaacctgatttgaacatgcgtcagtgaagatggttagagttgattaaagattatgatatggaaatccattatcacccgggtaaagcaaatgttgtagccgatgccctcagcaggaaaagctattgtaatatgtcagaaggtcgacatctaccttgggagttatgccaagaatttgaaaagctgaatttggggatagtcagcaaaggttttgtggctgctttagaagctcaacctaccttgtttgatcaagttagagaagctcaagggaatgatcctgacatccaagaaatcaaaaagaacatgagaagaggaaaagccatcggttatgtagaagatgagcaaggaactgtgtggttaggagaaagaatttgcgtacctgataacaaggagttgaaggataccatcgtgaaagaagctcatgaaactttgtattccattcaccctagaagcactaagatgtaccaagacctaaagcaacaattctggtgggctagtatgcgacgtgagatagcagaatatgtggctctatgtgatgtatgtcagcgagtcaaggctgaacatcagaagccagccggtctgttgcaaccattgaagattccagagtggaagtgggaagaaataggtatggattttataaccggtctacccagaacgtcggcaggacatgattctatttgggtagtggttgacagattgactaaagtcgctcatttcatacctgtcaaactgtcaaaacaacctacacggggaataaacttgcagagctatacatggccagagtggtatgtttgcatggagttcccaagaagatagtgtcagatagaggtagtcagtttacctcgaagttttggcagaagctacaagtagagatgggtacccgtttgaatttcagtaccgcttatcaccctcaaacagacggtcagacagaaagagtaaaccaaattttagaagacatgttgagaccatgtgttctagattttggtagaagttgggataagaatttgccg

SEQ ID NO: 76733 - DNA, 673 bp, Oryza sativa
aggacttgcctgcagcatagtcgatgttccagttccggacgacgctcagcgtcgtcttgatcgtagcatgggcctgcatcgatgccgtcgccgtacggccacactgacttgcccgaagatcaatggcgtcgttgtctggtcacagctcttcggccagccagtcgcctgcggatagtcatactgaaggcattggtaatggaagacgccggcgtagacatcagcagacgccgtgaccttcgaatagccgatgggtcgcgccgtcgtcgccttcgaatcgccgatcgcgataacctgcagatcgatctatcgattctgtttacaaccacccacgagattttaatacgagctattcaaaagggttctggttagtacggaataattcagattatgaggatttttttcgtaactagaaatcaaaacgggctcggtatatggatccgcttgctgatttgatcggtggtgttcgctgatggacggtggatggaaccgggagtacctactcctgggagtatagaatcattatatatatatatatatatattatatcctactaccgggagtagctactcctgcatcatctgctatacgtgctttcaagatttgtgcagctttctgctaattcgaatttgtcattagcgggttaattaaccccgttaaatatgccgatcgctat

SEQ ID NO: 76734 - DNA, 572 bp, Oryza sativa
gttgacgatccaaatagctagctagcctcctttttcccctttagcaaaagaaatatgcttttcatatgactaagattacataaagcctatagaacgggatcctattcagatgacggcatacttaatgacgagcccatcaccaccacatgtcatcctctcctcttcctcgacctcctctttctcctccgctcccttctacggcctttccctctcatgctcgtcattttcaccttcttcctagctatagagaatcgatatgttgacaggcataggcggcgacagagcgggtcgtcaacaatagatctagaggtctaggccccctcccccgttggattcggccgaggtgtacgtcagtgatgagggcagcagatgacaccaatcctgtggcctcctcttctgtctcatgtttgaggcatggcagcgcccaccaaatcaagttcccacatcgaaaaggccaaggagagaagaggttgtcgagaaggacaccaatcaacggggctcttcctcctaagcattgtcgatggtgatgaaggagaaggcaaacaaagctgctggatctggagccctatttg

SEQ ID NO: 76735 - DNA, 4884 bp, Oryza sativa
  unsure (1)..(4884): unsure at all n locations
ttcattccagaccttttgtatttctattttctttgttcgcacgtatttctctcttgctcaatgcatcggggaggacaactagagatcgtcaacacattttataaggacttggtcgctcgatacacatgcacatttagttcctcccggtaagttcgtcgtcgactcgtcgtcggatcgtcgcccggagccataatgcaaacgctcgacaagccgacgatggcgtcggagctgagggcgatggcatggacggtgctgctcgtcccggcgtgcgcgtggtacgcgcgctcggcctgccgccgcctacggccaggactgccccgcctcgccgcgctcgccccgacgttccccgtcttcgtctacctgccgtgcctgttcaactccctccacttccgcctcttcagcaccttcttccacacctggctcgccatcaacaagctcgtcctcctcgcgctcggcatcggcccgctacacccgtccctccccctcgtcccgttcgtcctctgcgccagcctccccatcaagctccgcctcagccagcagccgcccgccgtcaagcgttctccttcgtcgccgccgccaccgcccctcgctgacttcctccgtccctgcgcccggagctttttcttcctcagctgcctcttcgtggcgtacccgcacacgggctggctacccgtgtacgccgtccacttcctatactgcgtccaggtcttcctcacgctcgacctcgtcctctcctccgtcgcgctcgcctcggcgaccgtcctggacgccggcctggagaggcagttcagcacgccgctcgccgtcgcgtcgctgaacgacttctgggggcggcagtggaacctgatggcggtggacctcctccgggcgtcggcgtacgagcccgtgcgcgcgcggtggggccgcgacgccggcgtgctggcggcgttcctcatgtcgggcctgctccacgagctcctctacctgtacctgacgctgcggcggcccaggggggagatggtgctcttcttcatgctccacggcgtgtcccagatcgccgagcgctgggccagggcggccgggctgtggcggccgcccaaggtggcggcgtacctcctcgtcagcgccttcatggtcgtcaccatatcggagctcttcttcgggccgttcatgagggccggggccgacgtgcggctgatggaggaggccgcggcgatgctgcagttgatcatgggcgtctcgaggcgtctgctccgaccgtttggggtggtttcgagcctctaatcatctacgggccggtgttatgtactctgtgtacgtgccactgtgccatctgggcctatatatgttcgagtgttaatttgtggcgctggatgcagaatgacgaaagtttcgttctcagttgagtaccaccaagatgttgtcatgtaacataataagaactcattccctttgcatgataattctgcccatatgtcagtttgtattgtagagcacactattgcttgcaacatcagtacatttttattctttgttccaaaacttgaacatttctcttcattcgagagggattctaatctccctggttaacgttcactcgtttacatgttaactaaattgttatatttttttaaaaaaaatgacaatataaatcaatgtgtaatagatttaaatttgatatatgcaaatttaaatcgacttctacaagttataccanaaatacaattttannctgtaaatatacgtataatagtagcgtcaaatttgttatttctgttacgacttatataaaagccaattttaaagtcatgtattacatattaatttatctttattttctaaaagaatcttataaccatctgggcgatatataataaacgagtcaacattcatcccgatgcttaagaaaatgtttcccctctccatcggttcaagtgttcaatagaggagttgtgtcatagcagcggccgcaggctcctccaactccatctcaggttctcaacacatagttagaacatgggaaactattctgaactctagagtaaacatcccctcgttatctgcatattgcctaaatggttatgaaaaaaattaaaaaaataatcaagaagatatataaatatgtgataaattactccacaaatatgtaaggtcaaattcaaattctactagttgcaacgaaaaaaacaaatttcattgtgcaatatgtgataaatcactccacaaacatgtaaggtcaaattcaacttctacaagttgcaacgaaaaaaacaaatttcattgtgaatatacgttaaccagtcatagtttaatttgtttattttgttgcaacttgtagaagttgaattttaactaatatgtttgtgaagtgatctatgtattaatctatctagttgaatgttttacatttttttcataacaattcaggtgacatgcaaataacgagatgatgtcctttgagagtttaaaatccacccccgtcagaacattttgtttggaaaagcctggtcgatacatggcatggcccacgttccctttgcaacccgtcacctaattagaacatcttgtttgaaaaggaaaaaagttcacttatctaccttgttttagttgcagaattaaactaactaacacgtttaaactctaaatttagaacttacactagagctaagaaaaattcctgatcttcgtgtgttgggcagattttgagccaacaccgttgtccccctgcttgagctggcagtggtgaacccgctatgcgatgtagagcagcggcagcgcccaacatccagctccgttgctaccgatgagtgtgccgcccactagtaaaaccggatttaattcatatccctatccgtaaaatcaagtataatgactcctccaaccggtaaaccaatgaaaaagactcccaaggcaatatctagggaagtattcgctaacatgataactacgtggcatctcaatcactaaataaaataaaacataaacataattccacatatcaagcatcgtcctttcttcttctctcctatgttttagttccctcttttttcccaaccacgtcagcagtgcggcacacgctcacgatcaaggttattagtaccgggatctaagatagtatcgttttgctgaaaatagtatcttatcgtaggatcatatcgtagtatcgggatactatgggattttcttttttaaaagtttaattaatatttgtattaattgcatatagtcattctatatcaaaaaaaatatgctaataatatgtcatgcaaatagagacaacatttatcaagagaaaccaaaccatattagttttgatatatttaactgatttttatataaacttgtgcatatatatttactttattttcaaaccatcatattttaaataatattctgtaggatcataaggttggtagaatcgggttactacctaagattttgtagaatcgtgtggtatgaatagtaagatcaagatactattaaaattaggatactaggtgggatcagtatcgtttcaatttggtagtatcatactacgatacagatcaagatactgataaacttgctcacgacttcacgagcccacctgctacaccgccgccttctcctcctcctccggcatggccgcatgggtaggggcggtggtggcgccggctgcgacgacgatgtccgctctcgcggcagccccaccccttctcttctaggccatgtcctctctttcggtgtgctagcttgctcgcctccggtggagccatgtcgccgcatccaagggcgtcccggccaaatcgggtccccgtgcgaaatattaaaatgggccctagtagcctagtaaatttttatagtaaaattaaaaacgggcgtggcgattagccgatcatcagcgatgaagtagaagcggaggccggagggaactggggagaggagacgaagcggctgcggcatcggaacttcggcgatacgcgacgacgcggacacctggacgggagtacgatggaagatggatcgattcaccttctgcagcgttttgggccatgtgtttgctactatttgaactgcaaattaacaaaaataaagcctctaatattattatatatagggcatacttaatattttaggggcccttaaaatttgggggccctgttcggtcgcacggcccgcactggcccccgggacgcccctgccgcatctcggatcgggcacagcctcagccagcgggtccaggtggggagctttgagcctttgagtgtcctcccctttgttcgcattttcgtcaccacgcctgaaccacaaaaaagaatcgagttaatccataaaatcccaaacgtactagagtaggcaggtacaaatatttggcgagacaggtttgaatgttaacccagattaatcaagtactgaattaccaatatttgtctttcagtttcagatcaattcccttttgtagtcgtctgattctgaaactcgtaatagagtttttttttaatgaactcataatggaagccttgatggtttcagttactcgtggcttgcacagaagatcatttctgcaacggatggatgaatgaacaaacaattctgcctggcaagacgagtacctcgggtggaatccgatgatccgatccatgcgtgaccggcaaaaccaccggcaaaaccagtccgtgttctacagtactccggcgtcaccgcactatgtcctcccgccatccagagcacggaatcagaaaaaatggaggaaaaactaaccgggagacacgaggacacggaatcggctggcgcgtaagccgcgacatcctgcggagccgagttgggagaatggagagaatggagggagaaacatggagagtagagcatcctatcagatgcactgtcccattattcatcgagaaaagcgcacgcggagataaaatc

SEQ ID NO: 76736 - DNA, 9239 bp, Oryza sativa
tgcctgcaggtcgactctagaggatccccagatcaattcccttttgtagtcgtctgattctgaaactcgtaatagagtttttttttaatgaactcataatggaagccttgatggtttcagttactcgtggcttgcacagaagatcatttctgcaacggatggatgaatgaacaaacaattctgcctggcaagacgagtacctcgggtggaatccgatgatccgatccatgcgtgaccggcaaaaccaccggcaaaaccagtccgtgttctacagtactccggcgtcaccgcactatgtcctcccgccatccagagcacggaatcagaaaaaatggaggaaaaactaaccgggagacacgaggacacggaatcggctggcgcgtaagccgcgacatcctgcggagccgagttgggagaatggagagaagggagggagagacatggagagtagagcatcctagcagatgcactgtcccatcattcatcgagaaaagcgcacgcggagagaaaatcgcgctccagcaaatacgccatcattgcctccaaatttagcgcgtccgtcatccgggagagagaaacgttaaatttagagtttttctctcctcatgccatattacaaccacttgcgtccggaccgagctcccgcctctagccggatcagtggcgtgcagggtggagtagtgaaggtgaagactggaaaggtagaagcataccaaagaacgagatgtagatgatagagcgaggcctgagcccaccactagtgccgcccacaacttcatcgccccgctgttggtgccgaccacagcttcctcacccccgccgcttctccacccacgtcgccccggcattggctccgaccaccgcttccttgccccgttgcccagccgccggcaacgactgcttcctcgccccgctgacagttgcttcctcgcccccaccgtctgtcgtgctgcctcgaccgcacgtccgcaccttctctgccctatcacccgcgcggtgctgtcgcccgcgacttctcccctcgtgtctgctcccgcgctcacatccgctccgcccgtagcacctttggcccgtccctcctctgccgtcggccctttgccccttaccttcccctcatccttccccttttctctcatgacactctctcgttctctcctctcaataggtgcagataaagaaaagagagaagataaatatgtttgaacataaaaatgagattagagtattagttgtttcctagatttgatagatccgtaatacaataaatttggacttttcaggatgtttgtaaatatatacattataaagaaaacaatacaaatgtatggatagttgaaagatattactaaaacataggtggatatgatatagaggatgtaatatacatgatttgttagagtgaagaaaaatatagagtggaaatttttttggatgaccatccaaatagggatatagagaatcaaatttggatgagctgctagggatactcttagctggggatggtggtgttggtactcctccctttccgtagtaaggggaagggggagagaggtagtatggcggagaaaggaagaaggggagagaatgagatgatatgtggatttcattgaacataattaacattatgcatgattcaacatttcttttatcatagtcaacctgtcatgccagtcaataccaccatcaatattaccctagagtcattttgtaacagcttaagcagttgtgggagtcgttatacatgggtttttttttttttttacagttagggatataactcaaattcgacctgtactgagggagtcctaatggactttttccatttggtgaagcctacctctcgatctcggatttcccgggccggcctgcccagccgcgacgctccccacggtccaaacccagtagtccccacccaccgaccatccgatgggcgacgttccatggacctcacacgttctccataaattcaaaccggctggttgcgatcgcaggtcaggaatcgatcagaagttcagggcacccgtaacgtcgtgcacctacgcagtaggacaagagtgttgactcttgatgagcgcgcagtgatacagttcacacatacgagttcgctagacgtgctctgtgtagtgtgtgtagtgtgtagtcgcctcacaccgtcacacggtcacatgtctagtgtactggaagctgtcccctgttcagctggcccaccctaacatctagtggcatgcatgtgtgacatgatactgcaaaaatatgctcctcacgtgaagctagctaggtcctgtttctttttttcctaatgcacaaattgattgcacgtcaatatattaaaagaagtagagtttaattatacaccgcaatcagctaaagggacattatcgggataaggagtaaaggaaactgaaaaaaggagaaggaaaaaactgagctaaaactgggtgcgagggaggagagagacggagccccactacacttccaatagatccacaaaagacgcaatgccatcagaccatcggtggccttcatgtaaaatggactccagaaccaccaaaacctacgagagagagtaatcgaacaccctgaagttttgctccttccatagctaccgggagacgaggagaactaaggaatcgaagcccttctaacaatgcttatgcatgcaagccctagaagggtgtgtttggatgcctcttttcctaacccctctccctcgattttcgcgcccacgcttttcaaactgctaaacggtgtgttttttgcgaaaaaattctatacgaaagttgcttaaaaaatcaaattaatccattttttttaaaaaaatagctaatacttaattaatcacacgccaatggatcgttccattttccgtgcaggagggattagttcccatccgtgaaacctgaacacagcctaagtcggccaccaaacttgaagagaggaaccacgagccggagtaaggtcatgccagctaggtgcagacagaattcggtgccagacctgatgagcgaacacacagtcaaggaggatgtgattcgccattttgagttcttggacacaaaacggacaaggcgagtggttgtcaataccacgcttctccaggagatcgcctatccaacaacactgctggaacgcaagccagatgaaaaggttgtgtttagtagggcctttagcccacccaagcagatcggcacgcaaataaaggattgctacccaagaaagcaagcttggtaggccgagtgagccgagtaacgctggttgcttatccaacgccagacaggacggtcctccgtgcccggagagaactagacaagaagcatcgcatcccagaccatcaggtgttgggagaggacatacattgtgagagcgccgcggatgtcccttacccaagaattattgataagggtagaagcaactgaacgcaagggcacggtgaagtgaaggtcccgcactaaggaggccaccgagcgaccctcaatctacttatatgtccaaaagagagtcgacgcgccatcacctggcacgaagaaggtggacgccataaacatgtcggacgtgccgtcaactaggtcatgtttgtaacagattatttacttgatatgcactacaaattaaaatcttaaaaaaggtagattttacaaaactatatatttaaaatgtagtatcacaaaactacatatttactacagatttaaaatggcgtgtaaaataataatattaaggagcaaattttataaaaaaaaaatacaggtttagtgccaatttatcacaacactataatgtttgtagctccaacaaaatggtagtgataaggatttaaactatagaatctaatgttttgtgatgacttcaatattaaatatctagttttgtgatacttgatattaaatatgtattttatgataaatttactgttaaatatgtattttttatacaacaccttaaacctataattttacgtacaatagtttggttagattatgtgtagttttgtgagaaattttatttaaaaatgaaattgttatataccatataataagtggtataaaaatgcagtaaaaatatttttttaggaatgttgtattttgtagatcttaaatgttcaagtatgttaaattatactccatgctttagtgagctatatatataatctttctagttttcattggacgatgccattgactttgactatactccgtatatcttatcaagaaaattatgtaattaccatttgttttgatgttatttgttttattattaaacgtgtataattttagcatgagttatatttttcatatgtatgttcaaaagacaatgacgtgatacattaaaaacctagaggtagtattttaccctgttttcgttaaaaaaaaagccatgtaagtattactttttaattgtgacttgttgtatcatttaagatattttttaaaataatagatagaaattcggactatctatcacagccaaacgttaaaagaaaaaaagactaaacttcaaactcttgctaaccttacgcgcgcagcaacatccatcgtcatttaagatactttacatgtctaacgtaaaaggactcaatgacaaatccataagccttacgaaattcctaatgaaagcgtgctcacgagtgtaattttgacttgtgaccgtgagaattcaaatttagtaaatatatttatgcatataggaataggagtacactatcaccaccggtccaccacgagcaacactatagcaatacttgcggtgcatgctagtgagtagtgacgaagaatttactgtgtgacgtcaacaagcttacatgtggcaatacatgcaaaaaaaaacatgacatcctttgcctgcaaaattcatccgcatattccgaggaaggcccgtggctctcactttgagacatgtaattctctgtacgctcaaaatttattgcaacgattcgtcaggttcttcccttaaaattaagcgcattaatcattcgtttgttttgcttgcatggagttttggattaacactcttcttccatggtcttttctagataaggctctctaatgtagtgatatactacttcttaataactattgcttatttttagatatataatcattgatcttaattattgagtgtcagtagtacatattcctttcttgattctgtcccgtcgccccacaagtttatatctttcctccatctcttggttcaaaggccggtctttccctgcacgttcaggcagtgtgggatccatagtaacttgtacccatccatcccgtgaggccgtgatccaggctcttgtttctcctttctttcagttgcatgtacacaaagttgcacaaatgtgttgctttctgctggtctctgtactgctagccaccactctcaccgacgtagccagtgcacagagatggaggcagaccagcggcggcggcaaggacaggtgggacggcctcctcgacccactcgacgccgacctccggcgcgacatcatccgctacggcgagctggcgcaggcgacgtcggacgcgctcatcggcgacccggcgtcgccgttcgccggcgcgtcgcggtacgcgcccgacgcgttcctccgcaaggtgcgggcgttcgacccggacgcgtaccgcgtcacgaggttcgtctacgcgacgtcgagcgtccgcctccccgacgcgttcatgccgaggcccgcgccgtctgcgggcgcggcgtgaagcggggagtccaactggatggggtacgtggccgtggccgccgacggcgtcgccgcgaaggccgggaggcgggacatcgtggtggcgtggcgcgggacaaagcgcgcggtggagtgggccaacgacctggacatcacgctggtgccggcggacggcgtcgtcggtccgggcccgggctggacgcacccgtcggtgcacagggggttcctgtccgtctacacgtccaagagtttctcgtcgccgttcaacaaacttagcgcgcgagagcaggtataattagttgcgactccctcgcatttacgcccttaattaatctagacttggccaatacagtatatcattttcttaaaaaataattaataaaacagtatagtactatactgtttcattatttttttatagaaaaaatgtgatactgttttggccgtgctactttacgctcgccactgtggcccaatcattcacatatttgcacaaggattatagttcacggtttggactttcgtttcctccaacataaggtgtctccagtacagacagagctattaaaagaaggcatagaaaattgaagagtgcaagagacagtttcacactcattctggggaactgacgaataatttcgttcacacattagtctggaggaactaaccaataatttgacatctcatctgaactgcacatgttgttcttgatagggaatgctgtttttctctagagtaggaccgccctcggatattgtttggagcatctaataacctccatagaaaacaaagtagcaaaatttcggtaactttaacctgtacaatatggaatgaactataatggtcattgccatgggattctccataaggttttcaaatcaaagtgtactactacctccgtcccaaaataagtgcagccataagtttccgcgctcaactttaatcgtccgtcttatttaaaatttttttataattagcatttttgttgctatgagatgataaaacatgaatagtactttactcgtgacttatgtttttaattttttttaaaaaaatttcaaataagacgaacggtcaaagttggacgcggaaaaccatggctgaacttattttgggacggaggaagtaataataaaaaatccagatagaacatgtgtccaagacataattgtgcgttgaatcttttaaaaagagaagttgagggacatggtaacttccagattttttacgtcttgtcttgctccagagaatctgttgcgtttgaacatacgaagacagtggacttgtacatattttccagattttctgtacataaattgctttttttttcaaaatgcatttgtagcaattcgatgaggctcatgtagtcatgcatacaaatgcaatttcagaatatcctttgcatttattatttaagatctttcagttagagaaaataaactggttgagggggtaaaaggctcatttgttcatggaaatatcttgtacatctatcaacaatttttctctcaaaaattatcaaatgtaaatacattataattataatataattacatttagtttatatgaaagtataatataacttgtatgtaactttcaaaaagatccaggggaggtctcagaggagcaaatctaatgatacaaaattatgtgaaacttacatataaattatactgtagttaaaatgtaatcacagtatatttatatttaataatttttggaggaaaaatgtcgatagttcgatatatgtgtagcaaaatcgctcagtcggaggtgggatgtgatcatgtggagtccaacatcccttacttacgacagcccaaaacatagctatatatgtacacttccaagtccaaatcaagcagaaaagcccttttttttttctttttttgcggggacgaaaagcccaaattaaccttctagcaatttcattttttttaggaagaggtactcttcgatcgaaagagacggaatatatttagagctagtacgattgcttcaaattctgattggaacaacaaattcgatgctattttctgaaaaaaaattgcaacaaaatttatgcaggtgctagctgaaataactagacttctgcgcgcgtacaagaacgagaactgcagcatcaccataacgggccacagcctgggcgccgcgctctccacgctcaacgccatcgacatcgtcgccaacggctacaacgtccgcggctcgtcccgcgtcccggtccccgtcacggcaatcgccctcgccagcccgcgcgtcggcgacgatcagttcaagagggccttcgactcgacgtccaacctgagcctgctccgcgtccgcaacgcgccggacatcgtgccgaccatcctgccgtcggccttcttaaagaacgtcggcgcggagctgctcgtggacaggcgccggtcgccgtacctgaagaaccccgcgggcccggcccagtggcacaacctcgagtgctacctgcacgccgtcgcgggcacgcagggcgccggcaacggcgcggggttcagccttgtggtggaccgtgacctggcgctggtgaacaagaaagtggacgcgctcaaggacgagtaccaggtgccggcggcgtggtgggtggagaagaacaagggcatggtgcagaacgcgagcgggcgctgggtcttgcaagatcacgaggagggcaaccttgcaatgtgatggatttggggaattttgtggaatccaataaactgatgggtttattgcttggatggaagttttccaagaaaaacatgaatagtaagggccgtggaaatgcagatataaattatgtatgtacgtctgaaaattctgagttgtaactgaaaattcttacggcccctttgaaacgtatgattatcaaaacacgggaatagaaaaaacgtaaaaatagtatgacacatttattggattcctacgggattgaacacgcataaaagcttcaacactattgtttgatagttacatggaaaaaacataggaaattaagacacgggaagaagaaaacatgaggtatgaccccatgctatttttctctagaattcctctacaatagtccattccttagaaattttagagaaattggtagaaatcaatactttattttaaaggattattcccatagggtataaatcctttagaattcatgtttttcctttgttttaaaagggacccaactccccggaagagggggatgggagtttggtagtggtggtggtggtggtggtgtgtgtgtgaatatgtgagaagaggggaatatgttttaatcctggcgtgcgctttgctaacaagtactccattttatattataagtcgtttgacttttttcttagtcaaaattctttaagctcgactaagtttatagagaaatatattaatatttttaatacaaaataaaaatattttcataatatattcaatctaaatttaatgaaactaatttagtgttataaatgttgctaattttttctataaacttaatcaaacctaaagaattttaactaagaaaaagttatttgacttataatataaaacggatggagtaacagttttg

SEQ ID NO: 76737 - DNA, 2246 bp, Oryza sativa
gttgtcatacgctgtctcgtgttgtccattctcgtggagtagaaaattgtagtagtggacaattttcaaacttcaatgtccaaagaaagaacatagttgagctgtcaattcttatttacctgtagaatctgatggatcataaacagaaaaagtatccttacactgctgaaatgcttgataagagttactaaaaaaacaagagcaaggcgacagtgctactgcctttttccagaacaaaattatcagtacatctgatatctcttagttatataatatctggacagaattattaaattcttctctaatatattttactaattaactatgttgtcatgagtcatgagtaatatctcgtgacaaacaaatgaacaattgtgcatagcaatactgctagtaatcagaaccctagacgttgtgcaattggcttgggtgacttgggaccatgtagttttgctaatgatgcagctatgctgttagtctttttgtatacgaaatatttatgctctgtatgcatggttatcattagggcctgttcactttgatgccattttcaaccttaccaaattttggtaaagttaccaaaaaaagtggctacatttagtttcctgccaaattttagtaactatataagaaattctgccaaaattttggtaaggtttttttggcatcaaagtgaacaggcccttagtgaaagtatctatgcatatgcataatgcaagtattgtttgttaggaatgtacatgctctccaaaattccgtggttttgttcgttgaatcatataccttagagatgatgtcctaattcgtatgcaagtgtttacatttttatcgcatatttacagatcatatgtatatctgctagctgtgatattgttagtctccatggtgtgtttcctagttggcctcgtaacatcagaatccccccagtattatctacctgatttagtggcctctctgatcgacagaacttaatgtaagcagcggctaactgataaaatatttgcacaggacatatgtggaactaagtacgcgattcatggcatgtttaatttttctaggaactaccattgctttcatctactccaatgcattgttcttgcaaagggaatatagccttttttagctcacgaacatgtgagcacacagccacacaacacggaggatgcagatgtttagggaggagaaaaaggctacagattctttcgtaatccaccctgtcctttgttcttttcctgccattcggaatttagtggtgacccaatgacaaagacctttccagtgtttccaattccaaggctgcaagtattaccgtgaatctttctgtcacaccataaaaatattacaccccttttttgggtcctgtagtttatcctttaacctaaagatcttgattttctacaggtggagcctatgatgattaaccatctggaattaatgcataccacataccagtctttcaatggtgaaattgagcaagggatctgctgcaaacttttgtggccatgtggggttttacctgaaatttcaggtattcctcaagcttttacctcttgcagacttcaactggtaatttaagttcactagtctccttccagtctcgtataatggtggtacaatttacatctggttcagtagaaagtagtaaatagaaacaaattatcaaaacaagcagtaattccacctattgagctgcagtagagtgtgattgtcagcttgaagcccatgcactatctctatcatggaatggatcaatgccatgtgttattcctgagagcaacccttgtgatatgcactcccgagagtggcttcagatagcttccatgtttggcaacttttcctatggaggaagcaaattaattgccacggaatggtgtgtaacgaaaagaaatgaagttatcgaattcaatcaatagtttccacagttgtgaaagagggattaacctgtgagttagtcacagctgacaaacttctatgacaactgacaggaggaaattggggacgcagctaacttgaagtaaaggtgtttggatagctagagtgataaccaaaaaagtgggcaagttcacacgctctaacagcaggaccataggatattccatatgctgctgctgctgtattattgatgagccaccagcattctgtagctgttttcttgctctcttaatttgcaacagaaatcactattatgatctgaggattgccctgcagttcagtacaatcatggcatcgtactgtacacacttttg

SEQ ID NO: 76738 - DNA, 1020 bp, Oryza sativa
agtatggcttccatggtagaaaagaggataaaaggcagtaagtgtattgttacctcccctgggggttgctgctgtgcgctgcagctgagcatggtggtgagggacagcatcctttcttcctctcacctgccatattttcatctcctaacgttagctccttcccacattcttctgtgtcccggtggctctgattataacctgaggtaacagaagagaagatatagaaaaaaaagaacagctgctcaaattaaggaactagagtaagctgctcgttttcccttgtcctaccttctagtgtggccccaacaatcgcaaaaaatcctctctttgccccagttgtgccgatgctggtggtaggctttgaatgtgtagggaagcaaccgatggatggttctgaggaactctctcgttgttgctgctgtatcttctctcttgaatcagctgctctctcttcctgttggacaccagggaggccgagcttaagctctagctccttatcctcatcggcatctaagtttgtgttccttgatccttctccatctgcttctttcaccttccattctctcccgtcagggatgaggtgtagcagcgtgggagggaggcctttgtccttgaattcttcttccataggacttgatctgctataggaaatatgaattctctaagaaaaaggaacaagaggaaaatctttgtgttaaaatgaatagatggtggtatgtggagctgaggaaggactacagtgccaatgttaagggcttcaacactcaaaaactctaccataaatgatatactacatatgaagttgggaaacgatgggaagaatgcaagtatgcagctacttgaagagttcagttttgcactcaacttaggccggagaaagtgtcaaaacaaacgtgtaacatattctaaggtcaaagtgaaagctggaaagagaaaccgggaagagataggacttgtgatcatcaaatcaattcatgtcacaacctcaaagacgttttcgagcaagggaaatggagcctg

SEQ ID NO: 76739 - DNA, 9432 bp, Oryza sativa
tgtttatgactgcaactttcgcagtcatacaaccattgttggatcaaatatcaagggctcaaatcacacaaaagtactgttcatcagatactgtagcagatgaatcctgtagcgcgtactgtagcaagtgataacaaacagtactggtactaaatcatggccgttgaaatcttcgatccgatggtattgaagacctaagactgctaattttgcagtccatgttcaaactgcgtgggatcccaatccgatctagcgacgcctacggggttatggcttatccaggcaagtggggggattggtgatgtgatggatgcggggtttgttagtattggtttattatatcatcgtgtagttgttgtcggatggtggtggtgtcatggtgacacatgctgcaatgcttcttgttctttcttactacactgcccttctgggaccactgtcggcgttgggagaatgcgttttctcttgatttgattttctgatcgctgtccactttgcatgtgctgattgctgaaactatgattttgatccatgctgatgaagaacacgtacctccggagctacggtgttacttactcttatatagcaacctaatactagattgaacagattttaatcgtacgaatttaatcaagtactaagttgttatataatttttgaaacaaagggagggagtaatttaatttcgttcataaagagagcatgggttcccatccttcacaactgctgcaacttgtaggaacgttcgcaacttcgcatgaaggtatagtgcacgcctacgtgttgccgctgcaggacgatgtatgctcctttcccttgcttgcccatgacgagaactcaacagaggccagaaaacagctagtgcaccggaaacacagatgcatggttgcgagtagtgcaccggacgcacgcacgcgccatgacatggagtatattactgtagcacactacgggatagtggactttgtggcagctagcctcgccctggcgcgcgacgcgaccacgcgagagaggcagagataaggagtggacttttgcgcgcgtgcggcgcgtccgccactgcgtctcgtggtcgccgatcacgcgcgcgccggtgtaagatcgagagatcagatggacggtgtggtacggtactccgtatccagtggtggtcctggtctacagcgctggcgcgctctttcctcgctcgtgcacgcaacgcacgcgcgagcaccaccgcggctagctgcgcacatcgacgaggaatcagtgcgttcggtaggcggtagcccctgtagacggtagtgtggctccgcaccgcagcgacgactcgcggcgccgaggtgcgctttggcgcagacggccgaccggcccatgcgggcaccgaatggcgctatcgaatatcgatcttggagacttggacatgcaggctaagactgtgccggcagtgtcctgtgtcccggtctttcttttctgcgattttggacatctacagttctacactttcatggacacggctctgttgatttgcaactgcagggttccgaggtacaccgaccgtgttttccaactcgacctgttcgtttttgccaggaaggcccatgaggagcctgaaggccaaatcataccaggtgccagtagcccaccacataataacgacatccagtttcaacagcgtccattaagcaagaaaccaagtacaatgcttcactctattcttagaaccagtgtaaatatactctcaaaaccaggcagtattgagaatagttttgggtgatgtgacatctaagtgggccaggtggcacttacaatcaacaaaaagaaatgaaatacagtgggacccacgtgtcagacgcaacaaaatccctacccctctcttccctatctccctctccttctctctctttagctcttctcctgtaggccggcgcaccatgaaggtgatactggtggcagtcccaaaggtggtatcacgaccaacagggagagggccaccatccctgccgatttcggttctccctcaccttcgctgaccccgcgcgcctccctcatcgttgtgcaccgtgctcatccacggggttgtcctggtcgttccctagcggcgtaggcgcaatgctcgcctcgtcgatatggcaagaatctgtggtgccctctacgaccctaccaacaccgagggggaggctgactacaccgtagctccgtccgtctccaccgtaccctacattctaccagcccccaccatccagttgtgttttggcactgccattagttgcgacgccccacgtcgcgtaccaccattggccacaacgtcaacgtgcctatctgtgcccccacgtcgtgtcgtggtgtccaccgcatgccaagttgtgagaggtcaacccggccattgaatctagctgtccccttcgactcctaattagaagattggggtagggttttttttgtgtgaatttgacatgtgggtcctaccatgtttcatcacctaaaagagttttggaactatatatttacaccggttttaacaattgagtatgtgttgtacttggtttttcgatgggctttagtttggggtctatctataatacattcgatagtttttggaggaaaaaaacttgtactaaactatagtataattaaagtgtaactaaaatatgtaaatttattttgaaatcaaaacttgcactattactccagtgagtaggagggtgcgggttcgagtccacaaccaattcaacagcctaaaatcaaaagtttttccctaaaaaaatattgcaagttacctggcaatttctttggtttgtactgccgtgtcggcgaacaagtaagacgtgatcattaccgtgcagcaaacgcatgcgcttttcccttttttttttcatggcacagtttttttttcctgctaagtgtgtatacatcaagagtttgtatttctaagagtaaatttcacaaaatcacaaattctttattcaaaatatcacaaaactacatatttaaaacggtgtatcacaaaaccatagatttaacaacaaattcgccatgaaactacatgtttaagataaagtactataaaattatagatctagtaataacaaaattatcacaaaactatgagtctagcaccaatttaatcgcaaaagtacaacatttacatcttcaatataacattagttctaagagtttaaactctaaaatatgcaattttgtgataacatcaatattaaatatgtagttttatgatacttggtattaatttgtaattttgggataatgcctttaaatctctagttttgcgatagttttgttaaagtatatagttttataaaatttactctttctaattcctgttcggatttcaattcaaattcagatttacatgttttatatctatattataaggtttagcttataaagtttttttatataaactttctatgacaacttatcatgatgggccagacgcacgtggggtcggccgaaacatattcgtgttcctggccgcgcccgaacattcacacattagatctaccgtcttttttttttttgaaaactaaacatccattaatataaaccgacagagttcacgggaataaatcccagtacattgccaaatagataaagagagagcgtaaaaccatccgtttctaaagaatggaaacctgcactaaggctacaaacttcataatgaaaccacacagcagataaggtgcacatcgatagggagctgcggcaatgccgcgacgaatgcaaccttgggcctccttcggcgtgcagcccgcttgacaaaccggtaatccccatccggttgactccacaaagactgcacaaaacggaggtctgctgctgagccatagattttggagtaagcaacaccggactcagcaagaggtgtccacggagttcgtcgttaaatctgaggagcgtgagctcaacccaaacaacaaaccctgcatggaacaagctgataggaaacatataggaagaaggagcccaaatccagatctccaaacccactgaaaaactcgaatggtggcaaacgaactgctgtcttcttggatcgacgtatggggatggggaagagtaatcctacgaatcttgactgatggaacctaagcattgggagctctcgaactggcaccagtgaaatcgtcgccaccacgccgacgggttgtcatcaagcaccacgagcagcaagctctgggcgacgatagcaccggacgacgcaagccacgagaagtcaccgcagccatcacacgagatggggcgatgacctcccagccactgacgacgaagcagccgacgctgtggccatagatgacgaagcagccaacaccgtggccactgacgacgaaacagccgacgccgtggccactgacgacgaagtagtcgacgccgaggccgcaggcgacgaagaagccgacgccgcggccacaggcgatgaagccgacgccgccgcaagaagccagctccaaccgtcaattcatccacaggtctacggatctcacacctccaccgccaccaaccgccgccgccgcctaccacaccggcgcccatggagctcgctagccaaaagtaccaaatagggacaaaccctaactacaggagagacctaacaacctaaaaacaaacctagaaacacaatactagtagggggaggtggccggacccctcctccaaccttcgccgatggcgagccgccggaatcgaaggggaagaggggccggagaggaagaaatttgggggaagaactgtagagagaggatgggaacgagagaagggtcgcgaagcgccgtggtagcagtctagatctaccgtcataattatccgttcgagcttcgttatctctaaatccagtgtgccatttttctattttaacttattccttcgctgcgatcaaacacataggagggatgggacttgatcaaactcgacaattttgtacgaccgatgaaggtagcatggctcaattgttggctacatcccacggccacacatgtcatatggccctataattgagagagaaccttcatgtccagtagttggccactatttgtccaaggacccaggatagaccaaaagtggctgcctaactgttgggcttttatggccaggcgtatttaatcggttgaatcggtttgtcatgaatatcctagcggaccatgggaaatctccaggtttaataatgattttgaatgttgatgctcagctcatcagtttgtgagttgtgacattgatcccgagtttgatggttaacctgctgaaagcgtgttcttgcttaggctcaatctggaggcacttgacacacggccatggaccgaccttcgcctaaccatgcgcacatctcgcgtaaggcaagtgcgcactgagctcgtctttgtttagtcatggaaaccgcatgccttaatttgttaggagctggggtaatttttttccctgactagcgcgggatggcggtgcgttgcaatgcgaatggaaaagagaaccccatcacacatttaaagcctcaaaagttttagaaaaaattaaggtcacatttatcatcattttgtacctcacttcaatattttttttaagggatataaagtctaccaaacctgtcgatagcaccactatataggtacatgaatgtacatctaaggctgtaacactggtggagaaaccatctttacttccggttgggaaccccgtttagtcccgatttttcaaccgggagtaatgattcgggactaaagatacatctttaatcctggttagtaccaccaaccgggactaaagagaggggatctttagtccaaccgggactaaagagacaatagcgacagtaccagatggtccctttttctatttctttttttctttttattttctcccgaatcaagtaggcaaatccccaaatcaaagtaacatcccaaattcacatcaccaaatccacatcacaaatcataaagttacttatacacacaaatcaaatacatcacaatatcctaagaaattgctcaaatacatcacagatccaaacaatgaatcatgaatttttaacttctcagtcaaatacatctaagtgaatcatcacattttttttttaaaaaaaagaatgccgccgctagccacgaccgccgggcgcggcccagccgcccgccgccgcgcgcggcgccgtcgccaggccgccgggcgcggccccgccggccttcgccccgcctgtagaatcgagatgtcgactagaggggggtgaataggcgatttaaaactaaatgacacctaatcaaaactaacttaagttgctaggcttggtgagggtcaactctaactaagcaactaagttatgttttgcaaacctagggtgatagtggctcaattatatctttagggaagtaagtcacactcctatgtcaatgtttagcaatcctagggtgatatgatctcaagtatgtctctaaaaatgtaaattgcacaaatgtaaatgcgacaatcaaatgagacaaggagacaagagatttttcaccaaggttcggaaattcgccggtttcctactccccgttgaggcgagcccaactccaccgctcaaccacgaagccaccgcacgcccccttcgtcaaggggtgggcaaggcgggagccggcccacggagaggactacccaagcctcgatcactagggtagttcttccttcactccgaaggtggtgaactccaaaccactcgcaaaccggcgccgggcctcctccataatcttctcggagaggtcaccgggcaactcctccacaagccgtctaggaggcggcaacctccaagagtaacaagcaatgacccggcgtgaagatgatcaatcaagtgccacactagctctacaaatggaagcaatgcacttgactcttggctaatcaaccctctaacacactagatggatgaacacaaagctcaagtgggtgtgagagaggtacaaggggtgtatgcaattgaattgggtgccaagagagcccccttgcagctagagggggagtatttatactcccaccaaccaaaactagccattgggggcgaaatcccccaactttgtgctctgccggtctgatcggaggtatgtgggtggtcagaccgtgctactctgcaacggctagaaaactagccgttgtagtgttgtcagagggccccatcggcctggccggtcagaccaaaattgattggccagtcagaccagcctcggctcggtcagaccggcctcggctcggtctgaccgaatacggctccgtcggctctgtatcgaccatcccgagcagcaccatcccggcctccagggggccggtctgatggcgcatgtgccgccggtcagactgctgttgtgaggccggtctgaccgcccctggtcaggctgagcccagtgaaagtaaaggtgattgtgtgtgtgtgatgaaaatgtgagcacaagtgaaaatgcaatgacctaatgtggcaatttaatcatttctttgctaggtcataccccccttgatagtacggcgaaactaacaaagaaactcgcaaatttgatcgcccttcacctcgatcaattttaaaattaaaacactagttttaccgttttcttttcttcgcttcgcgccatcaaattttaatccatcgatagtcatccatgcgcacacatgacgtggacctaacttaaaatatatctcaatagcaatggttagtccataattatcgcttgtcattaattaccaaaattaacaacgggggcctagatgcttcaatctccccctttttggtaattgatgacaaacaccacaaatatatataatcaaacatagaacacatggatatatactgcaaaggaaatcaaaagcttcccctaaacatgtgcataacaatcacaaatagcaaatatggagccaatgcacatttcaatttcacaattcaacatatcacaaacacaagagcaatatctcaatgtgaagttcaagaaatattcatccatgagtataagatggtcacatatatatcaatatcacatacaccatccatcatcgcacaagttcacatcacaaaagtcataaatcatcctaaaagggctcacaaataaacataggctattacaagaccacgagtggtccaaatgacataaagtttataacaaaacgacaaataatacacaatatagagtaatagcacatacccatacaaaatatagcccaaaccaccttaatctattagatatgagggcactatcctcactactactagtcccaatccacaaaaggtaaagcacacttttctcccccttttggcattaagcaccaaaaaggtcttcactcttgtggaggagaaggaggacgcgccgaagtggaaggatgaggagcatcacgacgacgatgatacacaaatgcttgggagctctccaacatttggactcgagaatccaatgtacctactctagtgtgcaatctccccatggaagcattcaagtctccaacatccgtgcgcaagccacgaacatcctcatgcaaagcttcatacccggtagacaagcgttgaatgctttcacttagggtattaatagccccaagtaccgggttgaagtactcgttgggttgcattctaaaataagcatactgtggatggaagaaagtatttggatcatacccaggaggaggaggaggtgctgagcttgagctagctccaggatgagaggagggcgccgccctaggagcatggagagctccaagctgaaggcggggcttgtactgcttgtgcttcttcaaattttgcccaacagccccaagcttgtcttgaatcaacctcgtgatgtaaggggcataatagattccctgagtgaaggtccccttggagatggcaatctcttgcatcatgagagacacaatgtcgaactgacggccctgaatgattgcatcgttgacgtgccaagccaccccctaatgtcatcattgttgccaaggtgagggaggatggtagctctcacaatcctgttaaccacactggggatagtcctcaagccggcaaccttcccatgtgtgtaccgcactccatcttcataaaactgagagagatagtctaaggagagcggattgtgggtgtgctcctcatacaagtcatctccaaagtccaagcgaatattgaggagccgccggaattgcctcctagagatagaacactggagggtatcggacatccacttcatctcactatagtctccagccacccacactgtagcataaaactgccggatcaaatcttcattgtagtcttgcttgagggtcacaatccagtcaatgccaacagtcttgaagagatcctgcaatccctcaagctctgtagtctcattgatgtctctccaagagatccacttatgctctgcaaatgctttccctgcataaacctactcatacacagactactggaaagcggtgtgaaaacggggatccggggtgtcccgaggcctcaaaaactaa

SEQ ID NO: 76740 - DNA, 5222 bp, Oryza sativa
cattattaaaaaatttaagtaattattaatatttctctatcatttaatttattgttaaatatacttttatgtatacatatagttttacatatttcacaaaagtttttgaataagataaacggtcaaacatatactaaaaattcaatggtgtcaaatatttagaaagggagggagtatatatatttgcatccacatgcatgcatatacactgaaccatatggtgaatattatatagtgtcactacgatggccggcacaccacgtggaacaattgcctaattgtcactagttaatatgcaattacgtaccactccatcaataaagacaagaagctagcgctagctacagctaggattaattagcaggcaaactaagcatctgaatcgatcacccagcaaataaaagaccagctgatatatgagtatgaccgatcgatcgatcgcgacaaacaagaaatacagtcgtcctagctcgcgccttacgtagtacgtactgcatcgatcagctggatctatgcataattattttattatatgagtatagtatgtatgcattgtcgactccaaacctcactttaatctgtaatcatgtcgagttaacattactacatgtgatgggaagaaagttaaaacaaattaaggaactcttgttgcagcgattaatttcttttttctgaacgcacaaaagaattgcacgtcaatatattagaaaaaaaagtttttgttacacaacacaatcagacaaaccggcttatgccaagaggaggaagaaaacaaagacaaaaaccaaggaagaaaaagaaaaactcatacgacgggtaacgctactccaatcagcgggagggggcaaagccacgctacactcccaacaaatccccaaaggaagcaacacccgctaacgaccacagctggccttccgaaagaatggactctaaaaccactgagaacgaagagagcagagtcaaaaaccctagagttccgttccttccacagttgccaagagactagaaggatcagggagtcgaagccggcacggaggcgttcaagtaaacagaccctagaagatggccaccagttctggagccagttgccatggggggagagggcagcctagccaggaggggacaacacctgtaaccagacctgccgagcgaacacgcagtcgagaaggatgtggttcgtcgtctcaagctcctgagcacaaaaaggataagtcaagtggccatcgatgccacgcttctggactagatcatccacttgaaattgctcatcgtagaatgatgccaagattggtgatccaacgtacgattgctatgccaggatgacctgctagagtcttgcacgtacgtatgcatttatgtgaatttctagtaagatactctactctactctactctaccagagtgagtatcatagaaagtacttaattactagctaagtgtgaaaatagaagaaagcttagctagcgaatcatgggtatgcattgcatggtgggccgatggatggacggatcgaacaaggaaggaggaaggttccgacgacgaggggatcattgatgggcccactctcggcctgtacccacaaacaaaccgacaccaatgggctgggcccactctcctccccgaccactttgggccccacacctcctcattaattcctcctcttctatctactgtattatctctgcctgcctgccacttgttttttttcccctcaattctttttgtcgaacattttccccataaataaagagtaaaaataaaaaaactaatacaaactcttagtgtcgtactggattgctcatatgcaccgtaagtatgaaatggaccagcccgtcacccgtaaatttctatctcctgttgttgatgtctactcttcccatcttaaaaacgaaaatcaaacttgaatctatacattttttttgggcgaaacttgaatctagataaatggtcgtccacattcatcatagtcaggatatgagggtgtgtttggataataggaaatgaggggtaggattaggatcggaaaataaatgaatgattaggattaaatgtaagagagagagaatggatggttaagatttaaacatatcttttggtgggtgagaaatcatttccttattccattagccaaacatggctgattgttttgggatatatagtgtatgtatttttctctatttctagcccataacataatataaagagcattctgcaaagcaaaatggaccggctaatgcaagcagcccatcaacacaagagataccaaattaggcgaggagcccatcaagctgcttcaagacttcagctgagtcttcttcacccttttttcgccgggagtcttcttcacccttcacaagactactgaagttctccacctatcagaacgcatctcctaaagtttaattttttataactatacatttctttgtgcctcgtgattgacagtaaaagataactccgcctctatcatatactgcttttcaataactgtcaaaaattaaaggatgggagtgagtgtgatgtgcgttgagacttgagagtatatatgctcagtaaaatgaagtctcagtctctcagatctttcttaccatttttgcatggcaaaggttggttgcattgcaggcttccttactctctaagtagagggcagagcaacgctgaaactatccaatcatcaatgaaggcagcttgttaaaaggaaagctctctctctccttaatgtgtgagtgtgactgattctaatgttaatataatctttctaatcatctcgtttagaaagtctcttttgttcttaaggagctccgatcgataatatgagcttgcattgcatcctcattttgtcggacagacagcaaaaacaaaagccattgatgtggtgacaatgcatatatgcaaaaaagacacttttgctgcaaaattaaagccatgcccccataccccataccgagaaagccaatgtctgctacctttatttattttcctttttttctttctccctttcctttccctccatgtgcttttgtttgccgtctctctctctctctctcttctcatcactggaattgtcacactaatgtctcattttacctgtaactttatgatcagataatgtttatggaagagctaaagaaaatggctacaaattaaagtgggtgagaagattgaaaaatcttcagagcatgcatttgggcagttataataatgcctgaatcagttcatgcagtagatcaaagcaagtggttaccggttgtaactgccgatgtctgatatttcaacgaacatttttgttttaccaacatatcatagcaattggaatctactagcggtagtcggagaagaagatttggtcacttgttgatctgaaaaaacaatggctcaaaggatataccaccgcgctttcgcattcctcttttcaattggaagctgctcgtctctcggttcattctttatggtacgagtatgaagcgatatcagatcagactggaggatttttcacaatttctttttactctttttgataagaaagatagtaacattgttcaagcatgatgtgtgttgggtttgtgcccatgctcatcttcactagcaggatgatactgatgacgatgcactaccaatgcaacgtgaagaggagttagtacatacaacaactacaagtgagatgatcactgatcagatgtggtggatcaaattatcagacagacagctttcacactaggtgagcactccactgcctgcctccggccctatccgagctgcttttcattctttggatttgattggtgccgccttttttcgctattgaatcgcactgcgagatgcaccatgatacgaatcaagtcaaatttctggcccaaacaaagacattgccacgctaaccgaactgttcaaacgatggtatcttttttattgatgcctctctaaactccacttatgagagctgagtacttgcaatccctaatttaagagcgctgagagcttgatatttcagatctttaaaaaaaaggtgcctgatatttctccattaccttccatgatctccaccatcagcttcgtgacaaaagaaacattcgcagaagtggtcaaaatatactggaaatattgtatatgattatcttgtttgcaaacaaaaaaaaatactgtcacattttgcattgccgacttgcttctgaatgtcccattgaataaatggccttttagataatgactgttgaataaatgtgtgatcatgcatgatatagtgcagtacccttttttttgtgtatgttttggaggtgggggctaaaacagtcagtgtgtatatcctgtatctgtcacacctctttttttttaagaaaaagaaaaaaaagtgccatcaagtaaaatgtctataaatagtccattacaagaacaatgctgcggcgatataggtggaagaggtactgatcatctgaaacaccataatgtggaagatgtcacaagtcgatgagtggaagccggtgatcgcaatgctgttctttgacctcatatctgctgtgacaacagccttgctcaagaaggcgctcgcggaggggcttgaccgtcttgtactcatcacgctgcgacaactagtcgccacgatcttccttgctccgattgcctatttcaaagaacggtacattgcctaaatgcaacttccagcaaatggtgatcagagttcacaacttgagctatgatgtgatactactgttggttttgccaccctctttttcaggggtaaaagacctaagctcacactggagatccttgtgtacctcttcttcagtgcagcacttgggtacaatctaaaaaccacttgttgatatcacattgaggtcaaaattttataaaactatatctatctaatccattgattgcattttttccccctctctgcttttagtgccgcgctatctcagtacacattcttctatgggttgcagtacacgaccgcaacattcgccataactttcaccaacatgtcccctgtgatcaccttcctcattgctgcactcctaaggtgttacatttttcaagcctagtacttgtctgcgctttgtttctttttttttttgtctgaatcattgggtactgttcatgtactcagggtggagtcactgaacatgaagaacaaggcaggagctgcaaagatcatcggaacactcatgtcattcgccggtgtcatgctcctcaccctctacaagggtgtggccttgacacaccaa

SEQ ID NO: 76741 - DNA, 4524 bp, Oryza sativa
gtgtacttgtgtagaacctcttttaggccttcatcctcgcttcgctcaaaaggttttaacatgtaagcgcaacacattggaatgactagtattaattactatatgctagtgaaactaaatgtcaaatggaaacgcgttgtttaaggacatgctcaagatttaacccaaaacctgaggttgttagataacggcggcacaagttgcttgcatttgagcatgtcaaatcattattatgtgtcacattgaacatgaaaggaaaagaaatgttctttgaatgcacgattttcgtaccgagagctcctgtgagggcggcgaatcaatgctttgtgatttgatttagacttaaagtgaccaattgctcatcaaagcagagacaatgggcattggatctttaggactttctcatggaaagatgttttctacttgttcttagtagttgctaaacaggctcaagctaatgttttagtgctgaaacagcatcctatgctctacagtagaagcaatgtatgcatgatcacaattatatactacttggttgccaaaactgaaagctttaaattgttccattgcactatgagaatactgttattccaattggttggttgcgccgttttctcaatgcaaatcttccatactgaagatattccgatgtcatcagctaatacttgcccacccccctcaactccaactcttgtgtttactcttcgtcacgtgttgcgaaaacgaaacgaaatcgaaatcatccttgcagatgccatgagcaccatcaccatgcatggcatatggctccctataaaaccatgacattaccaaaaacaaattgctcaaactaggccaccggatcaaactttagttgagagcaaaggaaaggcctctggttttcctgaaatgtggagggcaggatgcatggagcaatggatgccgacggtgtcaatggtcgccaccaatgttgtgatagccatcatgacagccttgatcaagcaagcactcaaccaggggatgaaccgcctggtcctcattactttccggcaaatggtggctactgtattccttggccccatagcctacttcaaggaaaggtaccaaagcaaaagtataactataataataaagtactgccaactactagtcgcttgtattttactgttgctgatcactgatttttcaggaagacaagaccaaagttcacaactgaaatctttgtctacatgttcttaagcggaatgcttgggtaatcatttgacaaatactatattatatgtagagagagttggatttcaccattcattgatacccctggatcaattgtttctttgacttgcattcatcaggccggtgcttcttcagtatacactgtttgtagggctggagtttacaacagcaacatttgctgcaactttcggcaatttgcttccggtggttactttcttgatttcactcgttttcaggtaactacaatttctttgagaaatctggaactcttttcactgaagagcactttgtcctctatatatgtctctctttaagtagctcaatatcaggcaagcagttacatttgctactatctactactccctctggtttttaagatacggcgcaattgactttttttttcacaaactttgaccagtaatatttattcaagtaaagtaaaaggactaccactaaatctctcataaaaaatactttaagcgtgcgtaatatgcttgtgcaaatacttctagataaaaatgaattcaaaaggtcaactgtgtcattttttttaaaaaaaaacagaggtagcatatgttaatagcttttcatttgaagttgtactacaacaccttaaaatcaactaaggccccaaagcacctaaaaggaaactccagctttgttgcccagcagaaagaaaattgcattgggtcctaaggcaccttcaactcctcacatgcttttggatttttttttcagtgaaacacaaaagcagtgaagtacttctcacaaactagttccaattctttataggtttgaagcacttaatgtaaagagcagatcagggagtgccaagatctcaggaacattggtttctctcagtggagcaatgatgctcaccttctacaagggctcagcactgacccatacaccatcatctagcagtagtccagcatccagcagtagccacagccaagctgaagaacatgacacggcccattgggtgctcggttccgtctcgttgctcgcgaacgtagttgggttcgcattgtggctgatgctgcagaggaaattcaccaggaagtacccagcaatctactctgctactgcattcatgtcattgttcagctgcttgcaagcaggagcacttgccttgtccatacaaaggagcagcatctcaatctgggctctcaaggggaaaatagagatagccacagttgtatattgtgtaagatctcttccagagctccccaaccatattttgcagcatttcttttatatactttttgtccattttgtttggcatagtcgaaaagtaccaactgaaaatagaactagccccgcctacttttcttcttctttttttgtttgaagctgcatacttaatttgcatgtgcactcttctaaaagaactctagacaaaacatagagcatgctaaaatatttgcacacatgaaacatatgtactataatataaagagaaataaatcaacaactttcatatctttctgtatgttacacaaataatcattcgtgcacgtattataaaaattctctacattattcttttaaacaaaatctagttaggtgtacataatactacatccacactcaaagaacccataatcttctccggtggatagtttcttatctacaaaagataccttttgtaaaaaaagaaatgaaaaggaaagaaagagaggggagaagatagtgttcattggaccagtatattatatgggatggatggatccatcctccacaccatgcatcatggaccagacctttaggataacattagccccgatttgaaacaaattattcaacagattatctacttaattgtaggaataaattaaatatttttagaaataaacttaataaatagcttcgaacaagtggcctaagcaatgtagtagaagaaagttttttttttaaaaaaatagagatgtggagcaaataatccgccataataatccatgaagtaactgaaaagaacaaggccagatcattataaacagttttcaactcttctttttcaatgtacagagatccttctacaaagccttatttgaaaagaaaaaggtctaactttcaagtttcaatagaaagggattggttaccactcaaacctgtctttatgacttgaaccgtttgcacagggggtcaaattgttccctttttactaggattcttccccttctatagatttttaatccctacataaaggtataaatctaacatatttggagagattattccaggatagccaggtgaaaaaagaaaatttagcccggcgaaaaagagattattccaggataaagaacttacaatatattaaattgataagcctattggtttctagcgtgcagcttaaaagatctttactgaaacatgtcctatggtcctttagaagtatcagattttttaagtgtaaattttgatacctcccaaccatgagcatgatggaattgtacaatgggacataggggtggaattgtatccccaaagtttttggcaaacaatatgcaatcaagtaggcataatatgtatatagaccattagataaaaaagaattattaagcccaaaatcaccatttccaatatattatagtttattttgagtatataattttatctttttgttctatgcaaataatttttatttgcactagtaacaaaaactagcacctcattttctgaagttctgttgctcctatttcagtcaaaaagtggtatggtgctcttctagcactgatgtaacaagaatttgcgacatatcgaataacaaaatgtgggcattgcatttgttctgtgaaatttgcagggtgtagtggcgtctggctttgggtacctgatgctcacatattgtgtggagaagagaggccctgttttcaccgctgccttcagccctctctcccagatcttcgtggccggcatcgatctcttcatcctccacgagccgctctatcttggcaggtactaattcttaattaatttctagcacaaacgaattgattgattcattcatgattccataagttactgattgttggtatggcactaaaagaatagttaattttttgcagtgtgttagggtcagtcctggtgattgtggggctctaccttgttctgtggggcaaaagggaggagaccgccgccgtcagcaaagatgccattgcttcgccggagaagccagtgcaagacgtagaacagcagcaagagaaagtgtgattgatattgattcctcttagctaggctgcatgctatctgcaaatgtgttgcaattaacttaacttgagtgtttatgcatttgtgatgatggagtatata

SEQ ID NO: 76742 - DNA, 8289 bp, Oryza sativa
gcacccaccggcttcccccatttacgaagtcaccaagtccatgctccgcacccagtacgcctcccagactcccaagcgagacaccggcagcaaccagcagctggaaatcgagatcgccgccgagaagccccgccgattaatcacctccgatggcggcgccggcggcgaggccaagccggagtccgctccacctagcgaaggaggcgatagagggggcaaggggcccacgttttcggatcttggggggatggagtcggtgatagagcagctaatgatggaggtggtggtgcccctatgccatccggaggtgccgcgctggcttggggttaagcctgtggctgggctgctgctgcacgggccaccaggctgcggcaagaccacgctcgctcatgccatcgccaatgagaccggcgtgccattctacaagatatcggcgccggaggttgtgtccggggtctctggtatgctatccgattcttttcatgaaaactctgaacttagctaaacctttgaacatgtgttacaagcaagaacaaattagtttaacttactaaccaccaatcatgtttgctgctgggatgcttgaggaatgctaaattttgcaaatgctaatgtggtgttttctgaatcgcaacttctcaacatactagcaaatttggtaacctgttgtgtcgatgtctgcaagttcaggttgttcgttttaataacttataatgcaatcctcacttgataaatggaatttcatttgttaactaatggactctgaagctattagtgttcaatatgtacaaatagaccaggatcactgtttttattgctgcttcttacattagtcgtttgatctacttcacttagttttctttctcattagggaaggagtgcccgcaagtctagccgaacatagaactggtagtttctgcttgatgtcagtgtggcatgagattgatcctctatcaaattaggttcctgagttctattgttatactggtaatagtaatactctgccttgcaatgaaacataacacataggctttaaaggttctgattgctaatatgttctgcgatgacatagctccactgagatatgatccttagttgaaaccatatcggtcaagctttgtccttaccctgcataccaaatcagatatagcctatctcctattttcttttaccttttttaatatatatttcgtccctactcttagatagatctcttctatcagtagccatataagggtacaccttgtaaaccctcgttttcttgcaggggcttctgaggaaaacatcagaagcctgtttaagaaggcgtacaggactgctccatcaattgtatttatagatgagatagatgcgattgcatccaagagggagaatctgcaacgggaaatggaacgacggatagttacacagttaatgacatgcatggatgaataccaccaacaaattggctctggtagcggtgatgtgggttcagagtcagctgaaaagaaacctggctatgttattgtcattggagctacaaatagacctgacgctgttgaccaagcacttcgtaggccaggaaggtttgatcgagagatctctcttggtgttccagatgagtatgcacggaaaaagatacttatgatgcttacccggaatcttcgactggaaggtcagttggacttgttgaagatagcaagggccacatcaagctttgttggtgcggacttgaaggcattggtggataaagcggggaatctagcaatgaagagaataattgatagaagaagagctcagttttgtcaggagcatgatgaaaacagcaagcacgactggtggagacaaccttgggatgcaaatgagatagagggcctgagtattacaatggatgattttgaggtgaggtttccacctgttacatgtgcagctcaagtccaataactcctctgctaatgtcatcaagtgtaacttctaaaatagttttcctggccacgtatccaatgctttaatcatgattagttctgatctcatttcaactgtgtgccttatgtggactaaatagccatgctaatgaacctttctgctttttgtttgctgaaggaagcaaccaagatggttcaaccatctttgagaagagaaggattttcttctatccctgatgtcacatgggatgacgttggaggccttgattcgctaaggaaagagtttgaccgctacattatccgatgtatcaagcaacctgaagaatataaggtgaacatacttagtatgtcaataaaccgttttctacaattatttcttatgtctgttctattgttcctcttttagcgatgatgcagcctagtagtttaaagtaccacatgacatacccatgatgtttatttgcaatatgttttgaagtttaggactccttttgcagtacttttacttatttgatttttttattccatgtccgctttgttgtctatattttccagacatttggattgaatatgcaagctggctttttgctgtttggaccacccggttgtgggaaaacactgatagcaaaagcagttgcgcatgaggcaggggcaaattttattcatattaaggtagttgatgcttatatttctgtattttgaccacgttcgttcagatttatacaaagtaacgttaagatattcctttgtgtgtttaggggccagagctgttgaacaagtatgttggtgagagtgaatcagaagttaggaaaattttcatccgtgcacaaactaatacaccatgcatcctgttttttgacgaggtaaaggattttggtttatctagccatatagtctgttccattgatgaaaacttggacacaagttactgaatgactccgaatgtttgataaattttgactgttaaacacacatcaagcagtgtatatgtgtggagtatgaagtcgtttttccaattctaagacgctcaagtgtaaacccatgtgatgttacaggtagatgctttgacaacaaaaagagggaaagaggggggatgggttgttgaacgtctcctgaaccaggtttgaatactttacaagttaatatatatttgcggtagttgatctgctaacaaggttctttttgttctgtgttactctaattgttttgttcacagttgcttattgaacttgatggtgctggtgaacggaaaggtgtttttgttattggagctacaaacaggtgctgtcagctgctgataggttctccttacatatttatcactgaacataaggctgaaactgcagctccttttctggtgcagaattgatgtgatagatgatgcagcacttcgacctggtagatttggcaagaaacattatgtacctttacctggtgctgatgagcgggtttcgatattgagagccctcgctcggaacaaaccgatctcctccagtgttgatttgggtgcactggcacgtagagaggaatgcaaaaatctcactggtgctgacctagcatcaatggtaagttatgactttttgttgagtggtttctccatttgaattttgtacagggtgatcatgtctgctttaatttggggcaatgtagttctttatatgttttagttgattattttcttcccctaggaacctatgggacattttgtgagttaaaccggatattggagtgattatagttgctttttgtttgaatattaatcatgtgattaaagaaacgtgcaaaatggaactaatgtggtccattcttcaggtgaatgaagcagccatggcagcattggaagagaggctggagttcctggagaatggggaatcgtcaatgagctcatcatctgcgattgagctccctcattttgaacgtgctctagcaaaaatgcagccatcagtatctgaacaggttagaagctcttaatagttcataaatgtcttgttgctatagcgaggagatgtacatcagattgtcatggtcaacccttttgatgacacgtttcaccttggttttgttctttggtcacaacagcaaaggagacactacgaggcgttgtgcaagaaatactccgcaagctgatatatattgcgccatgcttacagagatccatgtcctctgagttgcttgcagggaaaatacaggtttcgcttgcaaccaattttggttttgccctttttttttgttcccctttgagtaggccttgtggcaattttgtgcgaccgaaacatagatggttgagtgagtagtagtatgaatatgcgagaaaaatagttgttttttttttcttttcacttattgtaccattcatcatcttgtattgtaatacaaacttcatattggttatgagattgcataatcatccaattaagcccctactatgctccaagttgtccattggattgagctgctgctgctgcttggagcttgtctaatgccgcccagagcttgtggtctttgtagtccctgatgacgagggacgctccggcggcgacgaccttggcctcccgggcctcctccgcaacggcgatcaccggcatcccggcggcgacgccggcctgcaccccgaccaccgagtcctcgaagacgagcgtgtgacggggagacgcgccgagcaggctgagcgcccggaggtagggctccggcgagggcttggggaggtcgcagtcgtcggcagcggcgacgatgacctggaagaagtcggagaggccgaggatggagatcatgaggtcggcgttggcccgcggcgcgttggtgacggcggcgcgcttgaggccgcgggcggcggcccaccggcagaggtcggtgaggccggcgacctcgcggaggccctcggcggcgtagcgcgcgaagagggcctccttgtcggcgaataaggcgtcgaggcggtgctggggccagtccgggaagaggaagctgccgatctggtggttgctccggccggccatgtgggccatgccgaactccggcgtgatggggacgccggagttgtagccgagggcctggaggagctcggagaaggccctgtggtggaacgggtcggagacgcacatggtgctgtcgatgtcgaacagcacggcctccaccagagacacctccgccaccgacatcctcttggtcgtcgtcgtcgccatcgtctccatggccatggcctcttcctccatcaagctcaccatcatcagtactgttattatattgacgaaggcttggttggttggtgtggttaaagttggcgcggttggtgaggtgaggtgacccgtctcgccttctttttctacgattcccgccatgtctccaccgaccttatttttcccactgtttttgacttgccctccaccgctgagtctgactgaacagtcaatatattgactctctgaagcaagggggaaaaatccattttaactcgtaggacttgttcggaatataggaatattaaaaatggagaaataggaaaagccgagaaatttgataggaaatgtgtaagcaaaatagaggatttgaagtacatgacttttataggatgggtatccggatgattgcgagaaacataggaattgttctggaggaatgcaacgtaaataatcaacaaacaaatataaagccagctgacaattgagtctagtgcatataattgtgtatgacaccattattaaagtagagtaaccaaaaataatagagttggtataggcctttgggcttccacgaaaccatggcctacctttcagttcacaaagaagtcagaaggaaagaagataaactttgggccgtttgcaaagaacagatgaactatgggctcaattcttgagcccataatggacgaagcttgaccactgtatggcggagaatccggtgcaggaaacattgaggagcttctctcttctgttgatttatgcagggaagattaggattcgggattgaggctctttgtgttgtaaaccaacacgcctattaacggatcaccggatccgttcactgtccctcccacagcagtagaggcatgagatgatgtagaacacccgcgtccatccctttgccctcaagaacattacagaagtagacaatgaacacatatatagggtggagctctctcttcattatagatctcatctggagtacaagccagccattagccattagatgtcacatcctgcccctgtatagataggggtcttaggaggagatagaccttatctctactccggttcggattagcccacaagaaacttatctccaagagatttgtttcacaacactcccccttaggctaatccacgaccaactcatgcctcgtcaaaactcctaccaaaacccagtgggaaaaaggctaggagaaagagtacatagttatcgctcatgcattgcacgttgttgcctcgttaaaaaccttatgtgaggaacaacagctccactcactcaagggaaaaagagtacaacactaaggactacacggtccatattgtgggtcatgttctagggtgttctccccctgaacctagcaaacatcaaagtcttctcatcccaattctccggaaaagcttccgagaactaaaagctgggagagactaggtgatcaatcctctagattatcattcaacttgaattgctgctcatctcacctcccctcaggagtctgtgaggtagcccacttgtatttggtgtcagtcaataaagacagatcttattatgataggaccttaggaacaggtctaagtgatcgtcatcgagtcaatgccctgggcatactctaagacatttcaatgtctcgcaaatgacaatcaacacatagcacatactccccctgatgacaacctttgtcacagaccatgttcccatagcattaaacatctctcagatgtatgcgtaggcaagaatccttcagatcctcaaaccattagtcttaaaagacttgtctcatttcaccgctaaaacgagaatagggaacacagagagtaatgcattccatcactatcatataccataataccatactgctgtgcaacgcaatctgtttcatccttcagaaggattattggataaataagtagcaacggcacgcacctcctggtcgtgaccccatcaagcacttggcctgatcattgcaactttctctgactgtgtcaccaacaattagggattcacaagatcaaccgaagccttccaaagacatgttgtaacaatcagagtaactagctagtctgaaaatttaagcactgtgggggataacacacagccaacaacaccaagtatacctcaatagctattagaggacaccaccattccaaccattaggtggaacggatttcacgagtgtacacactccagtgataatcacgagatgcacatgtgcctacagacctcgtctgtgatctcatcaggttcctcatttcaatcttaccgggtcataaatgggtcatcatccctccaagggattatacaatatggtgtattcagacttactaattattttgtatctcagaggaaaattcatcaatgaggtctccccctcagagaaaattccgtccatgagattttctcccaacgggagatggtactcttaccggaatacctattggtacgagatttgcatgccgaaatttcactatggagtctattcaagacctcctcatggatttcccaaatcctttaactgcatatttaatttcatgccattttgccaatacctttgtttagtggaacattcaactcacgtggaagaggtctcatgaaggacctacttgaaccatcgcgcatcaccacctcattatattaataatgacccataaaaatccgaacaacgttcgcgattttcaattggcgattcggttcaacctcaattgcatttccatttgacccgatttgagcaccgtatgctcatgccatggacttgttccggatccgggttctctctaagagaatcattagcaagaggcgacgtagtgtcgacacatttattcctacttacacatttaaccagatcttcgtcatttcccaaaatgatcgatccatggttgttccatattcctagcaccataatatgcgcgcattgctaggaatgtagtctccacgacgaacatcattatgaggtatatcaccttccagaggtgaattctccaccaggagaatcagaggagtatgctcacatccagtgagaactcttatgctctgactaaggactacggatcgtgttagcaggcgtccccgcacaacatgatcaaatgccataagtcttatgtggatacgatattattcccgggtctatccacatttaccacaattgggagcattactctttttaacaactatctagttgttcctcatatgattttgttggcaaaaactc

SEQ ID NO: 76743 - DNA, 3663 bp, Oryza sativa
ggagacatttgtccatatatgcagtgagcctagacatatacgaatacagtggcatgaatactgtattcttccttcttccgaagggttatcctcaacctcctagttaggatatacaggtttgcaaaaaccaccattgctatcaaatgtatatgcaaccaacatgcaatactttagccaaatgcactctccatggattaatgctcacctagtgccattcaaactcacaatcgattccggatcgacgtgcattacacatggcatgtcatatgcttaagaaggcaacctatggtggcaaaatgcattccgatgtgctcaacaaggagtatgatagcaaaatgcgcggccactagcctgcgctgccaaccatattttgtggtgcagagttgttttaaagtccatcttgtttaatgcccaagtttgaccccaattactcataacaaactctagaattgggtcatagttaagcagcatgtattaggtaccatccactagcgaattattaaaccacatttgctaatgtcccctggacatagccatcgagagataatcaatacctccaacaatggtaatattcacaataaaaccattatattcagacatatccacaaaaatagtggaatgtgtcggtgcaaccgtcgttggtataacgaagctcaacgcatgcaacacgacgaacctttgcatggcttgcacatgtccacacgcaaaaaacgccagtgtgcgacaagcatggtcatcaacccatgggatgatcaaccaacacaaccagggagtagtcatcgactacgagagcgcgataaaacgcaatagtgcatagccaacctttgtctgaaatacagttacgtcgaattgtgtgagtggttgtaactcctcggattatacactaattgttcttctaaactaaagcattttatcaattccagcatgaagataagctttagaatagaacaggaaagaccaagaacgttatttatctgagaaatatcgatctaatgcaaagttccaaactaagcaaaagataaactgcttggcaacagtatagtcgaccattgtcctcctaggacatgctctaaactggccatacaactcctgttgtcaaaacaactttattagacaaacactacaaacaattggtcaacaaccagaggtggcaatttagcgctagatgcacacgaggaccgagactgggtcaacacccaagtcaagctgttggcgctatagtgaagtgggaatcatgcctattcacagcatctacccttgggcttatccctctagatttgcctcctcttttccggtgtcctcgcaagacatcaggttccaaataatattgagaaaatttgtgcacaccaacggcaaccatacgaacagtgtcattccaccatatgaaaaacactttacatctttcaccgggccaggtgaaaaatatctcaaattattgaacctcgcaactccacgttgccagaaaattgaggtataatcatttatctccaaatcagaaaagcgtgctctcaaccattgggaaagcaaaaaaaaatgtcgaccgtagtccggccatactctgattgagatgttaagccactaggggaaagacacaatgaatcccaaacacattgtctaatcccacacatttcaatgactcagaatcccattcttgagtgtgatcacagggatagagtgatctacattaatgcccaaagccatacaatagtcattgaaggcttttacgtgaaatcacccacactatcatccgaatcgtttcatgcggttctcagagaacgcaacacgcaaactgacgatatgcagagtgaattcggcaagagcatggatcttgtacaacaagtatacgtgactccatcttgtagacacatcgatatcaccatttatgtatggaggagtgtatcagtaaagagtggtcttatctatagccatggatatttaatttcccagaatttccatgcattaggtgattttctattatttacttggtcttattggcattatattcccaatatttatgccacacagaaaaccatcacacataaatgcaggaaaataaacccatcataatgcttccaaggggggattctacactgtatgaacacaatttatggaagcatcataacctagaaaaccatctctagattatttagttggaattgcatcaattttaaaagcaaagcaatgcttaaaaaacaccattacatggttatttacgagtccggagacccacatgcaaaaccaaactatacaaggcctaagcaacaagacataaccacacaaacaaaattaatataatctcttgttaattacaaggttcaaactgtaaaattgcattaaacagtgaactatagcataaaaacccaacactccgggggcttaaacgcaagttgtcaataaaccgaaattaatcgggccgaattaccgttcatgccacgatcttatttgggctagcaagcacagtgtagcccaacatgcctaatgggccgaatttccgaaagtctaggcccatgaggatttccaggtttattatttttattaatttgtttgggctatctcgttactgttgggctttattcggtcgggcggaggcagaccggcccaaccggttcgcctaagtgaccgagagagggaagggggggaattagggtttcccctttcccattcattgtccgcaacggcgtccaccgcccggcgcaccggcccctcgggcatggcggcagcgttggaggccgtcgactgtcgactttgaagggatttagggcggtgcacgcgaggaggtcatcgacgacccatccactaccccgattggcaggacggcggcgatgacatcactcccgtgtggcaatttggtgcggtggcggctcggtggcacacgacggagctccacgttgacccgcgcatccttatgatggtggcgaggcgaactcaacgacgacaactgagacaccaacaacggcaaccaaattgcatccggccatatcgtctcggcggaggttaatccggtagcaggcagccgatgacccatcatcctcctaccacggctcgacggcagcgtcgatgggaggtcaacggcggcaacggcgacatgggtttagggatttctccgagacggcggtttcctgcgacggcatcgacgtaaggccgacggcgtacccaacagcgacggcgaacgacagttgacacgtctccaagtccagcaaaacggactgagattatgtcaccgtgttcccggcgtggcatcatcaaagaaagagagaaacagagagatgcgaggtaggagggcgagtcggctgattcggcctagccgaattaggcacgtctccagtccagagtttcctatcgattttaatgatttctctcacacagttttctccagttttcatcaaataaaatagatgcatatagatcaaaagcagaaaattaatctaccgctagatcaagagcagaatcaaatctactgcaagcaaagcatccatatgataaaaacgagaaaatataatcaatctataaaacatatagatttcatgccttaataggcacatgcccggatgtatatatatgaattatagtaaattagtttataaactaatcttactaattaccgtgatttgcgcgtctgtcttagatcgcgcggttgatgtgcgtgtgtgcgtcgaccaaccg

SEQ ID NO: 76744 - DNA, 628 bp, Oryza sativa
caaaagaagtggtttgttatctctcaccttttcccttcaacctattgtgcttgtggtcatcgaccagttgtggcaaaacactgttattctagctagttggatgtgatatatcctaaattatgaacatagcctaaaatatgtcatattcacctaaaattccttatgttttgggacggatgaatatctcaaagtattggagtactgcaattactgaacagggagggaacaccattacaccaagcaataagataacagggaaggaacaaaatgtgcatgccattttggtttgctacgtacgtacgggtacagtgagttcgtcgtcgtcgtcgtggtggcggcggcggaaggaatgaaggcggcaaccaataagatcgcgatccagcacggaggcccggatacttactatgggcttaattccacttactaggcctggatccttaaaccttgggctgtcaagtgggcccggcccatataaatttcattctcagaactaaaagttaacccatctccctccaaaaaagaaagaaagaaaagcgcaaccagctgtgtctcctcggcccaaaaccctagctagcaccctcctcctcctcctctgccgccgactacggtgatggggaagcgcgcgcgc

SEQ ID NO: 76745 - DNA, 5907 bp, Oryza sativa
agcagtgatctgccgtgcgtgaccccgccgattagagacatcctgttcccatatctgctgtttcccatcgacacccagtgctccactcaggtctgatcccaatccgctgcctgctccactcctttgattgttattcccctttcttccacataattgcacacttaggcagattcaaccaaattttgtttttcagatatattgtgatatagtgttacacaatgagaattcctcctcacaaataaatggctccacgtgcttctgttttcttggaatgctatacgttagtttttagatgcagcgattaagcgagtataatctgtgagctatctaagtaggatatgacttaattcgtgcaaggttaatcgcaatagcagccatattgtagattagtattcttgagaaatgccatataggaaatggatcatttcaccaatcatatcattttattcctagtttcaatagtaaggcaatgaatctgcatacttcatcatgttaacaagccggcccaattaactactgatcaatattttttttggaaaataaatttcatttaataatgccatggattggagaaggttgagaaaacaaattactagacaagattcggtggtatccactttagacttcttattggcaaagtcttgaacattttaggtttatatattttgggatgaaatgctaggctcatatattttttatttgcattctccttcttaccctctgagtaaataactgaaaatagatgttttagcttcttttcaattctcagaaatttcgctaattttcacaagttcaggagatcgtcgtgcgtgacttgcctatcggagacctcctgtgcccatatcctgctgtttcccatcgacatcctcagttcatcattaccttaattgaaggtaaaagcagtgccttctcttttttttttcctgtttcccttgagtgattgatatgagcaaatattctttttcttttttttctttggcatctgtgcatgtggatttactcatctgaaatacccttgagactttgacttctatatattccttgcaaaggggaataatgtctgttttctatcctgactcgttgggttgtctctcatatacaagggaaggaatttgcaagagctgtagccatactaccttctctccaattatatcggttaacagaaagatagaaccattattccattttgccacacaatcccaacaggacagatcccggagttgctcagactttgaggattaaaatactaactttgtaatttctcacatcattatttttccttctgtgaaacaacgtgaaattaaaaaatggtgaaaaaaagacagattccatcccctgaggtggaaggtgcgttagtgcatcacacatgaaatttgtacttagctggaaccatcaggtaaagacttaagagctgttaagcttaataaaggaattcagttgttgaataagcaggtagatcctgacctgtggattagtacctatttgtgtgtttataagatgaattgattgttcatatgttaccgcgagttaatttggaaaagaaatgagcatagggtgaaaacagcagagttattatttcatttgcactctgaatgaaaaataagtaaataacaattcaataagaagttataaatgcaacaaattgatttacctctgtacatgattcaagattcaagtgcaacagctaaaaggtttcttcccctggtcaaaatagagtgaatctcaacagccatgtataataccaacgttctacagtattctaaaattaatcatcccaatgttttcttttgatcaatggtgtaatcctaccaatttggaattgggatacatcgtacatccagtttgcatgttctaagtgtgcacatttcttactccctggccgctatcacaaagcttgaccagtataaaagtctacgacataactgtaatcttatttgcatactttatgaattcattccttctctgtttgcaggttggtacgtaggcatgccaaaaatctaccatcatttgattgtacaacctgtaaataaatatgctggagatggagtgatcagaatgaataacaatgtcatccatcagatcgcctttggctttgaacaagctctatgagatggtcaaagattttttaatcttctgcttaccattaattggttacctgataggagccaaggtcacagtaatagagggaggcttaatgaatattcccttgattgaatttttctgactccatatgtataataaaaagttagtatggccatattatttgggtataaccctgttaggaacccaaaggcataaaattcatactagggaaaactgctccccttttttctaatatagaaatacttccagctggaagctgctggtcatttgttagtatatatcttgatgattttttcctctattgctactttccatttttatagccaatgaaataagttactaacatacgccatacagacaatattatttttgaacttgttttacagccacaacaaattaatggaataactctatcattcattttttgtatgtgtggacatatattgctctatattgtactccctacatttctacatatttgacaccggtgattttatagcacatgtttgacccttcatcttatataaaaacttttgcgaaatatgtaaaactatatgtatacatataagtatatttaacaatgaatcaaatgatagaaaaaggattaatagttacttaaatttttaaattttttgaataagacgaacggttaaacatatttaaaaaagtcaacggcatcaaatatttaaaaacggagggagtatattaaagcgattggatataatggtcgatgccctcgatatcatagtattgtgtcgcgccttaaatatatttatatatgatctgaatggaattaaaacttaattggatggattctagaaaagttattttctgacacatgaaattttaacaatgtattaaaaaaaattatgacaacgtagcgttagcacgggtatattactagtgatgagtgaaaccatttgttggactatagggtagatttatgatgattttttatcccgtttatctggcattacatgttgataacccggcaaatcttttctgaagaatagtactattacttgcaacagctactgagcaccaaattatagtcagtgagtcaggatggcaacacaacaattcaagctccctgctaccctctctagtctccaccttactacagtctactggctgctgctgtgtctcgtcagataatgagataaacatgtttgtttcctgaactaatgctggaaaaatatcatgaaattagaggagttacagacgcctatcttggttatctgaagactctgatgtttaagctgttcagccgggtatttgacagttatatgatctctactccaaattgatgccgacttcaacagacaagaagaactggtcgaatcggagggctggccctcgtgccgctcatccccagggcggcgaccaggcgagcgcgccaccgccaacctcttcctctcctcccctccatctcgctgccactcgagcggccgccagcaaagccggggacgcaatgatgacggtggcggggctccctacctcctctcgcgggcccggcggcctagggcagtagactcgctgctccggggtcaggacttgctcagcatcttcagggccaaggactacgacgccaccgtcgagttctactaggcgtctaaatattcgatgtgacatctattttttttcgtaaactaaacaaggcatttgaccaatatgaaaacgatatgtaacggagggagtacatttcaacaccaaacataatagtaagagatatcatgggtggacaaatactagtagcagcagataaataacacaagaagaagaataagcagcagcagcagcagcttcttctcacaaagagggctggaggaggaagatctcttgtgctcggtttgacatgaggtagcagcgcgccttgtgcttcacaaggcgcagctgtccttcttctccggcgacggcgacgacttggacagccatgaggaggagggcgaagcgcgtgggcatattagaatagccgtattgctcgccgaactcgacgatgatggtccagccgatgcacaacctgccatctcccaggtaggccaggctcgccggcccatgcgggaaatatccccgctccaggcactcgcgagggtacgtctcctccacccacgcgtacctggtcaccggcgccgccgccgccggctcggcggaggggacgtcgaaggcgcagaggcagtaccttgtccggcacatggcgaagcaaaggttgagttcgggcacgaacacggcgcgccgcacccatggaagctcccagtcgcctaccttgcgccacgccatggcattcccatgggcggtggtgtcgaaggagtaggtgcccctgtccggcgcggacacccagatgcgcgcgccggcggccacgaaggccgtggtgttgcagaagatcatcgcgggggccggacggaccatggagaagtcggccggtggatcgggcagcgcgcgccacgaccaatggcgccggcgccggccgccggacccggcgacaggggtggcgggcgggaggaggacctggaagcaggggtcgggctcgcacgggcggttgtccatggagtagagtcgggtccccagcaggatgagggccgtgccgccgatcgtcgcgtgccggagctcggaccgttcgacaccactgcggcggcggtgtcgtagaggagggtgcgcttctgcgtgctgacagcgacgacgttggatccgaccaggggcgaagtcgaggcgctcggcgcaccgctccagcgaatcgaacggggcgattggaggaggtaaggccctcatcgttgcccaatcgtggtcgtcgccggcgtcggcgaacatgggcttgagatttagggtgaagacgaagtatatgccgttgccaccagtatccagcctcttctcatccaccacgaaaaatatgcgatttctcctcctccccttgctcttcttacgctgctgctcgcttgcgccgcctgattccatctgccctgccctgatgaatcggtggagacggcgaaaatgctttggtacgggagatgcagagatcacccaagaaagacgtggcagattatcgccttaaaaaagtttactctattttatcgacatcatcgctccctcaccgacatcagcgtggcggccgccaatccgttccgcagtggattccgactctctgtttgagttccctgccgacggaatcagaataggactgggagaaaataaatactccctcgataccaaaatatagtagtaagcatatctacaatcaaaactaaattagagtgttctcgctaactgaggatgatctccggaaaactcatctcttaatggcggacactccagatggactcctcaaaatctagagtaagttggaagagatactccagcctacaacggttatcctagaccacaaaacccatgtatatttttactaccctacccctaatctctccctcccgcacaaaatctctcttttttcgccgccgcccctccacttctctttttcttcgcctctctctctctccctctcgccgccgccgtcaatcgcctctctgtcgcctgtggccacgaggaggacgagtagggccacctccctctctctctcatcgccgcccatcgcatccctctctcccgtcgccggatctaggccccccgcggccagatcggggaggagacgttggcggacacggcgctggcggaggaggccggggagggaggttggcggcggtggcttggtgcattccgacactagtatagtagtgtcataaaggagtagtgtatagcaagcgcttctaactgcatcaagattaactaaaatcctgtgatcttgagaaaatcaat

SEQ ID NO: 76746 - DNA, 662 bp, Oryza sativa
acagtagctcatcatgtccacatatagtacttgtttcgtgaaaaaccaatgggccttcttcaccaaaaacaatttaaagccacttcccttttcttactgcccttgcttaacctgctgtccaagtaagtactaatttcaaatgcaaggttgtgtaccaaagctacaacccgaaagtcaaaaatgacctgatttaactagctggtaccactcgccctacttgtttattcgttccaactattctatttgttggctggctgaaccaaggaaatataggcctgctgacttgtccaattaaaagtagctttcctactagtggttccaacttaaccaacaaccaccggattgagcgcactagcgcaaaagcgtaacacgcgcatccgttttcttgctccactcataagaacaaatctggtaatcaagaaatgaaaaggtattggtatatcaatgaacacactccatagagtttctgctcaaatcagagtgttgaaaaattaagaaacagtttcatcccgcctttccactaatcccccgattttcgctcaaagctggtctttcatttcttcccctttagaaggtctttactgcaactgagtttgaaagcttttactcatcaaatatttttggccagcaaagtaggtatcaatctggttgaaagctgcaga

SEQ ID NO: 76747 - DNA, 591 bp, Oryza sativa
ggataagagagattggtcccaactgcccttgggcaagaaaaacggaagaactttttattgggttctccaaccgaataagttcagaaggatagccgaacgactggaccataagtcggaatggttcggtaaccagtaagctccgattctcccctttttgggggaaaagctgggggccctttgggggtgtaaattctttggacgggccgccctttttggtcggtagatccggtcaagttggttttggttaacaagggcgaagttggtttaagttctaatgacgaagtcttttgggccctggtgacaaaatttttttaaggaataaaaaaggcctttttaaccggttaaaaatgggaagtggtccataacgggtaattctgggttgggttcgattacgcaaattcgggaagaatcggtagttgggccctggatccctttggacctggaaaacgtgtgaccatgggtcggggtttggtgaaccaacaggtcggtcctttaggtgaaggatcgggccccttttttgttgcctaggttacgctttggaataccccaaacggggaatgaggtttattcccccccattttcactttacgc

SEQ ID NO: 76748 - DNA, 7531 bp, Oryza sativa
caagacaagaaacaaacgagtaatgttcacaaatcgaagcgacacgagatcgagtttgaacacccttactaatgtcacccaacacttagtcaattgggtgatccttggaaagaacggtgtgtatccttggtggcataggtggattttgtgccttctcctcctccacttcaacttgagcttgacttggcgtagcggaagtagatggctcatcttgagtggaggtggatggcttgtcttctacttcaataggcttgacatctccaattgacatgttcttcatagctctcatcaagccttcatcacctacatcatccaaattctcgtgcccctcttgggagccattagtctcatcaaattgaacatcggcggtttcttccacaatacctttgttcttgttgtagacccggtatgccttgctatttgaggcataacctagaagaaacccttcatcacaccgactttcaaatttggttagtctaacaccctttcgataaatataacacttgcaaccaaaaactcgaaaataggcaacatttggcttcctcccaacaattagctcataggaagtctttttcaagagacgatgcaaataaagcctattgattgcatggcaagcggtatttatggcttccgcccaaaagaaatcggaaacaccatattcatcaagcatagtccttgccatctcaatcaatgtacgatttttcctctccactacaccattttgttgaggtgagtaggtagcggaaagttcgtgtttaataccaagatcatcacaatagtcctcgatattggtattcttaaactcggaaccattgtcacttctaattttcacaagagtgcaactaaattcattttgggccttttttgcaaactttttgaaaagctcggcaacaatagacttatcatgcaaaaagaacacccaagtatagcgagaataatcatcaacaatcacaagacaatgactatttccaccaatgctcttataggttgttgggccaaacaaatccatatgcaagagctccaatggtctagatgtggacatgatacttttagtaggatgagaacatgcaacttgcttgccggcttgacaagcactacaaagcttatctttctcaaacttcacatctttcaagcccacaactagatcacattttgaaagtttgctcaattgattcatgccaacatgggctagcctcctatgccaaagccatcccaatgaagtttttgcaactaaacaatttttcaaatttgcttcactagaattgaaatcaaccaaataaagatttccatatctaaaacctttgaacacacaagacttgtcaagaaggctagaaacaataacttcttgtggcaagaaagcacatgacaagccaagatcacaaatttgagcaaccgaaagcaaattgaaacttagagatttaacaaaagagacattatcaattgacaaatcattggagatagcaattttacctaacccaattacctttcctttgctattgtcttcaaaagtcactttctcttgttcattccctcctacttcaaatgtggtgaacatagccctatcaccggtcatgtgttaagtgcatccactatcaagcatccaatggctctgtcacgcctagaaattcccgaatagaattccaagcagaatgtgcattaaaacccccgtccaggaccggccagggtacacaaacgacaaagttgacatacagatccacgtcttacaaatatcataaaagtcttacataaatgcagcggaaaattaaatgataactggagctaagccttgacttggactgcagcgggaacaccactccacatgcatcattgacggcacggacgaagcctactcttcggagaagccaccatctgacacgtactcaaactctggggtttgggagaaaatagagcaagactgagtactacccactgtactcagcaaatcataccggaataggggtatgatgcaggatataaccaaaggataggtagagcggttcatttgcataaagcgagcatttaaaaacagtagttgaaagcagtaaaacagttgtagtaactaatcaatattaatcatccactgtccaacgctacaccacgttgcgacaagcccaaccatccacctgaactaaccaattccattagactagactagggtgagactaatcacagtgaatctggttgatcgcccataaccgcgggcacgactattcgaatagttttactctgatcagaggtgtacaattgtacccacaacacacagccccacgacacgttaccgtgcgccgacatgccaccacgacataccggaaagaggccgtgacaggatctttcgcataaccccctctagccaagcacaccacacctcaggtttcacccccgtccgcagcgggcaacgggcagtcccctctcgtgcctaggtgaatctggaagcgacagaggccgtcgcagggcccgccccgctccatcacgcccacccttgcctggatgcgtcaactagaggaaagctacactacaagcccagccgttgcccacgctggcttgtggtaagtacgataagttcttccagggcatcccgcgaaccgatccttaagtgctatgggcgcgaccatcaaaaccatgcacccacagcccaccatttaatgcattttaattgactaacaccaggacggaggctttaatccaacaccaacactagaacctgaagtctatgcattaatgtgattcccccattgtgtgctagttgaactaagcatggctaagcaatccctagtccaatatctagtcatgttatatcccaagctaacaaaggagcatggtacaaaaatagcatggctgtacagtaggtatacatcccatagtaacattataaaacaatacagtatttaagggaaaacgatagaacatttgtaatatgggatcaacatgttcaagtgacaagcatgacttgccttgctctgctgctggtggaacctcggcgactatttcaaagtacaccggagcgtcgggagagccggaatctaatcaacatacaaagcaaacaatacaaacatgccataagactactgaaacagagaacaaaaccatttttaatggattctatgcatttttcttgatttactgagacttgcatgggtttaaacgaagctcggatgaattttctatgaattttagaagattcactgtgtttttactataaactgaaaaatccttaattgatttattgcgtaataaataaaatcctggggagagagaggggcggcgccgacatgcgggccccacatggcagtgactcgggtggcgatccgcggtggaccgggtccacagaccggggagggagcggcgcaccacgtggtgctgacgtggcgccgaagtggcgtacacgtggcagccacgcggcagccacgcgggcagccgaaccgacggcggcggggagcgcgcggccggcgcgcacaggcggctcaagctggcctggcagccatggcgtacagcggcgctaccgcgaggcggcggcggcagacggcggcgacccacggagagcggtggcgacgcgacgagcggcggcggcgcgatgcgacgactaggcagtggtgctaccagaggaaaagagagggggaagatggagggggtgtcctcatcgaagaggtccgaccggcgtggagggagacgacggtgaacggtggtgagactctacggagggaagtcgacaagcgacggacggggtccgggacgacctaagaaacaaaatgggagaagttagaggggaagagaaagatcaccgagggcaggaacgccggccaaaggcggcggccatggccgaacacaccggcgcacggtgcggagtgggtttcggcggcggaatccgacgggaggggagtggacggggtggcccgcacgacggcgaacgtgacggcgtcgacggcgcgactcggcgcagcggctagcgacggctagcggcggccggaacggtggcggcggcggtggaaagaagggcaacgacgctagggcggtagagtgcatgggagcgggcgattgcaaaacgaaaaagagagagggggaaacgggggtgctttatatcggctcacgagggtcgatcgtggccagggtggtcgcgatttcgccggcggagtggagagaggtggggaggagagagaggtgagattcaaaaattgaatcccggccgtctcgagcgcgggcgcgggcggaagagagagggagtgggcgcgggcggcgtcgtgggtgacgtggcccgggagacgcgggagcgagtggggcggcggttgcgggatacggcggcgccggttggaggtgggagacgggcccgacaagtgggccccacctgtcggcgacccgaagggaggagggaggcggccggctcggctgggccgtggccttcggccggcccaacggggagggggagaggaagagaatgggccggcggcccattcgaaaaagaaaaaggagggaaaagaaaagaaaaggaaggaaatgaatttcctaggattaaatattgcttgtgctcgattttaattggttaaaattatttctagagctctgaaaattccactaaaaatcttgttagcacatttcgacatgtagatctcaagaaaaattccacatgccaattccgactattattcgcattaatttatttagggtttctctcttgcttttacaccgatattttcttgaggccaattaaatattcaatttaggcttgggaaaagaacttcagggtgtgacaggctcccaccggtgcggtagttcacctacaaaagaagatcaagctcttttaggtaccaaacttgtttgggtctttggagattagagactaaagctttgggcacccaaatggcattctttttaccaccgagtataggggaatccacatatctagcaacaatgctaccatcataagccttcctaagcatataatgggaatcaaacatgcatgtcttagggggcttactaccggggcaatcattcaccaaatgcccaacctcacgacacttggagcaatacttaccattgctcttgacaaaacgagtggcacggtgagaaggtttcttacccttctttggaatgaatccaagtctctccttgttaaggatgcaccgttgctcactcaaaatcttgttaagagtgttcttacccttgaagcacctctccaaactcttgttgagcttagccacttgctccttaagcttattgttctcaacaacaagtgaggcatcacaaatagaaacacaagggctagagccagagctaggcatatccacaagatcattaaaagaggtagaaatgctagatgatgcaacatgagcaatatggcaagtagcactatcatcaagcaaatcacaagatatgccaacatcaatgagagctctatgttaagtagtggaaaggaggttgtcatgagcttccttaagcttctcatgagaaatggtgagtctctcatgagaagtctttagctcctcatacaagacctccaaagaagcatgatccttctttagatccttgaacttgacaatctccttctcactataagcatagagctcctcaaacatactcacaagctcatcataggaaacatcatcacaatcatcatcactcccaccatcactaagagatattaccttagaggagccctttgccatgagacaaagtggagcaaagagtgatggagcctccttgatggcaacaacggccatcttcttcttcttggagcttgcatcatcaccaccttcttcctcggacccggatgaggtggagctctcctcatttgagtctcattccccgatgaaggcctcaatcttcttgccttccttcttgagcttcttcctgagcttgtagcctccacttttcttcttggatgacttgtcttcatcatcatccttggaagtgcacttggaagcaaagtgtcctttctcaccacactcaaagcacctcaagttggagagagtcttcttgggtcttctatttcttctcctattggagttagagcctcttcctctctcctttctccttcccaagagatcattgaaccttctagcaagaagggcaatctcttcctccaagtcctcattggcttcatttaccttgcccttgcccttgtcttcaacttcggcttggagagcaatgcacttcttggaaggtgaggcttccttcatctcctccttcttcaacttgtacatgtcattggtgttgatcttccccaagaggcttgcgagtgtcatccttgacatgtcggagttgatgagcatggtgacaagggtctcatacttctccggtagaggtctaagcatcttttgggcaacctcaagatcgatgtagtttgccccaagccccttgagatcattcacaatgacattgagcctcccatacatgtcatttacactctcatgaggcaacatggagaatgtctcatattggatctttaggaaatgaagcttggcatccttgtactcgcttgtgccctcatggatctccgccaacttgttccaaatctcatatgcggtcttaaggttgctcactctatcgaactcctcttggctcaaagagttgaacaaagcattcatagcttgggcattgagttggaggttgtggtgatcaatctccgtcaagggcgtgtcggtgatagtaaagcctacatccacaatactccaaatatggaaactcatagctttgaggtgagtagacattttaattttccaagtggagtagtttgtgccattaaacatgggagccttccctacatggttcacctcgttcgacatcttctctctaggcggtaaagcccaatcaagagagaccaagctctgataccacttgtaggatcgagatgtcgactagaggggggtgaataggcgatttaaaactaaatgacacctaatcaaaactaacctaagttactaggcttggtgagggtcaactctaactaagaaactaagttatgttttgcaaacctagggtgatagtagctcaattatatctttagggatgtaagtcacactcctatgtcaatgtttagcaatcctagggtgatatgatctcaagtatgtctctagaaatgtaaattgcacaaatgtaaatgcgacaatcaaatgagacaaggagacaagagatttttcactgaggttcagaaactcgccggtttcctactccccgtcgaggcgagcccaactccacctctcaaccacgaagccactgcacgcccccttcgtcaaggggtgggcaaggcgggagccggcccacggagaggactacccaagcctcgatcactaggatagttcttccttcactccgaaggtggtgaactccaaaccactcacaaaccggcgccgagcctcctccacaatcttctcggagaagtcaccgggcaactcctccacaagccgtctaggaggcggctaacaagcaatgacccggcgtggagatgatcaatcaagtgccacactagctctacaaatggaagcaatgcacttgactcttggctaatcaacactcttaacacactaggggctgcaggaat

SEQ ID NO: 76749 - DNA, 2693 bp, Oryza sativa
gtcctattattgattaagatagctaattgaatccataggaatcctctctagctaatcctatcattgactaagctagtgttgatgcgaaaaacacacactggcctgggagatctgcttagctccagtgcaggtccaaagcttgatgagatgcgggcgtgccagtcagtttgatcctgcaactgacaagatatgtaaacagtagatcaatgagccgatcggctgacaagccgatggagtagttccagtcgatgccgataatagctgatgccgaaaccagccgataacgatagggtttaaacaatcggctatatgtccaatgtagataatgatataaaggcaatcggctaatgatgatgtaataaaataacaatatgatccagtataaaccaataggctagcagtgtgatatgatagaataagcattgatccgaaggataaagcatgtatcggctggaggtccgatgttataaaatccacaagattagattaaacagtgaaacctttgttgtcattggctaaatccaacttatatatacaatccttatgagccgatgcaacgtccagataattcattggctgaaaccccaatgaaacccttcttggcaatcaacaagcaggctagagattatggttctaagcacgacttagtagatcaaacttaactgatgcagcactaagtatgacaagaaacataatatctagataatcaagccgttgactgagttttctgggtggtagatgtctaagctaatctaatatagcaacgcgatttagccgataccggcagaaaccctaaagcgagaagtagccgatagagctaaattgatatgctaagactagattaacagagacatatgataaataggtaggcaaatataccatccaaaccagagcaatccaagaggtcgaatgtactgatgcagccttgaacgacgccgacgtagatgatacaattgcctgggccagcggaacataggacttaacccttcgccggagatcgaactaaaccgatgcagcctcgcgttaggtgccaggttccgtcggttgataagtaaaacctcaggaaagagggtggcgatgcaccgagagtagttgtgttgatcgagattgataaattacatagaccctaggtgtacatatttatacccatgggttgatacaagtccttgtcagacaggaaagaaactttcctaaagataaaaggaaaacataaagtccttatcggacactaaacacaccttcctaaagataaaaggaaactaacaaactattcctaattaatagataaactgccatgccgcatccttcttgaacccggactcttctggataaattccctttagttgatccgactccatcgagaacacggttgctagcgatttgacgacccccatcggctgattccataactctgaagccaatgctgactctaagccgatgatgactttgggcttaccaaatttcgtcgttaacacatgccccccagttttggagtatgaggactcatgctccaaaattctcttgtctgatcttgataactccaaaatcgatcttcccttgattctcgcaatcggctttcattatccggtactgtctgcattaaatgagctagactatcaaactcgtggcaaaagaatctctctctgataggtgctgacaatccttggaatgcaagatctgcgagttgttcatcacttagactcaatccatagtcgattctccttcttgctgctcaaacgttattaaatctgaaagcttcaactctttgattctagcaaagaagtgtcatgaaattgcttctcaagatcagcccatccttggatagaatctgatggtagcgatgaaaaccatgtgaaagccgatccagtcaaagacaaaggaaaaaatctaactttcagagcttcttcagccgatgcctgcccacattgtgctaagaatcggctgatgtgttccattgtagatgtatcatcctgcctgaaaacttggcgaaatattgaactttgtatcggtgtagcaatggcaccctatcaaaccactcaggatatggcagccgatacgcagaagtatgttccttatgtttgattccaaactgctcttctattatctttgcaattctatcagccaaatcattgttatattgatattcttcatcatacccatattgacgaagttcttctggctgatattgatatgcttgcccccgagctaattcttttgagcaactatttcaggtactatcttcttgatcacatcttgtagtgtactcaccaaaactccagactgatcaaataatgtgtgatgaaccgtgtcgcttcccaaatcgaccctaaaatacatcctctaaattatgcctagaataattaaaatgcttgtgaaagccttcaaaaattaaaatgtgcaaagttaaaagtcaaatagggcttggaggatttttgtatatttcctaaaagcctaaaatgtgtaaataaattttagtggaattttcagagcacaaataataattattcagaaataaacaaagttaaaatgattttataaaaagaaaaaccctaaaaatcacctctcccctctaatgggccggctcggcccatctccctccccctctctcctcctccccgcggcccactcggcccttcccgcgcgcgccccgctgacgggcgggcccgcccgccacccttgttgacgggtggggc

SEQ ID NO: 76750 - DNA, 637 bp, Oryza sativa
aggatcagttaaatgttttctttggacaacggatttggactcattcaggcctcgtttggatgtgtcgaaatccgaaagcccagtccatatatgcatgtatgggatttcagttcacttttcatggcttacatgtggatggactgggattgaggcccatccaaaagatatgccttgggagaactatgcaaggtttacatgaaattaagatgcatccacatctctgaatcttgatgcatggctttagtattacatgtttgtcagggtgacctatctttaattgactttttttttggtgggggaatgggggttgggggttttatacaattcttcataccgataaacagtcttgacttgatgcattatggcgtcatgggggtcgcaggtctcatcactttttcaactgttctcactctgcaggcaaatacacacgtaaatgtccatcaagacctcaaagatgtgaagctgtgggaggtctgtgccatcacattttctttatgctagttttgtgtaacatcttagaatttcagattgacactgtatggcttttgcaggttcaaactctcctaaaagggttggaaaaaatagctgttagtgcggacattccaatgttggtctgtggggatttcaattcagtccc

SEQ ID NO: 76751 - DNA, 7673 bp, Oryza sativa
cctgcagcccccgcgtccaaacgcgtgctggactgagcaagctctcaccaatgtgggagggtccgtatcgagtgatcggcgtcccccggccgggctccgtacggctggccacgggcgacggcactgagctgccgaacccgtggaacatcgaacaccttcgtcgcttctacccctgaggggggggtcgggtgtcaggtttcgggctcgggctaaccacgcacctccctcgggtgtgcagggttagccgggggctaccacacatgcacaaccttacttttcttatttcagcatttcaataaaagcagtttcaatttcctaaaggttgtgtctgtgccgtttttccttctaaagaatcttaacttgaaataaggtcactcgtgctcaaccttgccctcgggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcataacaaaacaaagttaacatagaaatttttcatcatttttgattgcagattaagttgatctatacaaaaagaagaaagaaaaagaaaaaattggagattggcgggggcctgggggctcattccaatgcgcccgggtcgctggcctcgtcgccaccgtcgtcctcgccgctggcgtcgccctcctcgtcggagctgggggcgaacgcgagccgaggggccgacccctcgaagctttggacgatgtggttggcggcatcccggacccacgcgcgcgcatcgtcctcggtcccgggagggaactcctccagcgccatccatggggagaagccggggtccctgacctggtaactcgctaacacgagttccaccgctccttgggcgaggtccctcgaggatgacttgatggtcttctcgagctcctcggggagttgttggacagcccaggccatcctcctaaggtgcggggcgaggccttccagattggtggagcgcgaaattgtctggcctttccagaggcccgcttcccgaccggcgcgatccagccgggagactgcatcccaaagcatgccgggccctatctcacccgacaagcggagggcctcggcttccccggtggatgagtctagggcgcgctgcatgtccgcgacgttgtgttcggcagctgcgaggcgggcgactaagtcgctttcgcccgtagccgccccgccgctgcgcttcctcgcatccagctccttttctcgcgcctcgaggttagcagcctgctgctccagcgcggctctctcggcgcggatgcattccagattgcggcgcgcctgctcctcctgcgctgcctcgcggagggacaggctgtccgccagccgttgtgtcgcggcctcggactcctcaagagctcgctcccgctcagcaagcgcgtcctcgcggagccggagcgcggactcctcttcggcgcaggcggcctcgtgcgccgccagcgtcgcctcccggatagcggcggcggcctcgcggtccgccaagctggtctccacggcgccggcatgatcctccagcgccatggcacgggcttcaagggcctcttcgcgccgccgggacgccgcttcagcctccgttgctcgctgctctcgggcagcggcggcgtcgaggaccccctgggcggcgtcgagctttttctttagctccgcctcccagctcccgtgttgaaggcggagggagtcctgcgcctcaatcatcgcggtggtggcgacgagggcggcctctcgctcttcctccacctctcgggcgatctccgccagtgccgccttgcgggcttcaagctccgagatgtggcggcggtgagccttacggcccacctccaccatggcgtccaccgagcgccgcccctcctcgacgcgcgcccatgcggcctcgagctccgctcgttccgctcgcaaggcctccacctgggcgctgaatccatctagcacctcggtgtttgcggcggccaaggcttgcagaaggggctcggcactcagcggggtggcagaagacgaggagaagagccgccttggagaaaatgcgacgcggctcggcccgccagaagacgcactgagctcggggatgtcccccggacccgtttggtcctgggcgtcgcccgagggagcgggcccaggcgatgcgcccgcggccttgtcgcaagccgccccggaggttgtcgcctgagcgtcgcccgagggagcgggcccaggcgatgcgcccgcggccttgtcgcaagccgccccggaggttgtcgcctgagcgtcacccgagggagtgggcccgagcgacgcgccggcggtcttgtcgtaaaccgcctcggaagacgccatcgcctccgcctggcgagcccgggcggtttcctcccgggtgacttcttcagcttggcgagcccgggcggcctcctcccgagcggtatcctccgcctgccgaacccgagcggcctcccgggcggcctcttcagcttcccgaaggcgatctgcggcctctcgccggtcagattctcgcctccgttcctctgcggccgccggatcttcggcctcggattgaccggacttgggatggcgggagggacgcgacgggacatcgctgaagcagaagaaaaaaccagaaggcaaacaagatgggtaaggtaaaacttgcttttgggatagaagaaaagacggtcgcaaagagagcgggacgaacctgcgagggggtcggttaaatgaccaccttggaggggaaattaggtttccctgggatggttctgtctcccccatcttgcgcagccgtttcttcttgcgctccccctcgggctgcgatgttggcgcggccccctccgggcgcctgctgctggcacgcgccgccccgccccctcggggaggagatgggggaggtgttcctcccagtttcctcttcccccgggcgtcggtagggcggttgctccccgagcccccgacgcggggcccagaagcacgaccccctccgggggtagattgatccccccgacggctcccacctgcgccgccatggcccttaggagcctgctcctctgaggccccgaccgccgtcataatggtcaagatggagacgcgatctgggtcgctgcagagggggaggataccgtgggggatgagggacgcctccacggagttgagatttagcacccgttggatcagtatcttgaagtcctcgggggcccaatcccatctgaccccctggtgggtccgcatatagtcttcgggcccgatgtactcccaggcggcccgagcgcgccgctggagcggcgcaatccgacgacggaggtagtcgccgtacaccatggccccggtgagcccctgggatcgcaggcccgcgaggcgatcgaggacggcgtcatagccatcccccagatctaccggcgcccgccagctggaggcctgcaccgggggctggctcggaagtcggagatgcgcttcgtcggcgaggggggtgtagaaccagtcgctcttccagtcatcccactttttgcggaggacgcaggggatgtagcggttcaacaccggcccccgcggcaggaagtagcagccgccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctgaagatcgtagaactccagaacatccataaagaaagaagaaaaaggaggaaccaacccggccattgcgaaggggagaaagaagacggaccgccccgggtagtctggcgccgggcgtccctcacccagcattactatctcacggccggtggcggattccggcatgaagcggcgcggcagcccagcctgcctctcgctcacaatgcgggaaggcggtagtacgctaccgtcgagcagagcggagccccgtgccatgtcgtcggagaaagagagggttgagaacgagtgtgtgtggcgaaggtgaggcgcagcaaagagagagttaggggcgcaaacggcgaaggaaaggggaatagtggcgaaaggaagggagcaagtcctttcctcgatagctttatacccttgccatcgctgagcccggctcctcgtttctcgtgcccactatctcgctccctcgttactcgctatctcgctccctcgtttctcgcgcccacgcttccactaattccattcgcccgcttgcggcgcataaggtagatatgcggttgtggcagtcgagatagatcgtatcgtgtgtgcgttaattacgctcgctgaccgaagtgacgttaccatatctccagacgaaacgaatctacacgcccagattcgagcgctgctcaagtgatgtggcagtcttgaagagaccgcccatgactgacggccaagacaccgttaccgatatgcgtggtttgagaccgttgggtttctgcccaatcacggagaccggtcccacctgtcaccaggctttatgagtggcgtcatgcccgaccgcttcccttgagaaggatgattgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggtggctcctgccccgaccctgagggccgaggtgccccgaccccctgtggggtttgcactatgtacataggttgggtgaacacggtagggctcacctaaccgcatttattgcggtctggtcaagcgtgtcacgttgcatgcagcgcaatgcagcgcgctcttttatccggtctgtgaccagtcacagaccggtcggatcaacggttaggtggcgactggtggtctgacgcacgcctcgccccgtcccgtcaagacgagagcctttaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggctgtcccatcgaaatgtcattcggacggcaaccataccaatctccgtccataaagagaagaaaagtccagtttggaaaggaaagggtacatgtggtatccccttaagatataaaaggaggaccatgcccacaaagagagggggctggattttcccgggagaggagagggctggttgattttttgtaacttgctcttacacagatccaccaaaaacacaggagtagggtattacgcttcccagcggcccgaacctgtatacatcgtccgtgtctcgcgtttcttcctggcacgcgatctttccacacacagagagagcttgagatctcaccctaagcccccggccgaactggcaaaggggggcctgcgcggtctcccggtgaggagccccgagctccgtcaaaccgggactaaagatcaaaatttttataacctggactaaaaacaatctttagtcccggttctttttgatccgggactattgtgaattttgccggaccgatcaaagatggtttcttcaccagtgtaacatactcagggtttgtcttttttttttttacggagagagtacgctaaaaagataaaaatcaaggataaagcgctgatatgactagctttatattgaaagcatacatgtatgtgtaaacagtggtgaacatcggctttcaaaatccagtgagtgaagtcaagtgtccactcatatgcttcccccgcagggaacacgatcttaattgcaaccatttgctgagctactaagagcagtacaatagcaggttattagccagctataaacctattttaatgagataaaatatgagagagaagagcagcgggctacagatctgtagccagctgcagcgcggactccaagacgctatgtgtgtatgacaggtgtgaccatatattaatagtatagtaagtaattattgtataaattagctattagattggctataaataaattggagctagtagtgaactatactattaaacttgctctaatacacggatagctcaagttatttgtagtttttatattttaaggcttaactccaagcacgtattcgtatactgacatctggtttgaagttaactggctaactgcctcttttcttctgtcacttctcgtttctacgatggaaaactctgcctacagatatgcatgcatttcgtccaggcacatctttatcctctcatcttttgctattattccaaatgatcaaaagccctggagctattattggtgaagtgaatcctccgatggttacaccacggaatggattggccgctcactcaaccagccacgccacctgaccacctgttacgttgcaccagctgtaaccggtgaagaaaaggtaaattttggccaaaagcgacgccagtagaatttacaccgttccgtggataaacaaaggcatctgatttcgcaaccgaagacagaaaacgaatcgctatcagcacgggagccacacgccatggcgatgctgcacgttgccgtcactctcgctcccagtcaaccgagccgcgacgatagcgtttttcccgcgagggcacgaggcgggggccgcgttgctcgccacttcgtccggctaaattcggagccgagaattagccgggcgaagcgggtgggcgggccagaaaaaacgaagaattccggccgcgtttctggcagcccgcacgaccagcagatggcggtcggtgtcctcgtcgtcgtcgtcgtgatcgcgcgcctgcccggtggtgccgtggtggctggtcgtttcccagcgacgtacgggttcagcgaacgtgttttgccgcccaggccagatgcgttgcgtcctgccttggtaggggtcctaggggagtaggactcgtcggccaaaagcttgacgcccatgactcgtcaactccacgctcttcgcctgtttctggtatggaagcagatcaagctagtcagtagggcggtcgagacggtgccgatgatcttcattatggtcttttcttatggttgagcagcttcaattcccacgagctggtactagtagttcatttgcacacgatgctatggtcgagtcgagtatggctttggtctaaaacgctttctttgccatgtgtggttggaatttccacccctaaattagcttggtttggcgacttgatctaaaaccacgtcacgtcgcgaggaccgaaaggacacacatggctctgtccccatccacaacgcttggctaggaacacccacgatccggacaaggaccattatcgcctgacataatctgggctgcaggaat

SEQ ID NO: 76752 - DNA, 1884 bp, Oryza sativa
agaagccaagggagagaaagaaaataaaatagcagaagaaaatgagagcaaagacagccgcatctgtgcagcagcgcggcgacgtcgtggagagcgacatgcgagcacgagaaaagccggcggtcgtctggcccgtccgtcgtggtggtcagtcaggcaggcagtcgcgcacacacgccgacgaacggcgtggctcctgttcccggacgcgccgctgcagcgatgcgcgcccgagttattttcgttttatctgtctcaccgctgcgtctacgtgttgggtttagcgcgcgacgtgtcacgctggccggttcccgcacgggacacgcacttggcgcgtagccgattcaagcccgacgcgtgtcctcgtttcgggaacttgcaggcacgttgtcacgtactactataggttttcccggtctagcagcccagtttttctacggcctcgaccttttttatgcgagaatgtctttgctttgttcagaaatggcaacggaaattgttcccccgcttttgcttttgtccggaggatgagttccgtgggaaatggatgtttaatactttaaccccgttattagccgctagtttttggagccgtttttatcttttcctgtgatccgttgttggcatctgatgaactgctggagaaaaaccttttcaatgcaagttgaaaaggagcctttcagatcaagaagaaccgcagatagccacctgtcctctgccgctgtctctgccacttcgattggataaaccaacagtcagaagtttattgacagctgttaccgtcggccccacatgtcagcggccacgaaccagccgagatgaggataagatcagacataacggggcatccttggaacagaatccgggaaagccatgtgggagtggccactggcctggccagcaccgcctttaaggcgtgcgggggccacgtaagtgggaccacctttgtcagtgtcacatgcgcaacctcccggtccgtgtgccatgttaggtaaccgcgcgccacgctcgccggcaaacgtgacgcgaggcggatcgtccgttcgcgcaatcgcgcacgcgcgcaccgttgcctccgctctttctttctttttttttttgcggcaaattccgcatgctacgttgcgttttttgttggtcaaacggacgcgcgccgtgccggtgccgcgttcgaaagcgagcgggttgttgggtgcgcggcgcgttattccgttcctcccgtatataacacgcgccacccccgcaccaccgccgctgcaaaggccagcgcccagcgagagacagccaccgccaccggagcagctgcgttttcagctacttttccgtgccgttttctgttggggggatcgcgttcgccgacgagatgagcagcagcaggctcggcgggggagatcgggcggggatgtacgaggagggggaggacgacgagctgttcggggagtcgtcgtcggtgtccggcggcgagtcggacgacgatggggaaggggaggaccagttctcggagggcggcgcggcggcggcggcggcgttggaccagatggagcaccgccggttcgcgccgcagccgctgcggcggttgaactcggacagcatctacgacatgtcgtccatgacggagcagctcccagccaagtgagtacccgtcgagaaaccctcgattccatccagaaatctcaactcttctgtcctgtgtgctcaccgtccaagaacaccgtgttaatctgcaggaaagggttgtccaggtactacgaggggaagtcccagtcgttcgcgtgcatgtcggaggtgaggtgcctggaggatctgcgcaagaaggagaagccatacaagtcgaagatcaagtcgtgcaacagctacgccgcgctgggagggatcgccaagacg

SEQ ID NO: 76753 - DNA, 1350 bp, Oryza sativa
acgacttagccgtctgcgttcatagagataagtatatgcgtgttatgagtgtttacgttttattatgtttctaaaaagaaaggtagccggatatatttatactctaaaatgggtagagtaaatatgaattttatgttctttcaaacaaaaaggaaaatgattaattaattactccgtggctccgtgacgtgcacggcagtttgtatgtagtgtaaaatttgtgctaattagctcgcgcctcaagatgataacgtagctaataaggtacagtaatttgtcgaagactgagaaattaccattaaaaaaagagctctgtctcttttctaatactctaccatatatactgggcatctagtacacatagcctgtacagatgtactctctgcgctatatttactgatacaacaaaaatatgtagaaaaatatagtactagtacctgtactctataaaggtacgtactgtacaagcttgcaatagaaaaaaagacgaaaagaaagaatcagacgctcctctgctgtgcagtgtactgcatctagttacaataactactgtagaaattttccttgagaaaaaccaatggaaaacagggagatcttggtacgttatactgccccaatagtacacactacggtatgtatacttacctacgtggcgcattctgggccattgagttatcagccatagaggatcggacggaccacctgaagtggcagctagccatcaaatgcgcacacaggtaaatgaatgataggccttttttacaaccaattttgcagggagaggcagctatagctgttgcatcatgtgctagctcgtatgggtctcatcctgcattacacccatcactcgtagctgcaccttccctgcaactcaactgaatatatggagtacacttgttgcagaactgaaacatgcacgcaaagttgcacagacaatcacgcaaaccagagaacaacaccaccaccaccaacaacaataataataaaagtatgtggtttagcgtctgtgtttataatgtatatataaaaaatttatgtgcgcatttattttgaaaatctaacttatgaaaaaagagttcaaaagaagtatttctccaaggtttattagaggtagatatggagggaatggcttgtgtggtctttggcagactgcaggattattgatattttgcattatcatggaacatgctcatgaattggttaggtcagcatttacttcgttcttgtagggtagcaagttaaggccatgcccataacgtatcaatcaacgacatgcatgcaaggtggttcatgaatgaatacatttatacatgcatggtttcatgcacatagatgcatggagtatacagt

SEQ ID NO: 76754 - DNA, 631 bp, Oryza sativa
gcccaaatttttcttgcggcccaggtactccatctttcacctgggattaagatattttctttttctccctccaaagcaacacgaagggcggctaatgctaatctgaaatctcctctcgccatatgggttccggttctcctctcccctgcccatgtcgcttgccgtggccactcaagcgtcagcacgcctctccccgctcaccacctcctcccccgaaccctgccgccgccgccgcctcctcctctccgcagccgcccctctccggcgcacccgtctccggcgccgcatcgccgtcgtcgcgtccgtccccgaccccgcggcgcggccggcggagtacacgccctggctcatcgccggcctcggcaaccccggcagcaagtaccacggcacgcgtcacaacgtaagcgggatgccttctctcgttgcgcaccttcctgtccgatttgagatgctcaccctctcaccgctttgtgctcgcgttcgcgttcgcgttcgtgattaggtggggtttgagatggtcgatcgcatcgcgcgagacgaggggatcaccatgaacacgatccagtccaagtcgctgctcggaataggtaccgccctctccttgttgcagtggagtggactattttgtttc

SEQ ID NO: 76755 - DNA, 813 bp, Oryza sativa
atccaggcccgtcgtttacacgtactctcccagtctcatgaaaaacaaactttgtacgaaagtgaatactagcttttaagccgttgtaaacatttaaattttaaaagttgattttagaattaattctgatgttttttttttcttcttcatagtttgatttttgagttaatttcactttggatcttattttgctgttaaagtttcattttagaccatcatttatcctttttttaaaactattttactatgtaactttacttttcttgcataatggaccgtctcaaaccacatcttcagcacttcaatgatctcgagcacatcgttaacaacatgccggtcaactttcctacatatacgcttgtcatagctttgcctaaggaaacgcgagacataattagtgaatagagttaagatggtccattatgcaataaagataaaagttaactagttcaaactgaaaaatattatgtatatgatggtccaaagtgaagttttaccaataaacatggtctaaagtacacttcacttttgtttttatcatttgcttctaaatggttgaggacatagatataagaattttaactggcaattttttttttttgctgacacatgagatctattcttcacctgctatgcttttgtacttcctccgactaagagtgtgtttagttcacgtcaaaattagaagtttagttgaaagtggaacgatctgatgaaaaaattggaagtttatgtgtgtagccatgccttgatgtgatgaaaaagttaaaagtttaaaaaaaaaagtttaggactaaacaaggcctaaaatga

SEQ ID NO: 76756 - DNA, 1930 bp, Oryza sativa
attatgcaactctatttgcatactacaccttcttttttctgtgggggagcatattggtccttttgactgttacattgggcttcattgccaaaaaagaaaaaaaaaagcaactgatcatttttggtaaagtcaaaaattggcaatgctaaaagtttgtaaaattttggcaacataaagatatgaaagtgatgtttaatttgatgccttaccaaaatttagtatagtttttatgagtagaagttcctagaattaccaaatgttggtagggattgaaaaggttacatggtaaagtcttgtttattttgttgtcttaccaaactttgataataccaaactttggtatggttgattttagtaataaattgaataagcccataattccatgcggaattgctattatatactattcttaattgttgctctctactgttaaagaaagttcactgcactagattttaaaacactgttttattggatggaacatttagttaagggtatttgtggagctacaacaatgtaattaattaatttcagtttgttattcacggaagattcatccaactaccataattcgtggaaaaaaaacaaatttcataacataaatgaataaatggtatactacggtaccttttccgtttcgatttaccatatggtattatttacgcgtcttgtttattgtccgattttgttatacacattttgttatgaaccacaccaagacaagtttgtggagtccaagttgtgccttaattagccctcaccaggtctatgaatattacattataatttagacatgtttagattcgtactatttatttgccatatcaaatataaataattatggggagagttatttcgagccatagatttaccattaagctcttatattgttcttttgacacaataagctattatattgtttatacccacacttcatcaatccattggctatcttttttatcgtgggtgcatcaaaatgttttactatagttccctagattttgtggtgtgccaaaccaacatgtataaaaatgtaagaatatacatgaagagcaaccaaatttgaaccaagaacttcacaatccagtactaagatatagccatatactttgacacgaaggtttaaaagtaataagagcgtagccgtcatagcgtatcacataaactaattgaaaatatgtcacattcaaatatttcaaaacatccttttcaatacgaacgatgaaatcaagctttgattactctaaaaaaaccatgtagcttgttagacttcctcacccggacttagtagatagatcgctcataagcctggttggccaaattctttctattgtcatcgtgtatacggaatcgacaaccactcccttagaaaaatcgtccatgagaccaatgacatggtgtcatggaagaaatctgccaaaggaagagcagtaaaacgagcatgttcaggagggcagaattgcaaaactgcctaatcactttcccccatcgccggtcaccgcctctgctttctttttggttcggaacacgtcacgttgacggcgaccgggccagcctaattacccaacccatcgctttcgccccgtagcttccacagatcggccagatgccaaaacccacgcagcatattcccatcgtgcaacgcctgtgcgctcacagccgtcagatcaaagatcggacgggacggggcgctccgtgccgactcggaaaccgcttcacgctctggcctgggccccgcccccgcgttcggaacatgggctgaacgaaatattattctggcccatttgatccccacggctcgcaccatgtgggccgagcccgagattgcagtcaattacggcccacgaagaggcggatgcgagtcgtcttcatctcgtccgacgcttcaacccgcaccgatcctgcgccaccccttcgccggcggcttctc

SEQ ID NO: 76757 - DNA, 6420 bp, Oryza sativa
atgtctggaatcaaagatatattatgttggtttgttctatttatctctaacggtggtttgtgcctacagctaagccatacaagtcacacaaaaggaaacaagaaagtatggcactacatgtacaaaagtcaatgacaagagatacttatttagtaacagagcatcgatacaaaataagagcccacatacaagatgacgccaagggaccacaaatctgctgtgtggttgtaaggttgttccctcacaagttctggagccatgtatagaggtgttcctgggtggaagaagaatgtttagtagaacaggtagccagaaaaaaggaaatcagttcacatgagtatacctgagtcactataatctatgaaaggaccagaaaggggaatgtcaatcaaaagcaggcatcatagcatttaaagtattggtttgttatgaaagaactgtttatgattattgtaaagtaactaccatatctactttcaaaaacaaacctgttggaagacagctatgacatgtattttacagtttatttatccttaatgattattattatttcaatatttgggaaaaacagcatgttaagtttcataccgaattgccagtagctaatatatggatagaggaatggatttacaagactagaaggcatatagtgctaaataaaaactgaaacatgctaaaagacacatacagagaagtaccttccatagaacgtaaaacaacagtactaccatggaaagaagctcaactatcatgcaaagatgaaaaggtaccttttatagaacgtaacacaacagtattagctgacatggcacgagcaaacccaaaatcacagagctgggaattagaaaaaggaaatgcaatttaaaacaaatatatatagtaaataagaataaataaagcaaaacagtacgcagttgtgtcatatactcatatatagtagcgatcaactcccggtgcataaataggactatgaggtaaggattgtggttattgagacaagacttcttttacaaacatgaatagacaattagaaacaactatgagcatcatactgtgaagctagacaaaatcagagaacttaaaaacataggatagtgttgctgcaagatatagaattaggtgcaatgtataacattttcgatgaagcaaatagtctgcagaacagatgatatactaaaaggcattacttttatctaacaaaaagtgtttagctaatagaacaagcagccattggcaacattgatgtggcaaaatatataccttgacaacagatcctttcccaataaggatgttctgaggtttcatatcccgatggataatacgattggagtgcaagtaatgcagtgccttaacctgaaataaggagatttgctgaaatgaagacaaccagagaagtccagtagtgtgtaagaaacaagaaactttttagtgcataccagctgcttagcaattgcttgaacctgttcttctggaaggcacttatcatcctcaagcacctcaaacagctctccctgagacaaccattatatatgaagtttaaccaactaaattccactgcaaaaccaattgttggtgaaaactacactgaaaaatcaacctgtacctgagcaaactctgttaccacacaaaattcctgaggggtttcaaatgaatcgatcatttcgattatattctcatgtttgagtttcctcagaatctaaaaaaatgatggcagcaaacagtaagatggaggaagcgccatatttaagatatgtaaacaaaataatttctactagtttgaagttctagctacatgagaaatgtcttatggcgaactaaatcaaagcaacatttgtgatttccaaggtgctgtatatattaattttgcattgttcagtaaaccatgagaaatgtcctgtggcgaactaaacaaagcaacatctgtgattttcaaggtgctctatgcattaattttgcaatgttcagtaaaccatggggggagctcagccgtatcccacaataaattcatcctcaaaatcaaattccatccccattgccaccttaaaagaatccaaaacaggcatttgaagatttccgcgcagattctagcccccaagggtcaagggttaattcaattagcactaaatatcaaattgcacaaacaaggcatgagacccttgacgtcatgagtcctcagagaagcagcgcatctcccgggagcacttgcaagtagagatgaaattgaaacattttattccctaagcagaatctcaagtagataaattaatagctacgattacctcaatctcctgccttagattatgtatatctttgtcagtcttcccatgcttaaggataaacttcatagctaccgtctgaaacaaatttaaacagaagcaatcaaacttccgagcaaaactagcagaaaaaaaaaagaaaaaagaattaaccattccatttcaccgtacgagcggaatccagagcacgaacctggcgagtgtacttgcgccttcccatgtacaccttcccgaaggagccctccccaacgagcacgatgacatggtaatcttctatccccatcaccacccacccactaggctcacacaaaccctggtagcaatccacaccgcaacgattaatcgcgcgaaaatcaaagcccaaaaatacagtgaaggtgggggaaaaaaatagtcaccggtgatcgactaccgcctccggagcagcagcccgggtgggcggaaccctaccttcccaacgacgagacaatcgaggaggttccagtcgagagggggacctgattcgtgcggtgcgcggcgccgcgcggccgatgggggaagcacggagcggaggcgggggatctcgcgagagcagaagacttgggggcggatctcgtcgggggctcgccggagatcgccggatccggccgccggaggggagggggaagggaggagctcgtggggggataaggctatgggctttctctctctacagggttgtgggtgggatattcccctcaaattctagggtttcaattattttcccgctcgctgcgcgaatttggaactgacgaactaggcgtcgcggatagagaggacaaagctggctaacggcccacttcttattgggcctagtaacggctagtttcagtctcacctgcatatttcacttggaacaaagtcaattaagtaacagaattttttttatttataattttttttattaaaagttttacaaaaataattttccattttgaaaattgacggaagtagtcgcctactgccctctgggaaaaatcgccctcccagagggcggcgaaaatgacgtggcagccggccgttcgctctcgggcgacggccgtcaacgaaatttgcaggcggcccccttgccgccctccgctagggcgattttatactgtgcggggggccgcctgcaaatgggcggcgaggggggcatggaattttgcaggcggcccccttgccgccctgggggagggcgattttataatgtgctctatatttttgtataaatatcaatagttatcaaatctttttatattgaaaactatacaagattaaaatctccaagactggtaaaatacaattttattattttttagggcatatttggattgttaccgtacaaatattttattagtgccaaaatataagcaagttttggcactaccaaatatttggtaaggcaaaattgcatttgatcatatttggtttgctgccaaaatgtaaaattgtagtgaagaatgttctacataatctcaaatctagattacgtattaccaatgaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggtgtgagacgaagaggccccagtaccgaagatcccggctgcaaatcctgctggacaaggaccatcagtttcgtacaagtatttaacagtagtaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacatgcagttaaaacatggtgacatattcgtgcaaaagctgaaacaaaaatgaactaatatgtgggctgaactgtaccgtgcgaaaccggtgctgtaggtcgcactgctccgaagctaggggcgctcgaaggcaaacgaggtcctgcgagaatggaacatcaagttacgacggggtgatgttttcgtagaaaaacagaaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaacgtaccagcgaaggtagtcacggtagttctcctccgtgtgtgggaagagctcgttgatcacctcctctgtagctaacacccagtcgtcaacgtactgctgtacacgtggagcccaaagtgcgactgctagctgtccccgtcgagtcaacctgtgaagagaggtaaattatatggctcgatgaagtaattatcataaaaatttagaaatgaacaattcgaactcacgagtggtcggcagggaggacggtcggctgcacgtttcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagaagacgactgataaacttataacgcagcgaagttgcactaaccccacgtcgacaccagtaagtccctatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcctgtgggtgctagtgaacatcacccacccgaacaaccacaataggtacgcctcaagggagcgtcggaccgagtaatcatcagcgtc

SEQ ID NO: 76758 - DNA, 690 bp, Oryza sativa
attcctgcagcccttagcaatagccatggaaaaaaattgcaaaaaaaaaaaaaaatcggtggccgccgacgccatcaccgccaccggagggaaaagagaggcagcaaagggagccgccgctgccggatccacccgcggtggccgccaccgccgacggatccacccgcggatgaagccgacgccgtcatcgccgtcaatgccgtcgttgagagggcgtcatcaccgtcaaggccaacgaggagagggagagggggagggacggccgtcgctgccgtctccgtcgcaccccgccgtcgctgcgccgtgccggtgagacgggaaggagagcgggagacggagcgcgaacgccaacgccgtcgtcgccgccgttgggagggcgccgtctccgccgcaccctgtcgtcgccgcgccatgccggcgagaagggagggagaagggaagggaagcagcatcggtggtgggagagacggcgccggtggtgggggaggcggccagcttgggggagggggagaagcgggagatggggagagggagcggcaccgccggaggggaggggaggggaagcggcgccggtggggagagagggagggggagaggaggcgttgggcccatggtggtggccggctcagctgggggaagggggagggggagggttaggggcattaatttgaattgatctgagccgtccat
